United States Patent 9,328,346 (POLYCOMB-ASSOCIATED NON-CODING RNAS) - sequence listing, part 3

SEQ ID NO: 191 - RNA, 150886 nt, Mus musculus
caugcgcagcgcggcccaugcaggcuacagcaucagcaucugcaagagcaucagcauccgcacccgaaaccccguucgggcgcgcucccggaggguggggugcaguaccgcgcugcgcguccccgagucucgcgcccgcgccgcgcgugcccgugccgcucgcuccugcgcgcgccuccucagcauccuuaggcccggcagcaacccccgcagucacuggugcggccgcgcccgccacugggagggugcagccacuggaggaggcuccaaguugguggagcggcggggaccccucucugcgggccgcucccggaaaggcggaaagagcagaggacggcgcgccgccguccccgagaccccagccccugaccccugcccgcggccgcagcaugcgcgcccagccggcgugaccggcuccgcccgcagccgccccgcagcccagcccggcucucucgcgggucacucggaccggcgcccgggagcgaugagccaugaagccgcccggcagcaucucccggcggccgacccugacggguugcagccuucccggcgccuccugcggccccggccgcugccccgccggcccggugccggcccgcgcgccgcccugccgccugcuccucguccuucuccugcuaccugcgcucgccaccucaucccggccccgugcccggggggccgcugcgcccagcgguggguauggccggugcccuuugcguugccuuccccgcggggcccuggggaggagagagaagggcacgcaggugcguguaacccggacgaguggguccccagccuggccuucgagcgccucccuguccaccucuccacccuuguccgucccaagcccagguucaugcugguucacuuuuggaaguccguuucuguugcauucacuaaagacccauuccagugacuguggguuccacccagagguauuugguggcuccugaguccuuuagcgcucucuauguaacuuccagugacaggaagaugcagugagcuagcaaguugcuuuuugccuuggggaaccuucauaugaaugcggagggguggggggcaugcaauaauagugacaaaugcuugaucccucaaauuccccaccagguuuagucccuacuguuggaauuaaggugagagaggcauaauuuggggaccagagaaugaaagucuccaagacacucuuugcgcaugaccuuuggcuguguuuucccaaaaugcuugucauaaugagcaaucagaauaauacaauguugagcacacuggugauuggaagucacugaaagcagaaagcuggccuuggcaguaaaaaagaaagaauuuggaaaguugccagcaacuauagcccuuuauggcaaaacaguuuuuuuucucaucucaaaguuagaaagaaauagaaaucauucauauauguauguauauauguguguguguauauacauauauauauacacacacacacauauauauauuucuacauucacacacacauaauacacauaaacacacacacacacacacacacacacacacacacacacaaauauauuugaaaguaucacuuuacauucaguguccaugaauucaggacccaaguuuugucuggaguguucuuggcucucagaugaggugauguuaagauggguacaguugagcugcugcauccucugaggagggaugggacaagggucaggacccuugagcauguuaguugcugacuuuucccuaagcgcauucugcuuucugaccccuuacaguucagauguucggcucuaagaguggauagaaaagauauaccugaguacaggacaugguuguguaaccuauccaggccaaaccacuguuacaguaacuugucuuuuggugucuccacuuucuaacuuuuuagcaauagaaaacuuuguuaauguaauuaauggaaagauguauuuuagaguuuauauauuuacuggauguaucuguguguauuuguguauauuugugcuucccucccccccaacccccccagcuccgcacuggaaugaaacugcagaaaaaacccugggaguccuggcagaugaagacaacacauugcaacaaaauagcagcagcagaaauaccagcuacagcagugcagugcaaaaagaaaucacacugccuucaagacugguguauuacaucaaccaggacucagaaagccccuaucauguucuugacacaaaggccagacaccaacagaaacacaauaagguaggcaggaggcugaauauguccaacuugcugccacaaggaguucucuuuucauuugauuuucugccagaaucugauuucacgaauuuuagcgcagcauuuuauuaaguaagcaauuaauacgaugguagaagagaaacuagagggaauuaacuugggaucgaccgggacaggguuuacuguuugucucuuugacugaaauggaaacugaacauuuucagacguccugugacaaacuggguccccgugucucucagguaccuuggcacuaagcaauagagugaacuuguuugcaguucugacuuguuucugggagcauuuauguaaaggugcaggaagcuaccucccaggagauauaaguccuggcagucuguccacagaaggcaguguggcuguccuuuccccagcagacuuuccaugcagaacuugcacuugaguucacuuuauuucuugaauugggcauggcggggggaagcauuacuaugaugucuugucaggaaacaauucagcauuucaagagacugugaagaacagaaaacaacgacuuauauaagauauagaccaguuuugauugacaucacccuugagggcccucugcauggauggugagcauuggcuuuccuuuuagguuggucgugaaaguggcccggagccugagaaagauacccaaacaaagacgaaaguaucuaaugguccaagaguuuaaagaauccccuguccugggucuuauuguuugauccaaugauauuuuggaucugaagcaagucuacacagugcgguaguggaaacuuugcucugcauugggcacagaaaacaggcuguucuguuugugggcgugauuucacggcacaugucugacuuuaugauaauaaggucacacauugccuucugaacugucccuguuuagccggcacgagcaggagcugguuaaacguguagaacuuaggcagugcguccgugguuugcaucagcaugugauugguaggacugccaugccucuccccauuuauggggagacagggauaaaaggccuuugugggacucuucuuacgguuuaaagcagcuauuagguuugagcaguuaauugcuacuauuuuuaaaacaagugaagucccugagaaaaaguguccuuuauacugaauaacuuuguuaaccugguuagccaccuuugugugauuuugaaggggguguugcccaccauggcugagacugugagcuucuccccuagcaggccuuucgcuuagaagguuucuguaacuuaguggaguaacuaauacuucaugucuuaaggauagaaggaauagauguugucuuuaggaagagaugcccaaggcccccuugauaacaugcagugaggaccagcuagcuucccuuauaagugaucccuaugcuaagucggggauagauugcauuacuuguuuauaguucuuaaacucuagggccuuuguacaggguacuggaggaagcccauagcuaccucaaagccugcuuuaaagaaggucuaaagccuccacagcugagaucugaaagagauuucagugaaacuucuuuuuaacgugggcguuggauguuaugacuaauguugguccuauggucuagccuuagauggcugcuuuguuuaugggugccauuuacugcauaugucugacuuuaugauaaucaggucuguugaccuuucaccugucacuuauguagaugaauggguuucuccuguggaguacuggcuugcuguuggacugacugaauuucuugacucuccucacccugguagccugacuucuuuucuacuuuugaaaagaacguuuagacagacaugauauuugacagucuuuuucuuuucuuauuaacuuaauucgauaaacaucuguuuauuucucauaugcaaagcuguaugguaaagguucacagauaagagaugaugggguucucaagggugaaaaagccacauuuauucuccaggagacaccgagaugacauaagcaagauucugaggccuggguuagauuuauaguacaaaucugauuugguugcacccugacuuuuccuuuugugaucucugaguuccuuuucccccuaggucuuuaagcuucuguggacuggucaguaggacguguuucguguuuuccacuggaucuuaggaugacuugcugaauagcagacacacuugccagcucagcugcuuucuaaaagucacaacgagaaaguacagaauuccccucauccuugcuucuaaaaaaaaagaacuugauuuuaauauccauguacuugggaccuguccuugcucgggcucugcugcaggcaagcacauuuuaaugaaugccuuagaaaugcugaaucacugugguucucccauggaucccugugauugggugcagauuuggacugggacauuuccaaaucuagguugcaaggccacgcuccacauuuaugucugaagaaguuuuguaaucuuguguguggauggguccuucauacuuaacagccacgaaaguugaaaugcuuauuaacucuuucauaaagggauagucugaaagcuggaugugugguggaccuguguauaugguauuggcucugaaagcuuuagcauuucuaugucaaagaaugcuuaggaauuuugcagguuaguuuuuguuuguuuguuuguuuuuuccuuuuugaucugucguuuugacacgcaaacuaggagcauuugggcagaggaaaucucaguugagaaaaugcccuaaucagauggccugcaagcaaaucuuggggacacucuuuugauuaacaauugaugugggaggucccccuuccucaggucagugauccccugggcugaugguccuggaguauaugagaaagcaagcagagcaaaccauggaacaagagucagugaguagcacuucuccguggucucuaccucaguuccugucucuacuucaguuccugccuugaaccccuacucugacuucuuucagugauaggucaugaccuggcaugugugagccaaagcaucccuucauucuccauguugcuuuggucaugguguuuuaucacagcaauugaaagugaaugagaacgggaaucauuucaaugucugcauagagugauguugaagaaauaguuaaagcccacauggcuccauuuuugagagaagggaacaauuauaacuguaccuggauaugaggcauaaaaccaagccagucugagagugggcaggggaugaauagauaccuuagguuuucuuucuacuuuucguacuucuccaaauuaagauuuuuuugauaggcaaucuuaucugaucguuuauuauagcaaucuccuuacuaccuaagaugucaguuuaguauuacauagcaguaguaucagggcaugguaaugaagaauuuuaauuuuguggguacuggaaaauauauauuugguaucaucccauuuucugucacacagacucuugaaaucaucagagugaugagagacugcucuuucaugggguaaugugacaaugccuggugacuggggccuucuaagauguuuuuuaugaugggagucuagucacuagaaagaugaaggugugauugaaggguugggacuuucauccucagccaucuggaaaggaccuuaagauauaguugaucaucaaugucuaggggcgugaucaaccacacuuauaaaaugaagguucuccaaagcuucugacccaaagggaccagauucuggguguggcaccugcggaggcccagagcucauaccuuucuuucauaucuugccuuguguauuucuuccaccuggcuguuuaaccugucacuuuuauaaugucuuuuuuggcaacuaguaaauguuuucccugaauucagugagcuucucuuagcaagucagucaacucugagggaguguugagaggccugauuuauagccugcucgcucagguccuagcuuggagcuugugauuggcaucugaagucuugugggagucaaccuccaaccugugagaucuaacacuaucuucauucagauggauagugucugaacaaaacugaauuagaggaccuggcuuguucauugcggagaauccucagauugcuuggcgugugggaaagaagaccggggcaacucaugccaacaguguuguguugaguguugagugagaaugaggauggaagaagagcuuugcauuuuccuaugccugcuuguuaucaagacuugccagucuuuaugagucuaugcgacguuauaugauuauuacacauaacaauauaucaucaauacaguauacaaaucuaacggacaguaaacaugaacagcaggagaaacugacucauucauucuucauucauucacuccccuuuaagaugaugcugggaagucuuuuccugagaauguugaucaaaauuuacuugucuuuuauguggucucucgucugauagggagggagugggagagggacacgaggcauaguuuagggucggggagggugacccacauaucauuggagucaccuaaacaaauuaccucuugucacaacugacuuuuagguaaacaggcuacucccuacuccccacaauuccagguuaaagagagaaacgggggaguuuaguaaagucaguucccuuuuuauuuugguguugggaguugaauccagacacucgugugugcugaacauaugucuaccacagagggucaugucagcuguaagcgaauuuggacuguagugauuaugcauuugaguuuacuucagggcaaggcuggucccacaguucuugauuuucuagaagccagaagcuccguuuuccuuaguaugggacaacagaaagagcaguaaggcauaaggaagucccaaggaguucuccugcaagauguucuuauauaguuuuagaaguacggaguauauguuuuuaugauccuuauuuauuaaaaggaaguuucacuauugugggacauggaacacccauauauaagaaaauauauagagaaagaauugagugauugccguacaucuccuguuauaaucacacugaaauuaaaaacaaauagccuacagauucuucuagauuuuuuuuuuguacuugacuagaucaucaggagugguaauuguagucuugaguuuugccauugugggagucgcuaaaccuaugcuuauacuauuuaaacuugcaaaaacaccucuauaguggccccccugcuucauuugcaaauuuucuuuuaggcauuucagucuugugaguaaggagaaggacgcagacagugcauuagguaugugagagaccggaaaugggaguguggcuaguaagaacaaaagcccuucacaauuccuuagaaaucuagugaccaagguuuauuuuacaugcagcaguugagauuuaucauuggugucuucaaacaggacuaauagcuagagagcugcagacagagccaggguuugaauccaccucuuuccugggcagagcucuugguggacagagauagugagugucagaagugagaggcuguauagacaggagagacagaugcagggguuugauuuauuccaugucauggggugagucauaggagggggcucaggaaaugagcaugguguccaacaccaauccuguggcucacagagcgcuuaccuuccaaaggggguggggggaggggcacagacaagccuacuaacaacaccagccuguuaauuagaaguguugacaagugcuuggagaagauaaaauaacagaacaugggagagaauggugguuuccuuugaagggcagagugggccuagaugcugggugugacagguccaccgaguguuaagaagaagcuccuauguagaggagguggguguaugcuuuagauaagaauaggagaaaaaggcuggagaaagacagcagcgcuuagucuccacucucuccugguggagagucaggaucgcgcuguggagugucugugccauuacuagcuguuggaacagaagaugguagacaggcagaggagagagcaaccuuugcucaaggaaagcagagggaagaaagaacugggcugcuccccaauccuaauuuccuuagacuguacuuugaaccuguucuacacaauuuuguguuggaaaugcuauuucaaacucauaugguagcgguauguggugguaaaguccuugggaagucuguaggauuguaggaugucaugaugggaggaaccccacgacggcaucaguagcuuuauaugaagagcaagaaagacucuggcuagaacauuugguuugccaugggaugcucucagccuggucaugcugcaucaagagggucuucuguauacacuagugccaugauugggggguuuugcagccuccagaaucaugagcuaaaugcaccuguguuuuuuguaagucaucuagucugcaguauucaguuacaguaauagacaacggauggaaagucuccugccucaguucaacccuucuuuauuucuuuuucuuucuuggugucuuuggguguuuagcuuuggauccuugucuuugauuuuuuuuuucuucuaucaagucuagaucaguuuuuuaaaaaaaucaauuugaguagcucacagcugagccuugcuuccugcucagggccugccuuauucuugccaacugucuaacugcuggcauccucucuucuugggguuaguagcccacugccccuuucuucugacagucagaaaauaagccaggacccuuugucugguggcauuggccagguuuagugacuuuagccauugcacgauaguuguauuucaaggagagagcuguccucacggucccuauuuuucucacugggacugcugccucucagcauggaagagugaacuugggaagucaucuuugacucuucuuuccuucauuuccugccuauaaauagucacuuaccaagucuugaugcugcuccccgaauccacccccuccucaccacauugugcucuugucaccacuucuugucucguucucugucaauccaucagucccaccucugacagauuaaucuuacuggaacacuuauuucaucacgcgacucgauuucuccacaugcagcaagcagaacuucagcuagguaaguuuuccucaggcagagcacaggugauacaccucugcuucccuccuaccccacagagccaccguggucuuucucauucagcauucuucugugucuguuuguccaagugucaguccaugugugggggaagucugugggcaugauuucauccauagcuguccagacuaugaggcuacuuccagaaaaccuuugugcuccauggaaagaaacgaauccaucacuaauguguccugaggcuuugagguccaaauuccauuaaauuccuacuuagcucagagguucuugucauauccauuuuuaaggccugaauaacuaguuguuccuaagguuugaguuuucagaauaaguuguuuuucuuucaagaaagcgcauaaagcacaaagcacacaaucauaagguuuuauucacccaaaguauucaguucucaaugaaugaagguacccuuuaggaacuuuagcacaauuuagugaacucucagucaaagucuggguuuuguaguguuccuggggagucuuugugcuuagaauuuauguauauuuaguacaacuuuaauugagguuaaugcuagaaauucuauuauaaaagggaucuaguuauuauguuuuauuugaaauaaugaccugagaaacaacccugcucacucaugucagggcagguagaagucucuggaaaccccuccagugcagcuucgaguuaauuuaguuucucaaauuuuuguugacaucuucuucggcuagagagcgggcagaagcacauuuccucccuuggaaauuuccuccauuuggaauuuuucuaugauguggugcacuuauuuguuaacggguucaacuuaaacaguaaauguuuuccaaggguuugaaaugagaaggaugggacuucaagcagaucccucuacaugacagacacugauggcagagccguuaagcccaaguaggcugcuguggagaaguauggacaggccaagggcuauauauugcucuugggcuuaaaucuuuagugacacagaggagggguucaccucuuaacuccauggcaguaucccggcaagggacugucuggucaagguugauaguggcgaucgggagaucacaugauccuggacuuccuuuguccaggaucaugugauccuggugggauuaaagguacauuuagaaguagucugaccuaagcaugggcagaagcugaucacaaaaaacaaacaaauaaaccaacaacucacaaaacaaaacaaagcaaagcaaagcaacgacagcaacaaaaacaaccugaaacaagauaaaagcaaaccaaacccguccaggagugcuggaaguguagggcagcuauagagggcuugccuaguauuugcaaggcuuugagucugaucucuuacaucccuagagaggaacacuagagagacgaauaaacaaggaacaagagaggcacuggcuugauucuuuugagugucuccugaguuccaggaucucccuggagcuugcuuuccuucaguauggacauguaaaaacucccguggcaaguugcagucuggcucacuuaauuggguguuuugugcugucuugugucacaggccugccaguacauaugaaggcagccccauagaugggcuccaccaacgcuauaaauccagccaugcguagacaagucuuucucucaugugucuccgagcucuuuacuucuucagugaaguagaacacauuaaaugaacuugcagcucaacucuccaaagcuuugcggcagcgaacacaaucuguagcuuuucuacugaacuucauuguuuuauggaggcacugcccuaccucucacccacaguccucagagcaaaacgacugauaugacuaucacuuccauguucuagauguggagccuucaucuccagauuuccaguuuccuguaauacacuuccgugagcggggcauagagagcuuggcaugcccuugaaaucaaaauauuuuuaaaaguauuuauuuaaaaauuguucucaaaauacauauuuuuaaauuugugugugugugugugugugugagugccgugcucacagacaccaaaagagggauuccuauccccuagaacuggaguuaggaacugagcuaccugacaguggcaguguuacugaacucagaaagagcaguucgugcuugcucuggaccacugagccuucucuguagcucagacacuugucuucuucuugaucaaaaguccugugagcuaaugacaccugagccaugucccuuccuacugccuucagcauuucccugcauugaguagcuuuguuggucuuuaucucucuucccccucccagcuuccucucccucucccuuuccucccucuccucucccccuccgucccucccuuccuuucuuuuuuuuuuuuauuuuuucuuuuuucuucuucuuuuuuuuuuuuuuuuugaguuuuuucgagacaggguuucucuguguagcucuggcugaacucacuuuguagaccaggcuggccucaaacucagaaaucugccugccucugccucccgagugcugggauuaaaggcgugcgccaucacgcccagcuccuuccuuucuuucuucuuuuccuuuucuuuucuuucuuuaauuuauuuauuuauuuauuuaaaauuugugagacaaguuuaaacuaugaaacucaggcuagcuuugaacucacaauauagcccaagcuagccucaaacuuaaaauccugcugccucaggcacccaaauucugggauugcaggugugucucacuaugccugacaucuucccuuauuugccuuuaaucuuauuuuuuuuuucuaucagauuuuccuuccuuauggagagaggggggcugguagaguuguguuugguguuuccaauguauaugucagacauuugacucauuuuaggaauaacuucuuuucuuggaaaaguauucuuguauacuuuguaggagcuuagagcuuaaagaggugggcgucugaagcaagcugauuuaacaagaguugguaaagccaccuuuuuuuuuuuuuuuuuuuaguagcuaagggaaaaaaauagacagaacucccaauuuagugcauuugucagcgcauggaauguagcauagccagggacucaaaaccaagaugauauuucaacucaaagcaaggaaauggacauuuaaugacccgguauaucuguuuauuuguggaacauaugugauucuaaaaauuuggccauuauggugguuugaauaugaaaugccccccacaggcuaguggguuaauggcuuaguccccagcugauguuacuauuuuaggaugauggacacauuaggaggcggggccuggcugggggaaguagaucuuccgggcugucuuucacccugcuguuuccuggccuccaugaauugagcaguguuugccacaugggcccugcugagcggcugacucugggcauaaaccucagagagcaagagcuaaagggcccuucucgccuuaggucacauucuuguguguuuggcagagcccugugacgaaggcugcuuagaauauuagaaaaugucugcuccugcuccccuuguugcuucugagugcugaguggcugagugauuucagcgucuucuugguuugaguucuagccaugucagauugaagaaggcuaaaggcuugagccagguuuggggcacagacuuaacgucaggucucuggaagcugguggugggguccugaggagugaguaugggauggugugcuugaggccugaugaauuaauuaucuguggcccuggcugagcuucgcugacagcuagagaugauuucccuaaaucuuuguugauaaccaggacauuuggaaaguaggcguuuuagugaguuguaaggcgaaccuuuucuuucuuucuggcagugugggacugaaacccaaggucucugugugucaggccagugugcaugcuaccgagcuauguccucagccccaggcugcaccuuuccccucccccucaagggcauugguaaagcccccauacuugugcucugaauaacacagaucuuaagaucgguuucccaagagcugucccaguuagcaaacucuuucccuuuucuucccucccaccaagucucccaaugaggccaaacccaagaauaacaucgauuugccauugaaaggcuuggauaugaaauagagaaaggaugagacuguggcagauagaaugucucuacaucuuccaacuagaaagaacccaacaggacaagaguaucagauccacaguaugcuuucauuuucacaugggauccaauugaacaggccuuggccagcauguagaaucugugugcagguuugccagaagagcuggcacccugguucucccucugcuuauaaaugauggcuuuguggugaguucucacuaauuacuuugcuaauugcuguaggcuguccugugugacacaguggccuuucaucucugaagaauguccauacaacaguuagucgcauucaucucuguugggcugugugacugcccgucgcuuguccccuucagaacuagugggacauucaaaugaugccauuguauugguuuuuguuuccuaauugugaguaaaauuguuuucagaaaugguuaaucauuauuccuuucccuuauaauuaaucuaguauauauuguguucacuuuauuuauucuuauauuucagugguguucauccuuucaagaccuacugaggcauuuaauacuguugcucaaguaguauauucacaaaguauccuguuccuucucacauucucuucauaauuaccucuaaaucugucuucuauuuuagaaaauaauuucuuuaugcauaacuaaagucuaaaaaaaucugccuaccagaaauguuaaguuugucuuuccauuuaaguuuuccaaaguuugcggauuccucugggauauuucuacaccuuaauauguuagcuguuuccgagcuaaccugacucacugcuguguagugucugggagucuuggacuuuuccuagaaggcuauucucaccauaguuuugaaggcuguuaugcuucuguuucuguucugacguaugauagacaacccaggcuuucccuguucaaaauggagcuuuuaauccuaacaucgccuaucccagccuccucccacguuccucccauguggguagugggaacaucaucuuccagauagcugcucaggcuacgagccuucucccacucuuucuccuacagcaucacuaaggcaucaagucucauugcccauucggaagcugaucauuuuucucugcugcugcccacugguuuagugcaccaucaccucucccuuacacugucccauccgcugcuuugcuguucuuguccccuucucuccucccuugucaugucugcaugcaucaggcaaaaugauccugcuaaauuccuauuuggauuauucaacugaaaaaacaaaacaaaacaaaacaaaacaaaccuccgagaagagccucucaccuccucagagugaguuccacccuucuaagcgcagugcuguggucaccgaggaaacuuacgcuguuacuacugcagcuggguacauauaagugcuucgcaucuuugaacauauaacuuagagcaaugaauacgguuuaaauaccaguucuacaagugauuugaacuauaguaaaguauaccuuauagauuucauuuucucacagaaauuaauucaacauaguuuaauucuguuuaaauuuaaaaaaaauaaaauucauacuaaaauaguuagcuuauguacuuugauuaauucacuuuuuaauaaaaaguuuuuauuuuccuagcuuaaaguccuagaccaugcaguuaaagugaguuguuuuuuuuuuuuuuuuaaacuguuagcaauagaagacaaacacaucaucucaguacauucgcuaacauugucacacauuaaagggcaugggucucuauucagaaaugcacgggugggucagagacuuguccagacuauuuucuuaccacaggaaaaguugaugcuucugcagccaaaggaggggcuguucuguggugcaaugaagauuuuuaguuucauagaaagggacacuuucuucuugguaucuagggcccaaaaugggaaacucuguagugaggauaggaguuuucacaggauuuuuuuggguagggcucuuauggaaauagcuauuaugcaaccuuuggguuucaugggcagagaggacaagucacuguauaauuguuuuauagugaaggcccuguguuacauucucaccaguacuguauauccuugcuaauacuuucuaucuucagcauuuuaauauggaugauccucagaggugucaaguaauaguccucauggcuucguuuuuauugccucaguguugcuaagguugaauccuuuuugauacucucauugaugacaaagguauuuucucuggagaaguugccuauucaaucuuuccccauuucuguuuguuuucugugguugagcuguuagagauucuucacacauucugaguauaacucuccagucucuugauuugcaauguuuuuucacauucuauguggacucuuucauucuguugguauuccuguccccucucauuggggaaugggcucuacggcauaauagacaaggauucuaccaucucccuuucuccuuuuuauuucgggacaagaugggaaguugcccaguucaccuugaacucacucuguugcccagguuggccucaaauuggucaccucccuuccuuagccucuugcucauagcuaggauuaugggccuguacuaccaggcugacagugauguuuaauguacgaaaguuuguuuaucauuucuuugaugucucauuuaguuuuucuuuugaugcccaugcuuuuagugucauauucacgaagucaucaccaaguccuguguuacaaggcuuucuuuucuccucuugucuuuuuuccugcucccauguuuucuucuggaaguuuugucauuuagggcuuagauguaguguauagauccucuguggacauugauugaacuuuucugggucaugcaaggucagguuccaauucucucccucucccucucccccucccccucccccucccccuccccccucccccucuucuucucccucccccuccccucucccucuccuucucccuccccucccccucccucucccucucccucucccucuuccucucccucccucucucccucccucccucccuuccuucuuucguguggauauccaguuccccaguaccauguauugaaaagaccaucuuuucucuuugaaacugccuugguauccuugcugaagaucaucugccucuauuugcacgaggcuuuauaaccuacucuguuggucuuccugcuuucuucugugccagaaccaugcuuugaucaucacaccuuugucaguaggugucagaugaacucaagggccucacacaugauaagcacaagcucuaucauuaagcuauaccugcagcuucuguucuuuuacaagauagguuugguuguuugggguucuuugagauuccaucauaaacuuuaggauggauuuuucuauuucuggucuuggaucacucuauugauugcuuagaguagcauugcaguuuuuuuuuuuucuguugaguuuuuaaauccaugaacucugauggauauccauauauuuguggcuuuagacuucuuuuuaucuaguuuuguaguuuuaaagauaaaucuuuugcaucuuuaauaacuuuauuccucauuauuuuauagugaaugggauuguuugguuaauuuaauuuccagauuguuuauugcuaauauguggaaaucagacauuauuuuguggcagugagcuacacacucagcccuucacauugaauccugagugugauguuguacucugcgaauuuucugaauucauuuacuauucuuagauuucuuuuuuguagaccauaggauuuucuguauaugaguucauaucauguauggaaagaugauuuucaugucugccuuuggguaccuucauuucuuuuuucaugcuuaguaacuuuggcugggacuuccauuacaauguugaauagaaguggcauaaaucgacaccuucaauuucuuucugaauuuagucuuuacuauucagugucauguuaguuaugaguuuuaauauagggccuuuguuauuucaauaauaauacuaauaaaagagaauuugucauaauuuuguauguuuuguuuuacaaguuucuuuuaaaagaauuucagauuauggggagaaugacugauucguagguugccaauuuuggauaaguugucuggauuuaaauuuugucauuuuaaucccaagaggguugaguuagauuuuggaauccuuuaguaauuuuagauaaaccuuggaaguugcugaaaagauguguggaauuuagugacuugaauuguuauggcauuucauuuugacaugggagaguucauucaauacaacacucccagcuaaaguuuuguggaacauccuccaaaaagggcuaugugcuguaaaguuaagggucaguccuuauuuccaggguuggcucuaguuguggaguagcugccgccugaaacugggguguuagacaaagaauaggagucacagauuauggguguuuaucugaggaugggacaaggcagagugggaaaaaggcucauugcagccaagugucugcugagcaagcuuggggacuugaguucggaucuacagucacccacauagaaaagcugguuaugguggcucaugucagggacacagagauggguagaucccaagugcccauuggccagucagccuuggcgaaccaggagcugcagguucugugagacagcuuguuucaaaacauuggguggagaacaucgaggaagguaguccaugccuuugaccucugcauauauccacaacguaagugcaccuaugcauguacccgcaccaacucguagggccgaggaggggaaggagaguagcuggcuucaggaaugagugggguaaagugauucaaagaggaaagaguguuugaaaaauaaagcagaggagagccuauggagugguuuucaauagaaacacugcuagcuggauugugcugcaccccugacuuauugugaaguccauagcaaggcauuucugugucuugguuucuggugauagaauuccaaagagugauguugggacuuuaggacaaaggagcauucuaauaggugaaaaccuaacaacagauguauacgaggaugcacauucccgugugugaaguuggcauaaauaugucaugcaaaauucaugguuacuuuuacguguuucccaacauggucuaagaauucagaguucauaguggcacgaaaugaacagcaagucucuuuccuagugcucuucaaaggcuggugaauuucuguuuuuaguucuuauaacauuuaauaauuuaucucugaccuauuuuuagauacccaucagccuaagauauuaucuuuucuccgccucaaggaaaggugaaaguguuucacuagugugugcuucuuucuuccccaacucuugacucucaguucugacaugcuuucuuuccuaauuuuugugauuuuagcaagcauuauacaccuaaaaugaucuugaagggauuuaguuucagaauuaugugucaaguugcagucuuuggccucuggagagagagagagagaugaacuuggagacccagggagagcagcuggaacaaauuaucccucuaugaaggguugccaggaguguaagcucauugugcagggccuuggaagguugauagugaaggacagagagacauuuuguggaggaaaaguguuucauauuuccugcuguguucuuugcucaagguaagaaagagccagaggacaaaggucuuguuaggguuucuuucucauuacguuaggaacauauuaaaguguuuuaaaagggaaagaaguugguucauauuuuaaaaaggucaucuggcaguccuauucaggauggacagcuauagggcaagaguggauguaaggagacaauuuggugcuugcucacagcuguacaggaccaagucugacagauaaauccauagauacauuuagagaaggggcacccagcuuccuggugauugggcuggaacaggagaggagcuuugguagaagaguccucuccgcaucucuaccucuagaaucugggacuauggcaccuugcaugacaaaggagauagguauaauuaaacagaugguuucgaaguggacuggaaugcauauggaucaucuggguggccucaugagagcacugaggcccauauggggcagacggauagacgaggaugugacuguggaugcagauacuugcuuggaggcacccuugagcccauggguguggugguugcugggauuccagaauccaagaaaauagauucuuccugugucucuaccgaaggaaccguggucacggacaccuucucgcuagucuggagacuuugauuuggacuuucgauguccagaaauguuagauaacaauuuauguuauuuguagcuuaaauuuuuauagacauucaauagagcaggcauaagaaacuaaccuagaagucuggaaaugccuggugggcuuuuccccuaggaaaucugugaaggaaguucagaaccaagaggagaggguacaucccccccucccccaccagugcuccagagggugacuggucaucuuugugacugacuuagcuguggugucagugacaggucugaguggaauagaaaugugggggccaucaucaaacaaaugacauuuagugaccggggcguuucacccaccgcgaggauauugccucaguuguggaaagacagcuuaguaaccuccgaacgcaggcuccauuaugacuccauucgcucucauuccuagcuguuuaaauuacaguuguuuucuuuugagucaccaaaugacauuucaaaagauaauaagaagcugucacuucgggaggaaagaaaguaauuuuaagcauccuuuaaaaaagauugaaauuuuggacugugcacauaguugcauuauugcuuucuuuauuauuuuuugaaggaugugugugagcucguuugacagauuuaaaccuguacuuuaauuuagaggaaucucuauggguauaaaaauuuuaaaauccugcuucucagguggcuuccucuaccuguggaaagagccuuaaacauugucuuuuuguuuugcagucacuuccuguuuuauuuggaauuuauuuguugaugguugcaaacagauuuugaagauaagguuaaaggaaucuguguaaaggugguguaucuagaagaaucuaaauucacauagcuccugcauauaugaaguagggguuguuaacuaaggguaguuugggcauauagaccguuuggcaacgccaagaggugcuuuuuaguugucccacgcugaagaucagaugcuggucucuuguggguggaggcuggguuuguagauacccacccuauuccccaccaaagagacuuuuagcucaaggugucaggagguuggcgaugagaagccuggccagaguccuguaaaccuauaagcuaggaaauagggaacugucaaugaaacauagacacaugaguaccagaacuucccuauagaaucuguacauuuuggacuuuguagggaacugacuaauuuaguguuuauuuaaaaagaagggagaaagaauaugcuguaaaaucuucauuuaaaugguguuuuccuuuuguguguguguaagaaaaaaguauuacauuuauuauaagccuacuuuuagaaaaccucuaaguaguuuuuuucuuuucuuuuuuuuuugcuauuuaucaaauauugauagcauugugcccucugcaaucauuacuaacugaauaucaccccaaguaguuauuugcuuaucucagguaauaaaaaccacuugaaauaacuagaauuaaaaauaauaaaaaauugaaaaauuaccuaauuuuccccuuauuuguuggcauuauuaacuaucuugaaucauugugguuuaaaaagaaauguucacacaaaauccccuugcuuucaucugcagucuuaaguaccagcccugggaauggaugcaggaagaagagcuuuguauaguggaggcuuuuuugcuccuagauuucucaauacaaacuuugugucauuagugccagugagcuagugcauacaugcacaugcgcgcgcgcaugcgcgcgcaagagagagagagagagacagagagagagacagagacagagagagacagacaaagacagacagagagauacagagaggagucgggugggagaaagacagacacauagacaaguagagaucagagaucagaggacaguuuuuggccgucuccuuccacuguggauuaggagguugaacucaggcuuucccacugagaaaucucaacagccccuaaaauacaaaccuuggugacuaaacuaaauuaguaaaagaccuuuagaaaaugacauuauuuaguagaauguaaacucuaucuuaauuucuccagccuaaguacaggucuuugagguagaagcuauagauggugaaacaaaauccauugaggaugacuuucaaaauuccacaagucugugacaaugcacgucagacuguaaggaacaaauuugaaauauugagaguaaugauagcauaaguucuaaaauaugaagacguacuuucaaaaaugcaaagguaaacauuuuaugauuccuucagaauacggaacagccacgaacauuggccuguggucugucacagggcugagccuaggagcaugcuuuggaauugaggauuuccuuuuagugggagcagauuucacggucuauaccagcucuugggcuacaagauggcacuucacuaguaugcuugaaaauguugauuuuuaagccccugaguagaguugcuuucuguugguuuuuauagguuaccccuccccccauucaccuuaguuuuugacuuaacuccuaguucugucacagaguauauuuucugcugaauugauuucuuuccucagaucuuaaaaaaaauuacuuauuuuuauuuuauguguuugaguguuuugccugcauguaugccaucugaacagcacgugcauaccugaugcccccagaguucaguggaugcccuggaucuggagcucuagauggcuaugagcuguccuaaggaugcuggaauccugaguccucugcaagagcauggagcguucuuaauuccugccauagcugcagccacacccaagugauuuuucauaauacauuuuuugagaauauaagauaaugacuucauuugcuccuuccugucuucucaccaaccucuccugugugucuaccccaccuugcucucuuucaaauccugggccuuuuuaucuuuaauuauugguaugucugugugucuguauuucuaaauaucuaaguauauccugcuuaguccauauaaugagacuugaauguauccauuuuuagggcugagcauuuggaauuuaauaaccgauuaguguacuccucaucuccccccuccccccacaaguccuuuuuauugggaccuguuuuguaucucugagguucauugagguguuccuuaauuccuaugcuggaucauugacuuauuuguucuuuacuucuuaguuuucuuaguuccuuaguaaacauucacuaaaggcuuuccuuuucuuaacagcaaggcagggggccuuguuuccaguuguccucucugcuucuccucucgaaccuaauacacauaacagaugugcaauggauggcgagguccugaguucccaucuucuucccuaacucaaggcguuuccugcucccuuugauuccucaggacaagugcuguguggcucucaguguccuuugugucacucauaacucauaucaauccugugagcagcguccguugacggcuaccagaacccgaugacuucugaucagcuccacugcccacccagguccaacccacugacacuccuaccuggauuauugccacaaccucccuuuggauccuuugcuuccuuuuuugucaccugacuucuugaguccauuguuaacaccauacccuugagugaauuguuaaaacggaaggcccgaccuugugacuuuauuucauucaaagcacaagggaauaaucucgccuugugugugggcuccuacacaccugacccucauuacuucccaucuucacugcuucagcuguuccccuucaucccuuccacuggaauugggcuuucugcucuuccuugacauaugcaacauuucuguguuagggcuuccacggguagcugcugcuucugccuggaauucucaauugcuagguaugugcauaagucaaaacuuuaaauaagacacucuugagccucuuugacaagaaacaggcccuggggugauuugaggaguguagugacgacaccuguagcuuugucaaauggggaaauccaucuuuggcaggucuaguuugaaaguuacucuugccauccaaaggggcagaaagaaacacauugguaauuguagacaaggccagagugcagagcaaagaacagaagcagcuauugccagacccggcaaguccagagagcuucauaaucuaggagaguuccuguagagaaaaagagcagcuguaccccaguguuaggcagcuugugacaugaaucuuguccagacaucuuagguaaauaguuucacaguucagaugaacuuggagcagucucuuaggcaaagcuugggaaauacaugcaaauagaaacaugaaguguguggaaaucugguaagagucacugggaggaaugguagagucacaagcaagggucucuagaaaaagugucuucuccaacuugcuggguagaugcauuugcuuagugcccucuuagcuacuugucuuucguguuuucuccaugagggagaacuagaaaugaauauuugguccacacucuaucaucuaugguuggccagauguaauagugcucaggugaagugugcaauuacugaacccugauucucauuuugcaucucagacuaauucuuaacuaauccucaugugaccaccgugaguuaaggagccuucugucccggagagauggugaaguugaaaggagcuuacugagucauagucaccacuucaaggaguggagcagcaggcugggucguuauggggugcugucuccagcaggcuaguuuucaggauagcacucccguuacauacaagucacagacaauaaguaugaagcacaauuuauuuuauuuucaaagcuuauaucuuguucucccuacucccuuugcucuucauuucacuccuccuuuuccuuccucuccucuuccuucucucccuccaucuucuccuucaggggcuggguauugaaccuaggacuucaugcauucacaaaaaaugcucugccacuaaacaauaccuccagagucucuccucuuuuucuuccauugaaauuauuuaguggguauuuagaauucuggcuaaagagacagacaguauucuuacuuuaggacaaaagaguuggagcgagaggcccuauuuggaguuguaccauuaugugauuuaggaacuuaugaggagaaggaagaaggugggucauaccgcagcuacuagauuaaugcaucaaauuaaauguuaccauucaggaaggcagcagaaagaaaccgcuuccauggcaacuguugacauaguuggauucuuacucgucuuucacauacuacaggaaagccuaagaauacagcuguggugccacuggugaugcuguacucaacucggaauaaaaucacucuggaggcuugcgagcuugucuguuuuguuggcacuguaaguugaauacacagaagagaguaauuaccaaagguuagagugcugaagagauuuaauauucauguccaaagagucugccacugauguauucacagagcccuaaagggcugccgaauguccuaaaggaguaauuuuuucauggucccucuucccucauaguauuacauguaccuccccaucuuugacuccucucuagagauugcaaagaaaguuucagcgcucauggaucauggcgcuuguuuauuggaauguuuguuuggauuauuuuuuaauugcuucuuuuugucuuuuguucuccuguuuucuguaucagccuuggggucucuuuauagaugguugauuuggaaaggagugcuugcagaagauuggccaaaaguuucauggaucuauaaggccaugccucccuuucucugugucaucacaucaguaauugaauacuggccacguuucuuucagacuccguuucuuggugagguuggcauagagaccaaagucaagcagugaccugcuucuuuuacugggagaugcugaucuguggccugugaccggagugugcuuggccgauguauuggucucguuucuguaaaacaaaaggaggcaaaaaggacauggcuucagcuuccuaguuucugcuaaagauagauugcuuaucaaaauacauuagcauuuuuggguuuauauacauuuaucacaucuauugaugucaugaaauacuuuuugauacauugucaauuuugauucucaccacaaucuaaauugcauuuuaauaucccaguauacccuguguuuugcuuuaaaagcauguuuuugaugcaucuguucguuagcaagcauuagaaacacuugauaauuucauccuauuaaaugcuggagcgauguuaguucuauuugcugagacuccucgauaagcuauugucacuuauuucugcauccagaacuaucccucuuuaaauucuaauaugcuuguccacacuccacaucugaugauuaaucuugcuuauauuuccccuugaugacagauaauuuuuuguuauuauuuaauugguacauuauauuuuguacgcaguuguuuuucauuucaugucccagauggucaucuucuuaaaugugaaucuuaauuuuucuauaaccuuacauuuucugcaguagcucauccaugguagauugccucuuccaacuuguuaaugggcuaccucauaauacugugcauuagaacacaauagaagagcacgugaugauauucucuuccacggacucccuauuuaaguguaccuuggcaggaauuguucagcaaauuaccuuaauuugcaaaacugccuucgugauccguuugcagcuguuucucuucucaggaaaaugauucauauuguuucaaagacacagcacuugaacaaggucaaagcauaaucuguaaugguagugaguaauaaaaauauaacauuuucaaauuuugccaaauauaaaggcacauuggaauuugcuagaagguaaccagauacagugggagggaauuuugagguagcuggcauuuuacccuuucuaaaauauuaauauagucuuuuuuucccccucuccuuucucagucuauguuacucuuuuuuuaaauuauuaagccuuuuucuaugugaccaagcuuuucuaguaaguuucuguuaccuuauggucuaauuuaauccucauacauauccuuguggcaagcuauuguuauuuauauuuuaaugacuaggaacuauugaagcuugaagauuuaaggacuucugacgugaacuuggcacuuuucacugaacugaagagaauacuuugcacuccucugaugugugaccuuggacagaaaugucccuaaaucuucuaucucuuuaaaaaaaaauuucucccuuauaugagaaguaauaagaacacauauccugccugcuuucggugcauucuggguaaauaugacagugguuugagaugauugagacacaaaaaggggcugaggaugucaguuccaguuauuucgauuuuaaaauuaugucuguguucgugugucucaguguauuuugugcacaugagagcaaugcccaaggaaaucagaggggacauugaaugccgggaguuggaauuaccgcgggcucugagaugacugaugagggucugggaacugaacccaaguucucgguaagaacagcaagucucuaacugcagagcauaaucuacagccucuaauaagucacccuuaauguuucccuuguuacuugaaggaaugucuccauaaauaacaauauacuuaagagaaaaccacuuccgauuguccucugcuucugaccgcauacggauggaguggagcaucacgccuaagacacgaggagacugacaacaacaggcuuucugcugcagcuuucucaauuuucaccaaauucugaaauuagguucuguaagugggaaaguguagacuuucuauuuucccauuuuaguuccagugauagguacgcuacagagagcucaacucccacaaaaggcagagaauccugugugaaacacgguuucaugucaaauaugcaugugcucaaaugaccguuuuauauuauauuuuuauagguaguauauauacacauauuuaucucuauauauuuacauauaggcauauauauuuuauaggugauucauuuaauuuuuaugucuacuaacugucugugaauauaaaucucaagaacagcucacugugccucuucagcauaugcuguaugccugauccaggcugccaggguuauaccacagcauugugugacaguaaagcuuacaacugcaccuggccuaggauggggacaggcuuuuaaaguugcuuaauaugguagcauuagaugucaucuacuagacaaaaagaaagaaaggaagaaaaaggccaaaugaacaaaagaguacuuucaggcuucugaauugucucucagcaaaggcggguuguguguauaauugcuuuuaguuguuuuuguuuauggagcgccugcaauuucccugggccagauucuuagucaaaagcaaaguaccaaagugcugcggcaacagcugucuccaguccuucagggugcuaauucccagcccagcaaugcgcuccuccuugugaaaugaugcuuccuggcuauaaaacucuguguccuccuccagugccguuacagagagcauacuuauaaaaccaggcuguuuaacacacguccugaaggggaaaacaacugaccuccugugggguucaccaacccuucucugaaguagucugaggaccucauuuuauacaaaccccacugcuucauuccuccuucaaaagagaggaauaaugcuggaggcggccuuuguauuuucagcgguguguagcauccugucaauuccgaacacuuguuagagcaaucagaagggcugugcugaauuacacaaaacccuacucauuucugcucuucggcuaauuuccuauuauuugggagguguguguguauaaaaccauacauauaugugugcauguauguauuuauguguguaaauaaaaauguaugauuuauccucaguggcaggaauuccggccagccucaguuacuugguaaauuugagucuagccugacugcuuaagaaccugucucaaagcugagcauggugccacacgacuucaaccagcacuuggcaggcagagaccaguagaucucagaguucuaggacagccagggcugcacagaaaaaccuugucucagaagaacaaacaaacaaacaaucaaaccugccucaaagauaaaaaagacaugcauaaauagacaugaacacagaguaugaaggacucacuuggcuucauuauauugaauauuucaaguuuaaaaaaaccuuaaaacuacauaauuuuguuaacaaaaaucucauaaaaugaaugccauagcugauuucagaaauuaaagucuguuuauauguggugucaagggcagcauagggggaagggaugaugggggaagaagccuccaccagccguggccgagugcagaauccgugcucugugcaccggggcaucgugaagaagagugggaagaugcgcagggagcaagaaaauggcaucauuuaaaauggaugcagcguauugagugaauucacaggguuuuuguuuuuuauaugagcaaagaagaucaguauauggaagaaaucuuauuuuauagaaaaaugugcagccugccuguuaaaaacgaaguaaguuaaaauguuaaaacaaguguguugauaaagauaacgaacuagauuuuuuuuuuaaaccccuguggaaaacaggcuguguuguugcuaguguggcugaaccucagugguucuggagaguaaugaguucauguauauggagggugaugguggugguggugguggugguggugguggugguggugguggugauggugaugaugaugguggugaugauggugaugguggugaugaugauggugaugaugguggugauggugaugaugaugguggggaugaugaugauggugugaaccagaugcugcugagugaaugcuaggaaugcacauuugcaggaaagguggccaucuuggccccacaugcacauuugccaccaucugucacugagugcaucauacaaagccuuccagugggcaggucaccuuuccagguccuuugacauuuacucugcaaguuacuugccuacagggcacacauuuuuaaaaacugaaaagccuucuccauuuccacauucauccuucugauccuauuuuugaaaauacaucucuuguuccccucauagguggauucuuuauuuaacuuuugaaauuuuauucaaauagcacuuugucagagaagucuuuccauggcugcuguccuggguguggcuaccuggacugugacucagccuuggcacugaguucccuggggccgugucuucuggcggcugccaucuuuacccgcaaggcuucuucacagcacuucugcagcgaacuuccuggaaggacagagggcaaacccggugccauuugcuaaauauugccacacugaagcuugucauuuugacuugcgauaaauuccgcgguagucaaauuguguaaguccaagcaguugcacaaaacagacgugcuguguuuuccaguagccggcccuacuuuccaaaaggauccucuuggugcuuacauuuguuuccuugcuuauuugcuaggcaggaagcuuucccugggucgauaucagguucuuagaguuuauaaggaagcuuauuaggagguuuuauggaucagacugguuaagcuguguugccacaagugaacaaacaguucccuguuauauaauauauuuuuaugaugaaaauaugcuuaaguacuuauauucucagaaaauaauuuuagauaaaaagaaagcuuuugaaaaccauagcugaaaaaucucuuauuuauucaucuguauaaaugucuucaagcaaaaauugauagugugagauacaaaaugaauucauguaaagauuaugcgguucguuuuggcuauauggauggucuacugcaguugagagagaccacacucgacaagacagauguuucuugguuuuauguuuagaugcaagaaucucagacaagcguggugaccuuauucuguuugguuuggauuuugaaaugguggccgaugguguuaggguagcaagaaccacuuauugguuuguauuugaaauuuaguauguguuaauugccuuuaaaauucuguuuacugaguuuauugaguaaccagcaguuguggauugacugaaguaaaaacuauagucuuauugaugguguuuuuauggcuguggcaagauaauagccuugacaauagaugcuugaugaauuauuugaagaguuggacaguuuugggggagggaucauuaaucuacaaucacuugcaaaacuccugugacaugugccguggugcucacuccuuggagggaguggaaggaugcaaacaccccaccagacagaggagggguaauaaaguguuccugugcucugaggaccagagaguucuuucugaggguguguguuauggaggacgggaggaugaggaccagagaguucuuucugagggugugugugauggaggacgacuggggugccuuuggaggauggggguggggagcauuuaauaaauaauaauagaagagagggcugcgaggagccuggaauggcaacagggggacugggaauauaaaaucuuuagaggauguuuaaguuggcugccagcuaccaggcaaggagcacuuuaccuguucuuuggugcucucacugcuguaggccuuugccuauauccuugucuuuuucuuuuuuuuaacuugguagaaugacaaaggaaagcuuuaugcuggauaguauacuucaacaguucuucguugauuuguuaauuuacguuauucagggcacuucucugaccuaugugcaucuccuaacaccugcuaaauaugacucuggauuauuguuggguuuugaaugaaugcaucaauugcagacucuuacaaggggagguaaacauagucuucccaaggggcuacacuucaaaugcuuucagaggucagaaggcugugccaucacauuuuauugaccuagucugcugauaacgucauguagagaaaguuccugucccgcagaagagcagagugcugaugugauuucucaugcaggaaacuauuuggggucacaaaacagucuaaaggcaaacuuuaaccugaggucuguacaauuuaucuccgucacuuuggagacccagcagggcuugcugcaugcugcugcuccuugccacagaggcuuuguuuuggaggaacaguuuucucugcugcucacguggugggucuuccaagcagaaccaagauggcaugcccaguccuuuaaagagaugaguucauacguaaagaugcauuaaaaagucuacauaaaaaugcugguccuguuaaaucucucuuaaggcuccucugucuuuuuuucuuuaggcugugcaucuggcccaggcaagcuuccagaucgaagcuuucggcuccaaguucauucuugaccucacacugaacaaguaaguaucuagcaaauccuccaaggaggcgggcacaggaaaacacuauuucuaaggugcaucaaaacagugucucugcugaagcaacugauuuuuuucucguacauuauuuggcaaagaauacuugaagaagagagggaagacuaaauaguaggugcaucuuuauuuuacuucccugaaauaagacauuuaagauguucccaaauagagaacuuauauauuaugauucuuaauaacuucuuacugaguuguugauuucagacuuuuguacauauauaaggaauauucugauuacuguaaccucaccuuuucuaaucucuuccccaccucaaauaaccaccccauccuauuccccuucaagucuccuuuccacauucauaucuuauuuucuuuuuuugagacccacugaguuuaaccagaauuggaucugugaccauggaguuugaaacgauccacuggagucugaugggcauaucaguuggugcauaccauagacaaucaccaccucucccucagaauccaucaauagccaauaguucaguaaggaggggugggcccugugagccccucucugaucuaugauugacucuugaggggccuagucuugccauauuguaauuuuaaaaagaauaaauauuugaaguaaugcuaguuaauuaagugcuaacuguaguaauuacuauauaagaagcauaacagauuacugauugaagcauaauuagacuuaagucuagagauuuauuccauuuuacuuuuuauaaugcaacacauaugacuucuguaggaagaagaaagcaagcaaugauucauguguaucuaguuugagaagguucuuugcuucauaauuccacauugauguagauucuuugaaacucuguacugaugaaaauuuaucccacugucucuaugccuguguuuauguugauauuuaaaugcuuuuuccuaaguugggacaaucuauacagguguucccgugcaaagugugaacaaacgcucuugucuuuggugaaggugguuucccauaugagucucuuuacacuagguaggauuuuucagcucucaucaauaauuuaaacaggacuacauuuuauaagaaauaauuacuuaaugcuaccagacacuguaaugcaggugaccacagccaacaucugaggaaucgcagaagacuauuaaauuucuuguaugccaaauucugucagcucugcagaaaaaaguugcggaguaagcuugggugcuccuuacucaaguguuauugcagcuuuaagucagaaugaaucagcagaacucagaauuucuguguuaaagauauugcagguuuucuccuuugguugaguuccaguucaccaugcuaugucagcagugugccugcauaagagauugucuugccaagucgucggcuaugcugaguaccaggaugaggcuaauuuuaguuugucucaguccuuuccauaucugaugcugccugaagaggagguugcagucaguacugcaguggacuuuggagggcagcucugcuuacauugcaccaccacggcugcaucaaaugcuguguauucugaauaguaaaauagcaugaccgcagcagaacuucccagucaaagaagcgaugucugagaaagggucugaugggaugcccaggguauuuagaguuacagaggcagaccaggaauuaccuaacauuuaacaugcagaagaaucagauugaauaccuauuaugaauauccuugcuugagggauugagucuagcuggggaugguugauagagagauaaaaauaacuuuagaagaguguggggugucuugugcuaaagguuaauguggaaugcuauaguagugugaccaagacagucaggacagucagugaagaaaggcuacuuaucuguagccaaggacagcauggggaauagguuaauugcucaacaggcacugucucuuugcacacagaaggcuaggauuucauuggaagacacugcauauucaugcugguaggcguugucucauagacucucucacauucaugagcauguucaguaggagucguugaauaagcuuucucaugaaucacauguuuaaaaauguugguuggcugccuggcaaugguggcacauaccuuuaaucccagcacuugggaggcagaggcaggcggauuucugaguucgaggcuaaucuggucuacaaagugaguuccaggacagccagggcuauacagagaaacccugucucaaaaaaaaaaaaaaaaaaaaaaaaccaaaccaaaccaaaccaaaaaaaaugguggguggcuguagccagagaaugucaauccucauauacagaauuuagcauuauaauuaacaaaguuuauacuuuggguaccuggaguaaaagucagcaguuuuucuugguuuaaaauggugccugaugugaucacaauaacaaaacaacuuaaaaggaugccaggaggcauuuaaagggacagcaucuuaucucacaugcaccucaaaauuccacuuuuauggcuaacugacacaccaaggagaggcagcucuucaggcaggaggaauaugaaaauacauguuagaagggguaauguuggagaccuaccuuguaagacaugcggaucaugucuuacaucagcaaggcaaauauugagaaaugggguagggguguggggguggggauggaggagauggagaaguacauccaggcauugaaaggucaagagagacaguaagauggauuaccuuuuuggguaagauguuuauuagaggaaucaauaccacagauaaacagauggguaugguggagcucugaagagaguugagacucacaaggcuaagcaggggucccuucuuauauguuucagagaguguggggaaauccaugguaugaaguuguugguuagcccauaguugugcuugcagucagguuguuucugauucucaggcagcaggagaagugggaaagcuuaaaucuuuaguuagugugugcuuaucauacaggaugagacacuuuagccccugauugcuaaaugugcuuguguaagauuccuuugggggaauggaggacugcagacucauucagauagcauggcaggaugccugucauuucuauuauagcaaauaaaaggguauauagagaaaggagcccgcucuuuguugaaauuuucauaaauuacaaggguaagacagagggagauaauucugaugcucuaagccgagggguagcucaacuuuuugggguuugugaccccggucuagaagcuccugacauggaaaacccaguacuuaggaggcgauuaaagggcuuacucgaugguuaaagaaugggaaagagggaacuuugcucacaaaucaaucuuugaguuuuacagaguugaguuauggaugcacaagacugagggagggagauaaacuacauaaagagugauacacccgagaacggagaaaggacauucaggaacuccgugcuaccucuuuccacuccuuucaaagucugauauuuuuugauguggagcugaaggaggaggagugaagcuugagcauuuaaauuuuuuucuuugauaaaaacucaugaauggucuggaacuuaggcuuaaguacuugggugucauucccaaauuuguaaaaagucaaggguacuaaacagaagucuugcucucaggcaaugcuaagucacacagagaggggauacuuguaagaagucuucaguugguaaaaaucauuagaauugguuugauggugaugacaaagcagaaaaaagaguuaaagccuacagaagugucuugauuagacaguuugcaucuagaggguaguuuaauaaaacuaguggagaaaugugagcuggagggaguugccuugggaguuacuuccauauaaacauuaaugacaaauaugucuuuaaauggaggaggaaagaggcagaauaaagagagcugggagauaggcaggagguggagagaggaacugugaaggagacaagugacugcggaaguaggaggagaaccugcaggauaaugauguugacaguuucagaacugaaagacgugauucacgucauuaucugcaguuggaugcucugguaagguaagcaaugagcauccuuuggauuuuccagcugauuugucacuggugguugucagagagugguuuuaguaaagccggggguuguugggggaaccaguuacauaauguggggacagcacauggccacugaaggauugggugaguguagaggaauuuuaaucaagccauauggcugcuuugccaggggaucacauuuauagauaugaucuggucagcauguagacacacccuggauuacaguaugaucugcuggaauacagacauacucuuaacacacauauuuaauuccaaacaaugucgguaagguuagguuguagaggaagcagccauauuugaaagugacauuuggggggcagacaaacugacaaaucagaacccuuucacagaacgagucagagauagaaucugcccaacucucacaugcauagcagaggaagauggcuacauaagagcagcaagagagaaagagaggggugggguggugugguguggugugguguguguauggacaguuuuacuuggacaguccaauagagacagguuacagaaagaauaugcauacagaugaagacagaaugagucagagaaugagaaggagccagaagacuagaacagauugcugaaguuacuaugaggccagucagagcaauucagucagaagcuaagagaagccaaauugaaucagucaucuuggaagauuagauuguguggaggcuagaagcuuucaggccuaggaguaguuagaacagagaaagaaacacucugggcacagucagagcuguguaucuuucaucugagcaaauaaaagcaacauuuauaggugagaggaagaguuagaagaaugcaugcuaucuuuuugugaugaugagcaaguugauaaccugagagauggagcugaugaggaaggguuagugauacagaggagauagucuauggagcagguacuuagaugccauuccccauuguauugggaacauacugugauucaugugcuuuggggccagucaccagucacuaguuuagaaaauaacaggauugggagaucaucaaauuuuuggaugcauaaaucgucaggucacacgauuggcuacaggcaacugaccagacuaccagcaugcuuuccuguuuauugaaagguacacaccuguaaucucagcacuuggguagcagacgaaagcaggaucaucuguacguucaaaaccagcacguuaagccucaggccagcuaggacuacauaaaaagacccuauggcacauacacagcaauauauaugcuugcccacuauugacccauaugcaggacagagaaggaagaauucucacuauguaccaauguucaaacauucuaggcuguuaaucaggcaggagccuuauucuggggagagucuugacaguccucagggaaugcugugcuugggugaaaacuguaaaacucagugaucgguggcuguaaccuaaagguguggaccugcagauguggaauguggagacuaagaggguugcuuuauuaguaaccaagugagcugagagaagggacucaggauggacuagguggggcagugcugaaagcuguaguuacuugcaggcacuggagaagcgagucugugggaucagaguagcacacgaaccccgugguagcauucuccuguguauaggacaggacuuuagcuggcuuucauagucuccuucuccuggggggggggaugcuucucugggggugggguacacuguguggguacgucaugagaagaugugcaggaguauggugcaaggugacagugugaggacagauucaggugacuuuagggccucaaggucucugcguggauggcaguggccccagugaugaguuaaguaggaaaaaaagagcaggauuuuaaaaaaaaaaaguguuacuauaaucuauccaggaagguaguuccagauuuagaagaguucuuugaauuuucugggacucagggguguuuacaugaacagcuagagaacgccgauuuacagcagcacaugcacacaguaauuugcucauuagaagcaguucaugcuguacucuuggaagaagaaaacaacuucacuaaaaugacuucaguuagguugaauaaagaacuggcuuucgugcugacugacacaguuaauucauccuucagcucgucaacgcugagcaucuaguuuguguaaaaugcugugcugagcagcauagagauuucaaagaugugugagaggguuuuuuuuuccucccuucccauagcaauggaauuaaaauguacauagacgauauuaaaacaugauggauuagggaagaacacaccaguuaguuauacaauaccagaaaacauauguacaaguaacauuguauagacugugagcgcggucauuacagauuuagaaacacauaugcaucccccuacacacacacacaaacacacacacacacacacacacacacacacacacacauaccaguugaaggaaaagaggccauagauucgaaagagagcaagggagcagguuuaugggacggguuggaaggagaaaaaggaaaaaugauguaacuauauuauaaucucaaaaaguuaagagaaauaguaaaaaccaaucuuaauaacaaaaccaucauggagugugcccguggcaccuuggugcugagagaaccuucucccggugagugggaccucugaguuuuacaggaugcugcuguagagcaugggucccugcuacuggcgcccgaagggaggauuccaggaaaucauggauaacagaaaggugaggcugggaagaagaugaccagagagaggcugcuugcuuucuacugacaucugaacaucuugcccagaggaauccuggggcugcauucucacauccagcccgccagucaucgagaggcaaaggaguuagauuuuguucaccaacugcccagacaguuguugacugagcggcuucuaggggaauugauucuucacuaccuccucccuaggaggacaaacugucucccuuucucaguuauuucuugagcuuccggugaauuguguggugagugcucagagcuuaacugugccaagcauauuaggcuccucccaaaaugcaucagacuuucaaaggauaucuuuucacacaguugaauuuggaccgugaguaagggaaauggaaagacacuggcucuuggggucaggggcaggagagacacaagcucaaucgauagcagaccaaaggccaagagccuucuggaccuuucugcauucuaaaaggguguuucagcuuuguucuguuuaacaucuuuuucagcucugcagauuuuugaugcuuagcuuucccuguggguuggaagaaggagcaugugaugaagaaaauggccgccuaggucacucugcuuuugugaaugaaugggaucaagugccaugagcucgugcuagggucagcaggaaacugacugaccugggcccagccccaggcuggaggguugucaggauuuugaauucuggacuuaauggcaccuguucuaagauggcugccuugugaugaggcacccaggcucucucuucccucagcaugcuagucucccuguucgcuuccuuucacacaguugagggagcacagggaauuugggaucuagacuuuccaucuuagcucugcagcagagguuaccagcugacacacccucagagcuguagucugaagagguuagagucgcuaacccguggaacccaucgcuggauuccguggcuuuaaguguugcuauuuagggcaaaugcuucuuuccuaaaugcaagagaauuuaggaaaaaauuuaggaaaagucugcagaaggagauuuuugaauuauacuaaugauggugucauagaccuucauuuaagcccauuacccaaauuguguauuugcccuuuuaauaacucuuuaaaggagauguguugcauauccucugcuucugggcagucugagggugguggagcugcaguugcaguuugggauuucagucugcuuaucugagcgagccucuccuucuauggcuacuaagugaucacagcaccaaacuguuaauacccuagugagcuggacguggcucucacgacuuucuauguucauguugacugacgguaucgaccgacuuuuaaugucauaaagaacaugcauaaggcuccagcugcauuuaaaacagccccaugcauugagccuggccaucuaucaugagcugaccuuuaucucacuaaugcuagcuaaaaugcuaaauuuuuaugaacuucaguaccucauguagcugggguuggaauaaggucuuuuaaaagauaauuagaauacagacuuuugagggagaccaaaauuaagugugaccauuuucuucauaagaacaagaaaucugaguagucaugaauggacauagagaaaccauacaagaucaagagaucgugacauccauaagucaagaagaagccuccagaauuuaaccagcccugcugauaccucauccuugggcuccugagacuaaaggaaauuguuugcuuguuuguuucagccaccauccugguacuuuccugcuuaugguuccucagccuaaagacucgccauccugaucuacaucggccagagacgcagaguuagugcugcuguuaguaagggaauauguuugucuccuacagaugauuaucugacugucguuuccaagugcugguuugagacuucggucucuuuugcauuuauauauuuuaggaagauuggaacuauuuugguaauuucagaaaagguuucuguaagaauaaggaaccuuaaggagcagcuuccaagaguauaaauccugauuagaugguaccacaugugcugugacauaguugaguucauguacauggccugaagucacugugggaaaauucuuccugccagguggaaggaacugcuaagggguuucaccuccucagacagucucuccuguuuaguucugaauacuucgauucuagggauccagauagcucuguuuuuugccagcuuugcucugacuagguaagaacuuggcagguuucacccuggacauugcuguuuggagagcaauguuggauguguuagauguuauuugguucugaugagucaucuauuuguuaguggaucagguccagauacuguggaaaauagaaaauaaguauucuccgaauauuggcaggcucuaguuuuagcuauguacaauguuuaugucaucuacuucaaaaggguuugagaauagcuugcaccacuaaacacaguaacagcaacauuaaaauaaaaccagaagcaucuuaacacccacuguuacuccugcacucaggaggggucaaggcagcagaucucugugaguuuggggccagucugguugauauagagagauccagacuagccagagcuacaggauagagagacccugucuccaaaaccgcaaaagaaaacccacaauccaaacauugguauuucucuccgcacccucccuggcucugauguuucagcuuaaaccaggguuuugugcauguaagucaagugcucuuucugcagucuauguauugauucuugauuuccgcagacgggcaaggucucugaggcuuuccuucugcuuacaguaagaggcccuucggccccagggcuugcugucuauugacaacgauugucaugggagaaucaucaagucugagaauaucagaauggccucaggaaacuagcuuuaguuuuuucuagaucccaagaggcaauacaguugugccggcccugaacagaaaaccuggaagccacaacagagagcaagcaugacagcaaagaauuuguaucaaaaucaaaagaaucuaauugccuuccaguggcaucucugggcauuucuuauccaauacaggauauaaaacacaaauuuagugaagcaaagaacuauuuccuucuuccuuuuuuuaaaggaaagguuguacuuaaaaaaacagauuauauauauaauauuauauauauguaauauuauauaugcuauaucuacauguauaccugaauucgagaagaggaugucagaucccauuacagaugcuugugagccaucauguaguugcuaggaugggacuacagaccucuggaaaagcagucagugcucuuaaacacugagccaucucucuaaccccaaggaacuauuucuugacugcuggauaaaaggagaccccauucaggaacccaacuugagauggaauauggccaaauaaacuagaacuugaugcauucuuuagagcacuuauucauuuuugaagucaaaguuuuacauaaaaauuauagcggagguuagucaugacaagacagccagaagcacagaggguccugcgugaugaggcaccggggaugaguuaauugcuguaguuacugaagucagaucuuauuuuucagacuguugacugagaaaggcaauaugcuggcuuauauuaauuuucacuaucuuguaagaguucaucugauugucuauugcagauaggacuauuuccugccaagggggaacuuaguuguuugguccuggaucaguaagauauuuaucagcaucaugguugacauggauaaccaucauuuugcaaaggagcagcaauaauacuuaagugggcuuuuuuucauacugaccuucuguaugaaccaaguacauaaaguucuuucuaauaucaaugaaaugaccaauaaauuuccacugauggaagaaaacuuugcauaaaccaugaccaguacuuuuauuucaugauauuuauugaaugucugcuaugugccaggaagagaggacucuucucuuacaggaugguggaggagaaagauaguuuuacaaucucuuagugaaaguccuagaagcgcuauaguaaagaauacaggugcuuuuacugacauagggagggcauaugugucuuugcugcuuuguggguuccuuuuccuacccuuuauccuccugguuccucccccuacacuugauaggagagaaaacaaggauagagaggagagagaaacuaggaaaaucccugaaucuaauuuauuuccucuuguuucuucuuugaccauggcuacuaacaaaucauaaccaacucccuaaacaaauaacacccugccccugacucuugggguucuagcauuuauauaccccugaaaaguucccagauuuucaaacaucacacaaucauagaaacuaucugcagcuggcaaaaccaugccucugcuagagcaugaggcaaaucauagucagcugcuauggacaguucaaaacaaccccacauccugacacccgguuuuuaaaacaaaagcauauuuuuauaauaauucuguguuguaaaaggaaaccaaaauucucaaauucucaagacugucacuacgcauguaaguuagauuaugguuaggaguggcuauagagcuagaccuucauggaaaucaauguuccaaauuaggccugaagcuuguuuuuaagaacuggcuauguagacauuugaaaguagagaucuggagacuuugauuaagagaaagugacuagagagaagucacagcugugaagaacacuggcuguucuugcagagggccuggguucaauucccagcauccacauggcagcucacaccugugcaugacuccaguuccaggagaucuggugcacuuauacggauauacaugcuggcaaaacaccugcauuaauaaaaauauuuagagagagagagagagagagagagagagagggagagagagagagagagagacagagacagagagacagagagagaaagagaggagagagaggagagagagagagaggauggacauccacaagauaagcaagccuaacagugacuccuacugacagcaauagcagaaccuaggacuguccauugucaaagccucaguucauuugugaaacuguugcagauuagcccagaauaauagaaauuuauuccugcaguucuggagguggagaagucuaggacuaaggugcaagaagauuuuaauuugguaaaggacaucugcuucacaauguuuuugugcccacaagggguagaaggacaaaaaguguguccucacauuggggaagagaugggaggucaaggcagcuaucugaagccugccuggucuugggauugaggucauuuuagugggcagagucuucguggccuugccauugccucagagcccacaucuucaugucaucaccugaaguuuauguucuaauuugaguuuuagaaggacacaugccagauguguuugaagcuccccacagaugugaaccucagagaaaugaaacaauauacacccugucauucacggugccuuguuuuuuauaauuucuauuccaugcauaaaucuaacucuaaacaaugauuuauuaagcuuuucucuugauuuuguauggauuuauauaaagucacaguuugauaccagauaaaacaacuuauuaauauccuuggugguuuuuuuguugccaauaaagauuguguugcuucuagcauauuucuuuuggugauucacagacaagauucaucguagaaagucauuucucagcucuuuuuaaauuaauuauaaauuaggagccccgauauuagaauccuaacuacagcugguuaugacuuguuuauuaaaaugcagacuucagaaaugucaguucuaauucaucuuccuugaugacguccaugugcuuuaauuuucagacuguuuuaaaaggaaauaaugcacagaggcuuaauuuuuuuuucagugaaaauguucaagucuaauuuaaauaauuaaaauugcauuuaccuuuuuauagggaugcguuucaacuaagaggcuaaagaucucuaccacacuacgcagggcacauuuuauuucuucuucauuugucuucugccuaaccaaguccacucaugcacuaaagcagacuuuccgaugugacuaaaugauucuuacaccacauagacaaacuguauuuucuaagaguucuauuuuaaacaucccuucugguuuuauuggguuguaauuaacaaaacuauaccuuuuaauaauacaguauguuguuuugauaucugucuuuauuguagguaacuacuauacucaagcuaauggacauccuaaucacaccacccuccccuccucuccucucuccuuuccucccucucuuucccuccuucucuuucuuucuccuuuucuccuuuucaccaaggagggcuuuucuggagauguaacaguaucaggggcucuugcuuauuguuacugaucugacuuggccuuaagaacuugcucugcucuuuaaaaaauaaucagacagugguauagggagucuuaauucgacucucccacuuacuucccuuucuuccauguucuacaugguguguggcuauaggacaagaaugagacuaaguuccaaggagcccacaguuuaggauuggaucagagaaaggaggggcuugguacugcaguauuaggcugaguaauucaaggaugacuaaguuguucaggcaggaaaauaacucucucugagcacucauuaauuuucagagaugagucaccaaccugcaguguuuauuaacuguacaaaugauaaacuguuaucuauuugcaucuuuuuuccuaacuaaagucucuuucuaugcaucuucagcaguguuuuauaagcugcaggaagaagucugaauauuuuaguggaauuagaaacacauccaugucuuguuagccucuuuccuaugacaucaguaauauagucuuuaauguagauauugauaaccagcagcacuuucaggagcaaauaguuucucuaccucuucaucuagcuuugcacuccgggacuuugaguuagucuguagaaaaagagcaugcacgccucaagaaaccauuagcuauuccuuuucuuaaaggcaguuugagggaaggguugcagcucugugguucaugguaggaaacuguugugggcuuaacacccugcaaaaugcucauuugacacuuccccuguuuuggauggguuuuccucccacacuuccucaaguagacagugaugcauccuuacuauggaacuaaacaugggccaucuugucuuuugagagcuggguuuucaucagagcuauuuuuuaccuggugguuucugaguuuaaaucucuugauagucccccuuuucugagugaaaaggcucagugguuacaggaguuguauaccacuguucugagugguuacaggagcuguauaccacuguuagaguuggcuuaguguguaacuuuugaaucucuguuuugaagguagaaggguucauggaggcucagggugaugagaagaaccuucauucagacacaucagugauagaauaaugcaucugggcauguacuuccuguucuaaggacagcuagccuuuuuucaacagacuucuuuuuaucaugagaaguugggguuaaacucuucaagacgccgcagguuugcuccccagcugagauaguccauuuuuguccaacugagaauucugagggugaaucaagaaacccuccaccccggcuugacagaacugguucuucggcuugguccuugcuuccuguugugugugugcauguguauguguguguauauauauauauguguguucccuguuuuguccuuaaaagcugcuuacucuuggacacuggacacuagccacuuaccaaaucauuuuggaacauggacccagagauugcuauaguccccaagaaaauagcuaaaauuuguuccuguauguuuagcuagaacacaaaaggguacagugccuuuuccaagaagaaaagaaaauuucagagagaauuuuucuaauacaugagaaguccacacuucaagcaugugagucccuauuuauaggccuucccugcuguguucaguacuguugaacagcagggcauuuuuguaguauacaaaaggccauuuuaaagucuuuaagaacuuucugcaaggugaaagccaucucaagucugaugcugccaguguugcugucucaguguuucccagacgagauaaacuuaaugcacugccuugugagaggaccauucagagauaagcacugacagacggcuaaauacacugacuggcacuagcgugagugaggcuauaucaacacucuguucaggauuaugccauggugacugacauacuugguuucuuccucacacgcacacgcacacauacuaaauaggugacuguuuauugaaucuuuacuauauuagugguagaaucagugguuuuggguuugucuguuuuuaauugacuuugaagaacaagagaaucuaauacuuauaugaagcaucuuuugcagauguaacguauugcccucuggcuuucaaacaaaccuugguuuggaaggcuguauucacuguccccauucacagcaugcaaaaugacugcuuuguguaaggccccaguauauuuuuuuaagugucuuucuuaucuauuuccuucuuccuuccucuuuauccuaacuuauuucugaauguguuuugcauaaucuuuucuuuguguauguucuucuaaaacauauguuauaauuucauaggccuuucccauaagugauguuaucuguagauuucuacucaaccugguauuuaaagaucuguaacuguguuuauccuuccaugaucucuaagcauggccguggaucuuuggagugcauccaguacccauucauucuccgagggagagaaaucuccauucccuuuggcucugugcagccauaaaccauaaucuaaugcguuugcaugagucaguguaaauauagcccauaggccugcgugagaaccucuccaguggguacucagacuugcuguagcauggaaggcuuauccuccagacagccuacacucgucuccccuugagcagagcacagagcuccacagugcauucagaucccuacucauccaugccaggcaagcugggcugagaauucuguugauuauauuuaguggacaauacuuucagggcuagaagauuaagccuaugugaagcaccaucuuuaguacgaauuaguucccauaaagacugcguuaauuuguuuaggccacugugauccauaggggaguggaguuuuauucuuucagaguacugugcuguccaauguuauuguaguguuaccuugaauauuuaguguaaagggcuggauucauauguauucaaugacgugcgucauaccaccggccaagaacaagaaucucuguucuuaauguagagcagagauuacaaaguuggccaaccuuugcagaugauaucugggaaggagccuguuugaaacuuagaugacaggaggaacggcuuggggaaaggagcaaagaauaaugagccacagcauaggucugcacccugugccaggcggagccucagcuccagccuagaaugacugaguugauagugagcuguugugaaaggaggggcuacucagacucaguccuuugaacugcucaccucgacugaggagagugcucccugaggaguauggugugagagggaccuguguguauacauggcacucagcaguguuugcggccuuugacagacugcacuugguaugcccuggcugguaauuagacucguucugcaguuauucugcacaaauugguuccagucuuggcuuuuuuggggguauaaagguauuuagguaacuuuucucucucucuuucuuucuuucuuucuuucuuucuuucuuucuuucuuucuuucuuccuuccuuccuuccuuccuuucuuucuuucuuucuuguuuuguuauucauagaauuaaagauauugucauauucuauuuaaaagucuucuuaaaacgaccauaguuguacuuauacagcuguauaggcugugacuauguaaauuuugaccuauuuuuucccuucaccuaaaacauauaaggaucuauuuuuaagcaccuguauugugaagccucauuugcacauuauugcaguggaguguguuguucuacauugaguagguuuucuaaauaacaguacuuaugccucaauuuguuaaacuuuaaauuuuuuagagauauaauuauuuuauuauuuuuuuguguguguuuugucugugugucuguccaccuguacuacaugagugcccauggaggucagaagaggauaucagauccucuugaucugggucgggauuggaguuagagaugauuuugagcugccaaguggggcuggggaaucgaaccugggcucucugcaagagcauuaagugcuuuuuaccaccgagccaccuuuccaggccugaaauguuuaaaaaaaaagaaagucauuaaaucugggucauggguugccugagugacuguaaccuuauuuuuucugauuuuuacaguuacuucuuugccugugugacuagcaguguaguagguuuaugacuuuuuucuauuguuagcuaugucuuuaguacaucugccauuucauccugguucucaauaauuugucccucuuugauguauuaguucuagaguaagagauaaccaaaauuauuagcaucuuauguaaaguccaggcaauaacgucagauaaaaccuugaugucucuucuguucaaauguuaauagauguuuuaccuuuggagccuggagagaugcuuaguuguuaaacgcuuuucuacuguacuuuggcucuaggacugggguucaguucccaggaccuaacaugguggcucacaauuggucaugacuuuaguuccaagggauaugacacacuuuggguacacauuuauacauacaugggggcaaagcaccaacacacauaaguuaagaauaaauaaauuuuuauaaaaaaggagauguuccaccauuaucagagauuuugaagcuugauagccuuccugcucuguuguggaugcuggccguuuuccagagugcuucagaggaccagcaaccaaagucuguguaaauaaaggguauuccuuuacucuagaaauggagcuuuugguuuaacaaguaauuuguagcaucaugaaacugguggcagauuuuauuauagaagagguucccaggcaagggcauuauugagaggugaguagaucaggaggcaccaccuucuccuccccuccccuucccuccccuccccuccccucccuucccuuccccuccccucucuuauacauuucuuccucucucugcuuucugccucacuccccuuucuccccugccuuucuucuguuccuucucuucucugcuuccuuucuuccccacccccagccccucucuccucuccucucuccuuuucacccuuuuuccauugguggcucaccucccagucuccauccuggcugccuggaggugagcagcuucccuucuccacauccuucuccuucugccacgauguucugcugaugcucugcuucaccacaguuccguggcagccgagccaggcagcuguggacuacaaucucaauaaccuugagccagacuguacaucuuccuugauuuuagcuuuugaucucaggcauuucaucacagugacagaaaagcuaaccagcaaucagauggggacucugggauucaguaauggacaguuuuuuuccccaaggucaccacuguaugguaugcugaggcauggaaucauggacucuggaguuccagcccucugcuucugauacuguacucuuguuacacagagagcaucgcuaccauggcccuucucuauguuagcuacaaaucaugcauguagaauuaauaagcuguguuguaccugccuaaguauggcagagcauuaaccaguugagguuccacagaaaaaagacaagguggccaggaacucugaugaggagccugagaccgagagcuuaagauugggagcuaaaugcccagaucucauucucagaaggacucauuuggugaguuacgcagcaggugucuugcaagagaggaagggacuaccaagagugggggagaugacucagugaugguuuacaaguguggagaccuugauuguccuugguuguccuugauuauucacaucaauaaccucagugcuaucagguagagaagaguggagaccaggggauaaccagagccucuggccagcuaaucuagccaugcagggagugcugacuuaagggagagaucccaucucaaaagauaaguuagaaggcaauagaaggagauaucugauaaugaucucugaccaucuacacucacacaaacacacauauacaaacacauauacacacacaaucacacauauacaaucacauauacaaacauggaugcacauauacaauacauacacauacacagggaagaaagaagggacuaucaaaccuaccacucaaugaaugcaaaccagaguuuucaacaguaaaacuuaaaucugauuuauaucucuugaaucaccagccaagaggauguacguuucagcucagguagacugccauguuggggcuuagcauucaaacaaaaguaacagcaaugacagacuuacugagcauguccagugcucgcugcaguguccaagagcgcuguaugaaccaagucuuuaauccucacagcgacuaacgaucuaguuacuauuauuauuccuguuuacaaauaguggaucaaaggcauggaggagcugaggucucacacugagguuuaucuaacucauagcuaugagguucagugggccuggggcuccagugcucucuuggcuuucuggagaggcagcucaaucagguuguaaguacacaggauaguuggauguuugugggguggagaaggguguuugacuccuaagaaagcccagcuuuccuuuguuuuauuuuuuuuaauauaaaaugcuaauuaccucccaauggaggagcuagagaaaguacccaaggagcuaaagggaucugcaacacuauaggcggaacaacauaaugaacuaaccaguaucccggagcucuugacucuagcugcauauguaucaaaagauggccuagucggccaucaauggaaagagaggcccauuggacacgcaaacuuuauaugccccaguacaggguaacgccagggccaaaaagggggaguggggguggguggguaugggggacuuuugguauagcauuggaaauguaaaugagcuaaauaccuaauaaaaaauggaaaaaaaaaaaagaaagggaucguccccagaauugagggguacugaccuaaaaaaaaugcuaauuacauuaacaagaugaagacuuagagauggaaacaguagcuuaccauguagcuuuaguacuuagcaggcagaggcagggauugucacacuuuccaggagggccuaggcaagagccuacuuuucccccaucucaaucaaaagaagagauaaaguuuagaguucccaaacauaccagacuuaaaaucccaugugccucucaauaccaccaggauuucuuaccaagacacuagacaaaccacuuguuuuucuaucauccuuacuauaucuccuaagaauaggcaggcuucuucaauaaagcuaucugucuuagucaggguuucuauuccugcacaaacaucaugaccaucuaguuggggaggaaaggguuuauucggcuuacacuuccauacugcuguucaucaccaaaggaagucaggacuggaacucaagcaggucagggagcaggagcugaugcagaggccauggagggauguucuuuacuggcuugccuccccuggcuugcucagccugcucucuuauagaacccaagacuaccagcccagagauggucccacccacaaggggcuuuucccccuuggucacuaauugagaaaaugccuuacaguuggaucucauggaggcauuuccucaacugaagcucccuucucugugauaacuccagcugugucaaguugacauaaaacuagccaguacacuauccuuugucauguuugagaaaguuuugcagaguaauucaucaaccuucgagguagcauggggauccacaugggaaggccgugcaaacaggagcauaugaaauuaagaugugauagcuggccucuaucucaaacauagcugagcagcugaggggucggggguggggguuaggggugggguucuaguuugagagcccuucaguguuuucuuuaggaccacuccacccacccacaguacagguucucaggaaccccaguacuccugcgcucccauccucuggccuucacuguuauagauggaagucuauauuuacaugugaaaacugacacgugaccuucacuuagauuuuuuccuuugguggaaugugguccuauuaugugcuagggacugacugaguggaaaauaaacccuccuaugcucuguuaucauuuggagaacauucuuaaccucuuugguuuucacaaaagaaccccauucuuaaacagaugucaaguuagccugucccucaguuuuauguagguagaaugagaaaaaucuugcuuuccaguuaaaucguucuuuuauuuugacauugaacagcaggcguaugucaaaauuaacgguuguguaaacuuagaaguauaaaugaagaagagugggaagguugaaaugaucuaaaagugugaaaaggugaucagagacuuugugggaugcgauugugccuuacccugagauaaaaggagacucaugucuaguuccaagucucuuuucuuuuguuauucccuccccaagaaauaaaugaaaggcuguuuuccucaacucucauaacguguauuuacaauguugccuguggauagagucauggcauuuugucuggcagcaugaagucagaaccuugccugaggauuuauuacauggugguugguuucccccguugcucaauucaggagcacauucucuuuuuaaugagauuuuugucugaagguccagugcucaggauuuuggggccauauguuuauguuuauguuuggucuuauggauauaaaaauugcaaacacguuucauaaaucuguauuuuucacuuugcagguguguuccacuuuucugauagacuuuauuucugcccucacaguaacaacuaggagcagagggggagucuacagcacaggcugcagaccagcgguaacugcaaggccaugcucgucuuccuucauuucuaggucuguucucuaggagagcucaggguauuagagaucagcgaagaagagauaaauagucccucuuucccccaggauucauguucauuuaauucuacugaggcuuuccuuaguagccuucugucuuuuggauaucauuuaguaaguuaaaugaguuaguaacuuaaaaaugaguucuuuauugucuacacccuuccuaggcuauuugcgucuugcuugacuggaguuaacugagaaguagauuauucgagguagaauuuugagugcugucucaugaauucauuuuguaauaaaugcuuaucggcuaucuuuguaauugaggaauaauuugggaagauaugaaacacuuaagccuuccuuucucugggauauuucaagaaugucucucuguggacuugggaauuccuaggaacaagucucagucaaugggaggucccucuucagagauguuauucuaaauauuuauuuaaaaucuuuucauacacauauuuuggucauauucuuuacucucccccccaaguccuuccauacccacccuccauaaauaccucuuuucacauucuuccucucucucuuaaaaaacaaaaaaagacaagaaaagcuaaaaucaaaccaaaacacgaaaaauauaagaaaugcacaugugcaugcacacacacacacacacacacacacacacacacacacacaaacacacacaaacacacacauacaccgaaaagacaaaacaaacaaauauagaaucuguuucauguuggccaacuacuccuguguuugugaccugcccugggguauggcuggccuucccagugucagagaggauguguuuuuacuguagggguuuccaucguuuuccuccucaguaucgaccaggauuaauagcaccguucagcaacacuacuacccagugauuuuuuucugugaacaugauuugccuuuuggaauuacaaguucauuguauuuuuuuucuuuaaaaauuauuaagauuuauuuauuuuauguguaugagcauuuugccuggguguauauauguauuaugugcaugccugaugcccaucuauggaggucagaagagggcauugcaauggucuacagggacuggguuacagaugguugugagccaccauucauuuaggugcuagaaucaaacuccaguccucugcaagaauaacaagaacucuuaaccacauagccaaauuuccaacuccauuuuuuuuuuuuuuuugguuuuucagagacaggguuucucuguguagcccuggcuguccuggaacucacucuguagaccaggcuggccuugaacucagaaaucugccugccucugccuccuaaaugcugggauuaaaggugugugccaccacugcccuccauuguguuuucuuguuuuuuuuuuaaccuuuccauuuaauaaaaaaacuauuucugaaccuuaccagcuucauacauauauauacauacaaacaaacauucauacauacacauacgcacacucacgcaugcacgcgcgcacacacacacaauguugugucuuugacuuucuuuuaaagaagaaguuaucucuauaguucucuugaggccacaguguugagcaucccuucuguuuccugugauacauacccuucaucucuccagggcuuacaccguuugcugcugcuucagugucuagaucuaggaccuuauuauuauuauuauuauuauuauuauuauuaauuauuuugguuaggauuaacuggugcuuggagcgaucugcugaagcagacuguggugaagugggucaggugccacaggagggaaggacacacuagcacccuucagcuaauuuggaguuuguugguuuggucacuuuucaaugggguguuucuacccuccuagagauggacaucccucuugggccaguggcaugaauggagcccagggcagagugcccuagggacgcauguggaucggcagggagucuauuuagucccauugcucuucagcucaccuuccccgaccugagcagguccuaagguggcaaauguggacucagauuuacaacacuuagcuucauagguuuugcuaguuuaagguuagagucauuuuaaaaaugauggcuguauuuuuuguucuuuucgauucugcuauuuaugaggaaguuaguggcauaauguguaaaaauuaauuacaguuugaaaaaaacuggaagaaggaaaacauuuuccaucuuuugaaauacuuuuuuaucauuauauauuggucuauucauguuacaugggcaggugacuuggacuucagaguggagaagguccaagaaguaagguugcccuaguuaccaagcagagaugcaggaaguucagaacuuacagauucaucucacugauacccaugagaaagacugggcaacuuuggggaguccuaacucccugggguccagguacuuauuucuugugguuguggaauagaacacuaggauugucgucuuauguguauguagacgcuaauaacauugauuugcaggaaauaugaagggacagcagagggggagaaaggagaggagggaggguuagagaacaggcacaaagcauacaguuccccaggagugggcacagagauugacaacaguacauaaaaauccauuaugugucucuuaaagaaccuauagaauagaugucagagguuccuaccacaaaggaacgguaacugccaauggagagggacauucggaucagccagauuugauuauggcccauuuuaacauaauugagcauuguaccucauuagagaguguaauuauaugucaauuaaaaauaagcauaaaauuuagaguuuacuuuuaaguucccuaagaaguccgcuuuuaaaagauaaguaaaggaaacuugucuucuaguuaggaguuacacaaaugaucaggcacgagacacagaaguggggguggggguugcucauuagaguugcuucacucauccuuucugauuuuggauugccauuuugaguggguguuuaaauuauuagccauuucagaaaugucucugguuuuagauauuauuaaucaucaggaaggcuguuaagugccauuacauggccuuaggauuuuaaaaauuaugcauauaagcagagcaauuuaaaauagugaccugacccucugauuaugcauuuuaaaacacuccuagaauaacccucuucagaauuauuagauguucuacauauccacacuguaacauauugucugaugaaaaugugagaauccagccugagcaaaagacugcacacaugggacuguauaaggcccugcagugagauguggcuguggccuuguuuuucuaagacauccuugaugucacugucuaggcauuucaccuuuuucagugguucucaaccuuccuaaugcuaugccccuuuaauacaguuccucauguugugaugacccccaaccauaaaguuauuugauugcuacuucauaacugcaauuuuacuacuguuaugaauuguaauauaaaugauaucugcugugugaccccaaggggucaugacccacagguugagucauuacaauuacacuuguuauuaugaauuccaaaauauguuuuuaaauacuuaacacaaugaucaagaucaauauuuuuccaggcaugcuaacuucagugauuaaaaauaugcuguccuuuucuuuccuuuuaugccacauguaauuucauugauucuuucagugaaaguaaagaauaauaucacaugcuuuaaacauuuuaaaaauuguauguguauggguguuuugccugcccauaugucugugcaccauguacaugucuggugccugcaaaugccagaggaggaccuuggauccuuggaacuggaguucuagaugacugggaacugcuauguagguguugggaaccaaacuuugauccucuggaagaacaccugugcucuuaaccauugagccagcucuccaucccuggaaagcaaaguuuugauggucaagucuuuuugaggucuuugggggacucuuucauguguguauaacacugcagaugaacuuuggaguucgguaacuuauguaaggcugccugcccauccuuugcucuucuguuucuucagcucuccuaguacaggagguaacaaucugggcgauacgaauguaguucagaucuugucaguccuguugggugguggcauuucuaaaugccucuccucugugcuuugcuauccugcaauuacugccuuuccccucucaauauucccucuucaagcagaaauugacuccucugugcacacuggagugugggagcagcccaaaugcugcuguuucuagagagaaggagaaagucccccucuuucccggugcuuuugccucccauggguuccuuagcuccuucugucuggccuuaguagugacagcuuccugguuccauaugcuuuugccauggucucuuucuggcuuuguuugucucauacuccaaauuuuuaaugucagagauuucgccuuucuguuuuuguuagcuguagacauuuuagauuccuuuucuuucaaggagaggccgaucaguggguagaaaacuuguuuggcacacaugaggccuaggcuuugaccccagcaccacguggacaugguggugagugcuugcagccagaggacuaucgugguagagcaggaagaucuaaaguucaagaccauccucagcuacauagcaaguuugaggccaaccugggauguacuagaccuugccucaaaaaaauaauaacagcaauaauaaaugcacauucucauauauuuauggcacuauucauagcaaugccucgcuaugguugacaaagaaggcauuaucaguaucuuagaaauccucugggugucccacauugccauauguccuccacuacccucuucuaccugugauugcgucucaugaugaaguuuagcugguagauuugagaauuuuaccccaagccaaacaaaauccacaaaaauccaacuuacaaaauguggcaauaauaggagaucgugugauagcucagcaguuaggagcacuuguugcucuugcaggggacccaaguucaguucccaggauccacacgggagcuuacgaucaccccuaacucaguucuagggagaucugauacccuuuucugacuuacuuagguaccaggcaugcaccugguacacauauguacaugcaaguaaaacacucuuacacauagacuaaaucuaaagacuauguaaaagugauaagaguagaacucauaguuacaguagaacagauucauguuuauuucuaacauuccauuaggacaggucuugccuagagugaagaggaggcuucacucuuacucuaaucugcuuaggcucauacugacaaaugucauaaacugagcaguuaacuuggaugccuggcagacucagaugcuggugcagccuuccucuuggcuagcauccgacuaucuugcugagaaaaagaacaaggguacucucuagggucuuuuuccccucuugcuuccagcuuccugcuuccugcuuccuuuuucuucucccuuugugcugguuggaagacuuaggcccuuauucaugauucaugcuaacugguuucugcuuaaacgugcaucaaucccaucaugaaguuccgugucgugaccuuaucuaugggcacugagguaggugcgcuugcuguaggauaguagguugguaaaaccuacgugcuuuucuuucuuuauuauuauauuuauuguguuauauuauauuauauucaccauuguuuugccugcauguaugucugugugaggguauuucaucccuuggaacuagaguugcagacaggugugaccugccaugugggugcugggaauugaacuaagguccucuggaagagcagccaguacacucuuaacugccacgccaugucuccagccucuaugugcuuuuuuugggggggggcauuauuuaguauguucuccagcauuuguaggcaugucaauucuuaacuauugucuacguccagaaauuuugacucuagcagauucaugauuuuugauauggcuuccuuggauacgaaucagguaauuuagaacccaucucuuucucugccaucuccgguccuaaccucucauggucuuggaaucuaucuugauacuuaguaaauucauugcuguggaucauguacaguuaauucuagaauuuauaccaaggcacuaaaaaugucuguuuuuuaagauuagccuauaaauagauccccugaaagacccaaauagaauaguuucuuuuuuuucuuuuucuaugucagucucucugggauuuaucugcuucugggauguuauaaagguuuugcuuuugauccacauauugagagucacuuugugaauguaagauuguugaccugggcagaaaauuuaagagcauguaaugaaaguugucuggcuguagacauuuauagagauuguuuucaaauucugaccuauagaccuguucugcauuguaagccaguugggauuugacuuuguuacuggcaggcuacaucaauauagaagaaaggaugcguuuaccucuaaaguauugaaagugauuuuaagauacauuuuuagaaugccaugaacaaacagugcucuaaauagccuuuaaaagauaaaaauccaguuuuaacauuaugcaaaaugucuagacucuauaauuagacugggauagauuaaauuacucacuucuaaucacuauuuuauacacgccucucaaagugacauuaauugcucucaauuugcuaauuauaagauagucuugcaggaugggcacuaauuucucccuguuauccuugguuuuuagcauuuuuaugauaaagcauguuaauguggccgugagguuuuagauuuauuuuagucacagcaaaguggugguuuugcagaccaguuagauuagucaacucgaguguagcuuugguaggucuugauucuuggcuuucagauuuguuuuuguguaagaggguguuuuguuaguuauuaaucagaucuguagaaagaguaucagaugauaucuugauaauggaggcauucucuuuugguuaagguauguagaaauauauggacuuggggggaaguguaaguaguuuuccacaguguguaggucaccuggauagaacuauuuuguuuuguuuuuucagcaccuucuggaaaagauuggccuacaggcaccugagaauucccacacagauuauuugacagaguguagcuacuagacagacugugugugccagcagccuacagcuucccacgcagcaaccuuuguuuguaggggguguauuagcuacuacugugucacuggcagagaugacuuaaaggaaggaggguuuauuuugguuuaugguuucaaaggguuccauucugucaugguguagauagcauaaaggagcagcccaguucauagaggugagauuguguggcaaaggcucuuaucaucuggaggaaauggagcaguggguaacgucuacccuucugggcccacuuuuaccagcuggucuccagaagguucuagaauuuuguagaguauagccagcaccuggggaugccuuuucauauucagaccauaaaaucauacagcgacugagaguuggagguuucuuuaagcaucuuuaaauccaguguuccugguuuuuguaagggacaagguagcuucaccagcgugagagacuucucucagaucucagaggcugucagcuccaggauguguuuaguuaaggcuuucuucagggacugaggcuaaacacugaacccaaagauccacugcuagccagcuaaggaaugacacgaaguuucaaaauccucuccagggggaaaggauucuuccuaaaguaguuacgcaagaauggccacguuucuagcaaauuccuuccagaagucuguugccuuacuaauauuuugaaaagaucccucugggagaaugaaaauugcccuuagagaagucaguccugcucuagguaaaucauaaauguuuaaaaagcaauucaaggccagugaauaauuuuuugguguuaugguugugcccagggguuagaacugccugaaggucaauuuucugaaugauaacuaaaaaccuguaugugugugugguaguaauucuguguuugcaugaggaagcuguugaagucacucguucauucccuucagccucuucucucccuuuuuccuauauuguaucauuugucacgugcugugcucuuacugauggugccauugugacaguuccaucuuuccacauaggaaggaccucggcuauacugucuacgcgucucugguuuagguauggggaguccauguuugggaagaaugcugcuuucugugucacacagguagauggcuucaaaugaucuucucuuguguuggguugugccgauccucuuagucuuuguguuuugagaauuugucugugggcauuuuauucucaguucagcuauucagguucagguuguggcaaccugaacagaaaucaagggcuagcuucccuagguagaaagggagccccuaaaagacaacuguggauguucuacuaaaacuauuaaaacaagacaaagcagcaaaguagaggcuagagugauggcuuaggguuugcaaagugcuugcuguaucaucauggggcuggaggucgauuuccaggaccccagaauaaaggcuggggauaguggugugcuuauuauaaucccaguuccagggagguaaauucaaguggauccccagggcuugcuggccagccaggcuagccaaucagugagcuucagauucagugacagacccuaagucaaaacauaagguagagagagacagaggaagacacccaguguugacucuucuuguaucucuuccucccucccucccucccucccucccucccucccucccuccuucucuaccucccucccuccuucgcuccuucccucucucccucccucccuccuucccucucucccucuccccaccccccacaucugccuauaccuccaaauauaauuggucuuugccuaauagauuuuuccaguguacauauguaugcauauauauauuaaauuuccaauaaaaauuaaagaaaugggaaaauuaauuuuucauuucucuuaauuguugauuucuuuucuucccccugccuuauucaaucuccagcaauuaaucaaaugagugaaggagagcuucagcuccagggucucauauauggauagaccuuuuccuagcgugugugcugguuucuugcagcucugucccgcugcuaacauuaauuacuuugcugauggcucuaauugacccaguaaaggagcuucucuauguucugccugccccagguccuaaagaccuuggauucucuguggacacaggaaguaacgcuugcuuucagcuuuuauaaauagcuuuccaaauucagguucuuauccauuccuuugcaagguccaagcccuugcuuaauuuaaaccuguguauugucccacgccugccuuuaaaacaccccacccucuccugcaugcucaggagcagguggccaacacagaacggauccuagauuucuuuuguuguucguguguauauguguuggcucuguuugauuuucaagggagagaaagaaugaauaugacauugugugcauggaucugggaagaguuggaggagaggaaauaguaugaccaaaauacacuguaugcaaaauucaaaaacuaauuuaaaaaguuuuguuugcuaauguuuuagcuaccugaauacaaaaugguauuuucggaaauuguuuaguuuucacuuuguaguuuuacuaggauuagcauaauuaaauugauagauaauauacccauaauugacagauaaugcacuuuaccacaaaauuacaugcaucauacuuuuuuggcccccaaaauaaaacuucuacuuuggugucucauuagauagguagucugggucagguguggaguacucggcguaaauucuagcacucaggaggcagaagcaagcagcugucugugaguuccaggccagugagggcuacauagugaaacccuaucucaaaagaagaaaaggaaagaaaggucaccaagcaucagugaagaaaguuuugguaagcaaaagaaaggaagggaaaugaugggaauuucugcaagaaguaagcgcuggugaugacauuuuggaagacagcuccuuguaagccuuucuacuuugaaggggggcauauaaacagcccaaagguuuucacacugguucuuuucuuugauuaugugauaauuuccccaagugacuguaaaauagcacacaacaaacaccucauaucugugugagugugugcgugugaaugugaauaugcaugaguguaggugugaguauggcugguaguggauauaugugaaugugcguggcuauauauauggucagugugagugugcaugaccgagugugagugugaaugugagggacugugaguguauaugagugugaguaugggugugaauaugaguggggaugugugggacuguggauguaugugagugugugugugugaugcauauauguaugcguagaugggugugagaaaaagcaaggucugcuuuuaccuuguuucuuuucuucaucaaauccucagagucagagugccuggauuagcgggaacacacugcaggcuuugacauccuuugccaaauggcucucuggaguguuaguuuucuaacaaccuugccagcacuuccuacuaccauucauuuuuauuuucuaaagagauugaguaaauguccucuuauguuaguuuaauuuucaagucuuucauugcuauuauaguugugcauuuguauaugauugaucgcucuuggcauuucguguucaguuuuuuuuuuuuuaugaauugcuccuugaauauuugauuuugauuuugugggugccuuuugucuacuuuucucuuguucuugguucuuuuuuaagaccuaacaugaaggcgaguacuuguuuugcaaguauuuuuuuuuaauccauuuguuuugaacuguugguugcuuuaacaaaguaucucaauuuuuguaguuauuuuuuauaguuuuaucuaugcuuuuggguuuaaggucauauauucaaagaccucccuucaguguuuaccuggauuucuauacucagcucaugacucuugugaugguuuguauaugcucagcucagggaauggcacuuuuagagggugugucccuguuggaauaaguguggccuuggaguaaguguaucacuguggguguggccuuuaagacccccauccuagcucccugaccaugccugccuggauguugccauguuguuacuuuaaugauaaugaacugaacuucugaaucuguaagccagccccaauuaaauguuguccuuauaagaguugccuggucauagugucuguucacagcaguaaaacccuaagacaucucuacuuuaaacacacaaucuuaauaaauagagucuugguuugcuguagggggugggauggcuguccauuuuccccaauauuagucacaugacugaaauauguggauucuuuauuccuuuucuuucugaacuuguuuccugucuuaugaccuccugauggcuuucaguuuuccacucuuuguagauuucaauuuuauucuuaacccuaggaugcgcuugucugaacucgagacuuuucuaauguucuucugugccuuuugggcugaagaccaggccccuguucuucaucuuaguucuugcaaugcugacacaaaguccugcuuuuguuauuuuauuugagaaaaugacauacauuuuucuuuaagaugaacguuagagucauuugucauguuaaaaaaaaaacccuugagauuuuguuuggaauugcacuaacauucaaguaggucgagggugguggauaguguuacaacacggccuguucccauggggaaucagggaauugcuucauucagucaugacuugucuuaugguuuauuuuauuuuuuaaacuaaggauuugcuguuaacuucauguguguuuuucuucauauuuauuuauacuugcuuauucuaguguauuuaaguauuaacauuuguaugugggauauauauauauauauauauauguauguaucauuugauaucauucuggaaaaugucucccauauuaucucuagaugguuuuuugcuggcuuauauaaauaugugcuucauauucaucuuguaacaaacaccuuauuuaacucuuaacuauuucugauaguuuuuuccccccauuggcuuguuuguuauuccuucagccauuccucucauuccucuggaauauggcaugaaugaagugccaguuuaaaaacagguugaaaguaaaagaagcagggaguucucucccuaagacucggaggagcugcuucuucuggauggaaugcuaccagucagccucuuggagacacugcuagccauagauuuaaguguucccugugcucugcagcuccuccacagcagggguugcaucaugcugguugggucaagcccacggaguggggguucuuucccuuuccacuauacaccuaagccucagguucuccaucuaacucuuccuucuuucuucucugcacuaugaauccacacucccaaguuucuuguucuccuuauucaucuuauucaaaaugguauuauggccuacagacuccucaacugagaccuaaggagcaccugugcuguggaauuuccaauuccacauguccuuuagaaagucaucaagucucuuuuguaacacuacagugucucaagcccuuccccuuuccauucacuuugcuaggaugguucucugccugcaacucugucugcaugaacuguggccacacucuagccugccaucuuugccuuacuucacacaaagccucuauccaaccuguaauucuuuuuaccuaccucauguaucugcuccagucuucaaucccagccucaccacaccgcuaucuuuuuacccagugacaacccuuauuuuauuguuuauacucaaaggauuauacuuugcccuacacacuugagaaaaauagcaauugauaaaccauuucacuucuaagucuaaaaaaaggaacaagccaaaagcaauagaagggcacaagcauaauuguagguaacaagcuauaauuguaugaaugucuugaccuaagugucugugauugucuucauuucuacuuaagaaaguaaucauuugauaaauuaaaaauaucacaaguuggggugggagauaucuugacagguacaguucuugacauauaagcauaaggaccugacuucaaucccuagaaccuguguaaaaaacuguccaaaugguggcacaugcugcaggaaguggggaccagaggauuagccagccuagcuucaguuagugaaccccagagcccaauaaaauaagguggagggcucuugaggaaagaaugagauugaccucuggacucccucucugucucuuuuucauacacacacauacaugcacaucauauauacauauauguauguauauguauacauaucuacauguacguauacauguauguaaugagacuaaagagaagcuucuguaaacagagggaucaggcauagugucuguaaaauucaggauccgccuggugaccagcaguagcugucaugaacuaauucguuaaaugaacuaaaagcuccaaggacuggugggaaucgggggaaagagaguucuuagaggauucugucagaggucauuugggugagcaugaauacauguuuaaguauagacacugucuuaauugccuuucuguccuugugacaaaccaccaugaccaaggcagcuuagaaaaaaaguuuuuaacugggauuaccgugucagaagguaaggguucaugauggggguggaguaguuacagcaauagcucagaguuuacaucuuggucugcaagucggagugcagggaaggagacgaagcucauauguacauguaucuccugaaaccuccaagcccacccccagugaccuccucucaccugagcaugccuugcaauccuucccaguuucaccaacugggaucugaucacccuuuuccaagcuuccuauggaguacuguaggguacauuggacauugcucugaauuauauguagagccauagagucugccuauucuucaacuagaguaguuugauauuuuucuacaagugaaccuacuguugagugacuucuagaaagucaauaugucugagcaggaagggacaugaagaaucaucuuuuguagcccuuuauuuuguagaaggaacaaagaccuaccuuuaggacauauaaaugguucagggaugaguucaugccuccuagauggaguaaguggcccauaaauguguugucaccccucucauuacuccugguggcagaucuggacagaaacccaaguguccuaacccagcucucugcaguggguacagagcaucuugcacuguacuugguucugaaaagcugacuggggugaugaaggaacaaagacaaaucagacacugaaguguacagagcaucuggaaucaggugcgccaugcuugcucuggugggggaggggggcaucaacugcucaacaucccgaccucagucuagguaggaggucucuguuaggggcauagccucaggcaguaaaccaccugaagguggacaaugcuagauacuuucuucauacacuguuaacauuuccaggcagaccaggggaaggcuucacaguucucaugagucugaggcauugguccuuaccaagaaagcucauacucaggucucccuccacauccacaaccaagaguuuauugcccagguuuacgauggaggaugcauuuaaaguuacaguagugauaguuacagugcccaacacugaacaguguugauuucuaggcuaaguucugcaugcuuguuuaaucaauuuaaucuucacaguacccugugacuuucacguuuuugauaggcucauuuuauacaaguuagugaaacuugcucaugucgacacuuccauucaugggcucugcuaggucuaaacccuauucugacuucaccguuuauauucuuacauuuuuuaaauucaaauuuauucuuaacaugauuuuggauaugauguauauccugugugugugcgcgcacauacgcaugcucauagcucagaggacagcuuucaguagucaguucucucuuuccacuggggaaucugggguugaacucagguuguuggguuucuguggcaagcucuuguguccauuggcucaucuuguuggccuuaugcauuuuuaaauggauuuaaaaauucaaaauaauauuauuucaugguacauuagaacugugugaaauucaaauaucauucucuauaaauaacacuuugccgggacacagccacacucauuugucuauauacuguugauggcagaguugauuguugcuucagggaccacacagcuggcagagcugcaguguuuacuaucuggcacuuaugggaagugcuugccaguucuuuucuuuauuccuucccacugauacacaauuuaaaaauuuccauuggcacauuaauugugugugugugugugugugugugugugugucugugagugauaggguuugucuucuacuugcaacuuaguuugguaguuuugauugacauguccacuaggugcugaaucugaggguguguccuuuccauugccuauguuuuauguuucugaaucuagacugaggauuuuucuuucuuuucauuuugcuggaugcugucuuaagacuugcccacagcuccuuuguccagacugcagagcugugguuuucaggucccugucaaccguuuauugagcucucuuuaaaccucuagcauuugguugcagaaaucacuuucucuucuuuccuuugcagugguuugcuaucuucugacuacguggagauccacuaugaagacgggaagcagauguacucuaagguauaguaaauuggccagcgcuccugcagcauaaagugcauucaucuuaccgcugaccagugcucacugcacucuucugaggccuccuaugcaagggaacggauuuacugaggaagaaugcauaggaacuuaagaugcugaggcgacauuagauucuguauacucaggccauaagggaauucuguugucuugauuuuguacucauuaccuuacugaauggacagaugaguguuauggucuuauaucagcacuaaaaauaccauuuggguaucccuuaccuaaaagacaugggaccggaaggccugggaacagggcucuaguuuaaacagaaaauucauuuauguuucaccuaugccguauacacacaacuugaagggcaaucuuguucauuuuagaucaucuuguucccgaaacaguuuugugcauggaacuuuccacuccugcugucaggcuggucagacuuuuggauuagggaugcucagucaggaucauggccauggaaucagaauuacaagguuaggugacuucuuacagugacaguucagugcaggcaacugaugcccaaggguggaaggcagguuucaaaaugagaccuugggaacauucuucuucucucaccccuuuuugagggccuguaagacagugucauaguuaggguuucauugcugugaacagacaccgugacccaggcaacucuuacaaaagaaaacacuugauugggacuggcuuacaguuucagggguuuagaccauuaucaucauggugggaagcauggcagcauuugggucaagauggagaacucucagacuggaggagcugagaguucuacaucuugauccaaagguagcaaaaggagacugagugacacuggccagacuugagcauguaugaccucaaaagccccaccuccacagugacacacuucuuccacagugacacacuuccuccaaagccacacccccuucaauaaagccaaacuuccuaauagugccacuuucuauggccaggcauucaaacacauaaaucuauggggccucaccuuuucaaaccaccacacccagguuggccacaaacucaagguucauuugccuuagucucauaaaugcugagauuacagucaugugcuguuauacccaacuuuguuucauuauuuaauuuuauuuauuuguucuugcuggagaccaaacucagaaccuucagcaugguaggcaaugcucuaccacugagcuguagcccuagcccuucccaacuuuaucaucaugacagguccaugagguggguauucuuauuccuagaguaaaaugaaagauacagagguacagagaagggggcaaacccgcucagggccaucacaggcugacacauaaagguaaucucauauaccugaaauucuucagggggagguaaucuuuucuucucaccaggaagggccaauaaggaaaaaaugggguagaaagaaagaaagaagagagagaggggggggggagggagaaagggagaaaggaagaaagaaagaaagaaagaaagaaagaaagaaagaaagaaagaaaggaaggaaggaaggagaaagaaagaaagaaagaaagaaagaaagaaagaaagaaaggagggagaaagaaaggaaggagggagaaagagagagaaaggaagaaaggaagaaagaaagaaaggaaggaagaaagaaagagagagagaaagagagaaaggaagaaagaaagaaagcaagaaagagagaaagagagaaagaggaagagaaaggaagagagggagaaagggagaaagggagaaaggaagaaaggaagaagaaagaaagaaagaaagaaagaaagaaaggaaggaaggaaggaaggaaggaaggaagagguauuauugauagugugugacaagcaagugauuucuaugagucaggcagaaaauccacagaaugggcacagaaaagaacuuaggacuuuuaguggcuguccaggugccauggacauucaguaaugcccauguaaacuauagacauugggaaggaaggaagaaacaaguaauaggggaaaaugcaauuuguauuuugcugauggcuuccgaaugucagccuaacgguggcaacuuucacaugcagaccugcauagcugugagccagggagaccuggauguccuagcccauagucucuuggcacaugcuuauaaguagccgccauuggaaacacugcucauggccacggugugucucgggacuucggucuauuugauuaaugguggguacaucugccaugcgcuucuuacuacugucagcucucuccuccagcugcaucugagaguuucaaaucucccugagacuaacgcuauggaaagggaccauucgugccaacucaagugcgggaauggugcuugcuggcauugguacaaaaccacacugcugucggcugugccaguacccugagcauggugugcugacucaugaacccggaggagaggagaucacacaaggacucuccagacucagcaaaugggccaccuuugcagccgcagaaacccaacccaaaccuuucucuaagaagcucaguguaauauauauauauauauauauagaaguacaauagcuaauugguguacggaguucauuugagguaccccaaaugaggccuucuuauuaauaagauaucccaagccucccgugguuguaacauauuuaaagcaaaagcugcaucaagucuggcaaagaagggaugcucacuguagcuugauucugcaugcaucccuuuccuuucguuuccucuacaacagcccuguacccacauuuacucauccguagaugauggauuaaugguaacauccugauuuuuauuuauauguauauaaauauauaugcccucaagccccaagcauaugcugugcacacauucuauguaagauuuacaaaaucuaaugagcuuauaaauucuuuagucuacaugauaccuugaucggugcuggaucauuauguuaaaaacugcauaauguucuucuaacuuauuuguuauuauuuauuuuaaaaauauuuuaauauuuaguuugcuuccaccauugccuaguuuuuccuaaggaaauacuucccagauggggucugaacacaaucuuaauaauugcugcaaguuuaaauuuaaaaauaagacucucuggaucaaagcguuguuauuacuuuaugacuuuugaucacaaugacaauuuuuugcuucugagacuaugagaaauuuuucacacauucccauucccauuccacacauaaauuuaaaagcacuuaagaaaugaacuuuacaaagauuugcuucaucccuguuuaagggagcuuuucuggggagcagcaguaaaggaagucaauguguaggcgugccaggguuucucauuccguaagcugaucucugagccagggcuggagaaaugggaugcgugcugugauuugaccggaagagccuggaauuauaaccagucugugagggagggccuugagguaaaacauagauguggcacuuacaguccucugagaguuaauaugaaaguccugaugcauagguacucugagagcaaacacgguuacagucuuuccacuuuacagugacaagcagcccugcuuccccauuccuggaugagguauauauuuuucuuuuacuuucacugaaugaaaguggggugaaaagagaagcaaagacaggaaccagagggacaaaaacaaaaacaaaaacaaacaaaacucaaaacaaaagcaaaaccgcaaaacaaaaccccccaaguucauggccuugggaccagguagaugucugcucuuacccacggaggaacuucuguguacccaggcaggcagauuuuauuacaacuucucccacuauuccuugcacaaaguaugcuacaauauacaauaaagcaacuuuguugauuucauuuuauucauuugaaagacaacuuauuuauguuuucuuugguuuaaacaaguuuauuggggcauaauuuauauacuguaaaguacacaauuaaauuguuuuuacuauauuugcaaaauuaugcauccauuaacauaaucuaauuuuaaaacauuuuucaucaccccgcaaagaaacaucuuaucuauuagcagucauucccuagcgacuuuccuucccaucauagguaacugcuaaucuacuuuucugccucuauaaauugccuauuuggagcauaaaugaaauccuauaauaugugguccuuugugagugcuuucuuuuccccagcuuuauugaaguauaauuaaaaaugcaaauuguguauuuaaggugugcaucuuagauuuuauacauaagaauauuacauaguuggguuguaccaagugucaugcuuugauauguaugcacugggaaggaagagcacacugaagcugauuagcacagccucugcuuccuguaguuguucauguuagugagaacauugaaaauucuaccucacagcagauuuuaaguauacaauauaguaacuguagucauugggucacuuucugucucugcaguauguuccacucacauaauuacaacguuguacccauuaacuaacauauccucauuugcccaauugccccuggccccugacaaacauauuccacccucugcuuccuugaguuugacucucaugcaaccuaugaggguuuguucaacauuugucuuucucuacuggacuguuccauugagcacagugucccaccguguugccagagugacaggauuugccucuuuccaaggcuggucaauaaucccuggcgaauacauuucuccauucaugcauccaucaguuuuuccagcuuggccacacaaaugaagcugagaugagcaugcucugcaauugucucuuugaaauucagauuuccuuuccauuuuuuuuuuuuuggauggaucuucauucuuuacuuggccaugccaaucuguaguucuaccaacagucuacaaaugucccuuugucccccauagccacacaauagccauucuaguaagugggagguguagcuaacuguacuuuaauuuuguauuucucugaugaccuuagguguguuucugugugaguuaaaacguauguccauggacccauggagauggcuuggggggugugccaaggaugcuugucuauaaauaugaagacccaaguuuuaauccucaaugcucauguaaaaugccaggcaugucucugcuuggucauaacaccaacaaugaggaauggagacaggccgauccugagagcuccuuagcaagccagccuaggcaaaugagcaaacuucugggucagugggagacuggucucaagcaauaagguggagagcuauagaaggcaccugauguccugcuguggcuugugcauacuucagcauaggcccccacacacuuccaugccuacauuucucccucuccucuccucuccucuccucuccucuccucuccucuccucuccucuccucuccucuccucuccucuccucuccucuccucuccucuccucuccucuccucuccucuccucuccucuccuccccuccccuccccuccccuccccuccccuccccuccccuccccuccccuccccuccccuccccucucugucacugucucucuuucccucccucccucccucccuuccucucucucucucucucucucucucucacacacacacacacacacacacacacacacacacauggaaucuauauagacauauauauguauauauuuauuauauauauauauauguauauauauauauauauauauauuauauauucaguucuugcucugaccuaguuccugguaaagcacauacaucagugagccagagacacaucccuguccuauggggagaagguuuauauucaccuuguucuuuuccuaaugauuagaaucuuccucaucacauaagcuuggguugacugaagaucuuuaugccuaugagggcuuuggcagcagaaggguagggaugccaucugggugaguggguccuugauagacacagcuccuggguggaaguggaaucaguguagagcagauggaucuggagagggaaaguccuuaggacccugacuauagucgucccuuguuauccuggagggauuuguucgaggaucccgcagaggacaccccuauccauggauucucagguuccuuguauaaaauaugguuggauuugugaaccccacacauucucuuaaauccuuuaagucaucuuuaugcuaauuacacugcccaaugcaacaugaaugcaugcaguugacuguuuagagacugauggcaaggaaggugguuuguccauguuuagcauagauagaguuguuucuuuuuuuuuuuuuuuugcgagauucuucaucauauuauggguuggcucugcagaugcugauccugagagcgcuauagacuaagucuuccugguaagagaggggcaggcauugccaccagcucuuagagcugaguuggggcacuugcacugggcaggacaauuuugguccuguguuuucuucucugguuucuuuuucuuucuuuuuuuucucccuuccccauuaucucuuucuuuauuauuuuuuuuaugaauuuucucagacuguuuuuucacugucuauuuucaaccuuucagccauauuuagaauuggaaauucuuauuuucuuuaauuaaaaaaaaaagucuuauuuuuauguucuauuccugucuuaguuuggguuuccauugcagugaacugacaccaugacaaaggcaacucuuauaaggacaacauuuaauuggggcuggcuuaaaguuucagagguucaguuuauuaucaucauggugggaagcauggcaguggguaauaagacacgacucuggaagagucaagaguucuacaucuugauccacaagcagccuuggaaagacuacugcaggcagccaggagaaggcucuuuccuacacugggcagagcuugagcacuagcaacccuuggagcccaccuacauacacagugacauacuuccuccacuaaggcacaccuaauccaacaaggccaccucuccuaauagugccauuucccauggggcaaguguauuaaaaccaccacaguuccuaacccaaagauucagauuucuacucuuacacaaauuuaaauggcucuuuuauuacuuauauauucauuauaauauuuuguggucuuuaaauuaauagcuagcuuaaaaguugcuugccauuagauaaauaauaaauaguuuaaguaauaacagagaaaggcuauacaugagagaacuuuuauauuagauauaaaauuauagucuuuacaauuucuaguuuaaaguuaagcuuacuauuguuaaucauucagaauauugcccugucuggcaguauucugaacauguucuagaauauaaaaggaacauggagagccaacacugguuccuuacuaagguauuuuaaguucggacaauauaguuuauaugaaguauuuaaguuauaugacauggacagagcugaagugguccaauacuauuaucaauacauuacuggaagauucuuuucaccccugaauuugaugaagguaaaauauuaaucuagcauuggaaucucaaauuccccaacccucugaaugaaguuuuucauuuucucauucugaaguuaauccagacacauguaaucagcaauagguauagaccacccacuuuuuaaaaaggcugguauacucagauaauagguaaauuuguaaaacauaaagaaaaacccaugccuagaacuuaggguaucaucuucuuuuuaguauguccccagucuacuuccuggugcacacaguucuucacgauaggcaaugucacuugucuguaaguguuuaccagaucuuccguagcccagagaaagaccccaccucucaggcaccacaaccauuuaaguuucccugagugucuaggacucugaagcugugacugacuguuuguuacugaagcaguugagguaauuaagcagacacaaagguugaaaaaaaauaacaagauuuaauuguuggcuugcuuucuuugguuucacccccaaaagcucaaauccaagaggcacugucaccaacuugguguccaugucuuacaccuucacaggcaccucacacugcucacuuuucucugcccuuauuucuucuggagaugcguggauuuucuuuuauaucacuguuguuugaguggguuacugugagagcagcgauguuucuuuuuauuaaagugagcagaauuaaauaaugccuguuaauagagcagugauaucauagaauagacuuuauuucccacuuucaaguuguuuucauuugaaucucuaaguugcuuucccuacuuauuuuugauugugaaguguuuuaauagaugaggaucacguggguuggggaguauagcucaguggucgggugcuuagcaugcaacaggucuuggguucaguucccagcaccacacacacacacacacacacacacacacacacacagagagagagagagagagagagagagagagagagagagagagagagagauguauaugcucacaccaugaagaauaggcagaccgacaaguccucaaguaaacaaaacuagcaaacaaccuuccccacaccugugggcagugacagaacagugcaggguacacaaugcuuuccaguggaauccuguauuuugcuaacuuuauguagaaauaaguuauuaugugagcaugucuuagcucuuggaguccuuggcugugaggagaggcguggcugagagagagagagagagagagagagagagagagagagagagagagagggagagagagagagaguguguggaggguacugacuaggaauuuucauuuccucugaugaccaaaauagguucugcuucacagaggauccauuucuguucaauuuaaugaacagaacaacaguuuuggaucccaaagaguugacaaugauggaaacacaguggcucagcccuugcugcugcuugucuaaucccagguuaguacucauucuucgaggucagcacugacgaguggucuugagccaucugaggcuuucuuaccuggaagaagagaugauagccagcagaccugaugaugugacauccaacggggccuuucuugcuacuuuuggcagagcuuuuaguacaugcugcccaucugcuaaucugcacaugaagauuaugguuacaaucaguuagugaucauucaauauggcauauuugugggccaguccccugaagcugauugcucuguguaacagugagugaaaucccucacaugauuccuuucuguccugaucaacuacagcagcaacaugggucaguagaguugacaaaugauauuuuucaacaauacuuuuaaaaaacuugcuauaaauguaacaauaaacucagaaaauauucuaagauuaagacuaaaauggaaaucgccaaacuacucauagugcuuaaucuaugaacuuuagauauuaaagccgaauauugugucaacaccagggacugaaugcaccuccaguuucauggaagauucacagaacuugaugacacacaaucaaauauacaguuuccuaccuuaauucaaaccuguagcaauuaucuuucuaggcagagaaucaacuuucacucaucagugcaugcgaauggagcuuacuguaauaagggcuggugauauuuuaugggaaaaaaagaauauuguaaggaaaaucugaaacuagcuuuucuugggaaggcuaaguaaauaggaauguuuucugugcacuucuuaccaccacucauuucugcuuuuuguguaugugugacaugaugugcuaaagaagaacuuugauagaauuuacaguuacuguauauuuugcuuuuagaaaugugaauaguuugaaaugugauggcuauauauugaccuggguucucaaguugcugagauguguggacccauuuguccuuauagguugcaguguuaaauacacaaauagaacuuggcauacuguagauuagucaauauuuauaagaaccauugcuauuugagaacauggaacaaccuccauauauagcaccaaugugauuuaucauaugccuuaccaauaagcuauucaaaagggaaauaaggccacugggacagaaccaaguaaaggcagcaguaggagauagaugccuaugcaauuucaggagaugggcagcaguaggccaagaacucucaggcuugagcuuuaucugcuccacuaaaugcuuuuuuagggaagcuggaagcaucaaggcaacuccugcuaucaaagccagaaagacccagagagcaggggcaccugcaaaggggugguggguugaaauguguauuuggagaacaauuaaacccccgauucacuacuuacccaccuagccagguggacaccccaucucuaguugggugaaguagcucaguuuaugaauaagcauggggaaggaauaaacaaagaguuaauaagagacugcuugcuucucggauggaggcgcaggagauguuuucaguuacuggguggccuggaguacuuaguguaauggagaagaagaagcauccacacggagacauaacccaagacugcauggacagggagcugaguaggaguccauaaaguccucuuaaagaauaauagaguuuauagaaaaugcccugaugcuggaaugggucuaaauuaguguugucagacauuagaagacucuacaggccucugaggugccaggaugaaguagcggacaguuuggcauuucuacccaacauguggcucuacugugagaguugaaaaugaaaaguuuacccucacaagugcuugcuaaacuuauuguucauaaauacuuuuuaauaaaguagcagacacugagugucucuaacaggaggaugguggcggugauaguaaaugaggaagacagggaauauaagguccaauguagaagguaaagaaggaaagacuugccuggcagugguggugcacgccuuuaaucccagcacuugggaggcagaggcagguggauuucugaguuugaauccagccuggucuacagagugaguuccaggacagccagagcuauacagagaaacccuguccaaaaaaaaaaaaaaaaggaaagacucuucccaucaguguuccagaaaguccugaauggucucuguuaacgggacccauggggaacugaaggaaaacacaagcgcgucuaucuucagguacaaaacaagcagcugcacugaccuacuaggaggagguuuagauuucucuuagagguuagggaugcuaauuacauauacaagcaaagagauaaaacaauauguccccucaaauuaaaaauguagacagauaguauaaucgaaugguagcccagcuauaaacaccuucucaaaguuacaacauaaacaucaaauagcagcuuaacccaagaugggcaguacauauugaaaagugggagaggguuucaugagucuguacgagagaggugcuuuucuuauuuauguuuuauuuuaguaucaauuuuauugauauauauuauaucuaucuauaucuaucuaucuaucuauaacacaaauucauugacuaugcucuuucaugauuucuuuuuuaaauucuguuuuuauauuuaaaacauguuaaaauuuaaauauauuugaucauguuuccccuccccuggguucuuccagauccuuugcccuucccuacccacucaacuuuaaauucuuucucaaaaacccuaauaaaacagugaagcccccucaaaccaagaaaauaaaauaaaagacaaccccaaaacaauaacaauaguaaacuauaaccaaauaaaaacacacaaagagccguggaguucauucuauguuggccaacuaugcugaacaugaggggugguuaauauacccagugccccccacuccauuggagaaaacuggcuuucccucuuccagcagggauaaauucaguuguuaaccuuuauccuagugacuagguuuucacuuacucauucauucauuuuucaaaaacgauaacaaaauaaauaaaagauaaaacuaucauacugaaguuaaacaaacuaaaucaacagaauaaaaaaaaaagcccaagagaaggucuaagaaucagacccacucauucacacucaagaaucucauaugagcacuaaacuggaagccauaauauaagcacaaaggaccuggugcagacucaugcaggcacugugcaugcugcuuuagugccucugaguaguucauaugagcuuuguucauguugauuuaaaagggccuugcuuucuugaaguaccucauucucccugguuuguacacucagucugucuccucuuccaugggcucugaggggagggagacaucucauuuagagcugauuauuccaaggucccucccucuuuguguaaugucuggcucugugccuuuauauuuguucccaucugcagcaggaggaagcuccucuaaugauaguugaacaagauauugaucuauaaguauagcagacuaucauuuagagucaucuuaucauuacauuuuuuuccuguuuuauaucaguauuauuugguuuuacucuaagccccugggcuaucuagucuuagauucuugaccaccaaagcaguaucagguauggguuccacuuggagugggccuuaauucaaaucuguuacugguugguucugcccacagcuuugugccaccacugcccuagcauaucuugcaauuagaacgcuacucuagauaaaggguugugguuggcuugguguuuauguuucucuuuugauaauauggagaauaccucaggaagauaauuucuaaaguggggugaaucugauaauagcaguauaaagauucuguuuaaaaugcauauaaacacaaaaggaagagucacggugugagaggaaacauguaaccacaucuguuuguaacuacuuugcaugcuuaagaagugcaugcgaacuuuauccuuuacauugguuuuauucccuauaaagccccauucucuuccauuaaaccuaugcaaacuuguuauguuuaaugcuuuuccagcccuauuuuugauuucaaauaggagugucuugugggccuguauucuugccauugguggccuuucucuacagaacugucagaagcaggaccaucaguguaucagauacagucaaucaggccuucuuuuguuuuguaggguggagagcacuguuacuaccacggaagcaucagaggcgucaaggauuccaggguggcucuaucgaccugcaauggacuccaguaagugggaaucugcuuggguccuccugaccuccaggcuugcucaaaaccauuagcucugugcaguuuuuaacuuucagauauuuuauauuaguggcuuuucuaugccagugauauguugaggacuaaauaaagaguaguucuagagagcuaaaguccucucuucuuuaacaccuagauuuugcagaaaacucagaaauuaaacaaauacuuacauagaguagugauacccauuuugguugaugcugugagggaaaggcuagagguguauuuagcuuucuguuacugaaacaaaauccuugagauaauagacuuauaagagaaaaggauuauuuucauucaagccuuggagguuugaauccaugauggcuugaucccauuacuuugggccaguggugaggaaccacaucauugugaacugaguguguguugugcagcaaaacuguugacuggguggcaaggagagauagugagaaggagacugaauucccacaaugccuacaagggcguuucccaugagcuaaagacuucuuacaaggcucauggugauuaccucaugaugaugccacugccugccaggagcaccacucugaggugaaaucagauccuuaguagcagaucuguugaggcauuuaagacccaaagucuagucggaagcuuacagaaugacucagucuaguugacucagcacuauaggacuauggcagaggucaucaguuggauuagaucuuggaauggaugggacauuaagaggaauucauccauugucugaguuucaggcauacucauugaaaccaugcauaaacacauuuuagacccaaaucaagugguguauaggauggagacuuagcuuuagacauuggaugaaaagggccuuaaaacuccuuucaaauguuauuuuaaaagacugucaugucuccucaaguuaauuuuuuuuaugacacacuacuuaauagaaauuuacaauuuacaaguauaaagauacuccugcuagccucuucagaaucagagacggucuuagaauauucuuagacaauagggcagucaaauuuguucuauccgauauauaauuuguauaacaagaaauuugugcuaguuucauguaguucugaaaaaagcgauuuuucccccuaccaugugagagaucuuauucccgaucacuguugucauaaguuuauuucuagaaaugaguucuaucguguagcauuugcaugcucugggggaacgcuuuacacguuugugcuggcaagcugccuagucgaguccuuggaguucugagagcggggcaggguucaucugggacuguuugaagacuuuugacacuguugagauucugacuugccuguucucacugcagcacuugcugacucuccuccugcugucuugucuuacaguggcauguuugaggaugacaccuuuguguauaugauagagccgcuggaacugacugaugaugaggugggccugggccaucaauuuccuuaugguauuugguuuucccagcaucaaagaccguuuauccguguucugugaugccacacuuagaaugguacagugcuagccccuuaugccggcgaggccagaucagaggugugaugcugagcuauucugaagcaagccccucuucccagucuuuagagagaacagggagggcuuuuguuuugcacugagcagccuggacuuuauuuuaaaaaucuuucauuucuacugucuucuuuagauaacuguauaagaauguacuuacuuucuguuacuagaaauacuuacuagggaaaucuguggucuaaguaguggcuacgugauacaacauacaguuuccagauggagaagaaaguaguguuucauuuuguauaggacaacaaccguaaugagaccuccuguguuccugccaggcuguuuacugacagcgguccuuacagucugauacagagucaucaauguuauauugaaagcuuacugcauuuuacauucaugauaaaauugauauccugagacucaugauggggaugccaaaagucacaugugacauuucagaugguggcacaugcugaagagagcaaagagccaccaaggugagggggaaucuugaguaaaggcuacaaggggauuagaacauucccagagcuauggagacacaaaggcucuggcuugggagauuagcaggugaagacagugugaggucacagcaggagguggggcagccuuggggaguagaucuagggagggaacuuuaaggagaaaaaccauuuuugagagugcuaauccgaguaaugcagucauuugauggagagcagaaaacagguuugguggggcacagggugucaccaugcagcccaggccucccgaguauucugugugugccgccaugcccagauggaaacauuaacaaaaaaaucuuucuuugaagaaaacaauagucacugaggcuguuaaaauauguauacacacacacacacacacacacauacauauauacacaugugcacauagauaguacauauauauuauauauauguaauauauuugauugauugauugguuuguguguggguguucuguguaaggagcucagcaaagggccucggagccucggagccuggggaguggaguuccagguggcugugaguagccaugugggggcugggaacugagcuugggccuucugcaagggcagcaagacuucucaacugcugagccaucucaccaacucugacauuuagacuuuugauaauaaaaagcagcauuuauuuucuugucuguacauguauguaugcaauauauuuauauauacauuuauauaauaugaaauauauaacauauaccuauauaaucuauuuacacaauacacacauuacauauauguauauauuuuauuuauaauauauaaauauauaauuuaauguauaaaugaaaauaaauuuauauuuacacauauauaaaacuaugagguaacuucaaauucgagacagaaaaaauauuuaauuauacauggugauugcaauauuugaacaaaccuguguggguuuugaugaauaacuuuaaaacuuuccauagagugacaacaguuuagccuugauuaggauauuuugaugaguaaaaugugcucccuguuccaugggcaggcagauaaccaucuuauggcaaaacugccagacagacauucagacauucagcaaaacaccugacuauuggcuuugaguaacugcucccuuaccucccucaccaaggaaacccccaaaggaaaacaacaacaauaaguccaaaauaguucucuaagcuuucacauuuuaagaaaguguaaaugggguaauuuccagugcauccauaauaugacaauuuuugcagacggggugaauucauaaauguguugcagugucugcugaagugcuaaaaggguuuauauacauauaaacucguaugaucaaaauguuugaggaaucagcacuuaguuguuauagcuguaauuauacugcugggggcuggugguuaugugcuuauuaucuucuguucccugccugccuccuacugccucccuuuuguucauucucacugugggugggggcaagcgagcagaacuugaaucuuuaaauuagcagcgaaaaucuuguugcagguucagggguaaauaucaugaugcuaggugucuuuucaucaguuuccagaauaaagaacugauuagauagaauuuggauuuugggauauucaaacuauuauuguuauuauuauuacuauuaguuuaacauguuugguaguaacucuuguauggacaggauaguuccagugagaauucacauucuauugcaaguagaaagcaauuagcaauauucuuaauuauuguuuucuaucaaaucuaauaagaaaggccuuuuaaaaagcuuuaugauuauaaaacuaauauauuaauugagugugguacuguaugccugugaucacagcuacucaggaggcugacacagaaggcuuacuucaaggcuaaccugggaaacuuagugaggcccugucucaaaacaaaacaaaauaaaacaaaacaaacaaaaucauaacaccacccccucccccaaaaacaggcuaggcauuacuuaguggaacagaacuaauuuaguauauaugagacucugaguucaauuaucaauauugcaaaagccaccaaaucuagaaauauguuaaaaaauuuugaaaagcaaaauaaccacuuaauuaacuaguaauuauccaucauaccacccccaaagaaaauuuaucaccuuuuagcaaauauucacacaauuuuuccauugcauauuuccauguauauuuuagauaaauugauuuucucauagcacaacuuaacccaauucugaauuuuucugaaucucaguauucuuauucguuaaguagaaaugugaugguugaucuugcuugucaacuugacucacccaagaagagagaaaccucagcugaagacccgucuccaucagaguggccuguugggugugucugugggucauuuucuuauugcuaacucauguacgauggccaagcccacugcagguggcaucauccugccacaggugggauaaaauagguaucccugggauauauaaaaacgguagccgacaagccagaggaagccagccaguaagcagcguuccuccacggccucugcuucaguucuugccucuagguuccuucuugagguccugccuucauuuucuuccauaauggacuguauccugccaggugggaugagcucuuuccuucucaaguuuguaauggucaguguuuuaucacaguggcagaaagcagccuagaacagggguagaauccagacaacauggacuucuugggaauaauucagacaaugcacacaccaacacugcuuggcagaaacugagcccucagcucuuaacaaugccacuuccauaccuaauaauguaaugaggcccuguaauuucuaggccaaaggauaugaauauuuccaagguugcuuauggaaaucauuaaaaucuuucucaagccauguuaccagugauguaugaguauauucagccuggccuugcagcuguaauuaaauauggaugucaucauuuuuaaaaucacuuacaaguugaugagaaaauugcaguuucaucuuuucaaauuuuaaaaguauacgagagcaccaagguuaucaugccaguggacaggcaguccuuuccuauucguuucccacuuggggcuuugagagaagcugagauucaagagcaacugacaaaacagugcuuucaucuaaaguggggccguuggagggcucuucuucauuuaaaauuaaagguucaacaaggcaucccgucuuccuucuaauaugucauguccccauguaaggaaggauauuagaagcagcauuaugcaagcacaguuccauggagucauagaggugucuuccugucuuacuuuuucauucccugccauugucuuuuguuucagaaaagcacaggccgaccacacauaauccagaaaaccuuggcaggacaguauucuaagcagaugaagaaucucaguaagucuucauuaaaauagcugugguauguguggggcugugucuugcagaccucuguagagggucagguuuguucaggagggaaauuggucugagagcuugggucggcuguguggguggggagugcagccucagcugugccuugcgugggaugaggcauggagaauugcuucagugaagaugacaaaugaagcgccagccagcguguagcugggcuuggaaccugaguguggccaaauauaaaugauuacugcagggccaggcauuaaaccagacuuucugguuugcucuuccccagcccuucugcacuaccucccccagucacccugcccagaagcaucuucaguaugcugauguuggcaaaggcuucuuuugguuuccugcaggcaugugagauacuauuucuauauacuaaugcccagaaucuuucauaauuuauacagaaccuuaugccacguaucauuuuaaagucuaaaguaaauugggcacacauaauagaguucuuaggcuauaguuaaacgguuguaggucaaauaaccaucuucuaaucaaccuugggcaacucacauuuuuuucacaaagagaggaaaaucucauuugagcugucuuugugagugugaaauguugaacaaucaaugcacgguuucacuguaggcuguuugggcccugugaugacauucauuauuaacggcacuguuccuucguguaauauuugaagacuauucucaauggaacgcuguccacauccauuugauguuaauuucccucuuacacaggcacagauggcagugaccaguggccuuugcuaccugaauuacaauggcugagaagaaggaaaagagcggucaaugugagugcagccucaggcagggcuccuucucacuccccacacuccaucucaacucuccccuuccaaacaaaacacagcacagagaagccccagcucuugaggauuucuagcacauugcuauuuauucuccccuuccuguuaaggauucaaacugauuagaguguccugugaauccugaugucauguaaaaauguguuguuuuaguucugucuucaauguguuuuuucuuaggaaaauuggaggauauuccccccgcccaauggaaaagcacaauagggcugguaagauggcuaaauaggugaagcuugguacccugaacuccauccucaugaccgccuggcgggaggaaggagagaacugauuccaauaguugaccucuggcuuucccaugcauucacccuccacacacaaccaaaccaaacaaagacgcaaacaaacaauaaagagacugcaccacaguuuuaaagauaaucuggcuuauacaaugccguauagaacauuucucuuaaaagaaauuggcuaaucaaguuuauuuguauuucuuccaaacaaaaaacuguuauuccaaaauugaaacugaauguguuuauucaguuuauucagaccagaaugauacaaugucauuccuuuauuggcaauaugacaguggcuaaaaaaaagucaugagacugcauaaccaguaacuguugcaugccuuuuauguucugauaaauacauaggggcauuguaacuaaauguguaguugauuagaaggguguaaugauugggacuguuuaguaauuacauggugaaugccauguaaccaagaauuaauucuguagcuuauagguuacauaguaauucacuagaugacuuaaugcguaauuauagcacaaauuauacauuuuagauaauacuuaguuaaauuuauuuuguguguauguguguuacaugaauuagacuccccccaccucccacgaucuaaaaguuaguucaaguuugaaucaucuucuuacauaguguacacuggcauuaugguaaucacgaauacaauuuuuaugcucacuuaauuagaacuuugcuuacucuugaagaugcaguuggcuuaugcgccuuuccuuucacugcagucuacccuguacugaacuguuacucaguacacaaugaggaagaauggucaucauuaccuuuucagcugugagaggauacgugugacugagaaguaaaacagucuuuauuccuaaaguguuaucugucggcguuuguuccugugaggggcuggaaaucggaacucugucagaugccuuuuaucccagaccucuaauucuuauugaccacccugaugugauuucagaggugccugcuguucucuuagaugaauuuaaagugaauucccuuugacauuuuaaguaaaugugaauauuuuaucauuauuacuguagaaaaggaaauguauuuauuuuuagcuaucaugccguaccuuuuccuuuagaguaauuuuaccuggaaagccacacagaaaccauaugaccuauuucucauuuuggcagguggcgauagugacgcuguguuucucuagcuucuucuuuguucaguggcacuuuauagucacauugcuuuaccaggcaucuuuuuuggauagcuauacaacaggcaaugaagaguccugaaaggcuuagagauacuuuauaucaacccuuguucuaaccaugcauuuuaaauuuucuuuagccaucucgugguguguuugaagaaaugaaguauuuggagcuuaugauuguuaaugaucacaagacgguaagaauagagaaucguagcugucuuaguuacuguucuauugcugugaagagacacuaugaccaaggcaacuuuuaaaagaaagcauuuaauuggggccuugcuuacagcuucagaggguaaguccaugaucccugugguggguagcaaaguacaggaguagcaggcaagcguggugcuagagcaguagagguugagacagguggaccgacacauagauagacagacagacagggagagaggaggggcuagcauggguucacccucagugacucauuucuuccaaauagcucauacauccuaguccuuccccagcaguuccuccagcuaaagaccaagcauucagagauaugagccgugggggccauucucaugcgaaccaccagcacagagagcuuguugaacaagaaaugcauuuuacuuugauugaacuauuguuuguaacuuaauaaaguccagauguuuagacacaaucauuuggugguucuaaaugagugccguguuucuagaugaagaagagacaguaacaauauggaauuuugacagcucuaaaauuaccucuuuaauagagauuuauaauggguagauuuaccaauaugaugcuuuucacuuguccauguuuaaaguccuugcucucuaccuuucacguuuguguguguggccacugguucaguauucuaucccaugcuuuugcgaugaaaaaaaaaaucacgcgugaggcucuggguuccauacccuggcacuucacauacaaacaaacaaaugaaacaucugucucaagagaccacguuaaaugagugguuucuuugacuaaauauugauaauacaaauaauguuguguuccacccaugggaguaauaggugcugcacuccagugaugcuuaagagaacuauggacagaaacaccauacucacuugugucuauucucugcuuagccacuuccauugucagcaccugagcauccuggcucaaggcugugcacuacugcacucaguucccgaggugugcugguaaccucucagauacacuucuccacugcuaacucaucucuggugugucaagcuacugaagugaccauuaacugaagcuccgcauggauguggccaagcgguucccuugagccuuuugcaucuggccccaccacggcgacauucccaaucucauucggcuagugauuauuuugucacaguuaugcaguuuaauucuaaacauugcucauugagaguaguugauuuuauggaaguagaguuguauuuuugaagacaccaugcuuaaaagucagauauggguaaaacccuuauaaaauauuagaauacaauauuaagcuucauuaaguccuuguuauuuuagggaaaucaaaguuagugaacuauaugauaaaguuguauuuuguacuaaauugacauuaugaaauuccauuuagcucaguuaucccagagaaauccuugaaacuguauauuacaaaagguuuaauguauauuuaaauuuucacuugagucuuuuuaauagauauuuaaacuaauuacuauuaguuacuaagcaaaaauucaguugugcugaaaauuauuuucucacccuguggaauucuuuuuauuuuuuuguagacagacuuaauuuucuguaucagcuuuuaaauaacuuucuuugagauauaaaaguaagaaggaacauggguuuuuggaaucacauauaacuuagaauuguucccugguaaggaaaaccaaauguucaggugucaacuugcgcuaaaaaaggcuuaaaucugaauuucugaaggguguugguggggcugucuucaucugaaccgcuuuucugacugagaauuuucuaacuacuuuccaaacccaaugauuguggcaaguuguggaauuaugucuuuaaaagccugagcguuuucuaacauccauuaaauaaaucuuguaauguauagauaacuguaucauaucuauacacaauauaugcauauguauauguguauauauguauguauacaacugcagagugcagcucuuccagaugagaaguugagaacauucuguuauuuacucuguguguguguguguguguguguaugugacagaguggaguaguagcacagacgagagcaggcacaggagauagugccacacuguacccaauugaacaaguaaugcaauagcaccauucucaaaaauauuguucucugcagagaaaaccuuauuugcuuauaccacauauuuugugauaaaaaucaucaucuuauuugggguacugugucuuuuaauuuaaguuguuuuaaacauguauuuaaacaccagucuauuauuguguguuuguguguaugauguguaugguuguaggcaugcguaguguggaggucagagguacugagacccuuguuucugcuaugcuguucucuaggcuagcuaguauucuaucuccauuucccaucugagcaucagggugcugggauugcaggcccacuucuggcuuuuuuuuuuuuuuaauauggguuuagacaauugaacugucgucagccuugccugacaaguacuuuuacccaccaaaccacucaccagcccacaucuucuaauuaaaaaagaaauccaaguuuuuaaaugaacagcguuugaguuuucauuucauuguaguauagggaaugaaaacugagcauauuuuaaugauaaauuuugggugguguuggacuuuaaaaaugcaaaugaacaaauaacaaaccuugauuuuuuuugaauggugauaaugccccagauagaacaaaacuaccagggaguuucuagcauuugaagaauauucuuuugggcuaauagcaguaaauaaucccuuugcuauaaaaccagauuacauccuguccuauagucaucccaaauaaauauucauuuuuaagacccccucauaggaguugagaaaagcccccuccccuuuuagguaaucuuuuuauuaaaugaaguuuuaaaauauuaucacugcaaagaugcaauaaaugacuagagagcagaauacugcaccucggagccgcaagcagacugagcuaggauaagugaaugcgucaauuuccagugucuggagauuugcugcugggcuuuagcauaaucaccccaccgaggagccccaucucgcgguguuuguacuguacgagccagcgggguuuuauaauucuuaccuuuggguugaaaauaagguucagcuuuaauuguuuucuaaagggcacauuucuuaaggggcucauuuauccaggaagugaaagccaauuugccggcuuaaauggaaaugguuuucagugaucagaaaaugugaagguaaguuuuaucauaaauggagcucgcacauuuuucuuuauuugccaaauuaguucucauucaugcaggaaauggaaacauuuugccuacauuugcauucgagcuucccucucuaauacuggccgccugaaaaauugcaccucucguguuuugaacaagcagcccaauuaucagaggcuuucaauuagaaagaaagaaagaaaaaaaaaacucucaaauuuguagaaagcgucuugguaccuagcuggcagaaccuaauuugugagcaauuauagcuugauaaaagucugcaaacauuucuuugagcugcuuaagcuaaaaauaaauauuaaaaacugccuaauaaaaaauugguugagauauuuuaaagugcauguaaagcaaguguuuugcuugcauugcugccgcguuauuaaauaugaaccaauaaggugcaaaucagcaaugacucaaauagguuuucaauuaaaaccucauuugguuuuccuuauuuaaaaaccacuguauuuuuuaauggacugaacaaauuacagauuuucaucaauaaucuugacuuguuggggagggcuauauaauaagcaauaguuuauaguuaucucauaagaauuauuaacugaauaaguuaauuucuucuucuagcccagaguaggacaaacuuugguuucagccccguaaucccagauaaguuauuugaggauaauagagcucccuucaugggguugugaggaguggauauuuguugugcgggggacauaguuucucauagauccugggugccgagugaguguuguuuucuuuguggggcuggaaacucaagauuuucugcuucuucagcaaguacucggucacgagcuuccuccccagccuccuucugcccuucguuuucucucuuaccaacacugaauacagaugacggucgucaucaucaucaucaugaucauuugaaaccaguuuucaucacuucugguuucuucgacccaauaauuccucucucucucucucucucucucucucucucucucucucucucucucucucucucuccuauuauaguuguuuaauaucugaccccuuagaucauguuugggaacuuggcucagggcucugucgcaugcucucuuccugauugacagcuuccaguuucaagcucuaaguaggaucaugacuuaagaucucugagccccuacuuuagagcuuuagacuucugaguuucauccugugaccuuggugucuuuucuuugguacugaagagacagcucacguuugguaccucuaaaucacaguucaaaguuacugggcugguuccaaagugcuuuuggaaauucauguguuaggaacuguucucgaauucacaugguggugguauucagagauagggacucugagaaggaucuaggauuauugaagaggaaaaaacaaaacaaaacaugauuuuuauuguguauuaaauauucuuaaucuuucugaaagauacaagugauuuaauaaguacaguugaaaaccaguuucacauuaugaacuaaccaguaccccggaacucuugucucuagcugcauauguaucagaagauggccuagucggucaucacuggaaagagaggcccauuggacacgcaaacuuuauaugccccaguacaggggaacgccagggccaaaaagggggagugggcggguaggggaguggggguggguggguaugggggacuuuugguauagcauuggaaauguaaaugagcuaaauaccuaauaaaaaauggaaaaaaaaaaagaaaaccaguuucaagcacaugguacgaaagagucaccaguuuaaaccaugcuuuucuuuuaccuaaugguuguagaaagaacaauagccucauggagcaguccagagcaugggguuccuaccgcugacuuaagcugucaaauguuuccuccuccuccuccuccuccuccucaauguauguugaguaaaguaucugacuccuuaguggggaguugcguccaaugguagugcacucgcuguacagugguggaguaugaagucucagacuguugacuccuccaaacagcaacuucucccaaccccaaacaaaugucccuagauguuuuguucuguucuugagauuucuuuuguacagguccuuaacucuugggcucaagggagucuccuacccaguuucccaagcucugggauuauagaagcccaccacaguuccagguugacauacagaaugauuuucuuaaauaguuuuacacuauuauuguuugcauacuuccuuuucuuuuuugccucaucuuuggcuuugguuaucuagaauaaaggcuuguucuaggaguggcauccucugugggaaauuuacuaaaagcagaacaaauacuccccgucauggacaaggcuacaugaagcgcugcaugauaggaaauggcuuugacuugugcuugaccuugagguuaaaguaagaaaguuguucagaggagacuaguuuuuggucuaagcccuuuguaaaugguaaagauucauuuuuaugaaugcaaaagaaccgaauaguagcuguuaagacugaauuaaaaguugacuucgagggacagaguuucuguguauacaacuauaggcuccuucagaccaugggacauguuuuacaauuuuucugccuggguuugugugguaagaaaagaaaaaaaauaaccaaccaacaaacaaaagccaaaacagcaucacuguguccagcuuggcacaaaccaguuucugaucuuuugagccauauuucuagcauuucuguuuaauauggaaucuuugacauugaggacaguaagaacuuggaagugacugguccaucuucucuuaccccccaguauaagaagcaccgcucuucucacgcgcauaccaacaacuucgcaaagucuguggucaaccuuguagauucuguaaguagccugguuuccuugaaacuucuuuucacuaauccaaaaagcaugguucauaucucuuucccuaugcucagugauaauguuggcuauuucuuggaugaaaugaaaacaauguauucauacgucccccuggcgaagaaacuguuggauggagggagagcuuuguaagaaagugcugucugggcuucagaauucucagacuucccaagaagcuuuggcauuguuucuuucuucuaagcauauugacuuucauuaauuaucauuuuaauuccacguaucuguggggugcagugauauaauuugauacauguguacaguaucuaaugagcaaaucagaguagcuagcaucgccaccuccuuaaacagugagaaauuuuuauuaacccacaguaauuguauagcauugccucgguuauuaccagaguccgugggggacaaagugcagcggagaaagaccgugaagccuggaaauuauccucagucaaugaggcuuuauuaauaacuacuugagcuuuuccuaaauauuuuugcguaaguagagaaguccuaauggauugaggcagcguguguuaagaggguuuagauagauggaaaucuccagacuguggauuuauuaucuuaguucucccaggguggaaugucucagacuuacuuucuaguauucuagaugauaaaauuaggugucauugccacacagaaugacuugggacaaugaaauggcuccuuccuucagagggguguggcccuacguguccucacuacugaugggcuuuccccucgugccauuucauaaauuccagagaaugaccgauuagauuuucuucauguucccugccuuagguugcaacaacccagagcugaguuucauacauuauauuccaauaaauaauuaauugaguugcauaaauuaauuuauauauucugaugugaagugcuacuuuguuaagcuaaauguauuuuuuaucuuguauuuauuguauggugccucuugacuguggaaaaaaaucuuuuuuuuuuaauaaauugccaagcaucuaaaugcuacucacucugaagaucugccuuuuaaacagccccaaaccacccgucauguaaauauucauaacauauuuugugcaccuagcauauguuaugugccucauaggcacagcugacaaaauuguaauaugaguugaugugcauagaauauguaauauaaaauuaagguugaaccccugagagccgguuuacaucugccuuauuacuuuucuuuaauuucagcccuugucaaucugcucacaggaaaccuauaacuggauauggaaaagagaaucuuaaacacauauucuccccugcaaaagcuauuuauuaggcagcaucucugcauuagucauuuuuuuuuacgugauugaauaaaaucauacuuugcaaaauuuaauuuuuaguuuauguuauacuuauaaaauccuggagcugaucguccauugcagaaauauauuauacuuagcucauuuuuguguaaagacauuauagcuucaauuugaugcuaauuucuuuauugacugucuucaaagaccauucauuuauuuucuuagauaguuuaaaagcggggcaacuuggcagcucuccuugaaguugcuuaauucugugaguuauugauuugguccaaaguauugagaacagaagaauaacaagaugugaauugagugaugccacucggaagugagagugagauuggugccucagaucugugcccccagcccccgcacuuggccucagcucugugauucucucugagaguuauuauauuguguagcaaggcaacuauacuguuugaugaacugucccaagccugcagguuauauuacacuuagagucucugugucaggcuccgguuugucaucuccucugggguuuggaaagguuauuuugcugggcccuguugacagugcagguccugacuugaguaccuugacgucccuacauucucauaauaugccaggcaacugaaaauucugagcugaggguggagacaaucucuuuaaggagaguagagaauacagaguugugugauuuuuuuuuuccuucguuauuuuggcucuuggaaaagagaaagcggaagccgauucuguaugauuagcuaauucugaccccauguucucuccccucccccaccucccuuccgcugacugacucacugauugugcauguuugacccaguguuugccuccugcaccuguccuguuguauacccccagauuuacaaggaacagcucaacaccaggguuguccugguggcugucgagaccuggaccgagaaggaucacauugacaucaccaucaaccccgugcagaugcuacaugacuucuccaaguaccggcagcgaaucaaacagcacgcugacgcgguccaccucaucucguacgugcuccuucaggcucuuacugcaguuuggcucgacguuuaucuuccuuauuguauccguuagcccccauacagggggcagugacuucugcaaaguugcuguugcucuccuucuggguuuauggaaguagaauuccagggcugggaggcuugcuugguucaguggccuucagcucuacuguccaagcacagagcagcuauccuuaaggucaaagcacaacccaaggugccccugguacuguugccuucucuacaggcagcaggagggccuggcuuggagagaggcaagagggugcuccuucuauaaggacagcaucuguaaaccagguuucuugaaagcuuguguguguuuccuucgaacauguuggcuagaucauugucaugugagcacaccuagcuguaggacgucuagaaaacaccuuuuuuuagacaacuacugaaugcagguguguuucugucacuaaggaagagauucauccucucuucccacucuuccuccuccccacucauggccguuuuuucaucuuccacuaugguucuguccugcaauccaaccaagcaacaccuucccucuuucugucuuacuuuugccuguugcccaccuccucuuucagcuuuuaucaauuuauaauaaucagcaauagauauucuuuaguagaaaaagagucaauguguuuauaacagcauagauggaaaucuauuuaaauacagguuuguuuguuuuuauuuccgguugggagugacuuuuagggugugggagaauucauguuuuaggaguguguaugugguguuuccugacaguaccuuauuuucuuaaggcgcgugacauuccauuauaagagaagcagucugaguuacuuuggaggcguguguucucgaauaagagggguuggugugaaugagguaaguuucaugauuucuguaacuagagcuccgucuuugcaacuaacuucauucuucauuaaggccccguguauaacuguucucccacaagucuucaacaaugacuuuagggauguaguaaugugagugguucagaucaguaaauggagcccugaguucauacugacagcuuuguauaccaccauggaaguuuuguacucuaaugguacaaacauuaccugaaaauugguucagagauuuuuaggucucuaguugagauguuaaguguuuaucaacuuaucaauccuuuuuccugugacucuuuuuuuuuuuaauuuuuaaugcuuucuuguuuagaauuagcucauuuaaauaaaaguuuuauagauuauauuuugucuuccuauauaaauuuucauuuuuaugucuucuacuuaagcuugguauggauuaaaacaaauguuuuuauagaaccauuguuuggguaccuuuaucacaaaaauuuuuaauugaaagaagcacuccaaagcccagccaacuguuucaaaauccuggcaagcacugggauaggucuuauucggcagucucacuucagaaugcuuuuagguacugggagaucuuucuuucuuucuuucuuuuuuuuuuuuagguauuuuccucguuuacauuuucaaugcuaucccaaaggucccccauacccaccccccaauccccuacccacccacuccccccuuuuuggcccuggcguuccccuguacuggggcauauaaaguuugcaaguccaaugggccucucuuugcagugauggccgacuaggccaucuuuugauacauaugcagcuagagacaagagcucccggguacugguuaguucauauuguuguucuaccuauaggguugcaguucccauuagcuccuuggguaauuucucuagcuccuccauugggggccgugugacccauccaauagcugacugugaucuuucuugacauauuugaauauguugaguuggagcacagucuuagucacuuuuacuuucuguucccaugugaaaacuuccuguucugaaagaugcuuguggggcacagucucaagggagaaaugauuugaaggguguacaccaucuauagauguuuuaaggcucuccuaaggagcuugaaaugagauugauaacaaugaagaaguaauaacuggcuuuguucuacucucucaaauguuucccaaacauuuucaacucugaaaacccaguauggucuuccaauggcgguggcacaaguauuaucacagagccuggcucaaaaccuuggaauccagugggaaccuucgagcaggaagccaaguauguacacugacuucuuacuccaguccccuugucguucuguguguauuacgcaugcccagucaccgagaauacuuuauuuccaugccaccgugguuuaaucauagugcaucucaugcuucaaaaaauaaucuugaacauuuugagaucauuauuaggcuaucugaggggaauacauuucucuuucaaaauucauaagcuuauccuccgucagcucuaucuuacauagagaacguugggacgagguggggugguagugguaugcauauauucuccagagauuuaaucauuugagcauagacacaaaaugacagauacagcucuguggagagaugaucagauauauagugcauugggaaugagaucuacagcauacaaggagcucauauuuaaaugcuaaccacacucacccacaaggucauaucuagaaggugagcuccugucuccccuaagcaaagccugccucuggcccuuuaagcuucaaaugcgugggcacaggacacaauuguccucuggugcagguagguccaagaggagcucauccauggccccugacccauguggcaucaaaguaaggcaagggacuguugaggccacuguuuccauugaacagaugagagaaggaaggauaggacuaacuuuucaagugggcugaggacugagggaacgucagauauuuagaagcccauggaaauaucugguucguuuuaaaaucaggauaaaguccauaucucauuuauuuuaaaaucaggauaaaauccaacccaaauuuuaguccccuuuguaugagcaccguggucaaauauaaucuugguacauuuuugugguagaaggcaaagcaucacaaugggaccugguggagaaaaagagcagcacguucauccauuguucauuuaaugagaaaauaagcugaaauccucacucucucauuauauaucguccugagagcgaggagaaaaaaacccucucuucccacccaggccuucccagagaagaaaagaaaagugcauuaucucacaugcugucuucuaugugacugauagguaguacuguggagaaguggaaggacacccgcauccauacuccugagucccuuuaugucauuaaggaccaaguacacacagucaugacaagcacccagcaacagucuccuagucuccacaaacuuucauuuacuaaaaucuugcucagacuaugugcuuucucaaggaaguagccaccucacuuuaaaguuucagaaacugacccagauagcucagacucgggaagaagaacauuggguuccguaacuuaguuaaaaguccuggaggccagugcuggggucagcugagcuguuauuggacugaauggugaaguagacugggaugagauuguugcacuucucuggcugauccuagcccugacuccagcaaauugaauuuuauucuuuagcugcccugugucugaaggacuucagugacauugugcuguauucauacagacugucugggaaugccaucuaucuguuugagcccuaaagccaugcugggagauagguagacaucacuuccauucuaaagcagacacccugccccuccccuuccccccccccccucaaaaaaagcugagugucuucucuaugggacucucuccuugauuaaaagauggacuagaauucaucuuuuuguuucuagccaaugguacuucuaacuaaacauugaauuuuagaaaucuaaucaagguaacugaguaacaaaaaugaagagaggaccaagguuguuuucccccuuaggaagcaaucuauacuccaggcauaagaacccaugaacuaaaggaaauagaggagucuugacacucuguauugaggaaguuuugcaagaacuggugcaaacugaagcugugacuuugucuccccucacccccuuuguuguucuuguuucauugagcuagaaugugaaugcauagaguccuggggcggcugcaucauggaagaaacaggguaagucugcauuacucuugcaugugauguaugcccaaugcaaaaauggcugcauauauagucauuagagacacagccucucagguacuggucuuuuaggcuaagcacuuaguauaaauucaauaauuaauugucugauauuuuaaaacugacagugcuaauucacuuuauguuuuaauuuuuaauuuaagguuggggagaaaagugaaauguauuagcuacuuguauuuauuaacccuuacaggaaucacaugacuaaaagcuucugcguuugguaguggcauuaaucuuuuaauauacuuagaauaaaagcagauggucuaccugaagcagccagugaaaaucaauucagucauccauuuacauuuuaaggaacuuauaaaugcuaguuuaugguaauaaauuuguagcauauuguuuguagagucgacagaguuuuguuuuuuuuuuuaaauaauucagaguuauaaugccuaaacagaagaguugccaagugguagacaagcaccauuacuuuacuugucuuuccuuggugggcacuugugcaacuggaccagcuguccaguagcacucguggccugagaccuggcaccacugcuguuuccaggagacucccacacuauguaggccauugccaguaggcaucauaguaguggcgagaauuuucuuucuuacugucuuugcuuaggccagacacugggaauuuuuuguccuaccauuguucugcacugaugccaacgaaaccaucuccuucccugggggcccuuccuucuucuuccauagagaggaaaaaguuuaugcaauuaacuguuaccccuucgaugccagagcauauuccuugaaaugcagucuaaccuugaaaugcuugccuuuuccggccauauuauuugugcuccacaguugaguucuuuaugaugaugcaggcuuaauaggucccauagcaaagacgccauauauauguugcuuuuguaugacaauauuauugccuuuuaaauugucaauuucuaagugaguuuuggauugaauauuuauaggaugcaauaaacuauuugaagcuaauguauauuuucucaaagauauauuugguauacuucuuguaagacauugcugucaauagaggugaauuuuaauucugcacauacccucauacauaaaacuauugcauuauauccuagaauggccuauugcagacauucccugggaacuaauguguaugauuuagcuuaaccucgucguguguaugauaguccccugugugcugacauaggggucuuaauuugauugaauaaaucacagagagguucauuuuuuauucaugcuaaaucaugaauauugcucaauaauuguauuugaaaugaagaauaaagagccauugcucacgggagcaucccuuaauucuuuuuugcugugggcauacacacuaauaacauaugcauguaugauccagcaugaucccacacauccuucaggguuuauucauuuacuuacauuuuggcuuguugaagccugaguaacacugucuuuaauaaacugaccuuccagccucuucucugaaaagaagguuuaguaggcugcuggacccccuuuauucagaacagaguaaaggaaagugagguugccucuauugagacacaguaaauaaaaauaaucaagcuuuaaaaccuagucuugauuuaagauuuuguagcaaaccuuuuaaacgauggguuucgagacagaccaggcagggggucgguagcuugggagugaccaaucuccuagucugugaagguuuucauuuuccuuucuccuauagacuccaccccguagauguagcagcuuguacccaagcaucuuaccaaauauuugugcugauccaucuacauccaggaugaacuuucagugguuuuuaauuuucuucucugaugauggcuuuugugaauuuuuuuuuuuuuuuuuuacauaauugguuccuuguuucuucagggugucccacucucgaaaguucucaaagugcagcauuuuggaguacagagacuuuuuacagagagguggcggagcaugucuuuucaauaggccaacuaagguuagugacuugauuuuccaauaguaaggauauggcaaacaucagagacuguucucagaaagcaagucucaugucacacaguucacuacauugcuacaagcucccuuccucagcuucccagacacugcaaguucagguaggagccacuaaacccaacugauagaugcucaguuauagagagccgcugcaugcucaagagaccaaauugagugucaguguucagugcucgcuugcaguucccuaaaacgcaaaauucuacagaauuucauguugguguuuucauuuuucugcuaagacauagggagucagaauggaaagaacuuuuccuuggaucacuucuuugcuaagucucauuuaaccuuggcauuccuucuggagacuuaguuuucuccucccgaaaguuucuccuaccauccagcuccaacuccuccacucucuggggugaucuggucccaggcagaaagcauuacugaugucagccaagcaaaaaguggucuuggucuaacauuugcaaguucuauaaauaccucaaguauuucuacuacauaguucccuuccucuggaagcccacgcuggcaauggcguuucauaagaguauguauaaacaaaauugcaauuccucaagcacaaacuuaaagaaaauuauacauuuccagaagagauuuuuaggaguuuucagaaaacacauuugacaguaaaauuaaauuuugaaaaucuucuuuuggcccucaugauauaaauauuuauuucuugcuguaagaagcaugaaauuguuugauuauaagauaugcuccaguucccuugacauagaacacaaccaaucaucacacuuuccuaaaguucagcaaaggcagcauucuccagcugacaggcuaacgcuuuugcagaaggcgcuguguuuuuauaggagcauguuuggaaaugaagcaggccagcaguugaaaagacagaacuggcauuauuagcagaugguauuggaauuugaccaugggaaaaaauucacuuuucuuuuagaauaacaccucacaugucagauagaguucauuuguauagagaauguucgauacucugcaaauuuaaagaguggcaauauuguguugaccuugucuuuaaaaaaaaaucagucaccaaggcaaacaacggauagacugauuuauuucauacucacaagugagugauacagcuagugucggaaugacugcuuggaaccugacaucccugagaaaucucaguaaagccaaagcgcuguaaaucucaagagaacugagacguuaaaagugacugugcaccauuaaaauaggcugcucggucuuuccuggcagugaccucugggcauagaaaccagaagucuugaaggcaucugaaaugagugagcuguguaaugaagaacuccugugaacugcuggcaguuuugaauuacauggagcacggcuaguguuaccuugcccugcaacuggcagccaguuguaagcacugugcuucaggagacagcucuagcuuguuuggagagguuaaggucucuggaauauacacuucucagauuaccuguaaacaggaagaaaauuauccugguaacuugggaauuucacaccaaaaaacuauguuuacauauucaaucucagaaguuagauacaggacaauuucuccuuuuaaacuacaaauuacaaugaucaaaaaagaaggcuucaugaauuccaguagaguagcuuguauguauauaacuaauuuuuuauccccaguguucuuagucaaugaauauaugcauaggcaaguguugcuuguuauuuuccauugauaugcauauuuucucugcuucagaaaucuucccaguugcugugauuuacaucuguuuugagauagugaccaaacucaggaaggggaaagaacccaagaacuaaagccugguaccaaguguuggccaucuuucuacugcccugccuuuuucugcauucucuugccugccagucaaaggagcauggagauuaauuagcacuacugacucccacccaacucggcuagaacauuuccuuacuucuuauaauaguucuuuccuggaaguaguagaagcaagucuuucuuguguagacucagugguagaugacuguugcccauaguguauguggcuacuggaggcaagcuuuuucucugaaguucauggcucugagcaucuguguugaggugugcuauuccagacucucuccuuauaccccacacacccagaagugauaaucauuccaggaaaguccugucccagccaauaggauauagacacuuuugaugugaguaagcaacuuucucaucgauccaucuauaguauuauuauccagaaacaaguucauggcaccaugagggggggauauucuagaaacuucuucugcuaugagugcagcaaugacugagagauuucuauugauucacauggcuauacauuaacuuaacauacuuaguuuuuuucuuuaugaguauuaagagauuggguauuugcauauaguuaauuuauugaaauuccuaaguuauugaauuaauuuucuuucuacucacagauaauucaaggaaugcaauggugggacuuugugccagacaaugcagauuucuuuccaaugagugggauagauuugagucucugacaacauuguucuaagcuuauuggcauuuccuuaguuguacaucacacauuugguuuugacuaaacauauuuaucuuucugacaguuuggaugucuucuuggcugccuuuagucaagucagcaaauuagauaucuaugagucuuauuacuaauacauuuuagcuccauuagaaaacaugggaagcgaucuauuuuucuugacagcuuaacuccauagucaaucuaaugcuggaagguugucucucaagaccccaccaaggaaauccccagagauaccacauccuuucuaagaugauuuuaaagaguguuauuaauaagcaaauaguagaucacuuauuauaugaugacucaucaguuaagagaacuugcuguucuuucggaauaguggaguuuggcucccugcacugacacuaggcagcuuauaacuauuuguagcuguaguuccaagcaauccaauguuacuuucugaccucuccaacuacccacgugugugugugugugugugcauauacuuacauagguacacacagaacacacaaguaaaaaugaauauaaaguaauaaucacagaagauucauaugauacagccauguauauggccagcuugauguauagguuuucugcaauaaauucaaaugcuuuucucugcauucuccauucucuuucagcuguuugagcccacggaauguggaaauggauauguggaggccggggaggaaugcgacugugguuuccaugugguagguauaagagacugucucuacuuuuagcucaguucauccuccaagcuaagaagaacaacagcggagaacagacauguuauccuucauuguggggucacugccuucuuuuuuuuuccugauugcuaugaucaaugcuuugucccagcucagacacauaagaauuugucauguuguuguugcagccgugucugaaaagcuuaauggauuguucuaaucaaauuccugaccuuuaaaaaguuaauucagagcucauauccaucucaggcaccuuguacagaaucaugagcauuucccaugccgcauuuauuuuuuuuccuuuaugagauaaaaccuggguauuaagaacaugguauaguuacagaggcuugugugggggugccuguuaaugaauaaucauacucuugggagaucacucugcugagaaacauggcaggagucugucaucauuugaagugauugguuucucuaaaauguuaguguacugauuauagaacucuugucaucugaugcauaaacugcacauggagggaauacugaugggcagugguauguuccugguuuacucaauggaguguuuucucuaggaaugcuauggaguuugcuguaagaaguguucgcucuccaauggggcccacugcagugacggccccugcuguaacaacaccucaugucuugugaguccccuggaaguuucauguuucuuuucauuccuugacaaguuagccagccgugucaggaugucuguugagcuuuugagugucuugauacacauuuaugcauguuagcucagugauacugguaauuuuauugaacuuuuguggaccacagcaugugucuauucacugucuacuuucucauccucccaggccuccucaagaggguguacccacaccuacagccuccaaacuagacaaguuacccuguuaacacagacaaacagauuaaaucauaggacaaaagaggaaaaauucuguuggucuuuaaauugaacaaccuauuuccaacauucauuuuuuaaaacuuacccuaauuuguuuuagacacguaguauaaaaacuagaacuuauaucucccacuuggcuuuuugaaucucauaaugucaagaaagcgaggugaggcaguacuuacauugucacaugugugcauguguguaugugugugcuugcauguggggugugugugugucuguguguguguguguguguguguguauguguguguguguaguuuuucaccuucaguaacugacaguucuuuuccaaaaguuauuaccccuuuaucucauauguuagaucuaugacauuucaagucgcuauaaaaacuacaugauuuuauugcuuuuuuuuucaguaccaagggagguucuacaucaugauauuauaagagauuucagcuuaauuugugcuugccucauauuacauaccaaaugauaaauugcuugaggcuaaugagacuucauauuuugcccauccuuugccagacaaaccaaauguuuuguucaucacaggcagccauggaugccucugaaguugauuuauaugaauucauuguaauuuuguuguauguauuuaucuaaagcacgauuaauauucaaacuaauggacaaauuaguuaugguugguuauauguguguguguguguauguauauccuuuagagaaaucuucaauguuuaaugacauuuuuuuuugucccuuuguguuaaacuaaaccaguguuucuucuuuacauaaauuucaucaccucgcuuucuuaccucaguuuguggagacaguggauuuuacaaucuacauacauagugccuguuugaugcuuaccucagugugggaugagcagcugagccucauuucuuuuuuuuuuuuuuccuuuucuuuuuucuuuuugguuuuucugagacaggguuuuucuguguagcccuggcuguccuggaacucacucuguagaccaggcuggccuugaacucagaaauccgccugccucugucucccaagugcuuggauuaaaggugugcgccaccacugccuggucugagccucauuucuaaccugugauaguuuuacaaauuuagaagcaagggauggggauuaugauaaagcccaggcuuguggguagaugcagggauggcagcguuguugacuauggugaauguuaccuccuaaugcuggguuuugauuuauaguuucagucacgaggguaugaaugucgggaugccguaaacagcugugauaucaccgaguacugcacuggagacucuggccagguauggaaaaccacauuguaucuuuuauauugugcaagacauguuuuaaauccuucaauaaagacugugaguauagaccuauuuuaguuucuuuauuguagauuuguuuucuagauauuucuagcucucuaccaaacuauuacuucaggaaguuuucuaucguauuuugggauuuucaucuuuaucucuccuuuuuuuuuuuucuaaauuccacuuucauaaauaucuuuagaugauuuauauucaauucauaaaauuuuucuccuuagguccccacaucuuacaugcuguuuucaaacauuuugaacaauuuaaaauuuuggaagggagcugagguaggagacugggagcaagcagacccgccauggcugggagcagaaggccagguuucuccaccacugccgcagucccugccucucgccucugugcuuuggcaggauuuugguccauuaaaaugauuauaauccuguaauuaauauugacuucuugacuccauauuuguauaauuuuagugcuuuuuauuuauagcauguuauuuuauggcccuauuugccacucaaaugaacaucuguugaguuacuugccaagugcugauguaaaugccaggauauguacauauguauauaugcauauguauauauacauacauguguauuuauauauacuauguaaaauauguauguguauacauaaauacauacauguauauauacauauauuuuuucauacuuauaugauaaaauaagguacuguggaaagaaaaaugugguagaauauuagguugggauaguugcuguggaaggaguuaguuucuaagcaggaagcauagaggcaugguuucuucaagauguggaaugaaagcaggcagaaaggaggacaguagaaaagguucaaaggaugucaggaugcuggcaagaggaccuguaugccccaguaaggauuugggauuucauuugacuuuuguuuucuuuuugaugugucuucagaagguuuuccuguguuacuaucuuguuuugugaugguauagugcaaauuuaucaguugauuucuuuuuacccagucauuauccauuagauuucaguauuuuuuuuauuguuuuaucaguauagauguaaagacuuucaugcauuuggaggaauaucucuccugcaggguuaucucuguaggauauguucccaggacuggacuugccaacugcaagguagacugguguccacuggggucaugaagaacauggugcauccuuuucaagccaaaagaucaugcuauaaaaacaaaaaugagcagcuugaguuauagccuuaacuuaauacaagggccacaugugucuuguaagagauccugguucaaacaguagcagguuacuggcacaauugguuucagcauggcuuccuugcagagacaagccccuugauagcgauagccugaagacauacuggacagugcuugcuucccacccacacuagacucucuggcucagaaugccuaauuauucuucaucagcuuaucacccaaucaguucagugacgggagagcagagugcuuggcauugcacggaacugcuggaagagaacaugagaagagaaaaagaaaagauguguuaauuaaccuucaggaaggucuuuguguuauuacccauggcucuguuaaugauagagcacauggaaauguguccugacuuuauuuauaugucacucuugugcauauguuucucauauuuaaguauguaaauagauuucuuuguaaugacagaguacaagaauuguggauucugucuuucauaaguauauauauucugauauaccauuugacugucacuuuuauaggauaguauuauuuuuuuaaaacuacaauauauguccuuggcucucauguuuagcuguuuuuuaaaaauauagguuuccauuucaaaaucuaauuccugaauugcuuuggagucugauggaaauaggcuuugaaaguggagauauuggggcuggggagaaagcucaguggauaaaguguuugcaauccaaaccuuaggaccugaguuuggauccccaacauccccaugaaagccagauguaguggcuggcacgugccuguaaugcaggcaugggagacagagacaagagaauuucugggcaguuagucuaguuaauuggugaauuuccgguucaaugagagacccugucucaaaacauagguauggagagucauaagaagauauacaauaucaaccucugauacccauaggcacacauagaucauacccucauacccucauacauauacucacacagauauaauauauauguauauacacacacugcauauacacugcacauacaccacucauacacacucauauacauacacaauauauauguauauauguauauguauauguauauauguauauauauauauauauauauguauguauucauauacacuacacagaccuacagaaaauacauaaaauaggggcucuuuccucaaccuauuuuauugucuaagaaaugcaguuauuuuucuuuuuacuucaugugucuuugguaaaaauuguauuguuauucuuucaguggcacauuagaauaaaaugcuauuuuauuaauaauuuaaaauguaaaaaaauaaaauaaaaaugugaucaucagaauaagcucauaguagauaguugaaguaaaaggaccuaaaauccauaauuuuuccuucuauuuuguaagggacaaggaaguuugacuuuauugauauucagaguuuuuauggaaauagaacccuacaucccugagaaucaugauccaccuggcuacauuacacccuuauccuuuuacuucauguuuuuaguugauuuuuauauuagcauuuacugauaucucugaacacuggucuucuuuucuuuauuuaaacacaacaaaauaaaauauaauaagaaaaaaaaaacaaaaaccaucauauugaaauuggacaagaucagcuaacagaaaaauaaaagauccccgacagaagggacaagacucacucauucacacauuuaggggucuuuaauggugcuaaacugaaagcuacaguauccacagaggauuugcugcagacccugacaggcccugcagcugcuauuccagucucugaguucauaugagcuuuguucaguuguuccguaggguccuguuuuccuggugucuuucguccccucuguuugaaagccgugaaaguggccuuggugagcacuggaaauuaaugguggauuccacaacuuaaaauaggcaccaccgaaauggcuucaccgaaucuuccugcacggcaucggcauccccgugaacccaggagcagugguguucagauaccacagaccaucacuuuacacggagagggcccagauuuguuccaguucugaagauccuuagaggaauuuuagaaccucugcgggauuuccccauuaaacacugcacugauuagcaccuagccuuaauaaguauucauuuguuuguuuguuuguuuguuuacuuuuaaggcauggccuuacuuugcaggccugccuggcuauaauccuuccaccacagccuccugacuguuaguuaggauuccaagugucccaauuacuuuucuauagcugccacaagcgccaugacugaaacaacuuauaaaagaccuaaacaguuuuaccaacuggggacuaaagcauuuaaauauaugcacuugcagggggcauuuucauucagaucagcaccgcaggugugcauggaccacaucugacuaacaacuggcuuuguuuagccuaaacuaaaaccagauugacuagaaaucacugcacauguaccugugacaguuuauaaugagggaugagggauauauauauaucuauaucuauauauauaucuauaucccucauauauauccauauauauauauauauauauauauccuuauauauacauguguguguauauauauauguguguguguguguguguguguguguguguguguguguguguguguguguauagucagcaaagcagucuccuuuuuccccuuccuucuuaagacaucacaaaagugauuugcuucuucuaggaggccccagcccucauuucuauuuauucugguuuuacugguuuuaggguaagugaauacuuuaugauaguugauuaaugagauaaugauccagaaagauggaagaggcccggggaucucucuugugugguuugcuuacugucaauuguugcaucccuggaagacacaggaccagguagugaagagcuguggugacugcaucugaaaggggcuucagccuuuaggaagaagaugcagaaccaacauuuuauugcucuguccuguagugugucacagcuccugaggaaagcugcaugcauccuucaucuuucuugugaugagcucaauaaauggccccaugccugcagcauaaaauaacuucauuuuaccaguaugggugauccauucauuuucugagucagcuaguaguaauugaacacccaccacauccugguguuguuuugugcagcaggaagccagagagaaaacccggccugcauggagcucacauaaucaugggggcagaagcaaacaaacuagggaaauauauggguugucagguggugguaagugcaguggagaaggggaaauguagaaaaugaggagcugccacucuaaagaaagugguuagagaagcuuugagagggugagaguugagcaaaaucccuaaagagaagaugggaugagcccagcaggcaguggccuggcaucucagggaaucacagcagccauugagagaguuggaaauggggccagcuaggugaugggguguggaugggagaagcaguucacaugaaacuuggaaggcuauucagaauuuuuugggcaggggaccaacaugaucugguguucauauuuuuacggaucucucuggggacagggaaacaggguggaagcagggaaguuuggaucggagauuaccggccagguuuauaauguuggcagccuagaccugggguuaaaugguagaaacugaggaaaagaauugacauuuugaaaugaaucugagaauuugcagucauaauggaucuugugugugagacaaaaagacaaaugaaacacagaugaagaagaacggagcacugguuugggaacugagauguuggguugaaaagacauuugcugagaaaauggcaaaugggagggacaucagugaauguccuuaagcuuccuucuccuugucccauggauauuuuucuuucauauucacuuucaaccuuauggccccugaccuuuaucccacucucuuaaauguuuaaaaagugcaacuggaguuauucuggaaaacuucuggagaaaaugaaguguacuuuaaaauggucucauagauggauugguugaaacagcagcagcagcagcagcaaguccuacuucacagauuauucuaguaacaagucuggcuggagaggucagagggauacugcacuuacacugauuacauugugcuucaagacuguuucucuugcuuuugcagcaaugucccauaggcacaugucauaaugucacaugcagauuugacauuuacaaggagcugcacaaguugcaaauuaguucuuaauguguccacuccuccgcagcgaacugauuucuucucuuugcugcccguuuuaggcccuucugcuuguagcuccuugacaaaugaacauuacuugcuaucgagcccaucuccugguaaacagaaaaacauaaaaagaauuaacuguguuagacuuuauucauuaaugauagagucaaauuaaguaauccauuaauggcauuaaauguguuuuuccgaauguuccuaauuguacauuuacucucucucucuuguauuauuauauuaaacacauuuucugaauuuuuuaugcauuuguacaucaacuaaaaagauaauauuuuucagugcccaccgaaccuccauaaacaagauggcuauagcugcaaucaaaaucagguaagcagggcucuaagauuucaaggcaauuuagaagggauuagugucauuucccccaccccacuuuccauacauguaacuugggaagaaaguuuacugaaguaaauugcagucgggugcuggcuuccaucagcuuuauuuccuugcaaauauuacaucugucuaaccagcgacagguuguccagauugaaggaaaaggagaaggccacaauggcugaggaaacgaggggucucauuugcugaguuguaaccauccuuaaauaauuucagcuugucuauuuaguaaaaaauaaauaaaaaauaaaaaaauaaagacaauauuuuacaagccuuuucccaagucaguauuacuauccucagcauucacguauaagaguagcuaagucauuuuguucucacuuucacaaugguacaauuuuuuguuccccaugaaaauuuaaguuucaagauuuauuuuacauuuaaaaagacaugcugugcugugugcccagagcuuuacauuuuaaugugguagagcuucuacuucuuugauaacuuuauguuucuuauuggccacugugaaaaggcuugcuuguggaaugaggagaacuuuguguaacucacccagagcaggacuuuguugucagauuuuggggacaauggccccgugcccugugacucacaauguguguguucuuucucucagggucgcugcuacaauggcgagugcaagacaagggacaaucaaugccaguacaucugggggacaaguagguggcaucuucuggccugauggccacacacaguuucuuuccgugguucugugcuuccagucugugacagagauacauagcaugaagugaugugaaagaaaaguccagcaaaggaggagaguaaagagauggcauaaacguuaggcacaggccugcagggguagugcagggguagcaggcuuuggguucaauucccaauacaccucaaauaaagcugugaacgcaaaggccaugggaacagauauccaagugagaaauugucauggaaacugaauugccuuucauugaccauggcuguuaaauacggagugcugcagcuaccugagacaacaggguugagugcccugguuauagccauagcugugccauagccauaacggucuggccacuugcauaauugcauaguuuacuuuguaccuuucuguuuuaucuuguaugaguagcaggcaugguuuuuguuuuugaggguuuuguuuguuuguuuguuuguuuggguuuuuuuuuuugguuuuguucuguuuuguuuuugaggguguuuuguuuguuuugguucuuuuguuuuuguuuuuguuuuguuuugguugucuguaauucagugucagugauaauaugcaggaauuucuuugguagcaggcaggaucaugguaacgaauuucagacccugccuaaaaguuaauacacauaucuacugacugagauuaacagugaucuucauuucaguucaugaggaccauauaugaauugaccuacuuugcuuuaugauaaaaaaaaaacacugauauaacuaacauuggggaggaaaagacuuauuugguuuauaccugcauaucgcacuccaucaugaggaaaaugagggcaggaacucccagcaggaaccuggaggcaggaacugaagcagagaucauggaggagcacugcugacuggcuuguccucaagaaggguucagucugcuucccuccucccucucuuccuuccucccuuucuacuuuugcuuauauuuucauuuauuuauuuugauacauauauuuauauuuggaaguuugaaaaugauuuucuuuuuucuuuguuuagcuauaucauaauauuuuaaguuuuauuuuauuuuacuuauucacuuuacaucugucucacugccccccccccaccaccaccucccacaauccuucccugccccccuucccuugcccccuccccuuauccucugagcaagugagggccuccugggguauucccccacccauccugacagucugcuuucuuaaacaguugagcagccccugcccaggagaggcaccaccaacaguggcugggccgucccucaucaagcacuagucaagaaaaugccuuccaaacuugccaguuucauggagacaguuuuucaauugaacugacuucuuccaagcugacucuauuuugugucaagguggcaaacacccccuggacagagaagcagagagaugagacuuacuagcuagcuaaagcuggcucuuccaaaauggaagaaaguacacaaaagaggccacgugaaugauuucugguuuuggccaguguuguuugugugaaauaauuuaacuucagugcuucacuuagguaaagauaauaaggacauaaacuucuucuuaaaauuuaaauaucaaaacucaaggacugauguaaaauuuuagcagagccaggcauguuggugcaugccuguaaucucagcauuugggaggcuggagaaggaggauuacuaguaguuauaggucaacuuauacuacagaaugaguuccaggccugguggaucaucucaaaaagauuuaaagagaccuaacaaccucaggggucugaaaccuucaaauuaauccccgaauguuaacauaaacaggauuaagagggcuggagagacagcacugcccuuaaaagcacccguugcucuuccagagaacugggcucaaauuccagcccccacauggcagcucacaacuauuaguaacuccauuuccaagagaucugaugcuuucuuccggcuuccuuggguacugcaugcacauggucuauagccucacuucuaggcacaacacccauacacauaaaacauaaaacuggucacucuaaaacccaccagccgggucugguuagagauuucucccauugcagacugagcuaugcuggagccuuuuugcaccagcucacaaaagccgcugaaguuugaaaguuuugauaaaucagcaaagggcacauucagagcuugaaaucagcguuugcuuguuuccaucguaggaacaggcaaucaagguuccuuuuuguccucuuucugggaggcaguugauagacagguuuguggcaccccacugagugugaguggcccggagaauaaaauguguuuucuucucuccuccaucucugauagaggcugcggggucagacaaguucugcuaugaaaagcugaacacggaaggcaccgagaagggcaauuguggaaaggauggagaccgguggaucccgugcagcaagcagugaguggguggaccccccggggaauagcaacugcuugcagaaggaugccaaguaaagggaaugaaaguagggacuuguggaugaguagugugugcauccuauaugaacugucaaaagguuagcaacauaaugcucuacuaaaaauaaaaauagguaaauguuaaaaggagagaaaaggcauaaaauaaacuauacugcucuggaccuuuuuguacauacagccuguguauauugucucuaucucucugggagauguacuuagcaaaaugauugccaggucccagggaugcauauuuucauuguuaucagaugacauaaaaugguugugcacuaggaaacucuccuguaauguacacugucuucaccaauaugugaucuuagcagauuuauaaugauuaucagcucugguggguggggacugcugucuuggcaugguuuuaaucugcauuuccacauuuccaugccccgugggcugugaacuuccgucuuagagacuugacacuucacuuguuugucgucacucuguaugacucauuguuuauugaacagcuaggcuaguguggagguagagauguccuuaugacagaugagucaugcaaugucaccaaggaugcagaccagugcuccccuucugcuuuauuguguugacgucuaaaaucuuacucuugugagcucacaguugcaaggcagaugcaagagcugcacauucaaagguggaucuucuucauguucuggcuuuuccucacauccguuucuaggcaggcugugcugcccuccgcucuagaguggggaggagggaugcacagggcaggagaugucaggaacaggagcacgcugcuacagauggagaauauugcuggucuuucuuucaacggugcacacuucacugccaugagugaagcugugcuccucuagguaaggaaguggggcuggcauagcuaggacagugucugagugcauuuauucugcaaugaagagacuauugagggaucugagggcuggagauaaggcucuauuguagacugauugccuggugucugaacuuuaguucccagaacuguaacauguaaaaacuaauguauguguaaugguguuuugagcuggauucuuccugucuucugccuucucaaacccgugcagugauguguucuguggauuucugcuuugcaccaaucuuacccgagcuccacguaucggucaacuucaaggagagaucaucccgacuuccuucuaucaucaaggccgagugauugacugcagguaacagauagaagucaggaaacccaggaaagaacgaugaucgcaggucucaaacaagaaaaagcugaaaacauggaagagcaaagauuuuguaguuuucaucuuuuccucccacaugaagaaccacuuugaaaaguaguauauugauuugcaaacuucacuugccuaaaaucauagugguuaucaguaguuaagaccguuuuccaaaucacaaucuuaggaauagaguuaugcuccaaguuauaacccaucuacccaaagcucuagguuagaaguguucagauguuagaauguuuguaagugcacaaugagguagcaugagaaugggacccaacacuaagcaugggauuuuuuuuuuuucacuuauaccuuauacacacaggcugaaggaaauucagucauuugugcaucuauuuuguugacauaggaaccauguguauucauugaaauaccuccauccaagcauacagcaccuguuaauuacguccaaccaucccuccauacccugcuucacagucccaaucccuauuccucucucuucugccaugaagccaacuuuuacagggugaugccuuugugagaggcuguguuuaucuuucugaguggaacuuaguuuacaucucuucugaaaacgacagacuucauucuacuuuguggcugauacuguuaugcauacacuagaucuucuguaucuauuuccuuugauggcuagcuggacugauucuauauccuggcuauugugauaauaccacaggaaauauauaguaguacuaucucguaucuaaaagaaccccccaugcuguucuggagacuguacuaauuuauguucccacucccagugcauuaagggucuuuuuucuucugacucuagccugcauuuguaauuauuucuuaaaugacaacugcuuuaagugaguugagaugacaucuaauuguguuuugagcugcaggucccuaagucauuuugaacuugccuguauuuauuggccauuuauguuucuucugagcagugauuuuuucccccaguacuuuuagugugccugcauuuuaacugugacuguguuuuaaguggauguuuccacuuagggcauccuauaaguacucauaaaauuucacauuuugaagcauuucagaguucaguguuuuggauuagggauaaucaaucccuguacucauuuuaucacuggcuaaaaauuuugagcauugcaguauaucacuauuugaauacugugcuucauuuuucauaaaacauccaguuuaagcaggauauuaugucgcauguaucugguuuagaggaugcccuaauaaguacccaagcacauacagauaauagacauuaaauauuuuuauugguguuaucacacacauccuuuuucauauccauucgucuauguacacauagcacauagacaagaggcguguguuuucagccaggaagcugcauuacaucacaaguaagagccauugcuuucagaguaaccaugguucuaugguggcgcucucuuguucagaggcacugcuguuaaaacaccuuugggauccuaccacagaacugacacaguucuugucccuuuauuuucacucucccagaauuucaaaccaccuuuuaaugggagugaauaaauguuugaaauuacccaagaguaauucugcacaauuucaugacgucuuggucagauaacuguuacuuuuccaucuuguugaauggcucugaagguaauuuuaacuaggccuuagagaauaagccccucccugggaaacaucuguaguauugucucuagacuuuccauguacacaagcacucuuccagcguguguuaccucaccugucuuuaauagccuuacugaauuauaaggcuauauuacaaacuaccauauugguaaaacauucagcaagacuccuuguuaauaauaauuauauccaguuucuaauuauuauccaaauucuaauuaccccuaacguugaaacauaaaagguaagcacuaguaaaguccuggcuuucuccuuucaguugugauagcccaauccuuugagguaauaguaaugguuuucaaaucaaauacagccuugcucugcuguguuugcucagcauuauuucccucccauacuaucuuuuccccaccaggccuuggagaaucaaucacacacuuucuucucugucuacacaaacaccuuucacuuauccuuaauauugagaacacccaaagaguuagaauauuuccugcugauaauuguuguuccugaugcugugugcuguaaaugauaacaaacagcaguuucuuucuuggacuuuuauuaaagauaggugggagggaagaaaagucucgaauaaacccuggcucacuguaacaguaucucuguuucacgaauggcaagccuugugcgggcuggcucuguguuguuggauaguguggugcuuauguuuaugugggucacuguugagguguggucuuuugcuauguauuguaaugcugcauacuggcucugguuguccuuaccuugccccgcaaguuagcccugauugauaaauaaagaugcucacagccuauacugaggcagaagagacuagguggaguuucaguuccugggcuugggauccgaggcaggagaccacgggagauaaggaagaagguggagagaggagaagauggcauuggguagguaagucauggaaaaaaauggccaugaagguuggccagcuggagauaagagcagcccagauagauaacagaaaauuauaacucaggguuauugauagggaaguaaacauuaauagcuuagaggguggauaugugcccaagucugauggugugaaggcuucucguaaacauaaaggcuugugacuuuuaucugggcacugaaugaucgaaggugggguagaacugagccccaccccauugagaugaauuauuuaauacaacagaucacugucugcuuucaguggugcucauguaguuuuagacgaugauacagacguggguuacguugaagaugggacuccguguggccccuccaugaugugcuuagaucggaagugccuacagauucaagcccugaauaugagcagcugcccacuugacucaagggguaaagucugcuccggccacgggguaaguaaguaaacagcagugugaugguuugaccuucauugucugggacccuggguucacagugauaacacagucagacacggacauuucuuacugagacuguggccaguuucugugcccugauuaucaucauauucugagugccuucaucugcuaaaauaaacguuuauaaauuaauuugaauuauuuauguguauggaucaccuucuccagcuauaacucgacaucaacacauagagacaggcaggugacacagaggagagcaaggugacaggaccaggaagcuuuucuucuggugaugcuugguuaaagcacaagcucacagggaggccagguagccuggugugcugaucacuuugcuuguugacauaaaaacauauauauauauauauauauauauauauauauauauauauauacacacacacacacacacacaacauaaguaauuccagagaggaggggguggcuuggcucaugguucaagggacauaguccagcaugcuggggaugguguggcagccaggaacuuauuccuccuauuugucagagcaggaagcaaaggcacggaccaugggugcuuagcuaacuucuuuuuucuucagacucagaccccauuccaugggguggcacuaggguccccauucagguggggccuuucuccuauagcugauccuucagaaacacacucagauacacgcccccaccccaaaggugugccuuacucauguccuucagguauuuauuaaucccaagaagaugacauugaagucagccauccuaucuagugacuuaagaacacgaauucaggggcuagaaagaguuuugauuuagauccuggcucugcucaguuaugucuuagugacucuggguggguacuuacccucucucagcccuuagcugaugauggagugcgaagugagggagaagcucgucgugauguuagaggcagaggaacuugacacauaaugaguguucaguaccguuucuauccaaaauaaaaucaccagguagacuuuuuaagcauuuuaguugcugcucuagaaauaugagacauaaaagcucugcuguuuucccuugucccaucucauuuuucaccauuuuuuaaaagcaaaguucagucuuauuagucauaaccauauauuacaguaucuuggauuuaaaagcguuggcauuugauuuuaucauuucuaaugauaaaagggucucggcaccuuucuuucuaguuugcgggguguuuuauuugauucauguaaauugcaagccugugccauuugcugccugguggagggugucagccugcugacugggaaagagugccuccaauagauggugggaggggugaggagugcuguccuggcaggcaaagugccaccagacgguugggcauggcgagaucacgcagcguguuaaggacugugucucuuggucuuuuguuuugagaauugccccuggagccugcucccucuuuucucugggauuguuuuuugagucccaugucugauaacuuacuguauuaaacauguauauuuucauagcuguuccuagaaacauuugcuucagggggaaaaaaucuacuuuauuggacauuuauauaccuaaauaugucuaauacugugaaucauaucauuuuaaacaguuuuuuucaccuaaacauaauuuuucauaauuacuggaaauauauucaauaauuugacccaugaacuuaguccucaaagccaugggaauguuugggaagccuucuaagugagauugugcuuacuaucagugguccacaucgcugugucucucuucuuucucugucacagguguguagcaacgaagccaccugcaucugugauuucacuugggcaggcacagacugcagcauccgggauccaguucggaaccccaaccccccuaaggaugaaggcccuaaggguuuguaugauuccgguuuuagaucacugcagauuauucaucuccccucucccacugcagcaguaauccacuuccacagcuucagaaggaggcacacaggaauauauccuuuugccacagagaugcgccauccuguguguaccacacuuucagaagcauauuaaaaugaccuccuagcuuggaacugcaguaagaaaaguaaauauacuggcuuccuuuaaaacaguuucuucucugcccuuuaaaccuuaaacuuucccccacuuucccaaaagccgauuauuuuauaauucaucuaagccauuccauuuucaaaucgguacagucuuuggggcugacaugagacuuuuauggcuccuccaugucacauucucuccagaggaaaguuguagucuuuuaugccccguucuaacaaauucuuuugauuugcuaaaagaaucaguucuucggauagcuuuaauuuuucaaagggaauguaaaaggucugaagcuuuauucuaagcagccgcuaagagaagagagagauuagaauuuagcauaaugagucuguggcaguucauagucaccaugugauauugaaaaugagaaugcucaggccccgaggucaggugacaugcccguuacccaggcaaccagaggccaaacugggagcacgcucaguuucuguugcaucauuuuacagcacugccuauguaaaaaugaauaugacagucauuuucucauuauucuccccucucucacccccucauuucauucccaaagaucgugaaaagcugucaguuacaauaggcuuuauguagcaucuaaguagcaaguucccagaaaacaaacuaucgcuagugccaauucugacauuugaccauggcauuguaccucagauucuuguuuuaaauggugcugcuaauaguauccuauaaauuaacugccaugauguuuucuuaaacacauacgacuagcaucaaauugaucaaccuugcuuuggaugaaacauuuaaacucugaacuuuaguguggucuguaugggauagcaugauucucacagcagacaaagcucccuagacuacacaguuccuaaagagacguagccuaguuuguaugcauguggguuguucaugacagugagcauguuaaaacacacuucauuccuuugcuuaauaugccugggauauuaaaacucuguaagaauaguuaucacacccucacaaucuguuucuaaaaaggaauccacuccacuccuacacucacucagucuuuuguuacuuuaaaacuagaacaaaacauucucggauccaccuucagaaguuagauuuggagaguuaggcccuggcaagagaaaugaagccuccucgucaagcccucugcauagcacagccguggcuuucaaagauaccucggugcuguuugcuucugugacacacaggcgugcuugugcacugagcuuaauaaccuucuccugccuguuaggugggaugggccuccauuagcuaucaagaaaugucaauucggagccgugaagcaaacagcgacacacuagaggagagagcacuuacggcuguuuuugguuagacucgcucucauuuuaugagguggcaaucuucauuauagauaagaaaauauucccccuuuuaugguaauucaaagaauacgugguuuuuauuuuuaaaaaaaaaagcauaaggaaauacaaaagggcuggaaaagacagcaaaaauuaucuauggcuccucagcucagaggugaucagugugcaccucaggcugcuccucucuggucacaguuuucuucuuucugcuccugcugaaggcagcaaguccuaggugcaaguugguuagauaacugcuaaaaucaccauguguuucugauaauuuugacuaagcaaaaaugucguuacuucacauaaaugagaagcagcuauuuuguaaacaaauguuuagauaaaucaagaaauuuuaggacaguuaaauaauagcucuguuuuggggcuggagagacagcucagggguuaagaccacugguuguucucguagaggaccuggcuucaguuuccagcaccuauauuucaacacuugggaggcucaagcagaguaauuuuaaacuuaaggccagcuugggcuacauaagaauucuagaccaggcuagcuagugagacuaucccuaaaacaaaacaaaacaacaaauccaaaacugccuaucuuuguuuaauuguacuccccuggaauggcagaaaaaucuaagaaguguaaugaaaauauuuccuuuuaauaccacuuauuuuuauuucaugcugaucucucuaccaaucuuuuuuuuaaaaaauaaucuuauuuuuaauauuuuuuuacaguccagucauuaucccccuccugcucugcccucugacaguuucuuauaccauuucuccucccccugucuccaagaggauguccccacaccccacaacuccccacaccccgucaggccuccccauucccuggggccucaagucugucaaaaauauggaacacuuuaugaauuugcaucucauccuuacacagaggccuugcuaaucucuguaccauuccaguuuuuaguauaugugcugcugaagggagcuugaaaauauugcccuuuuacucaugaacuuggcauaagagauagauggagcccgucuacagcccuucggggcaagaccacacugagaggcaaagacugcaggucccuuucuguugaguugaagguaucauaaaugaaccuguucauuuugaaaauuaauucccagauaaacauauagauguggguagagacuuaacauaaauacuguuuagucaucaacuugcuaaaguugucugugguggacccacaguacagcaguuagguuaguucugccauaucccagccacaggcaguugagaaaaaagaucuuuaaauguacaaacacuauggaugaggaagagucucucccucccugccucccugccucccugccucccugccucccugccucccugccucccugccucccugccucccugccucccugccucccucuccuucccucccuccaugauuugcuucuuucugccccucucuuuucucuccuuucuucuuccuaacccuuuuuggcucucaguggaacucacagccucaugcacgcucggugagcccuaccacugugcuguauuuccagcccucuggagaaggauuuucagagaauuauuuaguauuacacaccauccauccguacauugccauuaauuuuauauuugaaaccucuuugagcuccucuucucucaaguccuuccuguugagaucacugaaaggaauuauuuuccuuuuuaugcaaggauagaauagccuccauuucuguuuaaaagaauuuccagaggcccaggagauggcucuguaggaaaagcgcuccagagcaccuguggugaacuccagguucagugagagcuccugccucaaaaaauaaggugggaaguggcugagagaggugccugaugcaagccucuggccucuacacacuuaacacuugugcucacacacccauauauacauguacagacaaacacagacagacagacagacagacagacagacagacagacagacagacagaggagagagaggggggggggagagagagagagagagagagagagagagagagagagagaaccugccauuuauuuuuauuaauuuguauccacucugcucagugcauauuguggacugugauggaguuuucucauuugguugcuaucaugcccucacuguaacaagaauaaaaacaagaaaguggguucuaucacuuacaccgacuugugugggcagagacagugugccuaggaagguuggaccagacccuuuaaugaggaccacagucaucaaauuagagauagaaaggaccucgaaggcaguucguccagaucugcugcuuuacaaacaggaaaaccaauuaucaguguuaacagcuaauuaaauaaaaugugaucacaugagcuuaaccccagugucuuuucugcugccacugccucauuuaaagcagaacgcuaaguccuucugcucguucuuugugcaugaggaagagaaggaauguugguagccgggcagugauuaagcccauuagaggaucaguuauuuaccagcagugcuuaauauugcucugaagaaaugaaguauaucauuagaguuuagagcuuugaaaacaguaacuuuaaauauuuauaauauaccagauauuauuuauugccuuugcauauauucuuuaggggacuuugauaugacaaagccuugauuuuauaguccugaccacuaaaugauucuucuaugugaguaugaaguauuauguauaauuaugucaggcauuuuuuauuaaacacagacucaccaaagauuaaggguuuaccauauucuacaauauuucaguaccuguuuauuauuuauuuauguaaauagccucuguauuuuuguuaaugaauuaucgucuuuuuuuuaagacagaauuuugcuauguaguucuagcuggccucaaacccacaauucuccugccucagccucccagcugcugauauuacaaguguaugccaucauauucagcugaaaacaacauagguguauuaguuaaacugcucuggcucucaguggguugcucuucuagcgaccagcccaagagcucucuggauuuucaaaugaaagacacauuugccaguuuacuuuugauaugccuugacuaguucaguggaugggcacuucuaaaccucccugcagccagcacacacuccccuccaguauuucugguuuaacaccuccuaaauccauaucucaucuuugcuuuccuggcuccuuggcgcgggugugcggguguggggagggggguggggugugugugugugcgggguaucuuugcugcccaagaggcuucugagcagcccuuccaggggccacuuucuuccuugugccugcauuccucccuccuguuccuucccuauagggucuguccuaccccuucuccuguucuccuggugguccuuucugccccccucccccaggaacuuagaaguucugccucugucaucuugcccagccauuggccacuggcucuuuauuggucaaucaaaaaucaguuagggacauggaccuucaguguuuggacauguagauucccaauuuugggacccaaaauaagacaaagcauuagaaccaacccccaacaaaauaauauuugucaugaaauaauuuauugcauauccuuccagacauaucucccaguauacuaaaauugaacuauuuuuauuacauggaaagggagaaggagauaugaauuuaugucuagcacacugaaauuuugaacaagauaagguauuuuuauaauaucaguauuaugcugucaaauaaagggguuuauuuaguguuuauuucuaaccuucaguuuaguaaagcaaaccccugcaggaagaacuaacuguggccuagaagccaccagugcuggcuuugcugccuauugccuuugaagugccaagggauuuagaguuggcccacccguuucacauaggugaaacacugccuccuccuguuuuggaaacuaagaaaggaaccacccacuuucaaaaagagcaaaacagagacuuuuuuuuuuuaugccauaaaggagaacauuuauaguuugcaucuuaauauuacacucuuaucagaaguucuguuuugguuugguuugguuuuuuuugaccaguaaaccuagagaacaggaagcaagauugaaaauaauaaacaccuacacacacacacacacacagagguacugagguaaugaccgugaucuaugggcgugguguaaagaagggcaagugugucagacagcgaagggaaagugucaagcauccaaaaccaggauuguguuuaucaucugugagcccuuaggagugccaugaucagggucaucagagaaaauuaacucaugucauuguacauacagcguagagccuaggcggaagagagacguuugcagagaagaagugaauaugaaagagaaauaaugaacaaaggcaguuccguaauaaaucaauggcuguggagguaaagcuacaccacaaacuuccaaaggcccaaggaaaaccucuuucaaauuuuucaucauggcugcauucacaaauguguccccuguaaaaugcugcccacccaagggucacucaaucaguuccugccagauuuggaaacaggccaagucugaguuuaaagagauaaaacccuguucgggaucauagcaagggaccugguagauuuuuacuugugccggagcuggccccgugaugggaagcacaugagagaugagcucugugaaagcuaaucgccaccuccucucauuugcuuuguguucagagcacuuaucucuuaagaaucugaagauaauuauucucucucagugcugauuaaggcucaucaucugccugccuggaauacgugcuugaagcaucuucaggauuuuuuuuuucuucuuccccgaucagguuucucauaccugcacagugggccaccgaguccucccgcuuccacagugaggaauuauacaacaaauguagaaggguuugcaaaauuguuauccaucuuucaugugguaguuauaauuuuuaaaaucaacgaauauuaaauuaacaucacauuauauggaagagcaaggaaauguuuuccuauaauuuaucagaucuaccucaugugagaguuaaagggaagguaggauugacuggugaguuuugacucuaagggucgguacuuaaaaauuaagccccucccccccaaaaguuaugaacuaacauauuuguuaauuuaacauucugaagacagcgauuuuauuuuaagaaaacaagucaaguuuuauguugggaaugccuuuccuuucuagucuuugucucuagaguuuggaaaucugagauguaauuugagucaugugggcuucaugccauggccaucuccugucuuccuccucccguacuucacuagacuucucuguguaauguugugucuccaucucuucaguuuuaaaggucuuucucugguugugucuaguuacuagccuccagacucuuguuuacauuguuuaccuugugauaaagcgaaguaacugcaaaguugugaagcaggcuuagagauccaagaugcuccacaagugcaauaggaagccuuaaccaacuguggccaugagucucaggucucaguccuguccccuguguucacagaguacaguccuguugaagugaagcuguucucguccggaaggucgauuccauuccauaccuuccguuuuucuagaaacaagagacaagugucugagccgguucccuuuuacccuuucagacaucacugacccuaaauaauauucccuccuauguuaauaucugacuucacguagcccauguggagaacacagugggcaucucuaccuguuccaggucuuuuucccaaccuuggaaagcuuuacacagaagugauggcguacggcugcagagcauuucugcucuguacuaauaagugcuugguggucugcggcagccucugcagucuucagaggcccucucuuucucucagcacacacaguuauacacuggaaucuacaguccaagaacuaaauguccauuuccuaugacagaagugcaaaccuugaguuauuuagaauaugcuuuccaaucaccuuccagguaaauuacacaggauuuuaaagcuagucuauuggguguuuaugaauuuucacaaaauugaaugguauauucuccauuuaaaugauguuaagcacauuuugcaguuugaaaaacuuauaaggcaugcaucaaugguuaguuuauaauuacaauauaaauuugcuguaguucaguuaaagauuuacccuuauacugcuaggcacuauaacucagaauggauuaguuaugagccuaaaaguauuuauaaggcauuauauuuuaaaguagcacauguagaguuugaagauaaaaauuauuuucauguauucucugauguaugcccaucucuguuucaaguuucugagugaagcuauccauacuuagccaacuuucacagcauuuccuggagaggucguuuuugugugauagugaaaccaguguaugauuuuucucuguuuuaaaaacaaaucuccguuucccuccacacagugaacauggccacgagcaggcucauaggggccguggcuggcaccguucuggcccugggggugauuuuuggaggcacaggguggggcauagaguaagcauaccgagugucugcgugucucucuguggugugugaggcgacucuggccuggaccugacccuuccaugcuuguccugucgaugguugcccgugcugguguaaucuguguugugauuuuuggauguauugugucuugugacuugugauguuucuugugcaccauagaaccuucuccugucuggaacaauguggggcauagaacaguguagggugcuuauucacaguuaaggcaagagcccaagacucccuuugcucuccugcuggcaaggcuuucaaaguacagaccuuauuauuauuauuauacuauuaauuggcaaaaugcuuuuaugugaguguuucauagaagcauuuuaacgauuuuacuccacuauucaaauaaauccauauauacaauuaggaauaccagcaacucucacacuuuuuaaagguagugagaacgggagccaguuaaugcuuuccuauggauuuagacugacauggcaggcuucagcuccaucugucugagaauaacaucaaggaagucaauuucuuuccuuuuuuuguuauaagauugguucaggguucagcuuugaaguguucguacacaucggagcaaggaacauuauaaaugaaaauauauuaaguucaaaccugcacaaccuuagcaacagcugcagcucaucuggcaguuuugucuuuaaagucccuagugucggaaccacgguguugugaucacuuuuucauuagauucccagaaacucaucucucccgaugcucuggugagcuugcucugcacuuaauccuugcccucuaaguagcugagauugcuaugcacagacuagcuuaucaggaagcccuuuuuucuucagcacccagagagcagaagucacccuucacacccuguguuuucuguuuacugggguucugguaacauuucacaguaguuccccguaacccucccccccccaaaaaaaaucauugucucagggagacacuaccuauccuuuacuuagcucaaagaaugagcaugugaccauguacauuguuggcacagcccucaauuucuacugguuagggacacaucugcucuccuuacauaacugagucaggcaacuugggcaccaagauagccaugggaaaggaacaggcgugcauauuacacaugacacuauucuaccauaguugccaggccuggccagccuuggaucuuuuuuuaaaaaguuuuagagacagggucucacucuaugguuuauauguucauuuacuggguagccuaggcuagccuuggucuuacagcaauuccccugccucagauuucuaaaugcugggauuaugguaugagcccucauacccagccuagccuaaugaugcucuuaacucgugcucccuuaguacagucugugaagcaucuuagaucaggagaaggggggacccuagaaaaaggcuuguuuuucucuuuaccugugagaagaugaagcauguaaccaugcuaaaauguuugacugcaagaagucaguccugcaaguugcaucuugucauuguuggccagauguuccuaucccagggccaaauucuagacauauguucauguguaauucuucuaagaggaaaggcaguuuuccaaagaucuucucaaauaugucuucuaucuuccuuaguggccauaguuucagugccuucagauauagccgaagccaugacauuuggucaaccaucuagucuuagagaugaauaggaaucaaaaaaaaaaaaaaaucuuuauuguaagcaguccuguugccuuuguucccauccauccuauccaguguggcugguguguugcuauuuaugcuugugacagguaagugucuacguguaugcuuuaaaacaaaaacaaaaaacuaaaggaagacuugauguucuuguuuuguaaacauuuccucuauaguuuauuaacuuuacccccuuuaaguuucacuuauuuguaauugauauguaaugaguuuuuagagaauagaaucaucuaguacaacauaguuuuaaugcuuccucauuuaauugacaguguaaccaauguucauguaaccaauaacauggacagauugaauuuuugaauucuaauauauagaauuuaaauauauaccccagggauuacuuuccauggauucuguauugaaucugauccuaaccuauccugaaccaacaaaguaaaucugcuuaagugugggugcauacaagguacuaugaacauauuuuugaaugccuucuccaaauuucacuguggagagauggagacaaaaauauguggaauagaauggaguuucaucaaggcaguuauucacaaacuuccuauaaagggcgagguauaaauagcuuugucuuccaauuucucaacagugcuaucaguauaucugcaaaaaguuaucgcugugcuauaguaaaaugucuuuacccagauagauagugaggccagauguggccugugggcuccagugcucugacccuugacuuauaacacaagucuugaagucaggcaaguccauguuuggaucuuguuuccauuaucuauuggcuuuauaauugucugggccuucaucucuugagcaggaugguccacauuccaccuugcauguuccugugugaggaggauucaaugcgaugaugugucaaauguucagaagugaguggagucggggcucacucugcagucucuaucauuaucauucucacugcuguuauuuauuguccuugauguaucuccaaaagccacugaaauucaugcucuaaagcuccucuaugauuuaagagcaucucaaaacccaggaaccagauaagaccccauccuggaauccuacuguaccaccuucuauccacccacuuacauaucuaaagcuguguggcuucuaagcaaaaccacccuucacucagccguggagauguaagaugugguguccacuaugugaggagaaaagagauuauucugcucagcaaagaaugaaugucugcaaaaaagaugagaggguuuuaggaaaaccaacgaaauugacugcuuugugauuuauaggcaaguauauguaguuagccuuaauguguuugguuauuaggaggcacugcuaugccuaugcauaguaaauccuggaggaugugaaauuuccucuuucauuuuaacuauguauaacucacugucuugauuguuaaaggccaaaugaagaagacuggaguuacuguaauuuguuaccaacuuuuagcaguguuggucucuuuacuucacauuaucauuccugguaucuuuuccaguauuuaaauauauuaccaaguuucaaaugucucucaaugagaaaugugaauuuagcgaauuuaaaagauauauuucuggcgcaugccuuuaaucccagcacucuggaggcagaggcaggauuucugaauucgaggccagccugaucuacagagugaguuccaggacagccagggcuauacagagaaacccugucucgaaaaaaaccaaaccaaaccaaaacaaaaaaaagauaauuucucaaguggaauguaaagaauccuuucuucccuauuuccuauaaauugcuuauauaaauuucaggucuccuaccucugcaagcucacuuuggggccuuaacacugaagaaauaucugaggaaaaaaaaaguuucaaagccaggucuuuacuggucaaccucuuccaguaaauucucacugucucccagugcagaccaaacagcauugagaguguggucuguccgauggaggaacacuaucauuggcuccuccuucaucuuauguauucagcagcagauggggccagugcuaauggaguccuguucuuuauuugcacaaaccuguuugauuuaugauaaggguggagaagagaaagagacaaaacacauauaugaaagcaagcagugcugauuuauuucaaguuuggaggaagauuaaccuaacugaguuuaagauuagugggaaagaaaggacagacuuaaagacaaaucauccaaccagagauggacgugucugaccugggauaaagcuaggacaaaaaaagcaucagggaccuugcacaacaggguuuugccuccugaagcugcuuaccugccuuuccuuugugguaaugaaaguaguuggcucacaugacuuucuucccaugauccucugucacagguccuagcgccaccaaucucauaauaggcuccaucgcuggugccauccugguagcagcuauuguccuugggggcacaggcuggggauuuaaguaagcaacgccgcaugucuucuucucuguggcucgggcaccucucuuuucugcuuacauaaccugguuuugaguuccugcuacgagacuuugguguugauaaugcaacuacaaccaccaccaccacaacaacaaaaagacgcgcuuuuacucagaaguggguuagaaacguagaacauggagcuucaaaugucaucuucaggcaagcagggaaguacaagcuacgaaaggaauucccuuucaauugagcccaagcuguucuagaaaguaaagacacucugcccugugggagcagccuccugcagugcucuccuuugcacuuagaugaccaagcaaacauguuggaaauaaauacacuugaauucauaguuguuucugcuaaacacuggcuuauaguccauugggguuuucuguacccucagucagcacacaaccauuguuucuuacguguaaccuugugauuugaaaaaccuucauuuuuucacuuaaauauauuuuaauugaaagcaauggcuuuguggcauuuacuguaaccuugguauaacugacuggccugccgugcuuucauaaugacuuuuauuuuggauugcauauugauacucaagauugcuagagcagaccauacuggauaguugcagauaaacccuacuauguuguaaguuuuaaaaccccauuuaucuaguuuggauauuuuguaccucugauucauuagagaaucacuuucaagcauuuugagcccugguuauuugauuuuuaauauuuguagauaagccuuccucugcauguagucucuuucauagauuaaguaaguuucauccagauuaauggggaugaauuuaagugggaaaugaagccugcagucacaccagagccccccacuucgcuuucauccagccacucaguggaggaagcuuugucuuaaacaaacuguguaguggccuucauuaaagccaguuaaaauguuaucauuaaaagcugacugugaaagaaaaaaauaccaagauauaaucuaaauaaaucaacauuuucugcuaauuuguuaugguguuagaauuuaaugaguaagcccguagcauuugaaaagcuucuaauuggaaacguguaucgaauggugcuuguuuucuacacagaugccuauaaaguuggacuuguuuagugaaauagcaauguugacauccacaugcuugcagaaacacacaaacugacgagggccugguauuuggauuuccccucauuugaauaagguguuguccagcacauaaggaccagcucagaagccauguguuuuuguuuggguuuuccucaaucuggaaaacuuuucuuagugucccacuacugugaaaaagucacccuauauuauagaaagucuguacucuauuuauaaugcuuccuuuaaaaaaaaaaaaaaacuaaacuaaaugugcuuccagaaaaagaaaucugguucacucuauggcacggagcaucuuagcauuaagacauguucaucucaaagacccaagaaacugucuccugugcgucauugccaugcaaggccaugcgauggcagauguaccauuucuuuguucucugugagagcacacuguucuguagcaggaccucgaagcagcagccuggcuagcucucagcuugaacugcauguugcgggagaagccuuuauuacuguguggcuaaguggauuagagucugugcagaugauucacaucugagagauguccagucgucagaagaucagggcaugaggugagggguggauacagagguucaaacccagcucugcugacuguguguggggacugugacauagggacgcuucuggaugagcucaguuaaagccccuucuuauuuccugucccuguaauauuuccuuuuugguaaaagguagaaaggcacaauacuacacaauaccaugcaggaaauauuuucacgccuugaggguggcaggccaggaaugcuccuccaaugauuaacugccccuuugugugacuucuggaguuggaauugagauacgcgguugugcuccgugcugcacauacauuguugucacacuguuugcuuuuagaucuuaauaagagcuggugguuugcaucaagcugugaacuguuacuccugccuugaaauggagggcuaucugcacucggggaaaaacacucguuuccccuccacuuggacaguuuugaagacaauuagagauaauuuggaaguacuggguugguuguccuucagagcuucacugaauucaguguaaauaaaaccaguuucccuuagaagcagcaauuggaaauaguuguaaaaaagaugguuuuuagacagcacuauugggaauccuuccugaaacugaggcacuauucccagaaguagagugugaaagaugccugcagcccuugagagcuggaaacuugagaugaaaggaacagguacaacugaugggggccuucuuuagugucaccguccuuuagaugcgacaugcugaguaauuuagaugaggaagaggguccuaaccauccuugaccggcacagcuauacaaauacaagcaagaaacaccacuaugcugacauugccuuucugauucuuuccccgagagcacucuucuucugaaguaggugcuaaaagguauuacuuugggagaacauguggauaugugugagugggugcacuuuccauguaguaagguuaugcuaauguaugaaaauuauugugaucuaaaaauaacauuaauuaagguugcuuccuuuuagucaaauagcugagccugaagcauuugguuaacaugcacaagauuuccauaugcaaaguuguagaauucccaaaaaggaaaauuaaaaaaaaaaauacucuuugguggaauucucaccauggcacccguguauucuguuauauugaauaauguaaaaccuaguaacauuagguaaggcuagacuccguguucuagaagucugaggcccgacgggaugacugagcagauguucauuuccagguguugagcaucuugugcuuaauucuaaggugucucauggaacaucaucugcguugguuuuuguuuguuuguuuguuuuugccacaugcuuuuccucuucaccuacagaaugaaguugucagcugugacgaggggaccacuaaccucuguuaugcacgguugacucauggagguuccucauucaggccgaauaacacuggugcucaaacuaccagaguuacuguuuuuaccggacaucggaacauuguuuuaauagugucuuccugaaagguuaaggaaacggggaugagcauuuugcauaugcauuaaaaacagggucgcuauuacuacuuucaugaaaacuguuuaggcaacacaccugucuuugguaguuacuguugcugugauaaaacaccaugaccaaagcacaacuuagggaagaaaggguucauuuggcuuacaauucuauauuaugguuugucauugaaggaagcuaggauaggaacucaagcagggaaggaaccuggaggcaggagcugaugcagagaccauggaggggugcugcuuacuggcuugcuccucguggcuugcucagcuugcuuucuuauagaacccaggaccaccagcccagguggucccacaauggacugggccuuccucuaucaagccuuaguuaagauuucucuauaggcuugccuacaacuucaucauagggaggcauuuucucaaucaaggcucccuccuuucugauguuaaguugacagaaacacuagccaguacaaccuccuaaauaugaauacaagaauuuagaugugagcuagaugagugcacacaguauuuauugcuaacaagugauagcaaugaugguggcaagaagaugaaauaaaggugccaaucagguaguuuucugacagcccuuaccacaacauugaugccgggcugaguguggaguguuccaccauauuacaauguguuaaucauuggaaucccccaauauuccaucuggucuccacgaguucccauggcaaagugaguuucuaccccugccagcagagaccauaguaaccucucauggcaguucuugauagaauguucucuaauagccugcaguucucacagguggcuguccuacugagaagucauuggcaugagcacccucccuuagcucugagccauuggcgguuaaccuggguuccauucuguuccauuucuucucuaaagaaaagacuguuacaguugguacuccucuaaaaugacagccaaaggacucuggccagaaaaauaacugaaucuugguggggagggaaaguauuuuugauuuucucaaaguuaggaugccgugaaaucaauuuuaacccguuucuguccgagaaugguaaccaagugguugcuuuccuuucuaauuucugugucauauuccagugcagauuaaggagccacauuaccuuacuguccaagacucuugggcuagacacuuucuucuccauacaucaucaugaugccaggcugaucaggaagacacauguguuuccuugacucaaacuuccgaggacauaaacucaaucuaagguggccuagaggcuuggugugugugugugugugcugguuaugggcauggggacuaagaugagagacaguaggugacuagagauggcucuguaguuaaaagcaguuguuauccuucaaaggacugggauuugguuccuagcacccacaugguggcuugcaacuguuuaaaacucuaguuccaggggauaggcaaaacauucauacacauaauuuuuaagggugacaauaguagguagcucuacaucuuuauuagaaggcccaugaaagcuauuguuaccuggagaucuuuacugauguguauguauauaauacaugcaguauaggcaaaaguuuagauuuccuauagguaucaaacauuguuuaaaaacagugucauuaugaggcuaauggauugcacugauauuuuacaaugauacagaaugccauucugguugugcuaacaaaguugccuucauccaguaagcagagggcauucagaugacauggcuugggaaggaagccagcaaggaccuguccaauguagguuuuauuuucaccuuaaaacuaaacaaagagucuuauguucauauagaaaauucaggacagacagugcucaauguacagugacccacaguggauguauggcuuaccuaagagggaacaucacagaaaccuugcagaguuaucccucuccacucaucucuggguucccucuccccuggacuucagauugcuuucuucacugcugggacuuuaguggaagagaaaauguccuccaguccucugucaguacuguucacaaaaugggugguucuaugggguaacgacuucuuugucugaccaaagaaguuaguaauccuuuagaauguuguuugaugagaacagcucagucuaagcuucaaauuugacuuuggagaggaacacacaccuuuggacacuggaguuuccugggugcccggcugaaguagaauuuuagaucucucuuuacaaacaugcuacuuggcuguucugucuuugggcauacccuguguuugaaugaaagaauuuaaauauggcuaaugugcucuuguccugcucaguggguuuguucuguccucagcauuuauauuaauugaggacauuuguuuuauauuucacuugaauugcaguaauaugcacaucuggcuuagauagggucccugguccucaagguuaggcaguagguguuucucucccccaagucuucacucuuagacaucuucucagagagcaugaacuuugaugggagaugcagguccugagcaaccccaguaaguucauuuggugacagccacaucauggggaugucccauucagucuuacccauagguaaguagagucagcaaugccugcucucaaaaccauuguugacuucagaggacuuggcaguaagucagcaacucuaaggcaaagguguuugcugcauugaauuaagucacuaggccaagccaccacauguccagacuuuugugaagauguuucaauggagacuuaagaaaagggaaguuuauguugaagauauucaugcuugguauuuaaaaaaaaagaaaggaagaaagaaagaaagaaagaaagaaagaaagaaaagaaagaaagaagcaucaaagugggucuucugggaaaguaggaacuuugcaggauauuuuccuauggauuuuaagcuuugguaguguuucuguuuugaaggacauguggggguggggguggaggaaucugucauaauauuuugguaccuagggccagugaagguauucagcuggcccugaguaagugggcaggggaaugagagagcaagggcuucccagccuccaguuuugcaugaugccuugguggcuguggaguugugcccgccaguaugcagacuaaugcaugagccccuugcuugaugccccacaugaagccagaccaugggagguuacaaccaacucacauuguugcuguguugugucuugcuauucuuuuuuucuuucucuucaagcccaggaaucacuuuuuaggagacuggacacugagugaggcacuugaaccugcuucucuccacagagcuaaacugcugcauuugcuuggcuaaccuggcccuguguccauucuccugaguguaccaccucccugugcacucugucugccaacuuuccaccaugagaagugccuguuccuuaguggaguaagaccucacacacccaaggcagaaauagccaggcagagcaaggauuuggugagcucuguugcuacagagcucuggggguuuggagggaacagcuacaagaccuuccaaguucuuccuaguucucauaggugaaaacuacuaugcuguaguacuuuucaucuggugaauuagcaaugguuuuugcuucugaaauuagaccaauuugugguugaaaaugaacaaucugaaguuuccccuaguguuccccaaaguguguagucucaauggggaaaugcaaacauguuccaaaacauuagcuuuucuuuguuucugauuacuuggagacugccucugugugaguggauuacucugcucugggacacgcaccauuguuguugucaucauuugucucucacugucaucugauuaauauuguggcuucucuuuuccucuuucugcaucuucuuugacguacucuggaagaaacgucaagaagaggagauucgaucccacucagcaaggccccaucugaaucgucugcacuggaggaaugccaccuugcacuguuggguucugggaaugacauguuuucagccaugcugccggaacucuuaagucuguaaagaagacccuugggugguaaugacuacagagccucagaucugagaauugggaugggguacaagacaaaggucccuuuuggaaauaacuucaaguaaccccccccccaucaccugucaauaacggggagggguuaaagaccaugucauuaaaaaaaacaacaacaacuucagaauccuuuuuuuucuuuuuaacuaaaggagaagggaguagcaacaagugcaauaaaagaacaaauagcaaaugacccugccccccagccugcuggcacuuaauauuuucuaaaugauuuggcaugauuuuuuuuccuuuuacuaucaaggacaaacuccaguggcaugaagauccaauuuuggaaaggguaaaaacugcauggcauauauaacaacaagcuagcaagccaaccuucagcaaauccuacaguggaaaucccgaggggaagaugacagaugaccacacaaacgcuaccugggucuggauuaaugccuuuccauccuccaccacccccccuccaccucugcccuggccaacccuuucccuacgugccccuggcccacucuaaacacgcccauggcagcacucaucuggacuguguucuuguugauccgcuguacccaucauuucucuccuggaccaagcauccucuggcaaugggagcuggaacuugagcaaugcuauuguacaguucuuuucuaaguguagauauggaaacaagauuucaauaugccauuuugcuugucuguauggaaauguuuuccgugcgaagauucugucuauacuugaguuuguugcuugcuccacaucuuauuuuucuuucuuuucugucauuuucuuuccuccuuugucucuguccucucuuuuaacauguccaccaauuguugagcuugcuuaacaagacagaaguagccacagaugcagggaguuugggcacaaaucuaguauguuugaaaccaaauauuaaaagggggggggggacacagaaaauaacccauaacaagaacacaaaagauuauguaaaugugaguguauauguacugauggaccuaacacuuuugaugucaucauaagcacauguauauacuguaggaaaacagacccuucucaaauuaaucacaaaagugccaagcucauuguuuuaguuucugguuucgacagcucucuuucccugucguaaaugugaaaggaggagaaacuuaaagccuuaaauaaaaaaauuaauaacuuucaaaugcuggaagcuuggaaaaaguuaagcuuuccauucuguucauauucaaauguauuuuuuuuauauguauaaauuucauuuauacuucaucuaacugccucgggaaguagccugugugacagagccccaguguggcgaggcagcacagcuggucauuucugcucauuucagguugucauucugaauggugauuccaggaacucacccugcucaguguuuugcugagacucuggguugcgaugggauuccacuguguaugaauccacacccuucuuuuuccuccagguagcuggggagaucccaggacugucugaguuucccucaucuucccccauuccuucuuuaaguauugccaggagagcuuccaaugcaauccuaagggaacaggcuacugaggaaauucucucagguuuguuucggacaugcagguguacagugaacacccaucaagaacucagacccgccagagagccccuacuucuccacuggcccauuuuuaccaagaagacauccagauaaacuaugcauuucuucccggcacugaguuacuuuuuacauuuagcucuaaggcccucuccagcaagacucaugucuuaaguuuuacaacauauuccuugacuagaagggaggaggauuuccuaaaaauagacugcaugaaacuggacuuucccuccucccccaaagauaucuuuaaguguuggcuuuucacccucacagagcagaaaccuugauugcuauauacuaccccaaaccauaacaacaucuuaaccuucggauggcuuucugagaaacaggugcuaugcagguaugcagucuuucgcuugaauuugcuguuuguuuauauaguaauaacagcgcuaucuauaaggcuuacuggccuuauuccugguuccauaagacacaggcuguaccccuuuacugaauggcaugggcucagcuuggaggaaggucagaggaaauucagauaacuugguaucucuuccugucguugcaauguuucgggguccacuucacuaugagauaccaagcagcugccaaccucaccauacucauuucguuacaauuucugaggcaccguggugacuugauccgacauacgaccacgucaguuacaaaccagaucuuuaugguuaacuuuugaacauuucacaaacaacauuguaaaugugcgauguuauguuuuaaaucagaccacagugguccccaaauauuauguacauaugacaaaugucaguguaacuuuuuguuacacugacaguuucauagguaaacaaaccuacgcuccaauguuaaauuaugcuuguguauguaaaauacacaagcauugggcuauguguguacggacaugaggguagugcaaucguacuguacgaaaugggucagaaucauuuucagugguguuagguuauguaguuucagacuccaugcugcauuuucucuugcacaugccauccauuugcuuauuuuggagugugaguauuccuucuuauuaauuugaauucaaagcacaagccucccauuguucaacauuacccaacaagaguguccagugaugaccgaguuaucucaccugcuauacuuuuacugcaauaauuaaugacaccuggaugaggaggcgugcgcugacuucauuguucacccgggauagugcaugagcccacugaauuagagcugcuucuaccagcaaagugagcaguacacauaggugcauguuugaaacaugaaucacauagagcuauggaguuuugccaagugauguguuuucuuuuucuuuuuucuuuuuuuuucuuuuucuucuuuuuuuuccuuuucuucuucuucuucuuuuuuuuuuuuuuuuuuuacuaugcaaagaugggaaaugcacaaacuuccaagacaugucugaagaacuuuacaauacuugaauuuuuucuuuaaucaucccaucacauuuauggucauugaugcuuccauuguuauuuuucuuuuguucccuucaacuucaaugguuuguaaauuuucaaugcacaaccugaacuuuuguuugaaguuaacuuccaauccuauuggcugccugugaacggagauucugucauccuuacacgcaucuuuuaguugacugugcauuaaaaguuuuauuaauguaggauguuguaguuuugugcucugauugguuuuucuuaacucuuguuucuguguuuucuugcauuauugguuaaguggcuaugugccuguuauugucuggguuuuggcagucacaaucaaagguucacuacaaauugaagcagccaauggagcaaaauaaacucucugguuaaugguaaacauguucuggauuagggcucaguuuuauuagagucauugggaguucuuugccccauaugaaacagaaagccaaacacaaaacaaacaggacaagcaucauaccacuguugauuuuauuuugaguuuuuaguguuugucccugaguuuaaagaguggcugguuagcaguaacauccauacuuugacuugguaccaaauuaacaaugaaagugugugcuugcacacaugaggaaggagaaggagagaggagaugaaaggaggaggagacagcagcaucaucugguuauguacauuacaucaaaagcauuuaaaguaagggacccugg

SEQ ID NO: 192 - RNA, 150886 nt, Mus musculus
ccagggucccuuacuuuaaaugcuuuugauguaauguacauaaccagaugaugcugcugucuccuccuccuuucaucuccucucuccuucuccuuccucaugugugcaagcacacacuuucauuguuaauuugguaccaagucaaaguauggauguuacugcuaaccagccacucuuuaaacucagggacaaacacuaaaaacucaaaauaaaaucaacagugguaugaugcuuguccuguuuguuuuguguuuggcuuucuguuucauauggggcaaagaacucccaaugacucuaauaaaacugagcccuaauccagaacauguuuaccauuaaccagagaguuuauuuugcuccauuggcugcuucaauuuguagugaaccuuugauugugacugccaaaacccagacaauaacaggcacauagccacuuaaccaauaaugcaagaaaacacagaaacaagaguuaagaaaaaccaaucagagcacaaaacuacaacauccuacauuaauaaaacuuuuaaugcacagucaacuaaaagaugcguguaaggaugacagaaucuccguucacaggcagccaauaggauuggaaguuaacuucaaacaaaaguucagguugugcauugaaaauuuacaaaccauugaaguugaagggaacaaaagaaaaauaacaauggaagcaucaaugaccauaaaugugaugggaugauuaaagaaaaaauucaaguauuguaaaguucuucagacaugucuuggaaguuugugcauuucccaucuuugcauaguaaaaaaaaaaaaaaaaaaagaagaagaagaagaaaaggaaaaaaaagaagaaaaagaaaaaaaaagaaaaaagaaaaagaaaacacaucacuuggcaaaacuccauagcucuaugugauucauguuucaaacaugcaccuauguguacugcucacuuugcugguagaagcagcucuaauucagugggcucaugcacuaucccgggugaacaaugaagucagcgcacgccuccucauccaggugucauuaauuauugcaguaaaaguauagcaggugagauaacucggucaucacuggacacucuuguuggguaauguugaacaaugggaggcuugugcuuugaauucaaauuaauaagaaggaauacucacacuccaaaauaagcaaauggauggcaugugcaagagaaaaugcagcauggagucugaaacuacauaaccuaacaccacugaaaaugauucugacccauuucguacaguacgauugcacuacccucauguccguacacacauagcccaaugcuuguguauuuuacauacacaagcauaauuuaacauuggagcguagguuuguuuaccuaugaaacugucaguguaacaaaaaguuacacugacauuugucauauguacauaauauuuggggaccacuguggucugauuuaaaacauaacaucgcacauuuacaauguuguuugugaaauguucaaaaguuaaccauaaagaucugguuuguaacugacguggucguaugucggaucaagucaccacggugccucagaaauuguaacgaaaugaguauggugagguuggcagcugcuugguaucucauagugaaguggaccccgaaacauugcaacgacaggaagagauaccaaguuaucugaauuuccucugaccuuccuccaagcugagcccaugccauucaguaaagggguacagccugugucuuauggaaccaggaauaaggccaguaagccuuauagauagcgcuguuauuacuauauaaacaaacagcaaauucaagcgaaagacugcauaccugcauagcaccuguuucucagaaagccauccgaagguuaagauguuguuaugguuugggguaguauauagcaaucaagguuucugcucugugagggugaaaagccaacacuuaaagauaucuuugggggaggagggaaaguccaguuucaugcagucuauuuuuaggaaauccuccucccuucuagucaaggaauauguuguaaaacuuaagacaugagucuugcuggagagggccuuagagcuaaauguaaaaaguaacucagugccgggaagaaaugcauaguuuaucuggaugucuucuugguaaaaaugggccaguggagaaguaggggcucucuggcgggucugaguucuugauggguguucacuguacaccugcauguccgaaacaaaccugagagaauuuccucaguagccuguucccuuaggauugcauuggaagcucuccuggcaauacuuaaagaaggaaugggggaagaugagggaaacucagacaguccugggaucuccccagcuaccuggaggaaaaagaaggguguggauucauacacaguggaaucccaucgcaacccagagucucagcaaaacacugagcagggugaguuccuggaaucaccauucagaaugacaaccugaaaugagcagaaaugaccagcugugcugccucgccacacuggggcucugucacacaggcuacuucccgaggcaguuagaugaaguauaaaugaaauuuauacauauaaaaaaaauacauuugaauaugaacagaauggaaagcuuaacuuuuuccaagcuuccagcauuugaaaguuauuaauuuuuuuauuuaaggcuuuaaguuucuccuccuuucacauuuacgacagggaaagagagcugucgaaaccagaaacuaaaacaaugagcuuggcacuuuugugauuaauuugagaagggucuguuuuccuacaguauauacaugugcuuaugaugacaucaaaaguguuagguccaucaguacauauacacucacauuuacauaaucuuuuguguucuuguuauggguuauuuucugugucccccccccccuuuuaauauuugguuucaaacauacuagauuugugcccaaacucccugcaucuguggcuacuucugucuuguuaagcaagcucaacaauugguggacauguuaaaagagaggacagagacaaaggaggaaagaaaaugacagaaaagaaagaaaaauaagauguggagcaagcaacaaacucaaguauagacagaaucuucgcacggaaaacauuuccauacagacaagcaaaauggcauauugaaaucuuguuuccauaucuacacuuagaaaagaacuguacaauagcauugcucaaguuccagcucccauugccagaggaugcuugguccaggagagaaaugauggguacagcggaucaacaagaacacaguccagaugagugcugccaugggcguguuuagagugggccaggggcacguagggaaaggguuggccagggcagagguggagggggggugguggaggauggaaaggcauuaauccagacccagguagcguuuguguggucaucugucaucuuccccucgggauuuccacuguaggauuugcugaagguuggcuugcuagcuuguuguuauauaugccaugcaguuuuuacccuuuccaaaauuggaucuucaugccacuggaguuuguccuugauaguaaaaggaaaaaaaaucaugccaaaucauuuagaaaauauuaagugccagcaggcuggggggcagggucauuugcuauuuguucuuuuauugcacuuguugcuacucccuucuccuuuaguuaaaaagaaaaaaaaggauucugaaguuguuguuguuuuuuuuaaugacauggucuuuaaccccuccccguuauugacaggugaugggggggggguuacuugaaguuauuuccaaaagggaccuuugucuuguaccccaucccaauucucagaucugaggcucuguagucauuaccacccaagggucuucuuuacagacuuaagaguuccggcagcauggcugaaaacaugucauucccagaacccaacagugcaagguggcauuccuccagugcagacgauucagauggggccuugcugagugggaucgaaucuccucuucuugacguuucuuccagaguacgucaaagaagaugcagaaagaggaaaagagaagccacaauauuaaucagaugacagugagagacaaaugaugacaacaacaauggugcgugucccagagcagaguaauccacucacacagaggcagucuccaaguaaucagaaacaaagaaaagcuaauguuuuggaacauguuugcauuuccccauugagacuacacacuuuggggaacacuaggggaaacuucagauuguucauuuucaaccacaaauuggucuaauuucagaagcaaaaaccauugcuaauucaccagaugaaaaguacuacagcauaguaguuuucaccuaugagaacuaggaagaacuuggaaggucuuguagcuguucccuccaaacccccagagcucuguagcaacagagcucaccaaauccuugcucugccuggcuauuucugccuugggugugugaggucuuacuccacuaaggaacaggcacuucucaugguggaaaguuggcagacagagugcacagggaggugguacacucaggagaauggacacagggccagguuagccaagcaaaugcagcaguuuagcucuguggagagaagcagguucaagugccucacucaguguccagucuccuaaaaagugauuccugggcuugaagagaaagaaaaaaagaauagcaagacacaacacagcaacaaugugaguugguuguaaccucccauggucuggcuucauguggggcaucaagcaaggggcucaugcauuagucugcauacuggcgggcacaacuccacagccaccaaggcaucaugcaaaacuggaggcugggaagcccuugcucucucauuccccugcccacuuacucagggccagcugaauaccuucacuggcccuagguaccaaaauauuaugacagauuccuccacccccacccccacauguccuucaaaacagaaacacuaccaaagcuuaaaauccauaggaaaauauccugcaaaguuccuacuuucccagaagacccacuuugaugcuucuuucuuucuuuucuuucuuucuuucuuucuuucuuucuuucuuccuuucuuuuuuuuuaaauaccaagcaugaauaucuucaacauaaacuucccuuuucuuaagucuccauugaaacaucuucacaaaagucuggacaugugguggcuuggccuagugacuuaauucaaugcagcaaacaccuuugccuuagaguugcugacuuacugccaaguccucugaagucaacaaugguuuugagagcaggcauugcugacucuacuuaccuauggguaagacugaaugggacauccccaugauguggcugucaccaaaugaacuuacugggguugcucaggaccugcaucucccaucaaaguucaugcucucugagaagaugucuaagagugaagacuugggggagagaaacaccuacugccuaaccuugaggaccagggacccuaucuaagccagaugugcauauuacugcaauucaagugaaauauaaaacaaauguccucaauuaauauaaaugcugaggacagaacaaacccacugagcaggacaagagcacauuagccauauuuaaauucuuucauucaaacacaggguaugcccaaagacagaacagccaaguagcauguuuguaaagagagaucuaaaauucuacuucagccgggcacccaggaaacuccaguguccaaagguguguguuccucuccaaagucaaauuugaagcuuagacugagcuguucucaucaaacaacauucuaaaggauuacuaacuucuuuggucagacaaagaagucguuaccccauagaaccacccauuuugugaacaguacugacagaggacuggaggacauuuucucuuccacuaaagucccagcagugaagaaagcaaucugaaguccaggggagagggaacccagagaugaguggagagggauaacucugcaagguuucugugauguucccucuuagguaagccauacauccacugugggucacuguacauugagcacugucuguccugaauuuucuauaugaacauaagacucuuuguuuaguuuuaaggugaaaauaaaaccuacauuggacagguccuugcuggcuuccuucccaagccaugucaucugaaugcccucugcuuacuggaugaaggcaacuuuguuagcacaaccagaauggcauucuguaucauuguaaaauaucagugcaauccauuagccucauaaugacacuguuuuuaaacaauguuugauaccuauaggaaaucuaaacuuuugccuauacugcauguauuauauacauacacaucaguaaagaucuccagguaacaauagcuuucaugggccuucuaauaaagauguagagcuaccuacuauugucacccuuaaaaauuauguguaugaauguuuugccuauccccuggaacuagaguuuuaaacaguugcaagccaccaugugggugcuaggaaccaaaucccaguccuuugaaggauaacaacugcuuuuaacuacagagccaucucuagucaccuacugucucucaucuuaguccccaugcccauaaccagcacacacacacacacaccaagccucuaggccaccuuagauugaguuuauguccucggaaguuugagucaaggaaacacaugugucuuccugaucagccuggcaucaugaugauguauggagaagaaagugucuagcccaagagucuuggacaguaagguaauguggcuccuuaaucugcacuggaauaugacacagaaauuagaaaggaaagcaaccacuugguuaccauucucggacagaaacggguuaaaauugauuucacggcauccuaacuuugagaaaaucaaaaauacuuucccuccccaccaagauucaguuauuuuucuggccagaguccuuuggcugucauuuuagaggaguaccaacuguaacagucuuuucuuuagagaagaaauggaacagaauggaacccagguuaaccgccaauggcucagagcuaagggagggugcucaugccaaugacuucucaguaggacagccaccugugagaacugcaggcuauuagagaacauucuaucaagaacugccaugagagguuacuauggucucugcuggcagggguagaaacucacuuugccaugggaacucguggagaccagauggaauauugggggauuccaaugauuaacacauuguaauaugguggaacacuccacacucagcccggcaucaauguugugguaagggcugucagaaaacuaccugauuggcaccuuuauuucaucuucuugccaccaucauugcuaucacuuguuagcaauaaauacugugugcacucaucuagcucacaucuaaauucuuguauucauauuuaggagguuguacuggcuaguguuucugucaacuuaacaucagaaaggagggagccuugauugagaaaaugccucccuaugaugaaguuguaggcaagccuauagagaaaucuuaacuaaggcuugauagaggaaggcccaguccauugugggaccaccugggcuggugguccuggguucuauaagaaagcaagcugagcaagccacgaggagcaagccaguaagcagcaccccuccauggucucugcaucagcuccugccuccagguuccuucccugcuugaguuccuauccuagcuuccuucaaugacaaaccauaauauagaauuguaagccaaaugaacccuuucuucccuaaguugugcuuuggucaugguguuuuaucacagcaacaguaacuaccaaagacagguguguugccuaaacaguuuucaugaaaguaguaauagcgacccuguuuuuaaugcauaugcaaaaugcucauccccguuuccuuaaccuuucaggaagacacuauuaaaacaauguuccgauguccgguaaaaacaguaacucugguaguuugagcaccaguguuauucggccugaaugaggaaccuccaugagucaaccgugcauaacagagguuagugguccccucgucacagcugacaacuucauucuguaggugaagaggaaaagcauguggcaaaaacaaacaaacaaacaaaaaccaacgcagaugauguuccaugagacaccuuagaauuaagcacaagaugcucaacaccuggaaaugaacaucugcucagucaucccgucgggccucagacuucuagaacacggagucuagccuuaccuaauguuacuagguuuuacauuauucaauauaacagaauacacgggugccauggugagaauuccaccaaagaguauuuuuuuuuuuaauuuuccuuuuugggaauucuacaacuuugcauauggaaaucuugugcauguuaaccaaaugcuucaggcucagcuauuugacuaaaaggaagcaaccuuaauuaauguuauuuuuagaucacaauaauuuucauacauuagcauaaccuuacuacauggaaagugcacccacucacacauauccacauguucucccaaaguaauaccuuuuagcaccuacuucagaagaagagugcucucggggaaagaaucagaaaggcaaugucagcauagugguguuucuugcuuguauuuguauagcugugccggucaaggaugguuaggacccucuuccucaucuaaauuacucagcaugucgcaucuaaaggacggugacacuaaagaaggcccccaucaguuguaccuguuccuuucaucucaaguuuccagcucucaagggcugcaggcaucuuucacacucuacuucugggaauagugccucaguuucaggaaggauucccaauagugcugucuaaaaaccaucuuuuuuacaacuauuuccaauugcugcuucuaagggaaacugguuuuauuuacacugaauucagugaagcucugaaggacaaccaacccaguacuuccaaauuaucucuaauugucuucaaaacuguccaaguggaggggaaacgaguguuuuuccccgagugcagauagcccuccauuucaaggcaggaguaacaguucacagcuugaugcaaaccaccagcucuuauuaagaucuaaaagcaaacagugugacaacaauguaugugcagcacggagcacaaccgcguaucucaauuccaacuccagaagucacacaaaggggcaguuaaucauuggaggagcauuccuggccugccacccucaaggcgugaaaauauuuccugcaugguauuguguaguauugugccuuucuaccuuuuaccaaaaaggaaauauuacagggacaggaaauaagaaggggcuuuaacugagcucauccagaagcgucccuaugucacaguccccacacacagucagcagagcuggguuugaaccucuguauccaccccucaccucaugcccugaucuucugacgacuggacaucucucagaugugaaucaucugcacagacucuaauccacuuagccacacaguaauaaaggcuucucccgcaacaugcaguucaagcugagagcuagccaggcugcugcuucgagguccugcuacagaacagugugcucucacagagaacaaagaaaugguacaucugccaucgcauggccuugcauggcaaugacgcacaggagacaguuucuugggucuuugagaugaacaugucuuaaugcuaagaugcuccgugccauagagugaaccagauuucuuuuucuggaagcacauuuaguuuaguuuuuuuuuuuuuuuaaaggaagcauuauaaauagaguacagacuuucuauaauauagggugacuuuuucacaguagugggacacuaagaaaaguuuuccagauugaggaaaacccaaacaaaaacacauggcuucugagcugguccuuaugugcuggacaacaccuuauucaaaugaggggaaauccaaauaccaggcccucgucaguuuguguguuucugcaagcauguggaugucaacauugcuauuucacuaaacaaguccaacuuuauaggcaucuguguagaaaacaagcaccauucgauacacguuuccaauuagaagcuuuucaaaugcuacgggcuuacucauuaaauucuaacaccauaacaaauuagcagaaaauguugauuuauuuagauuauaucuugguauuuuuuucuuucacagucagcuuuuaaugauaacauuuuaacuggcuuuaaugaaggccacuacacaguuuguuuaagacaaagcuuccuccacugaguggcuggaugaaagcgaaguggggggcucuggugugacugcaggcuucauuucccacuuaaauucauccccauuaaucuggaugaaacuuacuuaaucuaugaaagagacuacaugcagaggaaggcuuaucuacaaauauuaaaaaucaaauaaccagggcucaaaaugcuugaaagugauucucuaaugaaucagagguacaaaauauccaaacuagauaaaugggguuuuaaaacuuacaacauaguaggguuuaucugcaacuauccaguauggucugcucuagcaaucuugaguaucaauaugcaauccaaaauaaaagucauuaugaaagcacggcaggccagucaguuauaccaagguuacaguaaaugccacaaagccauugcuuucaauuaaaauauauuuaagugaaaaaaugaagguuuuucaaaucacaagguuacacguaagaaacaaugguugugugcugacugaggguacagaaaaccccaauggacuauaagccaguguuuagcagaaacaacuaugaauucaaguguauuuauuuccaacauguuugcuuggucaucuaagugcaaaggagagcacugcaggaggcugcucccacagggcagagugucuuuacuuucuagaacagcuugggcucaauugaaagggaauuccuuucguagcuuguacuucccugcuugccugaagaugacauuugaagcuccauguucuacguuucuaacccacuucugaguaaaagcgcgucuuuuuguuguuguggugguggugguuguaguugcauuaucaacaccaaagucucguagcaggaacucaaaaccagguuauguaagcagaaaagagaggugcccgagccacagagaagaagacaugcggcguugcuuacuuaaauccccagccugugcccccaaggacaauagcugcuaccaggauggcaccagcgauggagccuauuaugagauugguggcgcuaggaccugugacagaggaucaugggaagaaagucaugugagccaacuacuuucauuaccacaaaggaaaggcagguaagcagcuucaggaggcaaaacccuguugugcaaggucccugaugcuuuuuuuguccuagcuuuaucccaggucagacacguccaucucugguuggaugauuugucuuuaagucuguccuuucuuucccacuaaucuuaaacucaguuagguuaaucuuccuccaaacuugaaauaaaucagcacugcuugcuuucauauauguguuuugucucuuucucuucuccacccuuaucauaaaucaaacagguuugugcaaauaaagaacaggacuccauuagcacuggccccaucugcugcugaauacauaagaugaaggaggagccaaugauaguguuccuccaucggacagaccacacucucaaugcuguuuggucugcacugggagacagugagaauuuacuggaagagguugaccaguaaagaccuggcuuugaaacuuuuuuuuuccucagauauuucuucaguguuaaggccccaaagugagcuugcagagguaggagaccugaaauuuauauaagcaauuuauaggaaauagggaagaaaggauucuuuacauuccacuugagaaauuaucuuuuuuuuguuuugguuugguuugguuuuuuucgagacaggguuucucuguauagcccuggcuguccuggaacucacucuguagaucaggcuggccucgaauucagaaauccugccucugccuccagagugcugggauuaaaggcaugcgccagaaauauaucuuuuaaauucgcuaaauucacauuucucauugagagacauuugaaacuugguaauauauuuaaauacuggaaaagauaccaggaaugauaaugugaaguaaagagaccaacacugcuaaaaguugguaacaaauuacaguaacuccagucuucuucauuuggccuuuaacaaucaagacagugaguuauacauaguuaaaaugaaagaggaaauuucacauccuccaggauuuacuaugcauaggcauagcagugccuccuaauaaccaaacacauuaaggcuaacuacauauacuugccuauaaaucacaaagcagucaauuucguugguuuuccuaaaacccucucaucuuuuuugcagacauucauucuuugcugagcagaauaaucucuuuucuccucacauaguggacaccacaucuuacaucuccacggcugagugaagggugguuuugcuuagaagccacacagcuuuagauauguaaguggguggauagaaggugguacaguaggauuccaggauggggucuuaucugguuccuggguuuugagaugcucuuaaaucauagaggagcuuuagagcaugaauuucaguggcuuuuggagauacaucaaggacaauaaauaacagcagugagaaugauaaugauagagacugcagagugagccccgacuccacucacuucugaacauuugacacaucaucgcauugaauccuccucacacaggaacaugcaagguggaauguggaccauccugcucaagagaugaaggcccagacaauuauaaagccaauagauaauggaaacaagauccaaacauggacuugccugacuucaagacuuguguuauaagucaagggucagagcacuggagcccacaggccacaucuggccucacuaucuaucuggguaaagacauuuuacuauagcacagcgauaacuuuuugcagauauacugauagcacuguugagaaauuggaagacaaagcuauuuauaccucgcccuuuauaggaaguuugugaauaacugccuugaugaaacuccauucuauuccacauauuuuugucuccaucucuccacagugaaauuuggagaaggcauucaaaaauauguucauaguaccuuguaugcacccacacuuaagcagauuuacuuuguugguucaggauagguuaggaucagauucaauacagaauccauggaaaguaaucccugggguauauauuuaaauucuauauauuagaauucaaaaauucaaucuguccauguuauugguuacaugaacauugguuacacugucaauuaaaugaggaagcauuaaaacuauguuguacuagaugauucuauucucuaaaaacucauuacauaucaauuacaaauaagugaaacuuaaaggggguaaaguuaauaaacuauagaggaaauguuuacaaaacaagaacaucaagucuuccuuuaguuuuuuguuuuuguuuuaaagcauacacguagacacuuaccugucacaagcauaaauagcaacacaccagccacacuggauaggauggaugggaacaaaggcaacaggacugcuuacaauaaagauuuuuuuuuuuuuuugauuccuauucaucucuaagacuagaugguugaccaaaugucauggcuucggcuauaucugaaggcacugaaacuauggccacuaaggaagauagaagacauauuugagaagaucuuuggaaaacugccuuuccucuuagaagaauuacacaugaacauaugucuagaauuuggcccugggauaggaacaucuggccaacaaugacaagaugcaacuugcaggacugacuucuugcagucaaacauuuuagcaugguuacaugcuucaucuucucacagguaaagagaaaaacaagccuuuuucuaggguccccccuucuccugaucuaagaugcuucacagacuguacuaagggagcacgaguuaagagcaucauuaggcuaggcuggguaugagggcucauaccauaaucccagcauuuagaaaucugaggcaggggaauugcuguaagaccaaggcuagccuaggcuacccaguaaaugaacauauaaaccauagagugagacccugucucuaaaacuuuuuaaaaaaagauccaaggcuggccaggccuggcaacuaugguagaauagugucauguguaauaugcacgccuguuccuuucccauggcuaucuuggugcccaaguugccugacucaguuauguaaggagagcagaugugucccuaaccaguagaaauugagggcugugccaacaauguacauggucacaugcucauucuuugagcuaaguaaaggauagguagugucucccugagacaaugauuuuuuuugggggggggaggguuacggggaacuacugugaaauguuaccagaaccccaguaaacagaaaacacagggugugaagggugacuucugcucucugggugcugaagaaaaaagggcuuccugauaagcuagucugugcauagcaaucucagcuacuuagagggcaaggauuaagugcagagcaagcucaccagagcaucgggagagaugaguuucugggaaucuaaugaaaaagugaucacaacaccgugguuccgacacuagggacuuuaaagacaaaacugccagaugagcugcagcuguugcuaagguugugcagguuugaacuuaauauauuuucauuuauaauguuccuugcuccgauguguacgaacacuucaaagcugaacccugaaccaaucuuauaacaaaaaaaggaaagaaauugacuuccuugauguuauucucagacagauggagcugaagccugccaugucagucuaaauccauaggaaagcauuaacuggcucccguucucacuaccuuuaaaaagugugagaguugcugguauuccuaauuguauauauggauuuauuugaauaguggaguaaaaucguuaaaaugcuucuaugaaacacucacauaaaagcauuuugccaauuaauaguauaauaauaauaauaaggucuguacuuugaaagccuugccagcaggagagcaaagggagucuugggcucuugccuuaacugugaauaagcacccuacacuguucuaugccccacauuguuccagacaggagaagguucuauggugcacaagaaacaucacaagucacaagacacaauacauccaaaaaucacaacacagauuacaccagcacgggcaaccaucgacaggacaagcauggaagggucagguccaggccagagucgccucacacaccacagagagacacgcagacacucgguaugcuuacucuaugccccacccugugccuccaaaaaucacccccagggccagaacggugccagccacggccccuaugagccugcucguggccauguucacuguguggagggaaacggagauuuguuuuuaaaacagagaaaaaucauacacugguuucacuaucacacaaaaacgaccucuccaggaaaugcugugaaaguuggcuaaguauggauagcuucacucagaaacuugaaacagagaugggcauacaucagagaauacaugaaaauaauuuuuaucuucaaacucuacaugugcuacuuuaaaauauaaugccuuauaaauacuuuuaggcucauaacuaauccauucugaguuauagugccuagcaguauaaggguaaaucuuuaacugaacuacagcaaauuuauauuguaauuauaaacuaaccauugaugcaugccuuauaaguuuuucaaacugcaaaaugugcuuaacaucauuuaaauggagaauauaccauucaauuuugugaaaauucauaaacacccaauagacuagcuuuaaaauccuguguaauuuaccuggaaggugauuggaaagcauauucuaaauaacucaagguuugcacuucugucauaggaaauggacauuuaguucuuggacuguagauuccaguguauaacugugugugcugagagaaagagagggccucugaagacugcagaggcugccgcagaccaccaagcacuuauuaguacagagcagaaaugcucugcagccguacgccaucacuucuguguaaagcuuuccaagguugggaaaaagaccuggaacagguagagaugcccacuguguucuccacaugggcuacgugaagucagauauuaacauaggagggaauauuauuuagggucagugaugucugaaaggguaaaagggaaccggcucagacacuugucucuuguuucuagaaaaacggaagguauggaauggaaucgaccuuccggacgagaacagcuucacuucaacaggacuguacucugugaacacaggggacaggacugagaccugagacucauggccacaguugguuaaggcuuccuauugcacuuguggagcaucuuggaucucuaagccugcuucacaacuuugcaguuacuucgcuuuaucacaagguaaacaauguaaacaagagucuggaggcuaguaacuagacacaaccagagaaagaccuuuaaaacugaagagauggagacacaacauuacacagagaagucuagugaaguacgggaggaggaagacaggagauggccauggcaugaagcccacaugacucaaauuacaucucagauuuccaaacucuagagacaaagacuagaaaggaaaggcauucccaacauaaaacuugacuuguuuucuuaaaauaaaaucgcugucuucagaauguuaaauuaacaaauauguuaguucauaacuuuugggggggaggggcuuaauuuuuaaguaccgacccuuagagucaaaacucaccagucaauccuaccuucccuuuaacucucacaugagguagaucugauaaauuauaggaaaacauuuccuugcucuuccauauaaugugauguuaauuuaauauucguugauuuuaaaaauuauaacuaccacaugaaagauggauaacaauuuugcaaacccuucuacauuuguuguauaauuccucacuguggaagcgggaggacucgguggcccacugugcagguaugagaaaccugaucggggaagaagaaaaaaaaaauccugaagaugcuucaagcacguauuccaggcaggcagaugaugagccuuaaucagcacugagagagaauaauuaucuucagauucuuaagagauaagugcucugaacacaaagcaaaugagaggagguggcgauuagcuuucacagagcucaucucucaugugcuucccaucacggggccagcuccggcacaaguaaaaaucuaccaggucccuugcuaugaucccgaacaggguuuuaucucuuuaaacucagacuuggccuguuuccaaaucuggcaggaacugauugagugacccuugggugggcagcauuuuacaggggacacauuugugaaugcagccaugaugaaaaauuugaaagagguuuuccuugggccuuuggaaguuugugguguagcuuuaccuccacagccauugauuuauuacggaacugccuuuguucauuauuucucuuucauauucacuucuucucugcaaacgucucucuuccgccuaggcucuacgcuguauguacaaugacaugaguuaauuuucucugaugacccugaucauggcacuccuaagggcucacagaugauaaacacaauccugguuuuggaugcuugacacuuucccuucgcugucugacacacuugcccuucuuuacaccacgcccauagaucacggucauuaccucaguaccucuguguguguguguguguguagguguuuauuauuuucaaucuugcuuccuguucucuagguuuacuggucaaaaaaaaccaaaccaaaccaaaacagaacuucugauaagaguguaauauuaagaugcaaacuauaaauguucuccuuuauggcauaaaaaaaaaaagucucuguuuugcucuuuuugaaagugggugguuccuuucuuaguuuccaaaacaggaggaggcaguguuucaccuaugugaaacgggugggccaacucuaaaucccuuggcacuucaaaggcaauaggcagcaaagccagcacugguggcuucuaggccacaguuaguucuuccugcagggguuugcuuuacuaaacugaagguuagaaauaaacacuaaauaaaccccuuuauuugacagcauaauacugauauuauaaaaauaccuuaucuuguucaaaauuucagugugcuagacauaaauucauaucuccuucucccuuuccauguaauaaaaauaguucaauuuuaguauacugggagauaugucuggaaggauaugcaauaaauuauuucaugacaaauauuauuuuguuggggguugguucuaaugcuuugucuuauuuugggucccaaaauugggaaucuacauguccaaacacugaagguccaugucccuaacugauuuuugauugaccaauaaagagccaguggccaauggcugggcaagaugacagaggcagaacuucuaaguuccugggggaggggggcagaaaggaccaccaggagaacaggagaagggguaggacagacccuauagggaaggaacaggagggaggaaugcaggcacaaggaagaaaguggccccuggaagggcugcucagaagccucuugggcagcaaagauaccccgcacacacacacaccccaccccccuccccacacccgcacacccgcgccaaggagccaggaaagcaaagaugagauauggauuuaggagguguuaaaccagaaauacuggaggggagugugugcuggcugcagggagguuuagaagugcccauccacugaacuagucaaggcauaucaaaaguaaacuggcaaaugugucuuucauuugaaaauccagagagcucuugggcuggucgcuagaagagcaacccacugagagccagagcaguuuaacuaauacaccuauguuguuuucagcugaauaugauggcauacacuuguaauaucagcagcugggaggcugaggcaggagaauuguggguuugaggccagcuagaacuacauagcaaaauucugucuuaaaaaaaagacgauaauucauuaacaaaaauacagaggcuauuuacauaaauaaauaauaaacagguacugaaauauuguagaauaugguaaacccuuaaucuuuggugagucuguguuuaauaaaaaaugccugacauaauuauacauaauacuucauacucacauagaagaaucauuuaguggucaggacuauaaaaucaaggcuuugucauaucaaaguccccuaaagaauauaugcaaaggcaauaaauaauaucugguauauuauaaauauuuaaaguuacuguuuucaaagcucuaaacucuaaugauauacuucauuucuucagagcaauauuaagcacugcugguaaauaacugauccucuaaugggcuuaaucacugcccggcuaccaacauuccuucucuuccucaugcacaaagaacgagcagaaggacuuagcguucugcuuuaaaugaggcaguggcagcagaaaagacacugggguuaagcucaugugaucacauuuuauuuaauuagcuguuaacacugauaauugguuuuccuguuuguaaagcagcagaucuggacgaacugccuucgagguccuuucuaucucuaauuugaugacugugguccucauuaaagggucugguccaaccuuccuaggcacacugucucugcccacacaagucgguguaagugauagaacccacuuucuuguuuuuauucuuguuacagugagggcaugauagcaaccaaaugagaaaacuccaucacaguccacaauaugcacugagcagaguggauacaaauuaauaaaaauaaauggcagguucucucucucucucucucucucucucucucucucucucuccccccccccucucucuccucugucugucugucugucugucugucugucugucugucugucugucuguguuugucuguacauguauauaugggugugugagcacaaguguuaaguguguagaggccagaggcuugcaucaggcaccucucucagccacuucccaccuuauuuuuugaggcaggagcucucacugaaccuggaguucaccacaggugcucuggagcgcuuuuccuacagagccaucuccugggccucuggaaauucuuuuaaacagaaauggaggcuauucuauccuugcauaaaaaggaaaauaauuccuuucagugaucucaacaggaaggacuugagagaagaggagcucaaagagguuucaaauauaaaauuaauggcaauguacggauggaugguguguaauacuaaauaauucucugaaaauccuucuccagagggcuggaaauacagcacagugguagggcucaccgagcgugcaugaggcugugaguuccacugagagccaaaaaggguuaggaagaagaaaggagagaaaagagaggggcagaaagaagcaaaucauggagggagggaaggagagggaggcagggaggcagggaggcagggaggcagggaggcagggaggcagggaggcagggaggcagggaggcagggaggcagggagggagagacucuuccucauccauaguguuuguacauuuaaagaucuuuuuucucaacugccuguggcugggauauggcagaacuaaccuaacugcuguacuguggguccaccacagacaacuuuagcaaguugaugacuaaacaguauuuauguuaagucucuacccacaucuauauguuuaucugggaauuaauuuucaaaaugaacagguucauuuaugauaccuucaacucaacagaaagggaccugcagucuuugccucucaguguggucuugccccgaagggcuguagacgggcuccaucuaucucuuaugccaaguucaugaguaaaagggcaauauuuucaagcucccuucagcagcacauauacuaaaaacuggaaugguacagagauuagcaaggccucuguguaaggaugagaugcaaauucauaaaguguuccauauuuuugacagacuugaggccccagggaauggggaggccugacgggguguggggaguugugggguguggggacauccucuuggagacagggggaggagaaaugguauaagaaacugucagagggcagagcaggagggggauaaugacuggacuguaaaaaaauauuaaaaauaagauuauuuuuuaaaaaaaagauugguagagagaucagcaugaaauaaaaauaagugguauuaaaaggaaauauuuucauuacacuucuuagauuuuucugccauuccaggggaguacaauuaaacaaagauaggcaguuuuggauuuguuguuuuguuuuguuuuagggauagucucacuagcuagccuggucuagaauucuuauguagcccaagcuggccuuaaguuuaaaauuacucugcuugagccucccaaguguugaaauauaggugcuggaaacugaagccagguccucuacgagaacaaccaguggucuuaaccccugagcugucucuccagccccaaaacagagcuauuauuuaacuguccuaaaauuucuugauuuaucuaaacauuuguuuacaaaauagcugcuucucauuuaugugaaguaacgacauuuuugcuuagucaaaauuaucagaaacacauggugauuuuagcaguuaucuaaccaacuugcaccuaggacuugcugccuucagcaggagcagaaagaagaaaacugugaccagagaggagcagccugaggugcacacugaucaccucugagcugaggagccauagauaauuuuugcugucuuuuccagcccuuuuguauuuccuuaugcuuuuuuuuuuaaaaauaaaaaccacguauucuuugaauuaccauaaaagggggaauauuuucuuaucuauaaugaagauugccaccucauaaaaugagagcgagucuaaccaaaaacagccguaagugcucucuccucuagugugucgcuguuugcuucacggcuccgaauugacauuucuugauagcuaauggaggcccaucccaccuaacaggcaggagaagguuauuaagcucagugcacaagcacgccugugugucacagaagcaaacagcaccgagguaucuuugaaagccacggcugugcuaugcagagggcuugacgaggaggcuucauuucucuugccagggccuaacucuccaaaucuaacuucugaagguggauccgagaauguuuuguucuaguuuuaaaguaacaaaagacugagugaguguaggaguggaguggauuccuuuuuagaaacagauugugagggugugauaacuauucuuacagaguuuuaauaucccaggcauauuaagcaaaggaaugaaguguguuuuaacaugcucacugucaugaacaacccacaugcauacaaacuaggcuacgucucuuuaggaacuguguagucuagggagcuuugucugcugugagaaucaugcuaucccauacagaccacacuaaaguucagaguuuaaauguuucauccaaagcaagguugaucaauuugaugcuagucguauguguuuaagaaaacaucauggcaguuaauuuauaggauacuauuagcagcaccauuuaaaacaagaaucugagguacaaugccauggucaaaugucagaauuggcacuagcgauaguuuguuuucugggaacuugcuacuuagaugcuacauaaagccuauuguaacugacagcuuuucacgaucuuugggaaugaaaugagggggugagagaggggagaauaaugagaaaaugacugucauauucauuuuuacauaggcagugcuguaaaaugaugcaacagaaacugagcgugcucccaguuuggccucugguugccuggguaacgggcaugucaccugaccucggggccugagcauucucauuuucaauaucacauggugacuaugaacugccacagacucauuaugcuaaauucuaaucucucucuucucuuagcggcugcuuagaauaaagcuucagaccuuuuacauucccuuugaaaaauuaaagcuauccgaagaacugauucuuuuagcaaaucaaaagaauuuguuagaacggggcauaaaagacuacaacuuuccucuggagagaaugugacauggaggagccauaaaagucucaugucagccccaaagacuguaccgauuugaaaauggaauggcuuagaugaauuauaaaauaaucggcuuuugggaaagugggggaaaguuuaagguuuaaagggcagagaagaaacuguuuuaaaggaagccaguauauuuacuuuucuuacugcaguuccaagcuaggaggucauuuuaauaugcuucugaaagugugguacacacaggauggcgcaucucuguggcaaaaggauauauuccugugugccuccuucugaagcuguggaaguggauuacugcugcagugggagaggggagaugaauaaucugcagugaucuaaaaccggaaucauacaaacccuuagggccuucauccuuagggggguugggguuccgaacuggaucccggaugcugcagucugugccugcccaagugaaaucacagaugcagguggcuucguugcuacacaccugugacagagaaagaagagagacacagcgauguggaccacugauaguaagcacaaucucacuuagaaggcuucccaaacauucccauggcuuugaggacuaaguucaugggucaaauuauugaauauauuuccaguaauuaugaaaaauuauguuuaggugaaaaaaacuguuuaaaaugauaugauucacaguauuagacauauuuagguauauaaauguccaauaaaguagauuuuuucccccugaagcaaauguuucuaggaacagcuaugaaaauauacauguuuaauacaguaaguuaucagacaugggacucaaaaaacaaucccagagaaaagagggagcaggcuccaggggcaauucucaaaacaaaagaccaagagacacaguccuuaacacgcugcgugaucucgccaugcccaaccgucugguggcacuuugccugccaggacagcacuccucaccccucccaccaucuauuggaggcacucuuucccagucagcaggcugacacccuccaccaggcagcaaauggcacaggcuugcaauuuacaugaaucaaauaaaacaccccgcaaacuagaaagaaaggugccgagacccuuuuaucauuagaaaugauaaaaucaaaugccaacgcuuuuaaauccaagauacuguaauauaugguuaugacuaauaagacugaacuuugcuuuuaaaaaauggugaaaaaugagaugggacaagggaaaacagcagagcuuuuaugucucauauuucuagagcagcaacuaaaaugcuuaaaaagucuaccuggugauuuuauuuuggauagaaacgguacugaacacucauuaugugucaaguuccucugccucuaacaucacgacgagcuucucccucacuucgcacuccaucaucagcuaagggcugagagaggguaaguacccacccagagucacuaagacauaacugagcagagccaggaucuaaaucaaaacucuuucuagccccugaauucguguucuuaagucacuagauaggauggcugacuucaaugucaucuucuugggauuaauaaauaccugaaggacaugaguaaggcacaccuuuggggugggggcguguaucugaguguguuucugaaggaucagcuauaggagaaaggccccaccugaauggggacccuagugccaccccauggaauggggucugagucugaagaaaaaagaaguuagcuaagcacccaugguccgugccuuugcuuccugcucugacaaauaggaggaauaaguuccuggcugccacaccauccccagcaugcuggacuaugucccuugaaccaugagccaagccacccccuccucucuggaauuacuuauguuguguguguguguguguguguauauauauauauauauauauauauauauauauauauauauauguuuuuaugucaacaagcaaagugaucagcacaccaggcuaccuggccucccugugagcuugugcuuuaaccaagcaucaccagaagaaaagcuuccugguccugucaccuugcucuccucugugucaccugccugucucuauguguugaugucgaguuauagcuggagaaggugauccauacacauaaauaauucaaauuaauuuauaaacguuuauuuuagcagaugaaggcacucagaauaugaugauaaucagggcacagaaacuggccacagucucaguaagaaauguccgugucugacuguguuaucacugugaacccagggucccagacaaugaaggucaaaccaucacacugcuguuuacuuacuuaccccguggccggagcagacuuuaccccuugagucaagugggcagcugcucauauucagggcuugaaucuguaggcacuuccgaucuaagcacaucauggaggggccacacggagucccaucuucaacguaacccacgucuguaucaucgucuaaaacuacaugagcaccacugaaagcagacagugaucuguuguauuaaauaauucaucucaaugggguggggcucaguucuaccccaccuucgaucauucagugcccagauaaaagucacaagccuuuauguuuacgagaagccuucacaccaucagacuugggcacauauccacccucuaagcuauuaauguuuacuucccuaucaauaacccugaguuauaauuuucuguuaucuaucugggcugcucuuaucuccagcuggccaaccuucauggccauuuuuuuccaugacuuaccuacccaaugccaucuucuccucucuccaccuucuuccuuaucucccguggucuccugccucggaucccaagcccaggaacugaaacuccaccuagucucuucugccucaguauaggcugugagcaucuuuauuuaucaaucagggcuaacuugcggggcaagguaaggacaaccagagccaguaugcagcauuacaauacauagcaaaagaccacaccucaacagugacccacauaaacauaagcaccacacuauccaacaacacagagccagcccgcacaaggcuugccauucgugaaacagagauacuguuacagugagccaggguuuauucgagacuuuucuucccucccaccuaucuuuaauaaaaguccaagaaagaaacugcuguuuguuaucauuuacagcacacagcaucaggaacaacaauuaucagcaggaaauauucuaacucuuuggguguucucaauauuaaggauaagugaaagguguuuguguagacagagaagaaagugugugauugauucuccaaggccugguggggaaaagauaguaugggagggaaauaaugcugagcaaacacagcagagcaaggcuguauuugauuugaaaaccauuacuauuaccucaaaggauugggcuaucacaacugaaaggagaaagccaggacuuuacuagugcuuaccuuuuauguuucaacguuagggguaauuagaauuuggauaauaauuagaaacuggauauaauuauuauuaacaaggagucuugcugaauguuuuaccaauaugguaguuuguaauauagccuuauaauucaguaaggcuauuaaagacaggugagguaacacacgcuggaagagugcuuguguacauggaaagucuagagacaauacuacagauguuucccagggaggggcuuauucucuaaggccuaguuaaaauuaccuucagagccauucaacaagauggaaaaguaacaguuaucugaccaagacgucaugaaauugugcagaauuacucuuggguaauuucaaacauuuauucacucccauuaaaaggugguuugaaauucugggagagugaaaauaaagggacaagaacugugucaguucugugguaggaucccaaagguguuuuaacagcagugccucugaacaagagagcgccaccauagaaccaugguuacucugaaagcaauggcucuuacuugugauguaaugcagcuuccuggcugaaaacacacgccucuugucuaugugcuauguguacauagacgaauggauaugaaaaaggaugugugugauaacaccaauaaaaauauuuaaugucuauuaucuguaugugcuuggguacuuauuagggcauccucuaaaccagauacaugcgacauaauauccugcuuaaacuggauguuuuaugaaaaaugaagcacaguauucaaauagugauauacugcaaugcucaaaauuuuuagccagugauaaaaugaguacagggauugauuaucccuaauccaaaacacugaacucugaaaugcuucaaaaugugaaauuuuaugaguacuuauaggaugcccuaaguggaaacauccacuuaaaacacagucacaguuaaaaugcaggcacacuaaaaguacugggggaaaaaaucacugcucagaagaaacauaaauggccaauaaauacaggcaaguucaaaaugacuuagggaccugcagcucaaaacacaauuagaugucaucucaacucacuuaaagcaguugucauuuaagaaauaauuacaaaugcaggcuagagucagaagaaaaaagacccuuaaugcacugggagugggaacauaaauuaguacagucuccagaacagcaugggggguucuuuuagauacgagauaguacuacuauauauuuccugugguauuaucacaauagccaggauauagaaucaguccagcuagccaucaaaggaaauagauacagaagaucuaguguaugcauaacaguaucagccacaaaguagaaugaagucugucguuuucagaagagauguaaacuaaguuccacucagaaagauaaacacagccucucacaaaggcaucacccuguaaaaguuggcuucauggcagaagagagaggaauagggauugggacugugaagcaggguauggagggaugguuggacguaauuaacaggugcuguaugcuuggauggagguauuucaaugaauacacaugguuccuaugucaacaaaauagaugcacaaaugacugaauuuccuucagccuguguguauaagguauaagugaaaaaaaaaaaaucccaugcuuaguguugggucccauucucaugcuaccucauugugcacuuacaaacauucuaacaucugaacacuucuaaccuagagcuuuggguagauggguuauaacuuggagcauaacucuauuccuaagauugugauuuggaaaacggucuuaacuacugauaaccacuaugauuuuaggcaagugaaguuugcaaaucaauauacuacuuuucaaagugguucuucaugugggaggaaaagaugaaaacuacaaaaucuuugcucuuccauguuuucagcuuuuucuuguuugagaccugcgaucaucguucuuuccuggguuuccugacuucuaucuguuaccugcagucaaucacucggccuugaugauagaaggaagucgggaugaucucuccuugaaguugaccgauacguggagcucggguaagauuggugcaaagcagaaauccacagaacacaucacugcacggguuugagaaggcagaagacaggaagaauccagcucaaaacaccauuacacauacauuaguuuuuacauguuacaguucugggaacuaaaguucagacaccaggcaaucagucuacaauagagccuuaucuccagcccucagaucccucaauagucucuucauugcagaauaaaugcacucagacacuguccuagcuaugccagccccacuuccuuaccuagaggagcacagcuucacucauggcagugaagugugcaccguugaaagaaagaccagcaauauucuccaucuguagcagcgugcuccuguuccugacaucuccugcccugugcaucccuccuccccacucuagagcggagggcagcacagccugccuagaaacggaugugaggaaaagccagaacaugaagaagauccaccuuugaaugugcagcucuugcaucugccuugcaacugugagcucacaagaguaagauuuuagacgucaacacaauaaagcagaaggggagcacuggucugcauccuuggugacauugcaugacucaucugucauaaggacaucucuaccuccacacuagccuagcuguucaauaaacaaugagucauacagagugacgacaaacaagugaagugucaagucucuaagacggaaguucacagcccacggggcauggaaauguggaaaugcagauuaaaaccaugccaagacagcaguccccacccaccagagcugauaaucauuauaaaucugcuaagaucacauauuggugaagacaguguacauuacaggagaguuuccuagugcacaaccauuuuaugucaucugauaacaaugaaaauaugcaucccugggaccuggcaaucauuuugcuaaguacaucucccagagagauagagacaauauacacaggcuguauguacaaaaagguccagagcaguauaguuuauuuuaugccuuuucucuccuuuuaacauuuaccuauuuuuauuuuuaguagagcauuauguugcuaaccuuuugacaguucauauaggaugcacacacuacucauccacaagucccuacuuucauucccuuuacuuggcauccuucugcaagcaguugcuauuccccgggggguccacccacucacugcuugcugcacgggauccaccggucuccauccuuuccacaauugcccuucucggugccuuccguguucagcuuuucauagcagaacuugucugaccccgcagccucuaucagagauggaggagagaagaaaacacauuuuauucuccgggccacucacacucaguggggugccacaaaccugucuaucaacugccucccagaaagaggacaaaaaggaaccuugauugccuguuccuacgauggaaacaagcaaacgcugauuucaagcucugaaugugcccuuugcugauuuaucaaaacuuucaaacuucagcggcuuuugugagcuggugcaaaaaggcuccagcauagcucagucugcaaugggagaaaucucuaaccagacccggcugguggguuuuagagugaccaguuuuauguuuuauguguauggguguugugccuagaagugaggcuauagaccaugugcaugcaguacccaaggaagccggaagaaagcaucagaucucuuggaaauggaguuacuaauaguugugagcugccaugugggggcuggaauuugagcccaguucucuggaagagcaacgggugcuuuuaagggcagugcugucucuccagcccucuuaauccuguuuauguuaacauucggggauuaauuugaagguuucagaccccugagguuguuaggucucuuuaaaucuuuuugagaugauccaccaggccuggaacucauucuguaguauaaguugaccuauaacuacuaguaauccuccuucuccagccucccaaaugcugagauuacaggcaugcaccaacaugccuggcucugcuaaaauuuuacaucaguccuugaguuuugauauuuaaauuuuaagaagaaguuuauguccuuauuaucuuuaccuaagugaagcacugaaguuaaauuauuucacacaaacaacacuggccaaaaccagaaaucauucacguggccucuuuuguguacuuucuuccauuuuggaagagccagcuuuagcuagcuaguaagucucaucucucugcuucucuguccaggggguguuugccaccuugacacaaaauagagucagcuuggaagaagucaguucaauugaaaaacugucuccaugaaacuggcaaguuuggaaggcauuuucuugacuagugcuugaugagggacggcccagccacuguugguggugccucuccugggcaggggcugcucaacuguuuaagaaagcagacugucaggaugggugggggaauaccccaggaggcccucacuugcucagaggauaaggggagggggcaagggaaggggggcagggaaggauugugggagguggugguggggggggggcagugagacagauguaaagugaauaaguaaaauaaaauaaaacuuaaaauauuaugauauagcuaaacaaagaaaaaagaaaaucauuuucaaacuuccaaauauaaauauauguaucaaaauaaauaaaugaaaauauaagcaaaaguagaaagggaggaaggaagagagggaggagggaagcagacugaacccuucuugaggacaagccagucagcagugcuccuccaugaucucugcuucaguuccugccuccagguuccugcugggaguuccugcccucauuuuccucaugauggagugcgauaugcagguauaaaccaaauaagucuuuuccuccccaauguuaguuauaucaguguuuuuuuuuuaucauaaagcaaaguaggucaauucauauaugguccucaugaacugaaaugaagaucacuguuaaucucagucaguagauauguguauuaacuuuuaggcagggucugaaauucguuaccaugauccugccugcuaccaaagaaauuccugcauauuaucacugacacugaauuacagacaaccaaaacaaaacaaaaacaaaaacaaaagaaccaaaacaaacaaaacacccucaaaaacaaaacagaacaaaaccaaaaaaaaaaacccaaacaaacaaacaaacaaacaaaacccucaaaaacaaaaaccaugccugcuacucauacaagauaaaacagaaagguacaaaguaaacuaugcaauuaugcaaguggccagaccguuauggcuauggcacagcuauggcuauaaccagggcacucaacccuguugucucagguagcugcagcacuccguauuuaacagccauggucaaugaaaggcaauucaguuuccaugacaauuucucacuuggauaucuguucccauggccuuugcguucacagcuuuauuugagguguauugggaauugaacccaaagccugcuaccccugcacuaccccugcaggccugugccuaacguuuaugccaucucuuuacucuccuccuuugcuggacuuuucuuucacaucacuucaugcuauguaucucugucacagacuggaagcacagaaccacggaaagaaacuguguguggccaucaggccagaagaugccaccuacuugucccccagauguacuggcauugauugucccuugucuugcacucgccauuguagcagcgacccugagagaaagaacacacacauugugagucacagggcacggggccauuguccccaaaaucugacaacaaaguccugcucugggugaguuacacaaaguucuccucauuccacaagcaagccuuuucacaguggccaauaagaaacauaaaguuaucaaagaaguagaagcucuaccacauuaaaauguaaagcucugggcacacagcacagcaugucuuuuuaaauguaaaauaaaucuugaaacuuaaauuuucauggggaacaaaaaauuguaccauugugaaagugagaacaaaaugacuuagcuacucuuauacgugaaugcugaggauaguaauacugacuugggaaaaggcuuguaaaauauugucuuuauuuuuuuauuuuuuauuuauuuuuuacuaaauagacaagcugaaauuauuuaaggaugguuacaacucagcaaaugagaccccucguuuccucagccauuguggccuucuccuuuuccuucaaucuggacaaccugucgcugguuagacagauguaauauuugcaaggaaauaaagcugauggaagccagcacccgacugcaauuuacuucaguaaacuuucuucccaaguuacauguauggaaaguggggugggggaaaugacacuaaucccuucuaaauugccuugaaaucuuagagcccugcuuaccugauuuugauugcagcuauagccaucuuguuuauggagguucggugggcacugaaaaauauuaucuuuuuaguugauguacaaaugcauaaaaaauucagaaaauguguuuaauauaauaauacaagagagagagaguaaauguacaauuaggaacauucggaaaaacacauuuaaugccauuaauggauuacuuaauuugacucuaucauuaaugaauaaagucuaacacaguuaauucuuuuuauguuuuucuguuuaccaggagaugggcucgauagcaaguaauguucauuugucaaggagcuacaagcagaagggccuaaaacgggcagcaaagagaagaaaucaguucgcugcggaggaguggacacauuaagaacuaauuugcaacuugugcagcuccuuguaaaugucaaaucugcaugugacauuaugacaugugccuaugggacauugcugcaaaagcaagagaaacagucuugaagcacaauguaaucaguguaagugcaguaucccucugaccucuccagccagacuuguuacuagaauaaucugugaaguaggacuugcugcugcugcugcugcuguuucaaccaauccaucuaugagaccauuuuaaaguacacuucauuuucuccagaaguuuuccagaauaacuccaguugcacuuuuuaaacauuuaagagagugggauaaaggucaggggccauaagguugaaagugaauaugaaagaaaaauauccaugggacaaggagaaggaagcuuaaggacauucacugaugucccucccauuugccauuuucucagcaaaugucuuuucaacccaacaucucaguucccaaaccagugcuccguucuucuucaucuguguuucauuugucuuuuugucucacacacaagauccauuaugacugcaaauucucagauucauuucaaaaugucaauucuuuuccucaguuucuaccauuuaaccccaggucuaggcugccaacauuauaaaccuggccgguaaucuccgauccaaacuucccugcuuccacccuguuucccuguccccagagagauccguaaaaauaugaacaccagaucauguugguccccugcccaaaaaauucugaauagccuuccaaguuucaugugaacugcuucucccauccacaccccaucaccuagcuggccccauuuccaacucucucaauggcugcugugauucccugagaugccaggccacugccugcugggcucaucccaucuucucuuuagggauuuugcucaacucucacccucucaaagcuucucuaaccacuuucuuuagaguggcagcuccucauuuucuacauuuccccuucuccacugcacuuaccaccaccugacaacccauauauuucccuaguuuguuugcuucugcccccaugauuaugugagcuccaugcaggccggguuuucucucuggcuuccugcugcacaaaacaacaccaggaugugguggguguucaauuacuacuagcugacucagaaaaugaauggaucacccauacugguaaaaugaaguuauuuuaugcugcaggcauggggccauuuauugagcucaucacaagaaagaugaaggaugcaugcagcuuuccucaggagcugugacacacuacaggacagagcaauaaaauguugguucugcaucuucuuccuaaaggcugaagccccuuucagaugcagucaccacagcucuucacuaccugguccugugucuuccagggaugcaacaauugacaguaagcaaaccacacaagagagauccccgggccucuuccaucuuucuggaucauuaucucauuaaucaacuaucauaaaguauucacuuacccuaaaaccaguaaaaccagaauaaauagaaaugagggcuggggccuccuagaagaagcaaaucacuuuugugaugucuuaagaaggaaggggaaaaaggagacugcuuugcugacuauacacacacacacacacacacacacacacacacacacacacacacacacacauauauauauacacacacauguauauauaaggauauauauauauauauauauauauggauauauaugagggauauagauauauauauagauauagauauauauauaucccucaucccucauuauaaacugucacagguacaugugcagugauuucuagucaaucugguuuuaguuuaggcuaaacaaagccaguuguuagucagaugugguccaugcacaccugcggugcugaucugaaugaaaaugcccccugcaagugcauauauuuaaaugcuuuaguccccaguugguaaaacuguuuaggucuuuuauaaguuguuucagucauggcgcuuguggcagcuauagaaaaguaauugggacacuuggaauccuaacuaacagucaggaggcugugguggaaggauuauagccaggcaggccugcaaaguaaggccaugccuuaaaaguaaacaaacaaacaaacaaacaaaugaauacuuauuaaggcuaggugcuaaucagugcaguguuuaauggggaaaucccgcagagguucuaaaauuccucuaaggaucuucagaacuggaacaaaucugggcccucuccguguaaagugauggucugugguaucugaacaccacugcuccuggguucacggggaugccgaugccgugcaggaagauucggugaagccauuucgguggugccuauuuuaaguuguggaauccaccauuaauuuccagugcucaccaaggccacuuucacggcuuucaaacagaggggacgaaagacaccaggaaaacaggacccuacggaacaacugaacaaagcucauaugaacucagagacuggaauagcagcugcagggccugucagggucugcagcaaauccucuguggauacuguagcuuucaguuuagcaccauuaaagaccccuaaaugugugaaugagugagucuugucccuucugucggggaucuuuuauuuuucuguuagcugaucuuguccaauuucaauaugaugguuuuuguuuuuuuuuucuuauuauauuuuauuuuguuguguuuaaauaaagaaaagaagaccaguguucagagauaucaguaaaugcuaauauaaaaaucaacuaaaaacaugaaguaaaaggauaaggguguaauguagccagguggaucaugauucucagggauguaggguucuauuuccauaaaaacucugaauaucaauaaagucaaacuuccuugucccuuacaaaauagaaggaaaaauuauggauuuuagguccuuuuacuucaacuaucuacuaugagcuuauucugaugaucacauuuuuauuuuauuuuuuuacauuuuaaauuauuaauaaaauagcauuuuauucuaaugugccacugaaagaauaacaauacaauuuuuaccaaagacacaugaaguaaaaagaaaaauaacugcauuucuuagacaauaaaauagguugaggaaagagccccuauuuuauguauuuucuguaggucuguguaguguauaugaauacauacauauauauauauauauauauacauauauacauauacauauacauauauacauauauauuguguauguauaugaguguguaugagugguguaugugcaguguauaugcaguguguguauauacauauauauuauaucugugugaguauauguaugaggguaugaggguaugaucuaugugugccuauggguaucagagguugauauuguauaucuucuuaugacucuccauaccuauguuuugagacagggucucucauugaaccggaaauucaccaauuaacuagacuaacugcccagaaauucucuugucucugucucccaugccugcauuacaggcacgugccagccacuacaucuggcuuucauggggauguuggggauccaaacucagguccuaagguuuggauugcaaacacuuuauccacugagcuuucuccccagccccaauaucuccacuuucaaagccuauuuccaucagacuccaaagcaauucaggaauuagauuuugaaauggaaaccuauauuuuuaaaaaacagcuaaacaugagagccaaggacauauauuguaguuuuaaaaaaauaauacuauccuauaaaagugacagucaaaugguauaucagaauauauauacuuaugaaagacagaauccacaauucuuguacucugucauuacaaagaaaucuauuuacauacuuaaauaugagaaacauaugcacaagagugacauauaaauaaagucaggacacauuuccaugugcucuaucauuaacagagccauggguaauaacacaaagaccuuccugaagguuaauuaacacaucuuuucuuuuucucuucucauguucucuuccagcaguuccgugcaaugccaagcacucugcucucccgucacugaacugauugggugauaagcugaugaagaauaauuaggcauucugagccagagagucuagugugggugggaagcaagcacuguccaguaugucuucaggcuaucgcuaucaaggggcuugucucugcaaggaagccaugcugaaaccaauugugccaguaaccugcuacuguuugaaccaggaucucuuacaagacacauguggcccuuguauuaaguuaaggcuauaacucaagcugcucauuuuuguuuuuauagcaugaucuuuuggcuugaaaaggaugcaccauguucuucaugaccccaguggacaccagucuaccuugcaguuggcaaguccaguccugggaacauauccuacagagauaacccugcaggagagauauuccuccaaaugcaugaaagucuuuacaucuauacugauaaaacaauaaaaaaaauacugaaaucuaauggauaaugacuggguaaaaagaaaucaacugauaaauuugcacuauaccaucacaaaacaagauaguaacacaggaaaaccuucugaagacacaucaaaaagaaaacaaaagucaaaugaaaucccaaauccuuacuggggcauacagguccucuugccagcauccugacauccuuugaaccuuuucuacuguccuccuuucugccugcuuucauuccacaucuugaagaaaccaugccucuaugcuuccugcuuagaaacuaacuccuuccacagcaacuaucccaaccuaauauucuaccacauuuuucuuuccacaguaccuuauuuuaucauauaaguaugaaaaaauauauguauauauacauguauguauuuauguauacacauacauauuuuacauaguauauauaaauacacauguauguauauauacauaugcauauauacauauguacauauccuggcauuuacaucagcacuuggcaaguaacucaacagauguucauuugaguggcaaauagggccauaaaauaacaugcuauaaauaaaaagcacuaaaauuauacaaauauggagucaagaagucaauauuaauuacaggauuauaaucauuuuaauggaccaaaauccugccaaagcacagaggcgagaggcagggacugcggcagugguggagaaaccuggccuucugcucccagccauggcgggucugcuugcucccagucuccuaccucagcucccuuccaaaauuuuaaauuguucaaaauguuugaaaacagcauguaagauguggggaccuaaggagaaaaauuuuaugaauugaauauaaaucaucuaaagauauuuaugaaaguggaauuuagaaaaaaaaaaaaggagagauaaagaugaaaaucccaaaauacgauagaaaacuuccugaaguaauaguuugguagagagcuagaaauaucuagaaaacaaaucuacaauaaagaaacuaaaauaggucuauacucacagucuuuauugaaggauuuaaaacaugucuugcacaauauaaaagauacaaugugguuuuccauaccuggccagagucuccagugcaguacucggugauaucacagcuguuuacggcaucccgacauucauacccucgugacugaaacuauaaaucaaaacccagcauuaggagguaacauucaccauagucaacaacgcugccaucccugcaucuacccacaagccugggcuuuaucauaauccccaucccuugcuucuaaauuuguaaaacuaucacagguuagaaaugaggcucagaccaggcagugguggcgcacaccuuuaauccaagcacuugggagacagaggcaggcggauuucugaguucaaggccagccuggucuacagagugaguuccaggacagccagggcuacacagaaaaacccugucucagaaaaaccaaaaagaaaaaagaaaaggaaaaaaaaaaaaaagaaaugaggcucagcugcucaucccacacugagguaagcaucaaacaggcacuauguauguagauuguaaaauccacugucuccacaaacugagguaagaaagcgaggugaugaaauuuauguaaagaagaaacacugguuuaguuuaacacaaagggacaaaaaaaaaugucauuaaacauugaagauuucucuaaaggauauacauacacacacacacacauauaaccaaccauaacuaauuuguccauuaguuugaauauuaaucgugcuuuagauaaauacauacaacaaaauuacaaugaauucauauaaaucaacuucagaggcauccauggcugccugugaugaacaaaacauuugguuugucuggcaaaggaugggcaaaauaugaagucucauuagccucaagcaauuuaucauuugguauguaauaugaggcaagcacaaauuaagcugaaaucucuuauaauaucaugauguagaaccucccuugguacugaaaaaaaaagcaauaaaaucauguaguuuuuauagcgacuugaaaugucauagaucuaacauaugagauaaagggguaauaacuuuuggaaaagaacugucaguuacugaaggugaaaaacuacacacacacacauacacacacacacacacacacacacagacacacacacaccccacaugcaagcacacacauacacacaugcacacaugugacaauguaaguacugccucaccucgcuuucuugacauuaugagauucaaaaagccaagugggagauauaaguucuaguuuuuauacuacgugucuaaaacaaauuaggguaaguuuuaaaaaaugaauguuggaaauagguuguucaauuuaaagaccaacagaauuuuuccucuuuuguccuaugauuuaaucuguuugucuguguuaacaggguaacuugucuaguuuggaggcuguagguguggguacacccucuugaggaggccugggaggaugagaaaguagacagugaauagacacaugcugugguccacaaaaguucaauaaaauuaccaguaucacugagcuaacaugcauaaauguguaucaagacacucaaaagcucaacagacauccugacacggcuggcuaacuugucaaggaaugaaaagaaacaugaaacuuccaggggacucacaagacaugagguguuguuacagcaggggccgucacugcagugggccccauuggagagcgaacacuucuuacagcaaacuccauagcauuccuagagaaaacacuccauugaguaaaccaggaacauaccacugcccaucaguauucccuccaugugcaguuuaugcaucagaugacaagaguucuauaaucaguacacuaacauuuuagagaaaccaaucacuucaaaugaugacagacuccugccauguuucucagcagagugaucucccaagaguaugauuauucauuaacaggcacccccacacaagccucuguaacuauaccauguucuuaauacccagguuuuaucucauaaaggaaaaaaaauaaaugcggcaugggaaaugcucaugauucuguacaaggugccugagauggauaugagcucugaauuaacuuuuuaaaggucaggaauuugauuagaacaauccauuaagcuuuucagacacggcugcaacaacaacaugacaaauucuuaugugucugagcugggacaaagcauugaucauagcaaucaggaaaaaaaaagaaggcagugaccccacaaugaaggauaacaugucuguucuccgcuguuguucuucuuagcuuggaggaugaacugagcuaaaaguagagacagucucuuauaccuaccacauggaaaccacagucgcauuccuccccggccuccacauauccauuuccacauuccgugggcucaaacagcugaaagagaauggagaaugcagagaaaagcauuugaauuuauugcagaaaaccuauacaucaagcuggccauauacauggcuguaucauaugaaucuucugugauuauuacuuuauauucauuuuuacuuguguguucuguguguaccuauguaaguauaugcacacacacacacacacacguggguaguuggagaggucagaaaguaacauuggauugcuuggaacuacagcuacaaauaguuauaagcugccuagugucagugcagggagccaaacuccacuauuccgaaagaacagcaaguucucuuaacugaugagucaucauauaauaagugaucuacuauuugcuuauuaauaacacucuuuaaaaucaucuuagaaaggaugugguaucucuggggauuuccuugguggggucuugagagacaaccuuccagcauuagauugacuauggaguuaagcugucaagaaaaauagaucgcuucccauguuuucuaauggagcuaaaauguauuaguaauaagacucauagauaucuaauuugcugacuugacuaaaggcagccaagaagacauccaaacugucagaaagauaaauauguuuagucaaaaccaaaugugugauguacaacuaaggaaaugccaauaagcuuagaacaauguugucagagacucaaaucuaucccacucauuggaaagaaaucugcauugucuggcacaaagucccaccauugcauuccuugaauuaucugugaguagaaagaaaauuaauucaauaacuuaggaauuucaauaaauuaacuauaugcaaauacccaaucucuuaauacucauaaagaaaaaaacuaaguauguuaaguuaauguauagccaugugaaucaauagaaaucucucagucauugcugcacucauagcagaagaaguuucuagaauaucccccccucauggugccaugaacuuguuucuggauaauaauacuauagauggaucgaugagaaaguugcuuacucacaucaaaagugucuauauccuauuggcugggacaggacuuuccuggaaugauuaucacuucugggugugugggguauaaggagagagucuggaauagcacaccucaacacagaugcucagagccaugaacuucagagaaaaagcuugccuccaguagccacauacacuaugggcaacagucaucuaccacugagucuacacaagaaagacuugcuucuacuacuuccaggaaagaacuauuauaagaaguaaggaaauguucuagccgaguugggugggagucaguagugcuaauuaaucuccaugcuccuuugacuggcaggcaagagaaugcagaaaaaggcagggcaguagaaagauggccaacacuugguaccaggcuuuaguucuuggguucuuuccccuuccugaguuuggucacuaucucaaaacagauguaaaucacagcaacugggaagauuucugaagcagagaaaauaugcauaucaauggaaaauaacaagcaacacuugccuaugcauauauucauugacuaagaacacuggggauaaaaaauuaguuauauacauacaagcuacucuacuggaauucaugaagccuucuuuuuugaucauuguaauuuguaguuuaaaaggagaaauuguccuguaucuaacuucugagauugaauauguaaacauaguuuuuuggugugaaauucccaaguuaccaggauaauuuucuuccuguuuacagguaaucugagaaguguauauuccagagaccuuaaccucuccaaacaagcuagagcugucuccugaagcacagugcuuacaacuggcugccaguugcagggcaagguaacacuagccgugcuccauguaauucaaaacugccagcaguucacaggaguucuucauuacacagcucacucauuucagaugccuucaagacuucugguuucuaugcccagaggucacugccaggaaagaccgagcagccuauuuuaauggugcacagucacuuuuaacgucucaguucucuugagauuuacagcgcuuuggcuuuacugagauuucucagggaugucagguuccaagcagucauuccgacacuagcuguaucacucacuugugaguaugaaauaaaucagucuauccguuguuugccuuggugacugauuuuuuuuuaaagacaaggucaacacaauauugccacucuuuaaauuugcagaguaucgaacauucucuauacaaaugaacucuaucugacaugugagguguuauucuaaaagaaaagugaauuuuuucccauggucaaauuccaauaccaucugcuaauaaugccaguucugucuuuucaacugcuggccugcuucauuuccaaacaugcuccuauaaaaacacagcgccuucugcaaaagcguuagccugucagcuggagaaugcugccuuugcugaacuuuaggaaagugugaugauugguuguguucuaugucaagggaacuggagcauaucuuauaaucaaacaauuucaugcuucuuacagcaagaaauaaauauuuauaucaugagggccaaaagaagauuuucaaaauuuaauuuuacugucaaauguguuuucugaaaacuccuaaaaaucucuucuggaaauguauaauuuucuuuaaguuugugcuugaggaauugcaauuuuguuuauacauacucuuaugaaacgccauugccagcgugggcuuccagaggaagggaacuauguaguagaaauacuugagguauuuauagaacuugcaaauguuagaccaagaccacuuuuugcuuggcugacaucaguaaugcuuucugccugggaccagaucaccccagagaguggaggaguuggagcuggaugguaggagaaacuuucgggaggagaaaacuaagucuccagaaggaaugccaagguuaaaugagacuuagcaaagaagugauccaaggaaaaguucuuuccauucugacucccuaugucuuagcagaaaaaugaaaacaccaacaugaaauucuguagaauuuugcguuuuagggaacugcaagcgagcacugaacacugacacucaauuuggucucuugagcaugcagcggcucucuauaacugagcaucuaucaguuggguuuaguggcuccuaccugaacuugcagugucugggaagcugaggaagggagcuuguagcaauguagugaacugugugacaugagacuugcuuucugagaacagucucugauguuugccauauccuuacuauuggaaaaucaagucacuaaccuuaguuggccuauugaaaagacaugcuccgccaccucucuguaaaaagucucuguacuccaaaaugcugcacuuugagaacuuucgagagugggacacccugaagaaacaaggaaccaauuauguaaaaaaaaaaaaaaaaaauucacaaaagccaucaucagagaagaaaauuaaaaaccacugaaaguucauccuggauguagauggaucagcacaaauauuugguaagaugcuuggguacaagcugcuacaucuacgggguggagucuauaggagaaaggaaaaugaaaaccuucacagacuaggagauuggucacucccaagcuaccgacccccugccuggucugucucgaaacccaucguuuaaaagguuugcuacaaaaucuuaaaucaagacuagguuuuaaagcuugauuauuuuuauuuacugugucucaauagaggcaaccucacuuuccuuuacucuguucugaauaaaggggguccagcagccuacuaaaccuucuuuucagagaagaggcuggaaggucaguuuauuaaagacaguguuacucaggcuucaacaagccaaaauguaaguaaaugaauaaacccugaaggaugugugggaucaugcuggaucauacaugcauauguuauuaguguguaugcccacagcaaaaaagaauuaagggaugcucccgugagcaauggcucuuuauucuucauuucaaauacaauuauugagcaauauucaugauuuagcaugaauaaaaaaugaaccucucugugauuuauucaaucaaauuaagaccccuaugucagcacacaggggacuaucauacacacgacgagguuaagcuaaaucauacacauuaguucccagggaaugucugcaauaggccauucuaggauauaaugcaauaguuuuauguaugaggguaugugcagaauuaaaauucaccucuauugacagcaaugucuuacaagaaguauaccaaauauaucuuugagaaaauauacauuagcuucaaauaguuuauugcauccuauaaauauucaauccaaaacucacuuagaaauugacaauuuaaaaggcaauaauauugucauacaaaagcaacauauauauggcgucuuugcuaugggaccuauuaagccugcaucaucauaaagaacucaacuguggagcacaaauaauauggccggaaaaggcaagcauuucaagguuagacugcauuucaaggaauaugcucuggcaucgaagggguaacaguuaauugcauaaacuuuuuccucucuauggaagaagaaggaagggcccccagggaaggagaugguuucguuggcaucagugcagaacaaugguaggacaaaaaauucccagugucuggccuaagcaaagacaguaagaaagaaaauucucgccacuacuaugaugccuacuggcaauggccuacauagugugggagucuccuggaaacagcaguggugccaggucucaggccacgagugcuacuggacagcugguccaguugcacaagugcccaccaaggaaagacaaguaaaguaauggugcuugucuaccacuuggcaacucuucuguuuaggcauuauaacucugaauuauuuaaaaaaaaaaacaaaacucugucgacucuacaaacaauaugcuacaaauuuauuaccauaaacuagcauuuauaaguuccuuaaaauguaaauggaugacugaauugauuuucacuggcugcuucagguagaccaucugcuuuuauucuaaguauauuaaaagauuaaugccacuaccaaacgcagaagcuuuuagucaugugauuccuguaaggguuaauaaauacaaguagcuaauacauuucacuuuucuccccaaccuuaaauuaaaaauuaaaacauaaagugaauuagcacugucaguuuuaaaauaucagacaauuaauuauugaauuuauacuaagugcuuagccuaaaagaccaguaccugagaggcugugucucuaaugacuauauaugcagccauuuuugcauugggcauacaucacaugcaagaguaaugcagacuuacccuguuucuuccaugaugcagccgccccaggacucuaugcauucacauucuagcucaaugaaacaagaacaacaaagggggugaggggagacaaagucacagcuucaguuugcaccaguucuugcaaaacuuccucaauacagagugucaagacuccucuauuuccuuuaguucauggguucuuaugccuggaguauagauugcuuccuaagggggaaaacaaccuugguccucucuucauuuuuguuacucaguuaccuugauuagauuucuaaaauucaauguuuaguuagaaguaccauuggcuagaaacaaaaagaugaauucuaguccaucuuuuaaucaaggagagagucccauagagaagacacucagcuuuuuuugaggggggggggggaaggggaggggcagggugucugcuuuagaauggaagugaugucuaccuaucucccagcauggcuuuagggcucaaacagauagauggcauucccagacagucuguaugaauacagcacaaugucacugaaguccuucagacacagggcagcuaaagaauaaaauucaauuugcuggagucagggcuaggaucagccagagaagugcaacaaucucaucccagucuacuucaccauucaguccaauaacagcucagcugaccccagcacuggccuccaggacuuuuaacuaaguuacggaacccaauguucuucuucccgagucugagcuaucugggucaguuucugaaacuuuaaagugagguggcuacuuccuugagaaagcacauagucugagcaagauuuuaguaaaugaaaguuuguggagacuaggagacuguugcugggugcuugucaugacuguguguacuugguccuuaaugacauaaagggacucaggaguauggaugcggguguccuuccacuucuccacaguacuaccuaucagucacauagaagacagcaugugagauaaugcacuuuucuuuucuucucugggaaggccugggugggaagagaggguuuuuuucuccucgcucucaggacgauauauaaugagagagugaggauuucagcuuauuuucucauuaaaugaacaauggaugaacgugcugcucuuuuucuccaccaggucccauugugaugcuuugccuucuaccacaaaaauguaccaagauuauauuugaccacggugcucauacaaaggggacuaaaauuuggguuggauuuuauccugauuuuaaaauaaaugagauauggacuuuauccugauuuuaaaacgaaccagauauuuccaugggcuucuaaauaucugacguucccucaguccucagcccacuugaaaaguuaguccuauccuuccuucucucaucuguucaauggaaacaguggccucaacagucccuugccuuacuuugaugccacaugggucaggggccauggaugagcuccucuuggaccuaccugcaccagaggacaauuguguccugugcccacgcauuugaagcuuaaagggccagaggcaggcuuugcuuaggggagacaggagcucaccuucuagauaugaccuugugggugagugugguuagcauuuaaauaugagcuccuuguaugcuguagaucucauucccaaugcacuauauaucugaucaucucuccacagagcuguaucugucauuuugugucuaugcucaaaugauuaaaucucuggagaauauaugcauaccacuaccaccccaccucgucccaacguucucuauguaagauagagcugacggaggauaagcuuaugaauuuugaaagagaaauguauuccccucagauagccuaauaaugaucucaaaauguucaagauuauuuuuugaagcaugagaugcacuaugauuaaaccacgguggcauggaaauaaaguauucucggugacugggcaugcguaauacacacagaacgacaaggggacuggaguaagaagucaguguacauacuuggcuuccugcucgaagguucccacuggauuccaagguuuugagccaggcucugugauaauacuugugccaccgccauuggaagaccauacuggguuuucagaguugaaaauguuugggaaacauuugagagaguagaacaaagccaguuauuacuucuucauuguuaucaaucucauuucaagcuccuuaggagagccuuaaaacaucuauagaugguguacacccuucaaaucauuucucccuugagacugugccccacaagcaucuuucagaacaggaaguuuucacaugggaacagaaaguaaaagugacuaagacugugcuccaacucaacauauucaaauaugucaagaaagaucacagucagcuauuggaugggucacacggcccccaauggaggagcuagagaaauuacccaaggagcuaaugggaacugcaacccuauagguagaacaacaauaugaacuaaccaguacccgggagcucuugucucuagcugcauauguaucaaaagauggccuagucggccaucacugcaaagagaggcccauuggacuugcaaacuuuauaugccccaguacaggggaacgccagggccaaaaaggggggaguggguggguaggggauugggggguggguaugggggaccuuugggauagcauugaaaauguaaacgaggaaaauaccuaaaaaaaaaaaagaaagaaagaaagaaagaucucccaguaccuaaaagcauucugaagugagacugccgaauaagaccuaucccagugcuugccaggauuuugaaacaguuggcugggcuuuggagugcuucuuucaauuaaaaauuuuugugauaaagguacccaaacaaugguucuauaaaaacauuuguuuuaauccauaccaagcuuaaguagaagacauaaaaaugaaaauuuauauaggaagacaaaauauaaucuauaaaacuuuuauuuaaaugagcuaauucuaaacaagaaagcauuaaaaauuaaaaaaaaaaagagucacaggaaaaaggauugauaaguugauaaacacuuaacaucucaacuagagaccuaaaaaucucugaaccaauuuucagguaauguuuguaccauuagaguacaaaacuuccauggugguauacaaagcugucaguaugaacucagggcuccauuuacugaucugaaccacucacauuacuacaucccuaaagucauuguugaagacuugugggagaacaguuauacacggggccuuaaugaagaaugaaguuaguugcaaagacggagcucuaguuacagaaaucaugaaacuuaccucauucacaccaaccccucuuauucgagaacacacgccuccaaaguaacucagacugcuucucuuauaauggaaugucacgcgccuuaagaaaauaagguacugucaggaaacaccacauacacacuccuaaaacaugaauucucccacacccuaaaagucacucccaaccggaaauaaaaacaaacaaaccuguauuuaaauagauuuccaucuaugcuguuauaaacacauugacucuuuuucuacuaaagaauaucuauugcugauuauuauaaauugauaaaagcugaaagaggaggugggcaacaggcaaaaguaagacagaaagagggaagguguugcuugguuggauugcaggacagaaccauaguggaagaugaaaaaacggccaugaguggggaggaggaagagugggaagagaggaugaaucucuuccuuagugacagaaacacaccugcauucaguaguugucuaaaaaaagguguuuucuagacguccuacagcuaggugugcucacaugacaaugaucuagccaacauguucgaaggaaacacacacaagcuuucaagaaaccugguuuacagaugcuguccuuauagaaggagcacccucuugccucucuccaagccaggcccuccugcugccuguagagaaggcaacaguaccaggggcaccuuggguugugcuuugaccuuaaggauagcugcucugugcuuggacaguagagcugaaggccacugaaccaagcaagccucccagcccuggaauucuacuuccauaaacccagaaggagagcaacagcaacuuugcagaagucacugcccccuguaugggggcuaacggauacaauaaggaagauaaacgucgagccaaacugcaguaagagccugaaggagcacguacgagaugagguggaccgcgucagcgugcuguuugauucgcugccgguacuuggagaagucauguagcaucugcacgggguugauggugaugucaaugugauccuucucgguccaggucucgacagccaccaggacaacccugguguugagcuguuccuuguaaaucuggggguauacaacaggacaggugcaggaggcaaacacugggucaaacaugcacaaucagugagucagucagcggaagggaggugggggaggggagagaacauggggucagaauuagcuaaucauacagaaucggcuuccgcuuucucuuuuccaagagccaaaauaacgaaggaaaaaaaaaaucacacaacucuguauucucuacucuccuuaaagagauugucuccacccucagcucagaauuuucaguugccuggcauauuaugagaauguagggacgucaagguacucaagucaggaccugcacugucaacagggcccagcaaaauaaccuuuccaaaccccagaggagaugacaaaccggagccugacacagagacucuaaguguaauauaaccugcaggcuugggacaguucaucaaacaguauaguugccuugcuacacaauauaauaacucucagagagaaucacagagcugaggccaagugcgggggcugggggcacagaucugaggcaccaaucucacucucacuuccgaguggcaucacucaauucacaucuuguuauucuucuguucucaauacuuuggaccaaaucaauaacucacagaauuaagcaacuucaaggagagcugccaaguugccccgcuuuuaaacuaucuaagaaaauaaaugaauggucuuugaagacagucaauaaagaaauuagcaucaaauugaagcuauaaugucuuuacacaaaaaugagcuaaguauaauauauuucugcaauggacgaucagcuccaggauuuuauaaguauaacauaaacuaaaaauuaaauuuugcaaaguaugauuuuauucaaucacguaaaaaaaaaugacuaaugcagagaugcugccuaauaaauagcuuuugcaggggagaauauguguuuaagauucucuuuuccauauccaguuauagguuuccugugagcagauugacaagggcugaaauuaaagaaaaguaauaaggcagauguaaaccggcucucagggguucaaccuuaauuuuauauuacauauucuaugcacaucaacucauauuacaauuuugucagcugugccuaugaggcacauaacauaugcuaggugcacaaaauauguuaugaauauuuacaugacgggugguuuggggcuguuuaaaaggcagaucuucagagugaguagcauuuagaugcuuggcaauuuauuaaaaaaaaaagauuuuuuuccacagucaagaggcaccauacaauaaauacaagauaaaaaauacauuuagcuuaacaaaguagcacuucacaucagaauauauaaauuaauuuaugcaacucaauuaauuauuuauuggaauauaauguaugaaacucagcucuggguuguugcaaccuaaggcagggaacaugaagaaaaucuaaucggucauucucuggaauuuaugaaauggcacgaggggaaagcccaucaguagugaggacacguagggccacaccccucugaaggaaggagccauuucauugucccaagucauucuguguggcaaugacaccuaauuuuaucaucuagaauacuagaaaguaagucugagacauuccacccugggagaacuaagauaauaaauccacagucuggagauuuccaucuaucuaaacccucuuaacacacgcugccucaauccauuaggacuucucuacuuacgcaaaaauauuuaggaaaagcucaaguaguuauuaauaaagccucauugacugaggauaauuuccaggcuucacggucuuucuccgcugcacuuugucccccacggacucugguaauaaccgaggcaaugcuauacaauuacuguggguuaauaaaaauuucucacuguuuaaggagguggcgaugcuagcuacucugauuugcucauuagauacuguacacauguaucaaauuauaucacugcaccccacagauacguggaauuaaaaugauaauuaaugaaagucaauaugcuuagaagaaagaaacaaugccaaagcuucuugggaagucugagaauucugaagcccagacagcacuuucuuacaaagcucucccuccauccaacaguuucuucgccagggggacguaugaauacauuguuuucauuucauccaagaaauagccaacauuaucacugagcauagggaaagagauaugaaccaugcuuuuuggauuagugaaaagaaguuucaaggaaaccaggcuacuuacagaaucuacaagguugaccacagacuuugcgaaguuguugguaugcgcgugagaagagcggugcuucuuauacugggggguaagagaagauggaccagucacuuccaaguucuuacuguccucaaugucaaagauuccauauuaaacagaaaugcuagaaauauggcucaaaagaucagaaacugguuugugccaagcuggacacagugaugcuguuuuggcuuuuguuuguugguugguuauuuuuuuucuuuucuuaccacacaaacccaggcagaaaaauuguaaaacaugucccauggucugaaggagccuauaguuguauacacagaaacucugucccucgaagucaacuuuuaauucagucuuaacagcuacuauucgguucuuuugcauucauaaaaaugaaucuuuaccauuuacaaagggcuuagaccaaaaacuagucuccucugaacaacuuucuuacuuuaaccucaaggucaagcacaagucaaagccauuuccuaucaugcagcgcuucauguagccuuguccaugacggggaguauuuguucugcuuuuaguaaauuucccacagaggaugccacuccuagaacaagccuuuauucuagauaaccaaagccaaagaugaggcaaaaaagaaaaggaaguaugcaaacaauaauaguguaaaacuauuuaagaaaaucauucuguaugucaaccuggaacuguggugggcuucuauaaucccagagcuugggaaacuggguaggagacucccuugagcccaagaguuaaggaccuguacaaaagaaaucucaagaacagaacaaaacaucuagggacauuuguuugggguugggagaaguugcuguuuggaggagucaacagucugagacuucauacuccaccacuguacagcgagugcacuaccauuggacgcaacuccccacuaaggagucagauacuuuacucaacauacauugaggaggaggaggaggaggaggaggaaacauuugacagcuuaagucagcgguaggaaccccaugcucuggacugcuccaugaggcuauuguucuuucuacaaccauuagguaaaagaaaagcaugguuuaaacuggugacucuuucguaccaugugcuugaaacugguuuucuuuuuuuuuuuccauuuuuuauuagguauuuagcucauuuacauuuccaaugcuauaccaaaagucccccauacccacccacccccacuccccuacccgcccacucccccuuuuuggcccuggcguuccccuguacuggggcauauaaaguuugcguguccaaugggccucucuuuccagugaugaccgacuaggccaucuucugauacauaugcagcuagagacaagaguuccgggguacugguuaguucauaaugugaaacugguuuucaacuguacuuauuaaaucacuuguaucuuucagaaagauuaagaauauuuaauacacaauaaaaaucauguuuuguuuuguuuuuuccucuucaauaauccuagauccuucucagagucccuaucucugaauaccaccaccaugugaauucgagaacaguuccuaacacaugaauuuccaaaagcacuuuggaaccagcccaguaacuuugaacugugauuuagagguaccaaacgugagcugucucuucaguaccaaagaaaagacaccaaggucacaggaugaaacucagaagucuaaagcucuaaaguaggggcucagagaucuuaagucaugauccuacuuagagcuugaaacuggaagcugucaaucaggaagagagcaugcgacagagcccugagccaaguucccaaacaugaucuaaggggucagauauuaaacaacuauaauaggagagagagagagagagagagagagagagagagagagagagagagagagagagagaggaauuauugggucgaagaaaccagaagugaugaaaacugguuucaaaugaucaugaugaugaugaugacgaccgucaucuguauucaguguugguaagagagaaaacgaagggcagaaggaggcuggggaggaagcucgugaccgaguacuugcugaagaagcagaaaaucuugaguuuccagccccacaaagaaaacaacacucacucggcacccaggaucuaugagaaacuaugucccccgcacaacaaauauccacuccucacaaccccaugaagggagcucuauuauccucaaauaacuuaucugggauuacggggcugaaaccaaaguuuguccuacucugggcuagaagaagaaauuaacuuauucaguuaauaauucuuaugagauaacuauaaacuauugcuuauuauauagcccuccccaacaagucaagauuauugaugaaaaucuguaauuuguucaguccauuaaaaaauacagugguuuuuaaauaaggaaaaccaaaugagguuuuaauugaaaaccuauuugagucauugcugauuugcaccuuauugguucauauuuaauaacgcggcagcaaugcaagcaaaacacuugcuuuacaugcacuuuaaaauaucucaaccaauuuuuuauuaggcaguuuuuaauauuuauuuuuagcuuaagcagcucaaagaaauguuugcagacuuuuaucaagcuauaauugcucacaaauuagguucugccagcuagguaccaagacgcuuucuacaaauuugagaguuuuuuuuuucuuucuuucuuucuaauugaaagccucugauaauugggcugcuuguucaaaacacgagaggugcaauuuuucaggcggccaguauuagagagggaagcucgaaugcaaauguaggcaaaauguuuccauuuccugcaugaaugagaacuaauuuggcaaauaaagaaaaaugugcgagcuccauuuaugauaaaacuuaccuucacauuuucugaucacugaaaaccauuuccauuuaagccggcaaauuggcuuucacuuccuggauaaaugagccccuuaagaaaugugcccuuuagaaaacaauuaaagcugaaccuuauuuucaacccaaagguaagaauuauaaaaccccgcuggcucguacaguacaaacaccgcgagauggggcuccucgguggggugauuaugcuaaagcccagcagcaaaucuccagacacuggaaauugacgcauucacuuauccuagcucagucugcuugcggcuccgaggugcaguauucugcucucuagucauuuauugcaucuuugcagugauaauauuuuaaaacuucauuuaauaaaaagauuaccuaaaaggggagggggcuuuucucaacuccuaugagggggucuuaaaaaugaauauuuauuugggaugacuauaggacaggauguaaucugguuuuauagcaaagggauuauuuacugcuauuagcccaaaagaauauucuucaaaugcuagaaacucccugguaguuuuguucuaucuggggcauuaucaccauucaaaaaaaaucaagguuuguuauuuguucauuugcauuuuuaaaguccaacaccacccaaaauuuaucauuaaaauaugcucaguuuucauucccuauacuacaaugaaaugaaaacucaaacgcuguucauuuaaaaacuuggauuucuuuuuuaauuagaagaugugggcuggugagugguuugguggguaaaaguacuugucaggcaaggcugacgacaguucaauugucuaaacccauauuaaaaaaaaaaaaaagccagaagugggccugcaaucccagcacccugaugcucagaugggaaauggagauagaauacuagcuagccuagagaacagcauagcagaaacaagggucucaguaccucugaccuccacacuacgcaugccuacaaccauacacaucauacacacaaacacacaauaauagacugguguuuaaauacauguuuaaaacaacuuaaauuaaaagacacaguaccccaaauaagaugaugauuuuuaucacaaaauaugugguauaagcaaauaagguuuucucugcagagaacaauauuuuugagaauggugcuauugcauuacuuguucaauuggguacaguguggcacuaucuccugugccugcucucgucugugcuacuacuccacucugucacauacacacacacacacacacacacagaguaaauaacagaauguucucaacuucucaucuggaagagcugcacucugcaguuguauacauacauauauacacauauacauaugcauauauuguguauagauaugauacaguuaucuauacauuacaagauuuauuuaauggauguuagaaaacgcucaggcuuuuaaagacauaauuccacaacuugccacaaucauuggguuuggaaaguaguuagaaaauucucagucagaaaagcgguucagaugaagacagccccaccaacacccuucagaaauucagauuuaagccuuuuuuagcgcaaguugacaccugaacauuugguuuuccuuaccagggaacaauucuaaguuauaugugauuccaaaaacccauguuccuucuuacuuuuauaucucaaagaaaguuauuuaaaagcugauacagaaaauuaagucugucuacaaaaaaauaaaaagaauuccacagggugagaaaauaauuuucagcacaacugaauuuuugcuuaguaacuaauaguaauuaguuuaaauaucuauuaaaaagacucaagugaaaauuuaaauauacauuaaaccuuuuguaauauacaguuucaaggauuucucugggauaacugagcuaaauggaauuucauaaugucaauuuaguacaaaauacaacuuuaucauauaguucacuaacuuugauuucccuaaaauaacaaggacuuaaugaagcuuaauauuguauucuaauauuuuauaaggguuuuacccauaucugacuuuuaagcauggugucuucaaaaauacaacucuacuuccauaaaaucaacuacucucaaugagcaauguuuagaauuaaacugcauaacugugacaaaauaaucacuagccgaaugagauugggaaugucgccgugguggggccagaugcaaaaggcucaagggaaccgcuuggccacauccaugcggagcuucaguuaauggucacuucaguagcuugacacaccagagaugaguuagcaguggagaaguguaucugagagguuaccagcacaccucgggaacugagugcaguagugcacagccuugagccaggaugcucaggugcugacaauggaaguggcuaagcagagaauagacacaagugaguaugguguuucuguccauaguucucuuaagcaucacuggagugcagcaccuauuacucccauggguggaacacaacauuauuuguauuaucaauauuuagucaaagaaaccacucauuuaacguggucucuugagacagauguuucauuuguuuguuuguaugugaagugccaggguauggaacccagagccucacgcgugauuuuuuuuuucaucgcaaaagcaugggauagaauacugaaccaguggccacacacacaaacgugaaagguagagagcaaggacuuuaaacauggacaagugaaaagcaucauauugguaaaucuacccauuauaaaucucuauuaaagagguaauuuuagagcugucaaaauuccauauuguuacugucucuucuucaucuagaaacacggcacucauuuagaaccaccaaaugauugugucuaaacaucuggacuuuauuaaguuacaaacaauaguucaaucaaaguaaaaugcauuucuuguucaacaagcucucugugcuggugguucgcaugagaauggcccccacggcucauaucucugaaugcuuggucuuuagcuggaggaacugcuggggaaggacuaggauguaugagcuauuuggaagaaaugagucacugagggugaacccaugcuagccccuccucucucccugucugucugucuaucuaugugucgguccaccugucucaaccucuacugcucuagcaccacgcuugccugcuacuccuguacuuugcuacccaccacagggaucauggacuuacccucugaagcuguaagcaaggccccaauuaaaugcuuucuuuuaaaaguugccuuggucauagugucucuucacagcaauagaacaguaacuaagacagcuacgauucucuauucuuaccgucuugugaucauuaacaaucauaagcuccaaauacuucauuucuucaaacacaccacgagauggcuaaagaaaauuuaaaaugcaugguuagaacaaggguugauauaaaguaucucuaagccuuucaggacucuucauugccuguuguauagcuauccaaaaaagaugccugguaaagcaaugugacuauaaagugccacugaacaaagaagaagcuagagaaacacagcgucacuaucgccaccugccaaaaugagaaauaggucauaugguuucuguguggcuuuccagguaaaauuacucuaaaggaaaagguacggcaugauagcuaaaaauaaauacauuuccuuuucuacaguaauaaugauaaaauauucacauuuacuuaaaaugucaaagggaauucacuuuaaauucaucuaagagaacagcaggcaccucugaaaucacaucaggguggucaauaagaauuagaggucugggauaaaaggcaucugacagaguuccgauuuccagccccucacaggaacaaacgccgacagauaacacuuuaggaauaaagacuguuuuacuucucagucacacguauccucucacagcugaaaagguaaugaugaccauucuuccucauuguguacugaguaacaguucaguacaggguagacugcagugaaaggaaaggcgcauaagccaacugcaucuucaagaguaagcaaaguucuaauuaagugagcauaaaaauuguauucgugauuaccauaaugccaguguacacuauguaagaagaugauucaaacuugaacuaacuuuuagaucgugggagguggggggagucuaauucauguaacacacauacacacaaaauaaauuuaacuaaguauuaucuaaaauguauaauuugugcuauaauuacgcauuaagucaucuagugaauuacuauguaaccuauaagcuacagaauuaauucuugguuacauggcauucaccauguaauuacuaaacagucccaaucauuacacccuucuaaucaacuacacauuuaguuacaaugccccuauguauuuaucagaacauaaaaggcaugcaacaguuacugguuaugcagucucaugacuuuuuuuuagccacugucauauugccaauaaaggaaugacauuguaucauucuggucugaauaaacugaauaaacacauucaguuucaauuuuggaauaacaguuuuuuguuuggaagaaauacaaauaaacuugauuagccaauuucuuuuaagagaaauguucuauacggcauuguauaagccagauuaucuuuaaaacuguggugcagucucuuuauuguuuguuugcgucuuuguuugguuugguuguguguggagggugaaugcaugggaaagccagaggucaacuauuggaaucaguucucuccuuccucccgccaggcggucaugaggauggaguucaggguaccaagcuucaccuauuuagccaucuuaccagcccuauugugcuuuuccauugggcggggggaauauccuccaauuuuccuaagaaaaaacacauugaagacagaacuaaaacaacacauuuuuacaugacaucaggauucacaggacacucuaaucaguuugaauccuuaacaggaaggggagaauaaauagcaaugugcuagaaauccucaagagcuggggcuucucugugcuguguuuuguuuggaaggggagaguugagauggaguguggggagugagaaggagcccugccugaggcugcacucacauugaccgcucuuuuccuucuucucagccauuguaauucagguagcaaaggccacuggucacugccaucugugccuguguaagagggaaauuaacaucaaauggauguggacagcguuccauugagaauagucuucaaauauuacacgaaggaacagugccguuaauaaugaaugucaucacagggcccaaacagccuacagugaaaccgugcauugauuguucaacauuucacacucacaaagacagcucaaaugagauuuuccucucuuugugaaaaaaaugugaguugcccaagguugauuagaagaugguuauuugaccuacaaccguuuaacuauagccuaagaacucuauuaugugugcccaauuuacuuuagacuuuaaaaugauacguggcauaagguucuguauaaauuaugaaagauucugggcauuaguauauagaaauaguaucucacaugccugcaggaaaccaaaagaagccuuugccaacaucagcauacugaagaugcuucugggcagggugacugggggagguagugcagaagggcuggggaagagcaaaccagaaagucugguuuaaugccuggcccugcaguaaucauuuauauuuggccacacucagguuccaagcccagcuacacgcuggcuggcgcuucauuugucaucuucacugaagcaauucuccaugccucaucccacgcaaggcacagcugaggcugcacuccccacccacacagccgacccaagcucucagaccaauuucccuccugaacaaaccugacccucuacagaggucugcaagacacagccccacacauaccacagcuauuuuaaugaagacuuacugagauucuucaucugcuuagaauacuguccugccaagguuuucuggauuauguguggucggccugugcuuuucugaaacaaaagacaauggcagggaaugaaaaaguaagacaggaagacaccucuaugacuccauggaacugugcuugcauaaugcugcuucuaauauccuuccuuacauggggacaugacauauuagaaggaagacgggaugccuuguugaaccuuuaauuuuaaaugaagaagagcccuccaacggccccacuuuagaugaaagcacuguuuugucaguugcucuugaaucucagcuucucucaaagccccaagugggaaacgaauaggaaaggacugccuguccacuggcaugauaaccuuggugcucucguauacuuuuaaaauuugaaaagaugaaacugcaauuuucucaucaacuuguaagugauuuuaaaaaugaugacauccauauuuaauuacagcugcaaggccaggcugaauauacucauacaucacugguaacauggcuugagaaagauuuuaaugauuuccauaagcaaccuuggaaauauucauauccuuuggccuagaaauuacagggccucauuacauuauuagguauggaaguggcauuguuaagagcugagggcucaguuucugccaagcaguguuggugugugcauugucugaauuauucccaagaaguccauguugucuggauucuaccccuguucuaggcugcuuucugccacugugauaaaacacugaccauuacaaacuugagaaggaaagagcucaucccaccuggcaggauacaguccauuauggaagaaaaugaaggcaggaccucaagaaggaaccuagaggcaagaacugaagcagaggccguggaggaacgcugcuuacuggcuggcuuccucuggcuugucggcuaccguuuuuauauaucccagggauaccuauuuuaucccaccuguggcaggaugaugccaccugcagugggcuuggccaucguacaugaguuagcaauaagaaaaugacccacagacacacccaacaggccacucugauggagacgggucuucagcugagguuucucucuucuugggugagucaaguugacaagcaagaucaaccaucacauuucuacuuaacgaauaagaauacugagauucagaaaaauucagaauuggguuaaguugugcuaugagaaaaucaauuuaucuaaaauauacauggaaauaugcaauggaaaaauugugugaauauuugcuaaaaggugauaaauuuucuuugggggugguaugauggauaauuacuaguuaauuaagugguuauuuugcuuuucaaaauuuuuuaacauauuucuagauuugguggcuuuugcaauauugauaauugaacucagagucucauauauacuaaauuaguucuguuccacuaaguaaugccuagccuguuuuugggggagggggugguguuaugauuuuguuuguuuuguuuuauuuuguuuuguuuugagacagggccucacuaaguuucccagguuagccuugaaguaagccuucugugucagccuccugaguagcugugaucacaggcauacaguaccacacucaauuaauauauuaguuuuauaaucauaaagcuuuuuaaaaggccuuucuuauuagauuugauagaaaacaauaauuaagaauauugcuaauugcuuucuacuugcaauagaaugugaauucucacuggaacuauccuguccauacaagaguuacuaccaaacauguuaaacuaauaguaauaauaauaacaauaauaguuugaauaucccaaaauccaaauucuaucuaaucaguucuuuauucuggaaacugaugaaaagacaccuagcaucaugauauuuaccccugaaccugcaacaagauuuucgcugcuaauuuaaagauucaaguucugcucgcuugcccccacccacagugagaaugaacaaaagggaggcaguaggaggcaggcagggaacagaagauaauaagcacauaaccaccagcccccagcaguauaauuacagcuauaacaacuaagugcugauuccucaaacauuuugaucauacgaguuuauauguauauaaacccuuuuagcacuucagcagacacugcaacacauuuaugaauucaccccgucugcaaaaauugucauauuauggaugcacuggaaauuaccccauuuacacuuucuuaaaaugugaaagcuuagagaacuauuuuggacuuauuguuguuguuuuccuuuggggguuuccuuggugagggagguaagggagcaguuacucaaagccaauagucagguguuuugcugaaugucugaaugucugucuggcaguuuugccauaagaugguuaucugccugcccauggaacagggagcacauuuuacucaucaaaauauccuaaucaaggcuaaacuguugucacucuauggaaaguuuuaaaguuauucaucaaaacccacacagguuuguucaaauauugcaaucaccauguauaauuaaauauuuuuucugucucgaauuugaaguuaccucauaguuuuauauauguguaaauauaaauuuauuuucauuuauacauuaaauuauauauuuauauauuauaaauaaaauauauacauauauguaauguguguauuguguaaauagauuauauagguauauguuauauauuucauauuauauaaauguauauauaaauauauugcauacauacauguacagacaagaaaauaaaugcugcuuuuuauuaucaaaagucuaaaugucagaguuggugagauggcucagcaguugagaagucuugcugcccuugcagaaggcccaagcucaguucccagcccccacauggcuacucacagccaccuggaacuccacuccccaggcuccgaggcuccgaggcccuuugcugagcuccuuacacagaacacccacacacaaaccaaucaaucaaucaaauauauuacauauauauaauauauauguacuaucuaugugcacauguguauauauguauguguguguguguguguguguguauacauauuuuaacagccucagugacuauuguuuucuucaaagaaagauuuuuuuguuaauguuuccaucugggcauggcggcacacacagaauacucgggaggccugggcugcauggugacacccugugccccaccaaaccuguuuucugcucuccaucaaaugacugcauuacucggauuagcacucucaaaaaugguuuuucuccuuaaaguucccucccuagaucuacuccccaaggcugccccaccuccugcugugaccucacacugucuucaccugcuaaucucccaagccagagccuuugugucuccauagcucugggaauguucuaauccccuuguagccuuuacucaagauucccccucaccuugguggcucuuugcucucuucagcaugugccaccaucugaaaugucacaugugacuuuuggcauccccaucaugagucucaggauaucaauuuuaucaugaauguaaaaugcaguaagcuuucaauauaacauugaugacucuguaucagacuguaaggaccgcugucaguaaacagccuggcaggaacacaggaggucucauuacgguuguuguccuauacaaaaugaaacacuacuuucuucuccaucuggaaacuguauguuguaucacguagccacuacuuagaccacagauuucccuaguaaguauuucuaguaacagaaaguaaguacauucuuauacaguuaucuaaagaagacaguagaaaugaaagauuuuuaaaauaaaguccaggcugcucagugcaaaacaaaagcccucccuguucucucuaaagacugggaagaggggcuugcuucagaauagcucagcaucacaccucugaucuggccucgccggcauaaggggcuagcacuguaccauucuaaguguggcaucacagaacacggauaaacggucuuugaugcugggaaaaccaaauaccauaaggaaauugauggcccaggcccaccucaucaucagucaguuccagcggcucuaucauauacacaaaggugucauccucaaacaugccacuguaagacaagacagcaggaggagagucagcaagugcugcagugagaacaggcaagucagaaucucaacagugucaaaagucuucaaacagucccagaugaacccugccccgcucucagaacuccaaggacucgacuaggcagcuugccagcacaaacguguaaagcguucccccagagcaugcaaaugcuacacgauagaacucauuucuagaaauaaacuuaugacaacagugaucgggaauaagaucucucacaugguagggggaaaaaucgcuuuuuucagaacuacaugaaacuagcacaaauuucuuguuauacaaauuauauaucggauagaacaaauuugacugcccuauugucuaagaauauucuaagaccgucucugauucugaagaggcuagcaggaguaucuuuauacuuguaaauuguaaauuucuauuaaguagugugucauaaaaaaaauuaacuugaggagacaugacagucuuuuaaaauaacauuugaaaggaguuuuaaggcccuuuucauccaaugucuaaagcuaagucuccauccuauacaccacuugauuugggucuaaaauguguuuaugcaugguuucaaugaguaugccugaaacucagacaauggaugaauuccucuuaaugucccauccauuccaagaucuaauccaacugaugaccucugccauaguccuauagugcugagucaacuagacugagucauucuguaagcuuccgacuagacuuugggucuuaaaugccucaacagaucugcuacuaaggaucugauuucaccucagaguggugcuccuggcaggcaguggcaucaucaugagguaaucaccaugagccuuguaagaagucuuuagcucaugggaaacgcccuuguaggcauugugggaauucagucuccuucucacuaucucuccuugccacccagucaacaguuuugcugcacaacacacacucaguucacaaugaugugguuccucaccacuggcccaaaguaaugggaucaagccaucauggauucaaaccuccaaggcuugaaugaaaauaauccuuuucucuuauaagucuauuaucucaaggauuuuguuucaguaacagaaagcuaaauacaccucuagccuuucccucacagcaucaaccaaaauggguaucacuacucuauguaaguauuuguuuaauuucugaguuuucugcaaaaucuagguguuaaagaagagaggacuuuagcucucuagaacuacucuuuauuuaguccucaacauaucacuggcauagaaaagccacuaauauaaaauaucugaaaguuaaaaacugcacagagcuaaugguuuugagcaagccuggaggucaggaggacccaagcagauucccacuuacuggaguccauugcaggucgauagagccacccuggaauccuugacgccucugaugcuuccgugguaguaacagugcucuccacccuacaaaacaaaagaaggccugauugacuguaucugauacacugaugguccugcuucugacaguucuguagagaaaggccaccaauggcaagaauacaggcccacaagacacuccuauuugaaaucaaaaauagggcuggaaaagcauuaaacauaacaaguuugcauagguuuaauggaagagaauggggcuuuauagggaauaaaaccaauguaaaggauaaaguucgcaugcacuucuuaagcaugcaaaguaguuacaaacagaugugguuacauguuuccucucacaccgugacucuuccuuuuguguuuauaugcauuuuaaacagaaucuuuauacugcuauuaucagauucaccccacuuuagaaauuaucuuccugagguauucuccauauuaucaaaagagaaacauaaacaccaagccaaccacaacccuuuaucuagaguagcguucuaauugcaagauaugcuagggcagugguggcacaaagcugugggcagaaccaaccaguaacagauuugaauuaaggcccacuccaaguggaacccauaccugauacugcuuugguggucaagaaucuaagacuagauagcccaggggcuuagaguaaaaccaaauaauacugauauaaaacaggaaaaaaauguaaugauaagaugacucuaaaugauagucugcuauacuuauagaucaauaucuuguucaacuaucauuagaggagcuuccuccugcugcagaugggaacaaauauaaaggcacagagccagacauuacacaaagagggagggaccuuggaauaaucagcucuaaaugagaugucucccuccccucagagcccauggaagaggagacagacugaguguacaaaccagggagaaugagguacuucaagaaagcaaggcccuuuuaaaucaacaugaacaaagcucauaugaacuacucagaggcacuaaagcagcaugcacagugccugcaugagucugcaccagguccuuugugcuuauauuauggcuuccaguuuagugcucauaugagauucuugagugugaaugagugggucugauucuuagaccuucucuugggcuuuuuuuuuuauucuguugauuuaguuuguuuaacuucaguaugauaguuuuaucuuuuauuuauuuuguuaucguuuuugaaaaaugaaugaaugaguaagugaaaaccuagucacuaggauaaagguuaacaacugaauuuaucccugcuggaagagggaaagccaguuuucuccaauggaguggggggcacuggguauauuaaccaccccucauguucagcauaguuggccaacauagaaugaacuccacggcucuuuguguguuuuuauuugguuauaguuuacuauuguuauuguuuugggguugucuuuuauuuuauuuucuugguuugagggggcuucacuguuuuauuaggguuuuugagaaagaauuuaaaguugaguggguagggaagggcaaaggaucuggaagaacccaggggaggggaaacaugaucaaauauauuuaaauuuuaacauguuuuaaauauaaaaacagaauuuaaaaaagaaaucaugaaagagcauagucaaugaauuuguguuauagauagauagauagauauagauagauauaauauauaucaauaaaauugauacuaaaauaaaacauaaauaagaaaagcaccucucucguacagacucaugaaacccucucccacuuuucaauauguacugcccaucuuggguuaagcugcuauuugauguuuauguuguaacuuugagaagguguuuauagcugggcuaccauucgauuauacuaucugucuacauuuuuaauuugaggggacauauuguuuuaucucuuugcuuguauauguaauuagcaucccuaaccucuaagagaaaucuaaaccuccuccuaguaggucagugcagcugcuuguuuuguaccugaagauagacgcgcuuguguuuuccuucaguuccccaugggucccguuaacagagaccauucaggacuuucuggaacacugaugggaagagucuuuccuuuuuuuuuuuuuuuuggacaggguuucucuguauagcucuggcuguccuggaacucacucuguagaccaggcuggauucaaacucagaaauccaccugccucugccucccaagugcugggauuaaaggcgugcaccaccacugccaggcaagucuuuccuucuuuaccuucuacauuggaccuuauauucccugucuuccucauuuacuaucaccgccaccauccuccuguuagagacacucagugucugcuacuuuauuaaaaaguauuuaugaacaauaaguuuagcaagcacuugugaggguaaacuuuucauuuucaacucucacaguagagccacauguuggguagaaaugccaaacuguccgcuacuucauccuggcaccucagaggccuguagagucuucuaaugucugacaacacuaauuuagacccauuccagcaucagggcauuuucuauaaacucuauuauucuuuaagaggacuuuauggacuccuacucagcucccuguccaugcagucuuggguuaugucuccguguggaugcuucuucuucuccauuacacuaaguacuccaggccacccaguaacugaaaacaucuccugcgccuccauccgagaagcaagcagucucuuauuaacucuuuguuuauuccuuccccaugcuuauucauaaacugagcuacuucacccaacuagagaugggguguccaccuggcuagguggguaaguagugaaucggggguuuaauuguucuccaaauacacauuucaacccaccaccccuuugcaggugccccugcucucugggucuuucuggcuuugauagcaggaguugccuugaugcuuccagcuucccuaaaaaagcauuuaguggagcagauaaagcucaagccugagaguucuuggccuacugcugcccaucuccugaaauugcauaggcaucuaucuccuacugcugccuuuacuugguucugucccaguggccuuauuucccuuuugaauagcuuauugguaaggcauaugauaaaucacauuggugcuauauauggagguuguuccauguucucaaauagcaaugguucuuauaaauauugacuaaucuacaguaugccaaguucuauuuguguauuuaacacugcaaccuauaaggacaaauggguccacacaucucagcaacuugagaacccaggucaauauauagccaucacauuucaaacuauucacauuucuaaaagcaaaauauacaguaacuguaaauucuaucaaaguucuucuuuagcacaucaugucacacauacacaaaaagcagaaaugaguggugguaagaagugcacagaaaacauuccuauuuacuuagccuucccaagaaaagcuaguuucagauuuuccuuacaauauucuuuuuuucccauaaaauaucaccagcccuuauuacaguaagcuccauucgcaugcacugaugagugaaaguugauucucugccuagaaagauaauugcuacagguuugaauuaagguaggaaacuguauauuugauugugugucaucaaguucugugaaucuuccaugaaacuggaggugcauucagucccugguguugacacaauauucggcuuuaauaucuaaaguucauagauuaagcacuaugaguaguuuggcgauuuccauuuuagucuuaaucuuagaauauuuucugaguuuauuguuacauuuauagcaaguuuuuuaaaaguauuguugaaaaauaucauuugucaacucuacugacccauguugcugcuguaguugaucaggacagaaaggaaucaugugagggauuucacucacuguuacacagagcaaucagcuucaggggacuggcccacaaauaugccauauugaaugaucacuaacugauuguaaccauaaucuucaugugcagauuagcagaugggcagcauguacuaaaagcucugccaaaaguagcaagaaaggccccguuggaugucacaucaucaggucugcuggcuaucaucucuucuuccagguaagaaagccucagauggcucaagaccacucgucagugcugaccucgaagaaugaguacuaaccugggauuagacaagcagcagcaagggcugagccacuguguuuccaucauugucaacucuuugggauccaaaacuguuguucuguucauuaaauugaacagaaauggauccucugugaagcagaaccuauuuuggucaucagaggaaaugaaaauuccuagucaguacccuccacacacucucucucucucucccucucucucucucucucucucucucucucucucucucucucucucucagccacgccucuccucacagccaaggacuccaagagcuaagacaugcucacauaauaacuuauuucuacauaaaguuagcaaaauacaggauuccacuggaaagcauuguguacccugcacuguucugucacugcccacagguguggggaagguuguuugcuaguuuuguuuacuugaggacuugucggucugccuauucuucauggugugagcauauacaucucucucucucucucucucucucucucucucucucucucucucucucuguguguguguguguguguguguguguguguguguggugcugggaacugaacccaagaccuguugcaugcuaagcacccgaccacugagcuauacuccccaacccacgugauccucaucuauuaaaacacuucacaaucaaaaauaaguagggaaagcaacuuagagauucaaaugaaaacaacuugaaagugggaaauaaagucuauucuaugauaucacugcucuauuaacaggcauuauuuaauucugcucacuuuaauaaaaagaaacaucgcugcucucacaguaacccacucaaacaacagugauauaaaagaaaauccacgcaucuccagaagaaauaagggcagagaaaagugagcagugugaggugccugugaagguguaagacauggacaccaaguuggugacagugccucuuggauuugagcuuuugggggugaaaccaaagaaagcaagccaacaauuaaaucuuguuauuuuuuuucaaccuuugugucugcuuaauuaccucaacugcuucaguaacaaacagucagucacagcuucagaguccuagacacucagggaaacuuaaaugguuguggugccugagagguggggucuuucucugggcuacggaagaucugguaaacacuuacagacaagugacauugccuaucgugaagaacugugugcaccaggaaguagacuggggacauacuaaaaagaagaugauacccuaaguucuaggcauggguuuuucuuuauguuuuacaaauuuaccuauuaucugaguauaccagccuuuuuaaaaaguggguggucuauaccuauugcugauuacaugugucuggauuaacuucagaaugagaaaaugaaaaacuucauucagaggguuggggaauuugagauuccaaugcuagauuaauauuuuaccuucaucaaauucaggggugaaaagaaucuuccaguaauguauugauaauaguauuggaccacuucagcucuguccaugucauauaacuuaaauacuucauauaaacuauauuguccgaacuuaaaauaccuuaguaaggaaccaguguuggcucuccauguuccuuuuauauucuagaacauguucagaauacugccagacagggcaauauucugaaugauuaacaauaguaagcuuaacuuuaaacuagaaauuguaaagacuauaauuuuauaucuaauauaaaaguucucucauguauagccuuucucuguuauuacuuaaacuauuuauuauuuaucuaauggcaagcaacuuuuaagcuagcuauuaauuuaaagaccacaaaauauuauaaugaauauauaaguaauaaaagagccauuuaaauuuguguaagaguagaaaucugaaucuuuggguuaggaacuguggugguuuuaauacacuugccccaugggaaauggcacuauuaggagagguggccuuguuggauuaggugugccuuaguggaggaaguaugucacuguguauguaggugggcuccaaggguugcuagugcucaagcucugcccaguguaggaaagagccuucuccuggcugccugcaguagucuuuccaaggcugcuuguggaucaagauguagaacucuugacucuuccagagucgugucuuauuacccacugccaugcuucccaccaugaugauaauaaacugaaccucugaaacuuuaagccagccccaauuaaauguuguccuuauaagaguugccuuugucauggugucaguucacugcaauggaaacccaaacuaagacaggaauagaacauaaaaauaagacuuuuuuuuuuaauuaaagaaaauaagaauuuccaauucuaaauauggcugaaagguugaaaauagacagugaaaaaacagucugagaaaauucauaaaaaaaauaauaaagaaagagauaauggggaagggagaaaaaaaagaaagaaaaagaaaccagagaagaaaacacaggaccaaaauuguccugcccagugcaagugccccaacucagcucuaagagcugguggcaaugccugccccucucuuaccaggaagacuuagucuauagcgcucucaggaucagcaucugcagagccaacccauaauaugaugaagaaucucgcaaaaaaaaaaaaaaaagaaacaacucuaucuaugcuaaacauggacaaaccaccuuccuugccaucagucucuaaacagucaacugcaugcauucauguugcauugggcaguguaauuagcauaaagaugacuuaaaggauuuaagagaaugugugggguucacaaauccaaccauauuuuauacaaggaaccugagaauccauggauagggguguccucugcgggauccucgaacaaaucccuccaggauaacaagggacgacuauagucaggguccuaaggacuuucccucuccagauccaucugcucuacacugauuccacuuccacccaggagcugugucuaucaaggacccacucacccagauggcaucccuacccuucugcugccaaagcccucauaggcauaaagaucuucagucaacccaagcuuaugugaugaggaagauucuaaucauuaggaaaagaacaaggugaauauaaaccuucuccccauaggacagggaugugucucuggcucacugauguaugugcuuuaccaggaacuaggucagagcaagaacugaauauauaauauauauauauauauauauauacauauauauauauauaauaaauauauacauauauaugucuauauagauuccaugugugugugugugugugugugugugugugugugugagagagagagagagagagagagagaggaagggagggagggagggagggaaagagagacagugacagagaggggaggggaggggaggggaggggaggggaggggaggggaggggaggggaggggaggggaggggaggagaggagaggagaggagaggagaggagaggagaggagaggagaggagaggagaggagaggagaggagaggagaggagaggagaggagaggagaggagaggagaggagaggagaggagagggagaaauguaggcauggaagugugugggggccuaugcugaaguaugcacaagccacagcaggacaucaggugccuucuauagcucuccaccuuauugcuugagaccagucucccacugacccagaaguuugcucauuugccuaggcuggcuugcuaaggagcucucaggaucggccugucuccauuccucauuguugguguuaugaccaagcagagacaugccuggcauuuuacaugagcauugaggauuaaaacuugggucuucauauuuauagacaagcauccuuggcacaccccccaagccaucuccauggguccauggacauacguuuuaacucacacagaaacacaccuaaggucaucagagaaauacaaaauuaaaguacaguuagcuacaccucccacuuacuagaauggcuauuguguggcuaugggggacaaagggacauuuguagacuguugguagaacuacagauuggcauggccaaguaaagaaugaagauccauccaaaaaaaaaaaaauggaaaggaaaucugaauuucaaagagacaauugcagagcaugcucaucucagcuucauuuguguggccaagcuggaaaaacugauggaugcaugaauggagaaauguauucgccagggauuauugaccagccuuggaaagaggcaaauccugucacucuggcaacacggugggacacugugcucaauggaacaguccaguagagaaagacaaauguugaacaaacccucauagguugcaugagagucaaacucaaggaagcagaggguggaauauguuugucaggggccaggggcaauugggcaaaugaggauauguuaguuaauggguacaacguuguaauuaugugaguggaacauacugcagagacagaaagugacccaaugacuacaguuacuauauuguauacuuaaaaucugcugugagguagaauuuucaauguucucacuaacaugaacaacuacaggaagcagaggcugugcuaaucagcuucagugugcucuuccuucccagugcauacauaucaaagcaugacacuugguacaacccaacuauguaauauucuuauguauaaaaucuaagaugcacaccuuaaauacacaauuugcauuuuuaauuauacuucaauaaagcuggggaaaagaaagcacucacaaaggaccacauauuauaggauuucauuuaugcuccaaauaggcaauuuauagaggcagaaaaguagauuagcaguuaccuaugaugggaaggaaagucgcuagggaaugacugcuaauagauaagauguuucuuugcggggugaugaaaaauguuuuaaaauuagauuauguuaauggaugcauaauuuugcaaauauaguaaaaacaauuuaauuguguacuuuacaguauauaaauuaugccccaauaaacuuguuuaaaccaaagaaaacauaaauaaguugucuuucaaaugaauaaaaugaaaucaacaaaguugcuuuauuguauauuguagcauacuuugugcaaggaauagugggagaaguuguaauaaaaucugccugccuggguacacagaaguuccuccguggguaagagcagacaucuaccuggucccaaggccaugaacuugggggguuuuguuuugcgguuuugcuuuuguuuugaguuuuguuuguuuuuguuuuuguuuuugucccucugguuccugucuuugcuucucuuuucaccccacuuucauucagugaaaguaaaagaaaaauauauaccucauccaggaauggggaagcagggcugcuugucacuguaaaguggaaagacuguaaccguguuugcucucagaguaccuaugcaucaggacuuucauauuaacucucagaggacuguaagugccacaucuauguuuuaccucaaggcccucccucacagacugguuauaauuccaggcucuuccggucaaaucacagcacgcaucccauuucuccagcccuggcucagagaucagcuuacggaaugagaaacccuggcacgccuacacauugacuuccuuuacugcugcuccccagaaaagcucccuuaaacagggaugaagcaaaucuuuguaaaguucauuucuuaagugcuuuuaaauuuauguguggaaugggaaugggaaugugugaaaaauuucucauagucucagaagcaaaaaauugucauugugaucaaaagucauaaaguaauaacaacgcuuugauccagagagucuuauuuuuaaauuuaaacuugcagcaauuauuaagauuguguucagaccccaucugggaaguauuuccuuaggaaaaacuaggcaaugguggaagcaaacuaaauauuaaaauauuuuuaaaauaaauaauaacaaauaaguuagaagaacauuaugcaguuuuuaacauaaugauccagcaccgaucaagguaucauguagacuaaagaauuuauaagcucauuagauuuuguaaaucuuacauagaaugugugcacagcauaugcuuggggcuugagggcauauauauuuauauacauauaaauaaaaaucaggauguuaccauuaauccaucaucuacggaugaguaaauguggguacagggcuguuguagaggaaacgaaaggaaagggaugcaugcagaaucaagcuacagugagcaucccuucuuugccagacuugaugcagcuuuugcuuuaaauauguuacaaccacgggaggcuugggauaucuuauuaauaagaaggccucauuugggguaccucaaaugaacuccguacaccaauuagcuauuguacuucuauauauauauauauauauauuacacugagcuucuuagagaaagguuuggguuggguuucugcggcugcaaagguggcccauuugcugagucuggagaguccuugugugaucuccucuccuccggguucaugagucagcacaccaugcucaggguacuggcacagccgacagcagugugguuuuguaccaaugccagcaagcaccauucccgcacuugaguuggcacgaauggucccuuuccauagcguuagucucagggagauuugaaacucucagaugcagcuggaggagagagcugacaguaguaagaagcgcauggcagauguacccaccauuaaucaaauagaccgaagucccgagacacaccguggccaugagcaguguuuccaauggcggcuacuuauaagcaugugccaagagacuaugggcuaggacauccaggucucccuggcucacagcuaugcaggucugcaugugaaaguugccaccguuaggcugacauucggaagccaucagcaaaauacaaauugcauuuuccccuauuacuuguuucuuccuuccuucccaaugucuauaguuuacaugggcauuacugaauguccauggcaccuggacagccacuaaaaguccuaaguucuuuucugugcccauucuguggauuuucugccugacucauagaaaucacuugcuugucacacacuaucaauaauaccucuuccuuccuuccuuccuuccuuccuuccuuucuuucuuucuuucuuucuuucuuucuucuuccuuucuuccuuucucccuuucucccuuucucccucucuuccuuucucuuccucuuucucucuuucucucuuucuugcuuucuuucuuucuuccuuucucucuuucucucucucuuucuuucuuccuuccuuucuuucuuucuuccuuucuuccuuucucucucuuucucccuccuuccuuucuuucucccuccuuucuuucuuucuuucuuucuuucuuucuuucuuucuuucuccuuccuuccuuccuuucuuucuuucuuucuuucuuucuuucuuucuuucuuucuuucuuccuuucucccuuucucccuccccccccccucucucucuucuuucuuucuuucuaccccauuuuuuccuuauuggcccuuccuggugagaagaaaagauuaccucccccugaagaauuucagguauaugagauuaccuuuaugugucagccugugauggcccugagcggguuugcccccuucucuguaccucuguaucuuucauuuuacucuaggaauaagaauacccaccucauggaccugucaugaugauaaaguugggaagggcuagggcuacagcucagugguagagcauugccuaccaugcugaagguucugaguuuggucuccagcaagaacaaauaaauaaaauuaaauaaugaaacaaaguuggguauaacagcacaugacuguaaucucagcauuuaugagacuaaggcaaaugaaccuugaguuuguggccaaccuggguguggugguuugaaaaggugaggccccauagauuuauguguuugaaugccuggccauagaaaguggcacuauuaggaaguuuggcuuuauugaaggggguguggcuuuggaggaagugugucacuguggaagaagugugucacuguggagguggggcuuuugaggucauacaugcucaagucuggccagugucacucagucuccuuuugcuaccuuuggaucaagauguagaacucucagcuccuccagucugagaguucuccaucuugacccaaaugcugccaugcuucccaccaugaugauaauggucuaaaccccugaaacuguaagccagucccaaucaaguguuuucuuuuguaagaguugccugggucacggugucuguucacagcaaugaaacccuaacuaugacacugucuuacaggcccucaaaaaggggugagagaagaagaauguucccaaggucucauuuugaaaccugccuuccacccuugggcaucaguugccugcacugaacugucacuguaagaagucaccuaaccuuguaauucugauuccauggccaugauccugacugagcaucccuaauccaaaagucugaccagccugacagcaggaguggaaaguuccaugcacaaaacuguuucgggaacaagaugaucuaaaaugaacaagauugcccuucaaguuguguguauacggcauaggugaaacauaaaugaauuuucuguuuaaacuagagcccuguucccaggccuuccggucccaugucuuuuagguaagggauacccaaaugguauuuuuagugcugauauaagaccauaacacucaucuguccauucaguaagguaaugaguacaaaaucaagacaacagaauucccuuauggccugaguauacagaaucuaaugucgccucagcaucuuaaguuccuaugcauucuuccucaguaaauccguucccuugcauaggaggccucagaagagugcagugagcacuggucagcgguaagaugaaugcacuuuaugcugcaggagcgcuggccaauuuacuauaccuuagaguacaucugcuucccgucuucauaguggaucuccacguagucagaagauagcaaaccacugcaaaggaaagaagagaaagugauuucugcaaccaaaugcuagagguuuaaagagagcucaauaaacgguugacagggaccugaaaaccacagcucugcagucuggacaaaggagcugugggcaagucuuaagacagcauccagcaaaaugaaaagaaagaaaaauccucagucuagauucagaaacauaaaacauaggcaauggaaaggacacacccucagauucagcaccuaguggacaugucaaucaaaacuaccaaacuaaguugcaaguagaagacaaacccuaucacucacagacacacacacacacacacacacacacacacaauuaaugugccaauggaaauuuuuaaauuguguaucagugggaaggaauaaagaaaagaacuggcaagcacuucccauaagugccagauaguaaacacugcagcucugccagcuguguggucccugaagcaacaaucaacucugccaucaacaguauauagacaaaugaguguggcugugucccggcaaaguguuauuuauagagaaugauauuugaauuucacacaguucuaauguaccaugaaauaauauuauuuugaauuuuuaaauccauuuaaaaaugcauaaggccaacaagaugagccaauggacacaagagcuugccacagaaacccaacaaccugaguucaaccccagauuccccaguggaaagagagaacugacuacugaaagcuguccucugagcuaugagcaugcguaugugcgcgcacacacacaggauauacaucauauccaaaaucauguuaagaauaaauuugaauuuaaaaaauguaagaauauaaacggugaagucagaauaggguuuagaccuagcagagcccaugaauggaagugucgacaugagcaaguuucacuaacuuguauaaaaugagccuaucaaaaacgugaaagucacaggguacugugaagauuaaauugauuaaacaagcaugcagaacuuagccuagaaaucaacacuguucaguguugggcacuguaacuaucacuacuguaacuuuaaaugcauccuccaucguaaaccugggcaauaaacucuugguuguggauguggagggagaccugaguaugagcuuucuugguaaggaccaaugccucagacucaugagaacugugaagccuuccccuggucugccuggaaauguuaacaguguaugaagaaaguaucuagcauuguccaccuucaggugguuuacugccugaggcuaugccccuaacagagaccuccuaccuagacugaggucgggauguugagcaguugaugccccccucccccaccagagcaagcauggcgcaccugauuccagaugcucuguacacuucagugucugauuugucuuuguuccuucaucaccccagucagcuuuucagaaccaaguacagugcaagaugcucuguacccacugcagagagcuggguuaggacacuuggguuucuguccagaucugccaccaggaguaaugagaggggugacaacacauuuaugggccacuuacuccaucuaggaggcaugaacucaucccugaaccauuuauauguccuaaagguaggucuuuguuccuucuacaaaauaaagggcuacaaaagaugauucuucaugucccuuccugcucagacauauugacuuucuagaagucacucaacaguagguucacuuguagaaaaauaucaaacuacucuaguugaagaauaggcagacucuauggcucuacauauaauucagagcaauguccaauguacccuacaguacuccauaggaagcuuggaaaagggugaucagaucccaguuggugaaacugggaaggauugcaaggcaugcucaggugagaggaggucacugggggugggcuuggagguuucaggagauacauguacauaugagcuucgucuccuucccugcacuccgacuugcagaccaagauguaaacucugagcuauugcuguaacuacuccacccccaucaugaacccuuaccuucugacacgguaaucccaguuaaaaacuuuuuuucuaagcugccuuggucauggugguuugucacaaggacagaaaggcaauuaagacagugucuauacuuaaacauguauucaugcucacccaaaugaccucugacagaauccucuaagaacucucuuucccccgauucccaccaguccuuggagcuuuuaguucauuuaacgaauuaguucaugacagcuacugcuggucaccaggcggauccugaauuuuacagacacuaugccugaucccucuguuuacagaagcuucucuuuagucucauuacauacauguauacguacauguagauauguauacauauacauacauauauguauauaugaugugcauguauguguguguaugaaaaagagacagagagggaguccagaggucaaucucauucuuuccucaagagcccuccaccuuauuuuauugggcucugggguucacuaacugaagcuaggcuggcuaauccucugguccccacuuccugcagcaugugccaccauuuggacaguuuuuuacacagguucuagggauugaagucagguccuuaugcuuauaugucaagaacuguaccugucaagauaucucccaccccaacuugugauauuuuuaauuuaucaaaugauuacuuucuuaaguagaaaugaagacaaucacagacacuuaggucaagacauucauacaauuauagcuuguuaccuacaauuaugcuugugcccuucuauugcuuuuggcuuguuccuuuuuuuagacuuagaagugaaaugguuuaucaauugcuauuuuucucaaguguguagggcaaaguauaauccuuugaguauaaacaauaaaauaaggguugucacuggguaaaaagauagcgguguggugaggcugggauugaagacuggagcagauacaugagguagguaaaaagaauuacagguuggauagaggcuuugugugaaguaaggcaaagauggcaggcuagaguguggccacaguucaugcagacagaguugcaggcagagaaccauccuagcaaagugaauggaaaggggaagggcuugagacacuguaguguuacaaaagagacuugaugacuuucuaaaggacauguggaauuggaaauuccacagcacaggugcuccuuaggucucaguugaggagucuguaggccauaauaccauuuugaauaagaugaauaaggagaacaagaaacuugggaguguggauucauagugcagagaagaaagaaggaagaguuagauggagaaccugaggcuuagguguauaguggaaagggaaagaacccccacuccgugggcuugacccaaccagcaugaugcaaccccugcuguggaggagcugcagagcacagggaacacuuaaaucuauggcuagcagugucuccaagaggcugacugguagcauuccauccagaagaagcagcuccuccgagucuuagggagagaacucccugcuucuuuuacuuucaaccuguuuuuaaacuggcacuucauucaugccauauuccagaggaaugagaggaauggcugaaggaauaacaaacaagccaauggggggaaaaaacuaucagaaauaguuaagaguuaaauaagguguuuguuacaagaugaauaugaagcacauauuuauauaagccagcaaaaaaccaucuagagauaauaugggagacauuuuccagaaugauaucaaaugauacauacauauauauauauauauauauaucccacauacaaauguuaauacuuaaauacacuagaauaagcaaguauaaauaaauaugaagaaaaacacacaugaaguuaacagcaaauccuuaguuuaaaaaauaaaauaaaccauaagacaagucaugacugaaugaagcaauucccugauuccccaugggaacaggccguguuguaacacuauccaccacccucgaccuacuugaauguuagugcaauuccaaacaaaaucucaaggguuuuuuuuuuaacaugacaaaugacucuaacguucaucuuaaagaaaaauguaugucauuuucucaaauaaaauaacaaaagcaggacuuugugucagcauugcaagaacuaagaugaagaacaggggccuggucuucagcccaaaaggcacagaagaacauuagaaaagucucgaguucagacaagcgcauccuaggguuaagaauaaaauugaaaucuacaaagaguggaaaacugaaagccaucaggaggucauaagacaggaaacaaguucagaaagaaaaggaauaaagaauccacauauuucagucaugugacuaauauuggggaaaauggacagccaucccacccccuacagcaaaccaagacucuauuuauuaagauuguguguuuaaaguagagaugucuuaggguuuuacugcugugaacagacacuaugaccaggcaacucuuauaaggacaacauuuaauuggggcuggcuuacagauucagaaguucaguucauuaucauuaaaguaacaacauggcaacauccaggcaggcauggucagggagcuaggaugggggucuuaaaggccacacccacagugauacacuuacuccaaggccacacuuauuccaacagggacacacccucuaaaagugccauucccugagcugagcauauacaaaccaucacaagagucaugagcugaguauagaaauccagguaaacacugaagggaggucuuugaauauaugaccuuaaacccaaaagcauagauaaaacuauaaaaaauaacuacaaaaauugagauacuuuguuaaagcaaccaacaguucaaaacaaauggauuaaaaaaaaauacuugcaaaacaaguacucgccuucauguuaggucuuaaaaaagaaccaagaacaagagaaaaguagacaaaaggcacccacaaaaucaaaaucaaauauucaaggagcaauucauaaaaaaaaaaaaacugaacacgaaaugccaagagcgaucaaucauauacaaaugcacaacuauaauagcaaugaaagacuugaaaauuaaacuaacauaagaggacauuuacucaaucucuuuagaaaauaaaaaugaaugguaguaggaagugcuggcaagguuguuagaaaacuaacacuccagagagccauuuggcaaaggaugucaaagccugcaguguguucccgcuaauccaggcacucugacucugaggauuugaugaagaaaagaaacaagguaaaagcagaccuugcuuuuucucacacccaucuacgcauacauauaugcaucacacacacacacucacauacauccacagucccacacauccccacucauauucacacccauacucacacucauauacacucacagucccucacauucacacucacacucggucaugcacacucacacugaccauauauauagccacgcacauucacauauauccacuaccagccauacucacaccuacacucaugcauauucacauucacacgcacacacucacacagauaugagguguuuguugugugcuauuuuacagucacuuggggaaauuaucacauaaucaaagaaaagaaccagugugaaaaccuuugggcuguuuauaugccccccuucaaaguagaaaggcuuacaaggagcugucuuccaaaaugucaucaccagcgcuuacuucuugcagaaauucccaucauuucccuuccuuucuuuugcuuaccaaaacuuucuucacugaugcuuggugaccuuucuuuccuuuucuucuuuugagauaggguuucacuauguagcccucacuggccuggaacucacagacagcugcuugcuucugccuccugagugcuagaauuuacgccgaguacuccacaccugacccagacuaccuaucuaaugagacaccaaaguagaaguuuuauuuugggggccaaaaaaguaugaugcauguaauuuugugguaaagugcauuaucugucaauuauggguauauuaucuaucaauuuaauuaugcuaauccuaguaaaacuacaaagugaaaacuaaacaauuuccgaaaauaccauuuuguauucagguagcuaaaacauuagcaaacaaaacuuuuuaaauuaguuuuugaauuuugcauacaguguauuuuggucauacuauuuccucuccuccaacucuucccagauccaugcacacaaugucauauucauucuuucucucccuugaaaaucaaacagagccaacacauauacacacgaacaacaaaagaaaucuaggauccguucuguguuggccaccugcuccugagcaugcaggagagggugggguguuuuaaaggcaggcgugggacaauacacagguuuaaauuaagcaagggcuuggaccuugcaaaggaauggauaagaaccugaauuuggaaagcuauuuauaaaagcugaaagcaagcguuacuuccuguguccacagagaauccaaggucuuuaggaccuggggcaggcagaacauagagaagcuccuuuacugggucaauuagagccaucagcaaaguaauuaauguuagcagcgggacagagcugcaagaaaccagcacacacgcuaggaaaaggucuauccauauaugagacccuggagcugaagcucuccuucacucauuugauuaauugcuggagauugaauaaggcagggggaagaaaagaaaucaacaauuaagagaaaugaaaaauuaauuuucccauuucuuuaauuuuuauuggaaauuuaauauauauaugcauacauauguacacuggaaaaaucuauuaggcaaagaccaauuauauuuggagguauaggcagaugugggggguggggagagggagagagggaaggagggagggagggagagagggaaggagcgaaggagggagggagguagagaaggagggagggagggagggagggagggagggagggagggaggaagagauacaagaagagucaacacugggugucuuccucugucucucucuaccuuauguuuugacuuagggucugucacugaaucugaagcucacugauuggcuagccuggcuggccagcaagcccuggggauccacuugaauuuaccucccuggaacugggauuauaauaagcacaccacuauccccagccuuuauucugggguccuggaaaucgaccuccagccccaugaugauacagcaagcacuuugcaaacccuaagccaucacucuagccucuacuuugcugcuuugucuuguuuuaauaguuuuaguagaacauccacaguugucuuuuaggggcucccuuucuaccuagggaagcuagcccuugauuucuguucagguugccacaaccugaaccugaauagcugaacugagaauaaaaugcccacagacaaauucucaaaacacaaagacuaagaggaucggcacaacccaacacaagagaagaucauuugaagccaucuaccugugugacacagaaagcagcauucuucccaaacauggacuccccauaccuaaaccagagacgcguagacaguauagccgagguccuuccuauguggaaagauggaacugucacaauggcaccaucaguaagagcacagcacgugacaaaugauacaauauaggaaaaagggagagaagaggcugaagggaaugaacgagugacuucaacagcuuccucaugcaaacacagaauuacuaccacacacacauacagguuuuuaguuaucauucagaaaauugaccuucaggcaguucuaaccccugggcacaaccauaacaccaaaaaauuauucacuggccuugaauugcuuuuuaaacauuuaugauuuaccuagagcaggacugacuucucuaagggcaauuuucauucucccagagggaucuuuucaaaauauuaguaaggcaacagacuucuggaaggaauuugcuagaaacguggccauucuugcguaacuacuuuaggaagaauccuuucccccuggagaggauuuugaaacuucgugucauuccuuagcuggcuagcaguggaucuuuggguucaguguuuagccucagucccugaagaaagccuuaacuaaacacauccuggagcugacagccucugagaucugagagaagucucucacgcuggugaagcuaccuugucccuuacaaaaaccaggaacacuggauuuaaagaugcuuaaagaaaccuccaacucucagucgcuguaugauuuuauggucugaauaugaaaaggcauccccaggugcuggcuauacucuacaaaauucuagaaccuucuggagaccagcugguaaaagugggcccagaaggguagacguuacccacugcuccauuuccuccagaugauaagagccuuugccacacaaucucaccucuaugaacugggcugcuccuuuaugcuaucuacaccaugacagaauggaacccuuugaaaccauaaaccaaaauaaacccuccuuccuuuaagucaucucugccagugacacaguaguagcuaauacacccccuacaaacaaagguugcugcgugggaagcuguaggcugcuggcacacacagucugucuaguagcuacacucugucaaauaaucugugugggaauucucaggugccuguaggccaaucuuuuccagaaggugcugaaaaaacaaaacaaaauaguucuauccaggugaccuacacacuguggaaaacuacuuacacuuccccccaaguccauauauuucuacauaccuuaaccaaaagagaaugccuccauuaucaagauaucaucugauacucuuucuacagaucugauuaauaacuaacaaaacacccucuuacacaaaaacaaaucugaaagccaagaaucaagaccuaccaaagcuacacucgaguugacuaaucuaacuggucugcaaaaccaccacuuugcugugacuaaaauaaaucuaaaaccucacggccacauuaacaugcuuuaucauaaaaaugcuaaaaaccaaggauaacagggagaaauuagugcccauccugcaagacuaucuuauaauuagcaaauugagagcaauuaaugucacuuugagaggcguguauaaaauagugauuagaagugaguaauuuaaucuaucccagucuaauuauagagucuagacauuuugcauaauguuaaaacuggauuuuuaucuuuuaaaggcuauuuagagcacuguuuguucauggcauucuaaaaauguaucuuaaaaucacuuucaauacuuuagagguaaacgcauccuuucuucuauauugauguagccugccaguaacaaagucaaaucccaacuggcuuacaaugcagaacaggucuauaggucagaauuugaaaacaaucucuauaaaugucuacagccagacaacuuucauuacaugcucuuaaauuuucugcccaggucaacaaucuuacauucacaaagugacucucaauauguggaucaaaagcaaaaccuuuauaacaucccagaagcagauaaaucccagagagacugacauagaaaaagaaaaaaaagaaacuauucuauuugggucuuucaggggaucuauuuauaggcuaaucuuaaaaaacagacauuuuuagugccuugguauaaauucuagaauuaacuguacaugauccacagcaaugaauuuacuaaguaucaagauagauuccaagaccaugagagguuaggaccggagauggcagagaaagagauggguucuaaauuaccugauucguauccaaggaagccauaucaaaaaucaugaaucugcuagagucaaaauuucuggacguagacaauaguuaagaauugacaugccuacaaaugcuggagaacauacuaaauaaugcccccccccaaaaaaagcacauagaggcuggagacauggcguggcaguuaagaguguacuggcugcucuuccagaggaccuuaguucaauucccagcacccacauggcaggucacaccugucugcaacucuaguuccaagggaugaaauacccucacacagacauacaugcaggcaaaacaauggugaauauaauauaauauaacacaauaaauauaauaauaaagaaagaaaagcacguagguuuuaccaaccuacuauccuacagcaagcgcaccuaccucagugcccauagauaaggucacgacacggaacuucaugaugggauugaugcacguuuaagcagaaaccaguuagcaugaaucaugaauaagggccuaagucuuccaaccagcacaaagggagaagaaaaaggaagcaggaagcaggaagcuggaagcaagaggggaaaaagacccuagagaguacccuuguucuuuuucucagcaagauagucggaugcuagccaagaggaaggcugcaccagcaucugagucugccaggcauccaaguuaacugcucaguuuaugacauuugucaguaugagccuaagcagauuagaguaagagugaagccuccucuucacucuaggcaagaccuguccuaauggaauguuagaaauaaacaugaaucuguucuacuguaacuaugaguucuacucuuaucacuuuuacauagucuuuagauuuagucuauguguaagaguguuuuacuugcauguacauauguguaccaggugcaugccugguaccuaaguaagucagaaaaggguaucagaucucccuagaacugaguuaggggugaucguaagcucccguguggauccugggaacugaacuuggguccccugcaagagcaacaagugcuccuaacugcugagcuaucacacgaucuccuauuauugccacauuuuguaaguuggauuuuuguggauuuuguuuggcuugggguaaaauucucaaaucuaccagcuaaacuucaucaugagacgcaaucacagguagaagaggguaguggaggacauauggcaaugugggacacccagaggauuucuaagauacugauaaugccuucuuugucaaccauagcgaggcauugcuaugaauagugccauaaauauaugagaaugugcauuuauuauugcuguuauuauuuuuuugaggcaaggucuaguacaucccagguuggccucaaacuugcuauguagcugaggauggucuugaacuuuagaucuuccugcucuaccacgauaguccucuggcugcaagcacucaccaccauguccacguggugcuggggucaaagccuaggccucaugugugccaaacaaguuuucuacccacugaucggccucuccuugaaagaaaaggaaucuaaaaugucuacagcuaacaaaaacagaaaggcgaaaucucugacauuaaaaauuuggaguaugagacaaacaaagccagaaagagaccauggcaaaagcauauggaaccaggaagcugucacuacuaaggccagacagaaggagcuaaggaacccaugggaggcaaaagcaccgggaaagagggggacuuucuccuucucucuagaaacagcagcauuugggcugcucccacacuccagugugcacagaggagucaauuucugcuugaagagggaauauugagaggggaaaggcaguaauugcaggauagcaaagcacagaggagaggcauuuagaaaugccaccacccaacaggacugacaagaucugaacuacauucguaucgcccagauuguuaccuccuguacuaggagagcugaagaaacagaagagcaaaggaugggcaggcagccuuacauaaguuaccgaacuccaaaguucaucugcaguguuauacacacaugaaagagucccccaaagaccucaaaaagacuugaccaucaaaacuuugcuuuccagggauggagagcuggcucaaugguuaagagcacagguguucuuccagaggaucaaaguuugguucccaacaccuacauagcaguucccagucaucuagaacuccaguuccaaggauccaagguccuccucuggcauuugcaggcaccagacauguacauggugcacagacauaugggcaggcaaaacacccauacacauacaauuuuuaaaauguuuaaagcaugugauauuauucuuuacuuucacugaaagaaucaaugaaauuacauguggcauaaaaggaaagaaaaggacagcauauuuuuaaucacugaaguuagcaugccuggaaaaauauugaucuugaucauuguguuaaguauuuaaaaacauauuuuggaauucauaauaacaaguguaauuguaaugacucaaccugugggucaugaccccuuggggucacacagcagauaucauuuauauuacaauucauaacaguaguaaaauugcaguuaugaaguagcaaucaaauaacuuuaugguugggggucaucacaacaugaggaacuguauuaaaggggcauagcauuaggaagguugagaaccacugaaaaaggugaaaugccuagacagugacaucaaggaugucuuagaaaaacaaggccacagccacaucucacugcagggccuuauacagucccaugugugcagucuuuugcucaggcuggauucucacauuuucaucagacaauauguuacaguguggauauguagaacaucuaauaauucugaagaggguuauucuaggaguguuuuaaaaugcauaaucagagggucaggucacuauuuuaaauugcucugcuuauaugcauaauuuuuaaaauccuaaggccauguaauggcacuuaacagccuuccugaugauuaauaauaucuaaaaccagagacauuucugaaauggcuaauaauuuaaacacccacucaaaauggcaauccaaaaucagaaaggaugagugaagcaacucuaaugagcaacccccacccccacuucugugucucgugccugaucauuuguguaacuccuaacuagaagacaaguuuccuuuacuuaucuuuuaaaagcggacuucuuagggaacuuaaaaguaaacucuaaauuuuaugcuuauuuuuaauugacauauaauuacacucucuaaugagguacaaugcucaauuauguuaaaaugggccauaaucaaaucuggcugauccgaaugucccucuccauuggcaguuaccguuccuuugugguaggaaccucugacaucuauucuauagguucuuuaagagacacauaauggauuuuuauguacuguugucaaucucugugcccacuccuggggaacuguaugcuuugugccuguucucuaacccucccuccucuccuuucucccccucugcugucccuucauauuuccugcaaaucaauguuauuagcgucuacauacacauaagacgacaauccuaguguucuauuccacaaccacaagaaauaaguaccuggaccccagggaguuaggacuccccaaaguugcccagucuuucucauggguaucagugagaugaaucuguaaguucugaacuuccugcaucucugcuugguaacuagggcaaccuuacuucuuggaccuucuccacucugaaguccaagucaccugcccauguaacaugaauagaccaauauauaaugauaaaaaaguauuucaaaagauggaaaauguuuuccuucuuccaguuuuuuucaaacuguaauuaauuuuuacacauuaugccacuaacuuccucauaaauagcagaaucgaaaagaacaaaaaauacagccaucauuuuuaaaaugacucuaaccuuaaacuagcaaaaccuaugaagcuaaguguuguaaaucugaguccacauuugccaccuuaggaccugcucaggucggggaaggugagcugaagagcaaugggacuaaauagacucccugccgauccacaugcgucccuagggcacucugcccugggcuccauucaugccacuggcccaagagggauguccaucucuaggaggguagaaacaccccauugaaaagugaccaaaccaacaaacuccaaauuagcugaagggugcuaguguguccuucccuccuguggcaccugacccacuucaccacagucugcuucagcagaucgcuccaagcaccaguuaauccuaaccaaaauaauuaauaauaauaauaauaauaauaauaauaauaagguccuagaucuagacacugaagcagcagcaaacgguguaagcccuggagagaugaaggguauguaucacaggaaacagaagggaugcucaacacuguggccucaagagaacuauagagauaacuucuucuuuaaaagaaagucaaagacacaacauugugugugugugcgcgcgugcaugcgugagugugcguauguguauguaugaauguuuguuuguauguauauauauguaugaagcugguaagguucagaaauaguuuuuuuauuaaauggaaagguuaaaaaaaaaacaagaaaacacaauggagggcagugguggcacacaccuuuaaucccagcauuuaggaggcagaggcaggcagauuucugaguucaaggccagccuggucuacagagugaguuccaggacagccagggcuacacagagaaacccugucucugaaaaaccaaaaaaaaaaaaaaaauggaguuggaaauuuggcuaugugguuaagaguucuuguuauucuugcagaggacuggaguuugauucuagcaccuaaaugaaugguggcucacaaccaucuguaacccagucccuguagaccauugcaaugcccucuucugaccuccauagaugggcaucaggcaugcacauaauacauauauacacccaggcaaaaugcucauacacauaaaauaaauaaaucuuaauaauuuuuaaagaaaaaaaauacaaugaacuuguaauuccaaaaggcaaaucauguucacagaaaaaaaucacuggguaguaguguugcugaacggugcuauuaauccuggucgauacugaggaggaaaacgauggaaaccccuacaguaaaaacacauccucucugacacugggaaggccagccauaccccagggcaggucacaaacacaggaguaguuggccaacaugaaacagauucuauauuuguuuguuuugucuuuucgguguauguguguguuuguguguguuugugugugugugugugugugugugugugugugugugugugcaugcacaugugcauuucuuauauuuuucguguuuugguuugauuuuagcuuuucuugucuuuuuuuguuuuuuaagagagagaggaagaaugugaaaagagguauuuauggaggguggguauggaaggacuugggggggagaguaaagaauaugaccaaaauauguguaugaaaagauuuuaaauaaauauuuagaauaacaucucugaagagggaccucccauugacugagacuuguuccuaggaauucccaaguccacagagagacauucuugaaauaucccagagaaaggaaggcuuaaguguuucauaucuucccaaauuauuccucaauuacaaagauagccgauaagcauuuauuacaaaaugaauucaugagacagcacucaaaauucuaccucgaauaaucuacuucucaguuaacuccagucaagcaagacgcaaauagccuaggaaggguguagacaauaaagaacucauuuuuaaguuacuaacucauuuaacuuacuaaaugauauccaaaagacagaaggcuacuaaggaaagccucaguagaauuaaaugaacaugaauccugggggaaagagggacuauuuaucucuucuucgcugaucucuaauacccugagcucuccuagagaacagaccuagaaaugaaggaagacgagcauggccuugcaguuaccgcuggucugcagccugugcuguagacucccccucugcuccuaguuguuacugugagggcagaaauaaagucuaucagaaaaguggaacacaccugcaaagugaaaaauacagauuuaugaaacguguuugcaauuuuuauauccauaagaccaaacauaaacauaaacauauggccccaaaauccugagcacuggaccuucagacaaaaaucucauuaaaaagagaaugugcuccugaauugagcaacgggggaaaccaaccaccauguaauaaauccucaggcaagguucugacuucaugcugccagacaaaaugccaugacucuauccacaggcaacauuguaaauacacguuaugagaguugaggaaaacagccuuucauuuauuucuuggggagggaauaacaaaagaaaagagacuuggaacuagacaugagucuccuuuuaucucaggguaaggcacaaucgcaucccacaaagucucugaucaccuuuucacacuuuuagaucauuucaaccuucccacucuucuucauuuauacuucuaaguuuacacaaccguuaauuuugacauacgccugcuguucaaugucaaaauaaaagaacgauuuaacuggaaagcaagauuuuucucauucuaccuacauaaaacugagggacaggcuaacuugacaucuguuuaagaaugggguucuuuugugaaaaccaaagagguuaagaauguucuccaaaugauaacagagcauaggaggguuuauuuuccacucagucagucccuagcacauaauaggaccacauuccaccaaaggaaaaaaucuaagugaaggucacgugucaguuuucacauguaaauauagacuuccaucuauaacagugaaggccagaggaugggagcgcaggaguacugggguuccugagaaccuguacuguggguggguggagugguccuaaagaaaacacugaagggcucucaaacuagaaccccaccccuaacccccacccccgaccccucagcugcucagcuauguuugagauagaggccagcuaucacaucuuaauuucauaugcuccuguuugcacggccuucccauguggauccccaugcuaccucgaagguugaugaauuacucugcaaaacuuucucaaacaugacaaaggauaguguacuggcuaguuuuaugucaacuugacacagcuggaguuaucacagagaagggagcuucaguugaggaaaugccuccaugagauccaacuguaaggcauuuucucaauuagugaccaagggggaaaagccccuugugggugggaccaucucugggcugguagucuuggguucuauaagagagcaggcugagcaagccaggggaggcaagccaguaaagaacaucccuccauggccucugcaucagcuccugcucccugaccugcuugaguuccaguccugacuuccuuuggugaugaacagcaguauggaaguguaagccgaauaaacccuuuccuccccaacuagauggucaugauguuugugcaggaauagaaacccugacuaagacagauagcuuuauugaagaagccugccuauucuuaggagauauaguaaggaugauagaaaaacaagugguuugucuagugucuugguaagaaauccuggugguauugagaggcacaugggauuuuaagucugguauguuugggaacucuaaacuuuaucucuucuuuugauugagaugggggaaaaguaggcucuugccuaggcccuccuggaaagugugacaaucccugccucugccugcuaaguacuaaagcuacaugguaagcuacuguuuccaucucuaagucuucaucuuguuaauguaauuagcauuuuuuuuaggucaguaccccucaauucuggggacgaucccuuucuuuuuuuuuuuuccauuuuuuauuagguauuuagcucauuuacauuuccaaugcuauaccaaaagucccccauacccacccacccccacucccccuuuuuggcccuggcguuacccuguacuggggcauauaaaguuugcguguccaaugggccucucuuuccauugauggccgacuaggccaucuuuugauacauaugcagcuagagucaagagcuccgggauacugguuaguucauuauguuguuccgccuauaguguugcagaucccuuuagcuccuuggguacuuucucuagcuccuccauugggagguaauuagcauuuuauauuaaaaaaaauaaaacaaaggaaagcugggcuuucuuaggagucaaacacccuucuccaccccacaaacauccaacuauccuguguacuuacaaccugauugagcugccucuccagaaagccaagagagcacuggagccccaggcccacugaaccucauagcuaugaguuagauaaaccucagugugagaccucagcuccuccaugccuuugauccacuauuuguaaacaggaauaauaauaguaacuagaucguuagucgcugugaggauuaaagacuugguucauacagcgcucuuggacacugcagcgagcacuggacaugcucaguaagucugucauugcuguuacuuuuguuugaaugcuaagccccaacauggcagucuaccugagcugaaacguacauccucuuggcuggugauucaagagauauaaaucagauuuaaguuuuacuguugaaaacucugguuugcauucauugagugguagguuugauagucccuucuuucuucccuguguauguguauguauuguauaugugcauccauguuuguauaugugauuguauaugugugauuguguguguauauguguuuguauauguguguuugugugaguguagauggucagagaucauuaucagauaucuccuucuauugccuucuaacuuaucuuuugagaugggaucucucccuuaagucagcacucccugcauggcuagauuagcuggccagaggcucugguuauccccuggucuccacucuucucuaccugauagcacugagguuauugaugugaauaaucaaggacaaccaaggacaaucaaggucuccacacuuguaaaccaucacugagucaucucccccacucuugguagucccuuccucucuugcaagacaccugcugcguaacucaccaaaugaguccuucugagaaugagaucugggcauuuagcucccaaucuuaagcucucggucucaggcuccucaucagaguuccuggccaccuugucuuuuuucuguggaaccucaacugguuaaugcucugccauacuuaggcagguacaacacagcuuauuaauucuacaugcaugauuuguagcuaacauagagaagggccaugguagcgaugcucucuguguaacaagaguacaguaucagaagcagagggcuggaacuccagaguccaugauuccaugccucagcauaccauacaguggugaccuuggggaaaaaaacuguccauuacugaaucccagaguccccaucugauugcugguuagcuuuucugucacugugaugaaaugccugagaucaaaagcuaaaaucaaggaagauguacagucuggcucaagguuauugagauuguaguccacagcugccuggcucggcugccacggaacuguggugaagcagagcaucagcagaacaucguggcagaaggagaaggauguggagaagggaagcugcucaccuccaggcagccaggauggagacugggaggugagccaccaauggaaaaagggugaaaaggagagaggagaggagagaggggcuggggguggggaagaaaggaagcagagaagagaaggaacagaagaaaggcaggggagaaaggggagugaggcagaaagcagagagaggaagaaauguauaagagaggggaggggaagggaagggaggggaggggaggggagggaaggggaggggaggagaagguggugccuccugaucuacucaccucucaauaaugcccuugccugggaaccucuucuauaauaaaaucugccaccaguuucaugaugcuacaaauuacuuguuaaaccaaaagcuccauuucuagaguaaaggaauacccuuuauuuacacagacuuugguugcugguccucugaagcacucuggaaaacggccagcauccacaacagagcaggaaggcuaucaagcuucaaaaucucugauaaugguggaacaucuccuuuuuuauaaaaauuuauuuauucuuaacuuauguguguuggugcuuugcccccauguauguauaaauguguacccaaagugugucauaucccuuggaacuaaagucaugaccaauugugagccaccauguuagguccugggaacugaaccccaguccuagagccaaaguacaguagaaaagcguuuaacaacuaagcaucucuccaggcuccaaagguaaaacaucuauuaacauuugaacagaagagacaucaagguuuuaucugacguuauugccuggacuuuacauaagaugcuaauaauuuugguuaucucuuacucuagaacuaauacaucaaagagggacaaauuauugagaaccaggaugaaauggcagauguacuaaagacauagcuaacaauagaaaaaagucauaaaccuacuacacugcuagucacacaggcaaagaaguaacuguaaaaaucagaaaaaauaagguuacagucacucaggcaacccaugacccagauuuaaugacuuucuuuuuuuuuaaacauuucaggccuggaaagguggcucggugguaaaaagcacuuaaugcucuugcagagagcccagguucgauuccccagccccacuuggcagcucaaaaucaucucuaacuccaaucccgacccagaucaagaggaucugauauccucuucugaccuccaugggcacucauguaguacagguggacagacacacagacaaaacacacacaaaaaaauaauaaaauaauuauaucucuaaaaaauuuaaaguuuaacaaauugaggcauaaguacuguuauuuagaaaaccuacucaauguagaacaacacacuccacugcaauaaugugcaaaugaggcuucacaauacaggugcuuaaaaauagauccuuauauguuuuaggugaagggaaaaaauaggucaaaauuuacauagucacagccuauacagcuguauaaguacaacuauggucguuuuaagaagacuuuuaaauagaauaugacaauaucuuuaauucuaugaauaacaaaacaagaaagaaagaaagaaaggaaggaaggaaggaaggaagaaagaaagaaagaaagaaagaaagaaagaaagaaagaaagaaagagagagagaaaaguuaccuaaauaccuuuauacccccaaaaaagccaagacuggaaccaauuugugcagaauaacugcagaacgagucuaauuaccagccagggcauaccaagugcagucugucaaaggccgcaaacacugcugagugccauguauacacacaggucccucucacaccauacuccucagggagcacucuccucagucgaggugagcaguucaaaggacugagucugaguagccccuccuuucacaacagcucacuaucaacucagucauucuaggcuggagcugaggcuccgccuggcacagggugcagaccuaugcuguggcucauuauucuuugcuccuuuccccaagccguuccuccugucaucuaaguuucaaacaggcuccuucccagauaucaucugcaaagguuggccaacuuuguaaucucugcucuacauuaagaacagagauucuuguucuuggccggugguaugacgcacgucauugaauacauaugaauccagcccuuuacacuaaauauucaagguaacacuacaauaacauuggacagcacaguacucugaaagaauaaaacuccacuccccuauggaucacaguggccuaaacaaauuaacgcagucuuuaugggaacuaauucguacuaaagauggugcuucacauaggcuuaaucuucuagcccugaaaguauuguccacuaaauauaaucaacagaauucucagcccagcuugccuggcauggaugaguagggaucugaaugcacuguggagcucugugcucugcucaaggggagacgaguguaggcugucuggaggauaagccuuccaugcuacagcaagucugaguacccacuggagagguucucacgcaggccuaugggcuauauuuacacugacucaugcaaacgcauuagauuaugguuuauggcugcacagagccaaagggaauggagauuucucucccucggagaaugaauggguacuggaugcacuccaaagauccacggccaugcuuagagaucauggaaggauaaacacaguuacagaucuuuaaauaccagguugaguagaaaucuacagauaacaucacuuaugggaaaggccuaugaaauuauaacauauguuuuagaagaacauacacaaagaaaagauuaugcaaaacacauucagaaauaaguuaggauaaagaggaaggaagaaggaaauagauaagaaagacacuuaaaaaaauauacuggggccuuacacaaagcagucauuuugcaugcugugaauggggacagugaauacagccuuccaaaccaagguuuguuugaaagccagagggcaauacguuacaucugcaaaagaugcuucauauaaguauuagauucucuuguucuucaaagucaauuaaaaacagacaaacccaaaaccacugauucuaccacuaauauaguaaagauucaauaaacagucaccuauuuaguaugugugcgugugcgugugaggaagaaaccaaguaugucagucaccauggcauaauccugaacagaguguugauauagccucacucacgcuagugccagucaguguauuuagccgucugucagugcuuaucucugaaugguccucucacaaggcagugcauuaaguuuaucucgucugggaaacacugagacagcaacacuggcagcaucagacuugagauggcuuucaccuugcagaaaguucuuaaagacuuuaaaauggccuuuuguauacuacaaaaaugcccugcuguucaacaguacugaacacagcagggaaggccuauaaauagggacucacaugcuugaaguguggacuucucauguauuagaaaaauucucucugaaauuuucuuuucuucuuggaaaaggcacuguacccuuuuguguucuagcuaaacauacaggaacaaauuuuagcuauuuucuuggggacuauagcaaucucuggguccauguuccaaaaugauuugguaaguggcuaguguccaguguccaagaguaagcagcuuuuaaggacaaaacagggaacacacauauauauauauacacacacauacacaugcacacacacaacaggaagcaaggaccaagccgaagaaccaguucugucaagccgggguggaggguuucuugauucacccucagaauucucaguuggacaaaaauggacuaucucagcuggggagcaaaccugcggcgucuugaagaguuuaaccccaacuucucaugauaaaaagaagucuguugaaaaaaggcuagcuguccuuagaacaggaaguacaugcccagaugcauuauucuaucacugaugugucugaaugaagguucuucucaucacccugagccuccaugaacccuucuaccuucaaaacagagauucaaaaguuacacacuaagccaacucuaacagugguauacagcuccuguaaccacucagaacagugguauacaacuccuguaaccacugagccuuuucacucagaaaagggggacuaucaagagauuuaaacucagaaaccaccagguaaaaaauagcucugaugaaaacccagcucucaaaagacaagauggcccauguuuaguuccauaguaaggaugcaucacugucuacuugaggaagugugggaggaaaacccauccaaaacaggggaagugucaaaugagcauuuugcaggguguuaagcccacaacaguuuccuaccaugaaccacagagcugcaacccuucccucaaacugccuuuaagaaaaggaauagcuaaugguuucuugaggcgugcaugcucuuuuucuacagacuaacucaaagucccggagugcaaagcuagaugaagagguagagaaacuauuugcuccugaaagugcugcugguuaucaauaucuacauuaaagacuauauuacugaugucauaggaaagaggcuaacaagacauggauguguuucuaauuccacuaaaauauucagacuucuuccugcagcuuauaaaacacugcugaagaugcauagaaagagacuuuaguuaggaaaaaagaugcaaauagauaacaguuuaucauuuguacaguuaauaaacacugcagguuggugacucaucucugaaaauuaaugagugcucagagagaguuauuuuccugccugaacaacuuagucauccuugaauuacucagccuaauacugcaguaccaagccccuccuuucucugauccaauccuaaacugugggcuccuuggaacuuagucucauucuuguccuauagccacacaccauguagaacauggaagaaagggaaguaagugggagagucgaauuaagacucccuauaccacugucugauuauuuuuuaaagagcagagcaaguucuuaaggccaagucagaucaguaacaauaagcaagagccccugauacuguuacaucuccagaaaagcccuccuuggugaaaaggagaaaaggagaaagaaagagaaggagggaaagagagggaggaaaggagagaggagaggaggggaggguggugugauuaggauguccauuagcuugaguauaguaguuaccuacaauaaagacagauaucaaaacaacauacuguauuauuaaaagguauaguuuuguuaauuacaacccaauaaaaccagaagggauguuuaaaauagaacucuuagaaaauacaguuugucuaugugguguaagaaucauuuagucacaucggaaagucugcuuuagugcaugaguggacuugguuaggcagaagacaaaugaagaagaaauaaaaugugcccugcguagugugguagagaucuuuagccucuuaguugaaacgcaucccuauaaaaagguaaaugcaauuuuaauuauuuaaauuagacuugaacauuuucacugaaaaaaaaauuaagccucugugcauuauuuccuuuuaaaacagucugaaaauuaaagcacauggacgucaucaaggaagaugaauuagaacugacauuucugaagucugcauuuuaauaaacaagucauaaccagcuguaguuaggauucuaauaucggggcuccuaauuuauaauuaauuuaaaaagagcugagaaaugacuuucuacgaugaaucuugucugugaaucaccaaaagaaauaugcuagaagcaacacaaucuuuauuggcaacaaaaaaaccaccaaggauauuaauaaguuguuuuaucugguaucaaacugugacuuuauauaaauccauacaaaaucaagagaaaagcuuaauaaaucauuguuuagaguuagauuuaugcauggaauagaaauuauaaaaaacaaggcaccgugaaugacaggguguauauuguuucauuucucugagguucacaucuguggggagcuucaaacacaucuggcauguguccuucuaaaacucaaauuagaacauaaacuucaggugaugacaugaagaugugggcucugaggcaauggcaaggccacgaagacucugcccacuaaaaugaccucaaucccaagaccaggcaggcuucagauagcugccuugaccucccaucucuuccccaaugugaggacacacuuuuuguccuucuaccccuugugggcacaaaaacauugugaagcagauguccuuuaccaaauuaaaaucuucuugcaccuuaguccuagacuucuccaccuccagaacugcaggaauaaauuucuauuauucugggcuaaucugcaacaguuucacaaaugaacugaggcuuugacaauggacaguccuagguucugcuauugcugucaguaggagucacuguuaggcuugcuuaucuuguggauguccauccucucucucucucuccucucucuccucucuuucucucucugucucucugucucugucucucucucucucucucucccucucucucucucucucucucucucucucuaaauauuuuuauuaaugcagguguuuugccagcauguauauccguauaagugcaccagaucuccuggaacuggagucaugcacaggugugagcugccauguggaugcugggaauugaacccaggcccucugcaagaacagccaguguucuucacagcugugacuucucucuagucacuuucucuuaaucaaagucuccagaucucuacuuucaaaugucuacauagccaguucuuaaaaacaagcuucaggccuaauuuggaacauugauuuccaugaaggucuagcucuauagccacuccuaaccauaaucuaacuuacaugcguagugacagucuugagaauuugagaauuuugguuuccuuuuacaacacagaauuauuauaaaaauaugcuuuuguuuuaaaaaccgggugucaggaugugggguuguuuugaacuguccauagcagcugacuaugauuugccucaugcucuagcagaggcaugguuuugccagcugcagauaguuucuaugauugugugauguuugaaaaucugggaacuuuucagggguauauaaaugcuagaaccccaagagucaggggcaggguguuauuuguuuagggaguugguuaugauuuguuaguagccauggucaaagaagaaacaagaggaaauaaauuagauucagggauuuuccuaguuucucucuccucucuauccuuguuuucucuccuaucaaguguagggggaggaaccaggaggauaaaggguaggaaaaggaacccacaaagcagcaaagacacauaugcccucccuaugucaguaaaagcaccuguauucuuuacuauagcgcuucuaggacuuucacuaagagauuguaaaacuaucuuucuccuccaccauccuguaagagaagaguccucucuuccuggcacauagcagacauucaauaaauaucaugaaauaaaaguacuggucaugguuuaugcaaaguuuucuuccaucaguggaaauuuauuggucauuucauugauauuagaaagaacuuuauguacuugguucauacagaaggucaguaugaaaaaaagcccacuuaaguauuauugcugcuccuuugcaaaaugaugguuauccaugucaaccaugaugcugauaaauaucuuacugauccaggaccaaacaacuaaguucccccuuggcaggaaauaguccuaucugcaauagacaaucagaugaacucuuacaagauagugaaaauuaauauaagccagcauauugccuuucucagucaacagucugaaaaauaagaucugacuucaguaacuacagcaauuaacucauccccggugccucaucacgcaggacccucugugcuucuggcugucuugucaugacuaaccuccgcuauaauuuuuauguaaaacuuugacuucaaaaaugaauaagugcucuaaagaaugcaucaaguucuaguuuauuuggccauauuccaucucaaguuggguuccugaauggggucuccuuuuauccagcagucaagaaauaguuccuugggguuagagagauggcucaguguuuaagagcacugacugcuuuuccagaggucuguagucccauccuagcaacuacaugauggcucacaagcaucuguaaugggaucugacauccucuucucgaauucagguauacauguagauauagcauauauaauauuacauauauauaauauuauauauauaaucuguuuuuuuaaguacaaccuuuccuuuaaaaaaaggaagaaggaaauaguucuuugcuucacuaaauuuguguuuuauauccuguauuggauaagaaaugcccagagaugccacuggaaggcaauuagauucuuuugauuuugauacaaauucuuugcugucaugcuugcucucuguuguggcuuccagguuuucuguucagggccggcacaacuguauugccucuugggaucuagaaaaaacuaaagcuaguuuccugaggccauucugauauucucagacuugaugauucucccaugacaaucguugucaauagacagcaagcccuggggccgaagggccucuuacuguaagcagaaggaaagccucagagaccuugcccgucugcggaaaucaagaaucaauacauagacugcagaaagagcacuugacuuacaugcacaaaacccugguuuaagcugaaacaucagagccagggagggugcggagagaaauaccaauguuuggauuguggguuuucuuuugcgguuuuggagacagggucucucuauccuguagcucuggcuagucuggaucucucuauaucaaccagacuggccccaaacucacagagaucugcugccuugaccccuccugagugcaggaguaacaguggguguuaagaugcuucugguuuuauuuuaauguugcuguuacuguguuuaguggugcaagcuauucucaaacccuuuugaaguagaugacauaaacauuguacauagcuaaaacuagagccugccaauauucggagaauacuuauuuucuauuuuccacaguaucuggaccugauccacuaacaaauagaugacucaucagaaccaaauaacaucuaacacauccaacauugcucuccaaacagcaauguccagggugaaaccugccaaguucuuaccuagucagagcaaagcuggcaaaaaacagagcuaucuggaucccuagaaucgaaguauucagaacuaaacaggagagacugucugaggaggugaaaccccuuagcaguuccuuccaccuggcaggaagaauuuucccacagugacuucaggccauguacaugaacucaacuaugucacagcacaugugguaccaucuaaucaggauuuauacucuuggaagcugcuccuuaagguuccuuauucuuacagaaaccuuuucugaaauuaccaaaauaguuccaaucuuccuaaaauauauaaaugcaaaagagaccgaagucucaaaccagcacuuggaaacgacagucagauaaucaucuguaggagacaaacauauucccuuacuaacagcagcacuaacucugcgucucuggccgauguagaucaggauggcgagucuuuaggcugaggaaccauaagcaggaaaguaccaggaugguggcugaaacaaacaagcaaacaauuuccuuuagucucaggagcccaaggaugagguaucagcagggcugguuaaauucuggaggcuucuucuugacuuauggaugucacgaucucuugaucuuguaugguuucucuauguccauucaugacuacucagauuucuuguucuuaugaagaaaauggucacacuuaauuuuggucucccucaaaagucuguauucuaauuaucuuuuaaaagaccuuauuccaaccccagcuacaugagguacugaaguucauaaaaauuuagcauuuuagcuagcauuagugagauaaaggucagcucaugauagauggccaggcucaaugcauggggcuguuuuaaaugcagcuggagccuuaugcauguucuuuaugacauuaaaagucggucgauaccgucagucaacaugaacauagaaagucgugagagccacguccagcucacuaggguauuaacaguuuggugcugugaucacuuaguagccauagaaggagaggcucgcucagauaagcagacugaaaucccaaacugcaacugcagcuccaccacccucagacugcccagaagcagaggauaugcaacacaucuccuuuaaagaguuauuaaaagggcaaauacacaauuuggguaaugggcuuaaaugaaggucuaugacaccaucauuaguauaauucaaaaaucuccuucugcagacuuuuccuaaauuuuuuccuaaauucucuugcauuuaggaaagaagcauuugcccuaaauagcaacacuuaaagccacggaauccagcgauggguuccacggguuagcgacucuaaccucuucagacuacagcucugagggugugucagcugguaaccucugcugcagagcuaagauggaaagucuagaucccaaauucccugugcucccucaacugugugaaaggaagcgaacagggagacuagcaugcugagggaagagagagccugggugccucaucacaaggcagccaucuuagaacaggugccauuaaguccagaauucaaaauccugacaacccuccagccuggggcugggcccaggucagucaguuuccugcugacccuagcacgagcucauggcacuugaucccauucauucacaaaagcagagugaccuaggcggccauuuucuucaucacaugcuccuucuuccaacccacagggaaagcuaagcaucaaaaaucugcagagcugaaaaagauguuaaacagaacaaagcugaaacacccuuuuagaaugcagaaagguccagaaggcucuuggccuuuggucugcuaucgauugagcuugugucucuccugccccugaccccaagagccagugucuuuccauuucccuuacucacgguccaaauucaacugugugaaaagauauccuuugaaagucugaugcauuuugggaggagccuaauaugcuuggcacaguuaagcucugagcacucaccacacaauucaccggaagcucaagaaauaacugagaaagggagacaguuuguccuccuagggaggagguagugaagaaucaauuccccuagaagccgcucagucaacaacugucugggcaguuggugaacaaaaucuaacuccuuugccucucgaugacuggcgggcuggaugugagaaugcagccccaggauuccucugggcaagauguucagaugucaguagaaagcaagcagccucucucuggucaucuucuucccagccucaccuuucuguuauccaugauuuccuggaauccucccuucgggcgccaguagcagggacccaugcucuacagcagcauccuguaaaacucagaggucccacucaccgggagaagguucucucagcaccaaggugccacgggcacacuccaugaugguuuuguuauuaagauugguuuuuacuauuucucuuaacuuuuugagauuauaauauaguuacaucauuuuuccuuuuucuccuuccaacccgucccauaaaccugcucccuugcucucuuucgaaucuauggccucuuuuccuucaacugguauguguguguguguguguguguguguguguguguguguuuguguguguguguagggggaugcauauguguuucuaaaucuguaaugaccgcgcucacagucuauacaauguuacuuguacauauguuuucugguauuguauaacuaacugguguguucuucccuaauccaucauguuuuaauaucgucuauguacauuuuaauuccauugcuaugggaagggaggaaaaaaaaacccucucacacaucuuugaaaucucuaugcugcucagcacagcauuuuacacaaacuagaugcucagcguugacgagcugaaggaugaauuaacugugucagucagcacgaaagccaguucuuuauucaaccuaacugaagucauuuuagugaaguuguuuucuucuuccaagaguacagcaugaacugcuucuaaugagcaaauuacugugugcaugugcugcuguaaaucggcguucucuagcuguucauguaaacaccccugagucccagaaaauucaaagaacucuucuaaaucuggaacuaccuuccuggauagauuauaguaacacuuuuuuuuuuuaaaauccugcucuuuuuuuccuacuuaacucaucacuggggccacugccauccacgcagagaccuugaggcccuaaagucaccugaaucuguccucacacugucaccuugcaccauacuccugcacaucuucucaugacguacccacacaguguaccccacccccagagaagcauccccccccccaggagaaggagacuaugaaagccagcuaaaguccuguccuauacacaggagaaugcuaccacgggguucgugugcuacucugaucccacagacucgcuucuccagugccugcaaguaacuacagcuuucagcacugccccaccuaguccauccugagucccuucucucagcucacuugguuacuaauaaagcaacccucuuagucuccacauuccacaucugcagguccacaccuuuagguuacagccaccgaucacugaguuuuacaguuuucacccaagcacagcauucccugaggacugucaagacucuccccagaauaaggcuccugccugauuaacagccuagaauguuugaacauugguacauagugagaauucuuccuucucuguccugcauaugggucaauagugggcaagcauauauauugcuguguaugugccauagggucuuuuuauguaguccuagcuggccugaggcuuaacgugcugguuuugaacguacagaugauccugcuuucgucugcuacccaagugcugagauuacagguguguaccuuucaauaaacaggaaagcaugcugguagucuggucaguugccuguagccaaucgugugaccugacgauuuaugcauccaaaaauuugaugaucucccaauccuguuauuuucuaaacuagugacuggugacuggccccaaagcacaugaaucacaguauguucccaauacaauggggaauggcaucuaaguaccugcuccauagacuaucuccucuguaucacuaacccuuccucaucagcuccaucucucagguuaucaacuugcucaucaucacaaaaagauagcaugcauucuucuaacucuuccucucaccuauaaauguugcuuuuauuugcucagaugaaagauacacagcucugacugugcccagaguguuucuuucucuguucuaacuacuccuaggccugaaagcuucuagccuccacacaaucuaaucuuccaagaugacugauucaauuuggcuucucuuagcuucugacugaauugcucugacuggccucauaguaacuucagcaaucuguucuagucuucuggcuccuucucauucucugacucauucugucuucaucuguaugcauauucuuucuguaaccugucucuauuggacuguccaaguaaaacuguccauacacacaccacaccacaccacaccaccccaccccucucuuucucucuugcugcucuuauguagccaucuuccucugcuaugcaugugagaguugggcagauucuaucucugacucguucugugaaaggguucugauuugucaguuugucugccccccaaaugucacuuucaaauauggcugcuuccucuacaaccuaaccuuaccgacauuguuuggaauuaaauauguguguuaagaguaugucuguauuccagcagaucauacuguaauccagggugugucuacaugcugaccagaucauaucuauaaaugugauccccuggcaaagcagccauauggcuugauuaaaauuccucuacacucacccaauccuucaguggccaugugcuguccccacauuauguaacugguucccccaacaacccccggcuuuacuaaaaccacucucugacaaccaccagugacaaaucagcuggaaaauccaaaggaugcucauugcuuaccuuaccagagcauccaacugcagauaaugacgugaaucacgucuuucaguucugaaacugucaacaucauuauccugcagguucuccuccuacuuccgcagucacuugucuccuucacaguuccucucuccaccuccugccuaucucccagcucucuuuauucugccucuuuccuccuccauuuaaagacauauuugucauuaauguuuauauggaaguaacucccaaggcaacucccuccagcucacauuucuccacuaguuuuauuaaacuacccucuagaugcaaacugucuaaucaagacacuucuguaggcuuuaacucuuuuuucugcuuugucaucaccaucaaaccaauucuaaugauuuuuaccaacugaagacuucuuacaaguauccccucucugugugacuuagcauugccugagagcaagacuucuguuuaguacccuugacuuuuuacaaauuugggaaugacacccaaguacuuaagccuaaguuccagaccauucaugaguuuuuaucaaagaaaaaaauuuaaaugcucaagcuucacuccuccuccuucagcuccacaucaaaaaauaucagacuuugaaaggaguggaaagagguagcacggaguuccugaauguccuuucuccguucucggguguaucacucuuuauguaguuuaucucccucccucagucuugugcauccauaacucaacucuguaaaacucaaagauugauuugugagcaaaguucccucuuucccauucuuuaaccaucgaguaagcccuuuaaucgccuccuaaguacuggguuuuccaugucaggagcuucuagaccggggucacaaaccccaaaaaguugagcuaccccucggcuuagagcaucagaauuaucucccucugucuuacccuuguaauuuaugaaaauuucaacaaagagcgggcuccuuucucuauauacccuuuuauuugcuauaauagaaaugacaggcauccugccaugcuaucugaaugagucugcaguccuccauucccccaaaggaaucuuacacaagcacauuuagcaaucaggggcuaaagugucucauccuguaugauaagcacacacuaacuaaagauuuaagcuuucccacuucuccugcugccugagaaucagaaacaaccugacugcaagcacaacuaugggcuaaccaacaacuucauaccauggauuuccccacacucucugaaacauauaagaagggaccccugcuuagccuugugagucucaacucucuucagagcuccaccauacccaucuguuuaucugugguauugauuccucuaauaaacaucuuacccaaaaagguaauccaucuuacugucucucuugaccuuucaaugccuggauguacuucuccaucuccuccauccccacccccacaccccuaccccauuucucaauauuugccuugcugauguaagacaugauccgcaugucuuacaagguaggucuccaacauuaccccuucuaacauguauuuucauauuccuccugccugaagagcugccucuccuuggugugucaguuagccauaaaaguggaauuuugaggugcaugugagauaagaugcugucccuuuaaaugccuccuggcauccuuuuaaguuguuuuguuauugugaucacaucaggcaccauuuuaaaccaagaaaaacugcugacuuuuacuccagguacccaaaguauaaacuuuguuaauuauaaugcuaaauucuguauaugaggauugacauucucuggcuacagccacccaccauuuuuuuugguuugguuugguuugguuuuuuuuuuuuuuuuuuuuuuuugagacaggguuucucuguauagcccuggcuguccuggaacucacuuuguagaccagauuagccucgaacucagaaauccgccugccucugccucccaagugcugggauuaaagguaugugccaccauugccaggcagccaaccaacauuuuuaaacaugugauucaugagaaagcuuauucaacgacuccuacugaacaugcucaugaaugugagagagucuaugagacaacgccuaccagcaugaauaugcagugucuuccaaugaaauccuagccuucugugugcaaagagacagugccuguugagcaauuaaccuauuccccaugcuguccuuggcuacagauaaguagccuuucuucacugacuguccugacugucuuggucacacuacuauagcauuccacauuaaccuuuagcacaagacaccccacacucuucuaaaguuauuuuuaucucucuaucaaccauccccagcuagacucaaucccucaagcaaggauauucauaauagguauucaaucugauucuucugcauguuaaauguuagguaauuccuggucugccucuguaacucuaaauacccugggcaucccaucagacccuuucucagacaucgcuucuuugacugggaaguucugcugcggucaugcuauuuuacuauucagaauacacagcauuugaugcagccgugguggugcaauguaagcagagcugcccuccaaaguccacugcaguacugacugcaaccuccucuucaggcagcaucagauauggaaaggacugagacaaacuaaaauuagccucauccugguacucagcauagccgacgacuuggcaagacaaucucuuaugcaggcacacugcugacauagcauggugaacuggaacucaaccaaaggagaaaaccugcaauaucuuuaacacagaaauucugaguucugcugauucauucugacuuaaagcugcaauaacacuugaguaaggagcacccaagcuuacuccgcaacuuuuuucugcagagcugacagaauuuggcauacaagaaauuuaauagucuucugcgauuccucagauguuggcuguggucaccugcauuacagugucugguagcauuaaguaauuauuucuuauaaaauguaguccuguuuaaauuauugaugagagcugaaaaauccuaccuaguguaaagagacucauaugggaaaccaccuucaccaaagacaagagcguuuguucacacuuugcacgggaacaccuguauagauugucccaacuuaggaaaaagcauuuaaauaucaacauaaacacaggcauagagacagugggauaaauuuucaucaguacagaguuucaaagaaucuacaucaauguggaauuaugaagcaaagaaccuucucaaacuagauacacaugaaucauugcuugcuuucuucuuccuacagaagucauauguguugcauuauaaaaaguaaaauggaauaaaucucuagacuuaagucuaauuaugcuucaaucaguaaucuguuaugcuucuuauauaguaauuacuacaguuagcacuuaauuaacuagcauuacuucaaauauuuauucuuuuuaaaauuacaauauggcaagacuaggccccucaagagucaaucauagaucagagaggggcucacagggcccaccccuccuuacugaacuauuggcuauugauggauucugagggagagguggugauugucuaugguaugcaccaacugauaugcccaucagacuccaguggaucguuucaaacuccauggucacagauccaauucugguuaaacucagugggucucaaaaaaagaaaauaagauaugaauguggaaaggagacuugaaggggaauaggauggggugguuauuugagguggggaagagauuagaaaaggugagguuacaguaaucagaauauuccuuauauauguacaaaagucugaaaucaacaacucaguaagaaguuauuaagaaucauaauauauaaguucucuauuugggaacaucuuaaaugucuuauuucagggaaguaaaauaaagaugcaccuacuauuuagucuucccucucuucuucaaguauucuuugccaaauaauguacgagaaaaaaaucaguugcuucagcagagacacuguuuugaugcaccuuagaaauaguguuuuccugugcccgccuccuuggaggauuugcuagauacuuacuuguucagugugaggucaagaaugaacuuggagccgaaagcuucgaucuggaagcuugccugggccagaugcacagccuaaagaaaaaaagacagaggagccuuaagagagauuuaacaggaccagcauuuuuauguagacuuuuuaaugcaucuuuacguaugaacucaucucuuuaaaggacugggcaugccaucuugguucugcuuggaagacccaccacgugagcagcagagaaaacuguuccuccaaaacaaagccucuguggcaaggagcagcagcaugcagcaagcccugcugggucuccaaagugacggagauaaauuguacagaccucagguuaaaguuugccuuuagacuguuuugugaccccaaauaguuuccugcaugagaaaucacaucagcacucugcucuucugcgggacaggaacuuucucuacaugacguuaucagcagacuaggucaauaaaaugugauggcacagccuucugaccucugaaagcauuugaaguguagccccuugggaagacuauguuuaccuccccuuguaagagucugcaauugaugcauucauucaaaacccaacaauaauccagagucauauuuagcagguguuaggagaugcacauaggucagagaagugcccugaauaacguaaauuaacaaaucaacgaagaacuguugaaguauacuauccagcauaaagcuuuccuuugucauucuaccaaguuaaaaaaaagaaaaagacaaggauauaggcaaaggccuacagcagugagagcaccaaagaacagguaaagugcuccuugccugguagcuggcagccaacuuaaacauccucuaaagauuuuauauucccagucccccuguugccauuccaggcuccucgcagcccucucuucuauuauuauuuauuaaaugcuccccacccccauccuccaaaggcaccccagucguccuccaucacacacacccucagaaagaacucucugguccucauccucccguccuccauaacacacacccucagaaagaacucucugguccucagagcacaggaacacuuuauuaccccuccucugucuggugggguguuugcauccuuccacucccuccaaggagugagcaccacggcacaugucacaggaguuuugcaagugauuguagauuaaugaucccucccccaaaacuguccaacucuucaaauaauucaucaagcaucuauugucaaggcuauuaucuugccacagccauaaaaacaccaucaauaagacuauaguuuuuacuucagucaauccacaacugcugguuacucaauaaacucaguaaacagaauuuuaaaggcaauuaacacauacuaaauuucaaauacaaaccaauaagugguucuugcuacccuaacaccaucggccaccauuucaaaauccaaaccaaacagaauaaggucaccacgcuugucugagauucuugcaucuaaacauaaaaccaagaaacaucugucuugucgaguguggucucucucaacugcaguagaccauccauauagccaaaacgaaccgcauaaucuuuacaugaauucauuuuguaucucacacuaucaauuuuugcuugaagacauuuauacagaugaauaaauaagagauuuuucagcuaugguuuucaaaagcuuucuuuuuaucuaaaauuauuuucugagaauauaaguacuuaagcauauuuucaucauaaaaauauauuauauaacagggaacuguuuguucacuuguggcaacacagcuuaaccagucugauccauaaaaccuccuaauaagcuuccuuauaaacucuaagaaccugauaucgacccagggaaagcuuccugccuagcaaauaagcaaggaaacaaauguaagcaccaagaggauccuuuuggaaaguagggccggcuacuggaaaacacagcacgucuguuuugugcaacugcuuggacuuacacaauuugacuaccgcggaauuuaucgcaagucaaaaugacaagcuucaguguggcaauauuuagcaaauggcaccggguuugcccucuguccuuccaggaaguucgcugcagaagugcugugaagaagccuugcggguaaagauggcagccgccagaagacacggccccagggaacucagugccaaggcugagucacaguccagguagccacacccaggacagcagccauggaaagacuucucugacaaagugcuauuugaauaaaauuucaaaaguuaaauaaagaauccaccuaugaggggaacaagagauguauuuucaaaaauaggaucagaaggaugaauguggaaauggagaaggcuuuucaguuuuuaaaaaugugugcccuguaggcaaguaacuugcagaguaaaugucaaaggaccuggaaaggugaccugcccacuggaaggcuuuguaugaugcacucagugacagaugguggcaaaugugcauguggggccaagauggccaccuuuccugcaaaugugcauuccuagcauucacucagcagcaucugguucacaccaucaucaucauccccaccaucaucaucaccaucaccaccaucaucaccaucaucaucaccaccaucaccaucaucaccaccaucaucaucaccaucaccaccaccaccaccaccaccaccaccaccaccaccaccaccaucacccuccauauacaugaacucauuacucuccagaaccacugagguucagccacacuagcaacaacacagccuguuuuccacagggguuuaaaaaaaaaaucuaguucguuaucuuuaucaacacacuuguuuuaacauuuuaacuuacuucguuuuuaacaggcaggcugcacauuuuucuauaaaauaagauuucuuccauauacugaucuucuuugcucauauaaaaaacaaaaacccugugaauucacucaauacgcugcauccauuuuaaaugaugccauuuucuugcucccugcgcaucuucccacucuucuucacgaugccccggugcacagagcacggauucugcacucggccacggcugguggaggcuucuucccccaucaucccuucccccuaugcugcccuugacaccacauauaaacagacuuuaauuucugaaaucagcuauggcauucauuuuaugagauuuuuguuaacaaaauuauguaguuuuaagguuuuuuuaaacuugaaauauucaauauaaugaagccaagugaguccuucauacucuguguucaugucuauuuaugcaugucuuuuuuaucuuugaggcagguuugauuguuuguuuguuuguucuucugagacaagguuuuucugugcagcccuggcuguccuagaacucugagaucuacuggucucugccugccaagugcugguugaagucguguggcaccaugcucagcuuugagacagguucuuaagcagucaggcuagacucaaauuuaccaaguaacugaggcuggccggaauuccugccacugaggauaaaucauacauuuuuauuuacacacauaaauacauacaugcacacauauauguaugguuuuauacacacacaccucccaaauaauaggaaauuagccgaagagcagaaaugaguaggguuuuguguaauucagcacagcccuucugauugcucuaacaaguguucggaauugacaggaugcuacacaccgcugaaaauacaaaggccgccuccagcauuauuccucucuuuugaaggaggaaugaagcagugggguuuguauaaaaugagguccucagacuacuucagagaaggguuggugaaccccacaggaggucaguuguuuuccccuucaggacguguguuaaacagccugguuuuauaaguaugcucucuguaacggcacuggaggaggacacagaguuuuauagccaggaagcaucauuucacaaggaggagcgcauugcugggcugggaauuagcacccugaaggacuggagacagcuguugccgcagcacuuugguacuuugcuuuugacuaagaaucuggcccagggaaauugcaggcgcuccauaaacaaaaacaacuaaaagcaauuauacacacaacccgccuuugcugagagacaauucagaagccugaaaguacucuuuuguucauuuggccuuuuucuuccuuucuuucuuuuugucuaguagaugacaucuaaugcuaccauauuaagcaacuuuaaaagccuguccccauccuaggccaggugcaguuguaagcuuuacugucacacaaugcugugguauaacccuggcagccuggaucaggcauacagcauaugcugaagaggcacagugagcuguucuugagauuuauauucacagacaguuaguagacauaaaaauuaaaugaaucaccuauaaaauauauaugccuauauguaaauauauagagauaaauauguguauauauacuaccuauaaaaauauaauauaaaacggucauuugagcacaugcauauuugacaugaaaccguguuucacacaggauucucugccuuuugugggaguugagcucucuguagcguaccuaucacuggaacuaaaaugggaaaauagaaagucuacacuuucccacuuacagaaccuaauuucagaauuuggugaaaauugagaaagcugcagcagaaagccuguuguugucagucuccucgugucuuaggcgugaugcuccacuccauccguaugcggucagaagcagaggacaaucggaagugguuuucucuuaaguauauuguuauuuauggagacauuccuucaaguaacaagggaaacauuaagggugacuuauuagaggcuguagauuaugcucugcaguuagagacuugcuguucuuaccgagaacuuggguucaguucccagacccucaucagucaucucagagcccgcgguaauuccaacucccggcauucaauguccccucugauuuccuugggcauugcucucaugugcacaaaauacacugagacacacgaacacagacauaauuuuaaaaucgaaauaacuggaacugacauccucagccccuuuuugugucucaaucaucucaaaccacugucauauuuacccagaaugcaccgaaagcaggcaggauauguguucuuauuacuucucauauaagggagaaauuuuuuuuuaaagagauagaagauuuagggacauuucuguccaaggucacacaucagaggagugcaaaguauucucuucaguucagugaaaagugccaaguucacgucagaaguccuuaaaucuucaagcuucaauaguuccuagucauuaaaauauaaauaacaauagcuugccacaaggauauguaugaggauuaaauuagaccauaagguaacagaaacuuacuagaaaagcuuggucacauagaaaaaggcuuaauaauuuaaaaaaagaguaacauagacugagaaaggagagggggaaaaaaagacuauauuaauauuuuagaaaggguaaaaugccagcuaccucaaaauucccucccacuguaucugguuaccuucuagcaaauuccaaugugccuuuauauuuggcaaaauuugaaaauguuauauuuuuauuacucacuaccauuacagauuaugcuuugaccuuguucaagugcugugucuuugaaacaauaugaaucauuuuccugagaagagaaacagcugcaaacggaucacgaaggcaguuuugcaaauuaagguaauuugcugaacaauuccugccaagguacacuuaaauagggaguccguggaagagaauaucaucacgugcucuucuauuguguucuaaugcacaguauuaugagguagcccauuaacaaguuggaagaggcaaucuaccauggaugagcuacugcagaaaauguaagguuauagaaaaauuaagauucacauuuaagaagaugaccaucugggacaugaaaugaaaaacaacugcguacaaaauauaauguaccaauuaaauaauaacaaaaaauuaucugucaucaaggggaaauauaagcaagauuaaucaucagauguggaguguggacaagcauauuagaauuuaaagagggauaguucuggaugcagaaauaagugacaauagcuuaucgaggagucucagcaaauagaacuaacaucgcuccagcauuuaauaggaugaaauuaucaaguguuucuaaugcuugcuaacgaacagaugcaucaaaaacaugcuuuuaaagcaaaacacaggguauacugggauauuaaaaugcaauuuagauuguggugagaaucaaaauugacaauguaucaaaaaguauuucaugacaucaauagaugugauaaauguauauaaacccaaaaaugcuaauguauuuugauaagcaaucuaucuuuagcagaaacuaggaagcugaagccauguccuuuuugccuccuuuuguuuuacagaaacgagaccaauacaucggccaagcacacuccggucacaggccacagaucagcaucucccaguaaaagaagcaggucacugcuugacuuuggucucuaugccaaccucaccaagaaacggagucugaaagaaacguggccaguauucaauuacugaugugaugacacagagaaagggaggcauggccuuauagauccaugaaacuuuuggccaaucuucugcaagcacuccuuuccaaaucaaccaucuauaaagagaccccaaggcugauacagaaaacaggagaacaaaagacaaaaagaagcaauuaaaaaauaauccaaacaaacauuccaauaaacaagcgccaugauccaugagcgcugaaacuuucuuugcaaucucuagagaggagucaaagauggggagguacauguaauacuaugagggaagagggaccaugaaaaaauuacuccuuuaggacauucggcagcccuuuagggcucugugaauacaucaguggcagacucuuuggacaugaauauuaaaucucuucagcacucuaaccuuugguaauuacucucuucuguguauucaacuuacagugccaacaaaacagacaagcucgcaagccuccagagugauuuuauuccgaguugaguacagcaucaccaguggcaccacagcuguauucuuaggcuuuccuguaguaugugaaagacgaguaagaauccaacuaugucaacaguugccauggaagcgguuucuuucugcugccuuccugaaugguaacauuuaauuugaugcauuaaucuaguagcugcgguaugacccaccuucuuccuucuccucauaaguuccuaaaucacauaaugguacaacuccaaauagggccucucgcuccaacucuuuuguccuaaaguaagaauacugucugucucuuuagccagaauucuaaauacccacuaaauaauuucaauggaagaaaaagaggagagacucuggagguauuguuuaguggcagagcauuuuuugugaaugcaugaaguccuagguucaauacccagccccugaaggagaagauggagggagagaaggaagaggagaggaaggaaaaggaggagugaaaugaagagcaaagggaguagggagaacaagauauaagcuuugaaaauaaaauaaauugugcuucauacuuauugucugugacuuguauguaacgggagugcuauccugaaaacuagccugcuggagacagcaccccauaacgacccagccugcugcuccacuccuugaaguggugacuaugacucaguaagcuccuuucaacuucaccaucucuccgggacagaaggcuccuuaacucacgguggucacaugaggauuaguuaagaauuagucugagaugcaaaaugagaaucaggguucaguaauugcacacuucaccugagcacuauuacaucuggccaaccauagaugauagaguguggaccaaauauucauuucuaguucucccucauggagaaaacacgaaagacaaguagcuaagagggcacuaagcaaaugcaucuacccagcaaguuggagaagacacuuuuucuagagacccuugcuugugacucuaccauuccucccagugacucuuaccagauuuccacacacuucauguuucuauuugcauguauuucccaagcuuugccuaagagacugcuccaaguucaucugaacugugaaacuauuuaccuaagaugucuggacaagauucaugucacaagcugccuaacacugggguacagcugcucuuuuucucuacaggaacucuccuagauuaugaagcucucuggacuugccgggucuggcaauagcugcuucuguucuuugcucugcacucuggccuugucuacaauuaccaauguguuucuuucugccccuuuggauggcaagaguaacuuucaaacuagaccugccaaagauggauuuccccauuugacaaagcuacaggugucgucacuacacuccucaaaucaccccagggccuguuucuugucaaagaggcucaagagugucuuauuuaaaguuuugacuuaugcacauaccuagcaauugagaauuccaggcagaagcagcagcuacccguggaagcccuaacacagaaauguugcauaugucaaggaagagcagaaagcccaauuccaguggaagggaugaaggggaacagcugaagcagugaagaugggaaguaaugagggucagguguguaggagcccacacacaaggcgagauuauucccuugugcuuugaaugaaauaaagucacaaggucgggccuuccguuuuaacaauucacucaaggguaugguguuaacaauggacucaagaagucaggugacaaaaaaggaagcaaaggauccaaagggagguuguggcaauaauccagguaggagugucaguggguuggaccugggugggcaguggagcugaucagaagucaucggguucugguagccgucaacggacgcugcucacaggauugauaugaguuaugagugacacaaaggacacugagagccacacagcacuuguccugaggaaucaaagggagcaggaaacgccuugaguuagggaagaagaugggaacucaggaccucgccauccauugcacaucuguuauguguauuagguucgagaggagaagcagagaggacaacuggaaacaaggcccccugccuugcuguuaagaaaaggaaagccuuuagugaauguuuacuaaggaacuaagaaaacuaagaaguaaagaacaaauaagucaaugauccagcauaggaauuaaggaacaccucaaugaaccucagagauacaaaacaggucccaauaaaaaggacuuguggggggaggggggagaugaggaguacacuaaucgguuauuaaauuccaaaugcucagcccuaaaaauggauacauucaagucucauuauauggacuaagcaggauauacuuagauauuuagaaauacagacacacagacauaccaauaauuaaagauaaaaaggcccaggauuugaaagagagcaaggugggguagacacacaggagagguuggugagaagacaggaaggagcaaaugaagucauuaucuuauauucucaaaaaauguauuaugaaaaaucacuuggguguggcugcagcuauggcaggaauuaagaacgcuccaugcucuugcagaggacucaggauuccagcauccuuaggacagcucauagccaucuagagcuccagauccagggcauccacugaacucugggggcaucagguaugcacgugcuguucagauggcauacaugcaggcaaaacacucaaacacauaaaauaaaaauaaguaauuuuuuuuaagaucugaggaaagaaaucaauucagcagaaaauauacucugugacagaacuaggaguuaagucaaaaacuaaggugaauggggggagggguaaccuauaaaaaccaacagaaagcaacucuacucaggggcuuaaaaaucaacauuuucaagcauacuagugaagugccaucuuguagcccaagagcugguauagaccgugaaaucugcucccacuaaaaggaaauccucaauuccaaagcaugcuccuaggcucagcccugugacagaccacaggccaauguucguggcuguuccguauucugaaggaaucauaaaauguuuaccuuugcauuuuugaaaguacgucuucauauuuuagaacuuaugcuaucauuacucucaauauuucaaauuuguuccuuacagucugacgugcauugucacagacuuguggaauuuugaaagucauccucaauggauuuuguuucaccaucuauagcuucuaccucaaagaccuguacuuaggcuggagaaauuaagauagaguuuacauucuacuaaauaaugucauuuucuaaaggucuuuuacuaauuuaguuuagucaccaagguuuguauuuuaggggcuguugagauuucucagugggaaagccugaguucaaccuccuaauccacaguggaaggagacggccaaaaacuguccucugaucucugaucucuacuugucuaugugucugucuuucucccacccgacuccucucuguaucucucugucugucuuugucugucucucucugucucugucucucucucugucucucucucucucucuugcgcgcgcaugcgcgcgcgcaugugcauguaugcacuagcucacuggcacuaaugacacaaaguuuguauugagaaaucuaggagcaaaaaagccuccacuauacaaagcucuucuuccugcauccauucccagggcugguacuuaagacugcagaugaaagcaaggggauuuugugugaacauuucuuuuuaaaccacaaugauucaagauaguuaauaaugccaacaaauaaggggaaaauuagguaauuuuucaauuuuuuauuauuuuuaauucuaguuauuucaagugguuuuuauuaccugagauaagcaaauaacuacuuggggugauauucaguuaguaaugauugcagagggcacaaugcuaucaauauuugauaaauagcaaaaaaaaaagaaaagaaaaaaacuacuuagagguuuucuaaaaguaggcuuauaauaaauguaauacuuuuuucuuacacacacacaaaaggaaaacaccauuuaaaugaagauuuuacagcauauucuuucucccuucuuuuuaaauaaacacuaaauuagucaguucccuacaaaguccaaaauguacagauucuauagggaaguucugguacucaugugucuauguuucauugacaguucccuauuuccuagcuuauagguuuacaggacucuggccaggcuucucaucgccaaccuccugacaccuugagcuaaaagucucuuugguggggaauaggguggguaucuacaaacccagccuccacccacaagagaccagcaucugaucuucagcgugggacaacuaaaaagcaccucuuggcguugccaaacggucuauaugcccaaacuacccuuaguuaacaaccccuacuucauauaugcaggagcuaugugaauuuagauucuucuagauacaccaccuuuacacagauuccuuuaaccuuaucuucaaaaucuguuugcaaccaucaacaaauaaauuccaaauaaaacaggaagugacugcaaaacaaaaagacaauguuuaaggcucuuuccacagguagaggaagccaccugagaagcaggauuuuaaaauuuuuauacccauagagauuccucuaaauuaaaguacagguuuaaaucugucaaacgagcucacacacauccuucaaaaaauaauaaagaaagcaauaaugcaacuaugugcacaguccaaaauuucaaucuuuuuuaaaggaugcuuaaaauuacuuucuuuccucccgaagugacagcuucuuauuaucuuuugaaaugucauuuggugacucaaaagaaaacaacuguaauuuaaacagcuaggaaugagagcgaauggagucauaauggagccugcguucggagguuacuaagcugucuuuccacaacugaggcaauauccucgcggugggugaaacgccccggucacuaaaugucauuuguuugaugauggcccccacauuucuauuccacucagaccugucacugacaccacagcuaagucagucacaaagaugaccagucacccucuggagcacuggugggggagggggggauguacccucuccucuugguucugaacuuccuucacagauuuccuaggggaaaagcccaccaggcauuuccagacuucuagguuaguuucuuaugccugcucuauugaaugucuauaaaaauuuaagcuacaaauaacauaaauuguuaucuaacauuucuggacaucgaaaguccaaaucaaagucuccagacuagcgagaagguguccgugaccacgguuccuucgguagagacacaggaagaaucuauuuucuuggauucuggaaucccagcaaccaccacacccaugggcucaagggugccuccaagcaaguaucugcauccacagucacauccucgucuauccgucugccccauaugggccucagugcucucaugaggccacccagaugauccauaugcauuccaguccacuucgaaaccaucuguuuaauuauaccuaucuccuuugucaugcaaggugccauagucccagauucuagagguagagaugcggagaggacucuucuaccaaagcuccucuccuguuccagcccaaucaccaggaagcugggugccccuucucuaaauguaucuauggauuuaucugucagacuugguccuguacagcugugagcaagcaccaaauugucuccuuacauccacucuugcccuauagcuguccauccugaauaggacugccagaugaccuuuuuaaaauaugaaccaacuucuuucccuuuuaaaacacuuuaauauguuccuaacguaaugagaaagaaacccuaacaagaccuuuguccucuggcucuuucuuaccuugagcaaagaacacagcaggaaauaugaaacacuuuuccuccacaaaaugucucucuguccuucacuaucaaccuuccaaggcccugcacaaugagcuuacacuccuggcaacccuucauagagggauaauuuguuccagcugcucucccugggucuccaaguucaucucucucucucucuccagaggccaaagacugcaacuugacacauaauucugaaacuaaaucccuucaagaucauuuuagguguauaaugcuugcuaaaaucacaaaaauuaggaaagaaagcaugucagaacugagagucaagaguuggggaagaaagaagcacacacuagugaaacacuuucaccuuuccuugaggcggagaaaagauaauaucuuaggcugauggguaucuaaaaauaggucagagauaaauuauuaaauguuauaagaacuaaaaacagaaauucaccagccuuugaagagcacuaggaaagagacuugcuguucauuucgugccacuaugaacucugaauucuuagaccauguugggaaacacguaaaaguaaccaugaauuuugcaugacauauuuaugccaacuucacacacgggaaugugcauccucguauacaucuguuguuagguuuucaccuauuagaaugcuccuuuguccuaaagucccaacaucacucuuuggaauucuaucaccagaaaccaagacacagaaaugccuugcuauggacuucacaauaagucaggggugcagcacaauccagcuagcaguguuucuauugaaaaccacuccauaggcucuccucugcuuuauuuuucaaacacucuuuccucuuugaaucacuuuaccccacucauuccugaagccagcuacucuccuuccccuccucggcccuacgaguuggugcggguacaugcauaggugcacuuacguuguggauauaugcagaggucaaaggcauggacuaccuuccucgauguucuccacccaauguuuugaaacaagcugucucacagaaccugcagcuccugguucgccaaggcugacuggccaaugggcacuugggaucuacccaucucugugucccugacaugagccaccauaaccagcuuuucuaugugggugacuguagauccgaacucaaguccccaagcuugcucagcagacacuuggcugcaaugagccuuuuucccacucugccuugucccauccucagauaaacacccauaaucugugacuccuauucuuugucuaacaccccaguuucaggcggcagcuacuccacaacuagagccaacccuggaaauaaggacugacccuuaacuuuacagcacauagcccuuuuuggaggauguuccacaaaacuuuagcugggaguguuguauugaaugaacucucccaugucaaaaugaaaugccauaacaauucaagucacuaaauuccacacaucuuuucagcaacuuccaagguuuaucuaaaauuacuaaaggauuccaaaaucuaacucaacccucuugggauuaaaaugacaaaauuuaaauccagacaacuuauccaaaauuggcaaccuacgaaucagucauucuccccauaaucugaaauucuuuuaaaagaaacuuguaaaacaaaacauacaaaauuaugacaaauucucuuuuauuaguauuauuauugaaauaacaaaggcccuauauuaaaacucauaacuaacaugacacugaauaguaaagacuaaauucagaaagaaauugaaggugucgauuuaugccacuucuauucaacauuguaauggaagucccagccaaaguuacuaagcaugaaaaaagaaaugaagguacccaaaggcagacaugaaaaucaucuuuccauacaugauaugaacucauauacagaaaauccuauggucuacaaaaaagaaaucuaagaauaguaaaugaauucagaaaauucgcagaguacaacaucacacucaggauucaaugugaagggcugaguguguagcucacugccacaaaauaaugucugauuuccacauauuagcaauaaacaaucuggaaauuaaauuaaccaaacaaucccauucacuauaaaauaaugaggaauaaaguuauuaaagaugcaaaagauuuaucuuuaaaacuacaaaacuagauaaaaagaagucuaaagccacaaauauauggauauccaucagaguucauggauuuaaaaacucaacagaaaaaaaaaaaacugcaaugcuacucuaagcaaucaauagagugauccaagaccagaaauagaaaaauccauccuaaaguuuaugauggaaucucaaagaaccccaaacaaccaaaccuaucuuguaaaagaacagaagcugcagguauagcuuaaugauagagcuugugcuuaucaugugugaggcccuugaguucaucugacaccuacugacaaaggugugaugaucaaagcaugguucuggcacagaagaaagcaggaagaccaacagaguagguuauaaagccucgugcaaauagaggcagaugaucuucagcaaggauaccaaggcaguuucaaagagaaaagauggucuuuucaauacaugguacuggggaacuggauauccacacgaaagaaggaagggagggagggagggagagagggagggagaggaagagggagagggagagggagagggagggggaggggagggagaaggagagggagaggggagggggagggagaagaagagggggaggggggagggggagggggagggggagggggagagggagagggagagaauuggaaccugaccuugcaugacccagaaaaguucaaucaauguccacagaggaucuauacacuacaucuaagcccuaaaugacaaaacuuccagaagaaaacaugggagcaggaaaaaagacaagaggagaaaagaaagccuuguaacacaggacuuggugaugacuucgugaauaugacacuaaaagcaugggcaucaaaagaaaaacuaaaugagacaucaaagaaaugauaaacaaacuuucguacauuaaacaucacugucagccugguaguacaggcccauaauccuagcuaugagcaagaggcuaaggaagggaggugaccaauuugaggccaaccugggcaacagagugaguucaaggugaacugggcaacuucccaucuugucccgaaauaaaaaggagaaagggagaugguagaauccuugucuauuaugccguagagcccauuccccaaugagaggggacaggaauaccaacagaaugaaagaguccacauagaaugugaaaaaacauugcaaaucaagagacuggagaguuauacucagaaugugugaagaaucucuaacagcucaaccacagaaaacaaacagaaauggggaaagauugaauaggcaacuucuccagagaaaauaccuuugucaucaaugagaguaucaaaaaggauucaaccuuagcaacacugaggcaauaaaaacgaagccaugaggacuauuacuugacaccucugaggaucauccauauuaaaaugcugaagauagaaaguauuagcaaggauauacaguacuggugagaauguaacacagggccuucacuauaaaacaauuauacagugacuuguccucucugcccaugaaacccaaagguugcauaauagcuauuuccauaagagcccuacccaaaaaaauccugugaaaacuccuauccucacuacagaguuucccauuuugggcccuagauaccaagaagaaagugucccuuucuaugaaacuaaaaaucuucauugcaccacagaacagccccuccuuuggcugcagaagcaucaacuuuuccugugguaagaaaauagucuggacaagucucugacccacccgugcauuucugaauagagacccaugcccuuuaaugugugacaauguuagcgaauguacugagaugauguguuugucuucuauugcuaacaguuuaaaaaaaaaaaaaaaacaacucacuuuaacugcauggucuaggacuuuaagcuaggaaaauaaaaacuuuuuauuaaaaagugaauuaaucaaaguacauaagcuaacuauuuuaguaugaauuuuauuuuuuuuaaauuuaaacagaauuaaacuauguugaauuaauuucugugagaaaaugaaaucuauaagguauacuuuacuauaguucaaaucacuuguagaacugguauuuaaaccguauucauugcucuaaguuauauguucaaagaugcgaagcacuuauauguacccagcugcaguaguaacagcguaaguuuccucggugaccacagcacugcgcuuagaaggguggaacucacucugaggaggugagaggcucuucucggagguuuguuuuguuuuguuuuguuuuguuuuuucaguugaauaauccaaauaggaauuuagcaggaucauuuugccugaugcaugcagacaugacaagggaggagagaaggggacaagaacagcaaagcagcggaugggacaguguaagggagaggugauggugcacuaaaccagugggcagcagcagagaaaaaugaucagcuuccgaaugggcaaugagacuugaugccuuagugaugcuguaggagaaagagugggagaaggcucguagccugagcagcuaucuggaagaugauguucccacuacccacaugggaggaacgugggaggaggcugggauaggcgauguuaggauuaaaagcuccauuuugaacagggaaagccuggguugucuaucauacgucagaacagaaacagaagcauaacagccuucaaaacuauggugagaauagccuucuaggaaaaguccaagacucccagacacuacacagcagugagucagguuagcucggaaacagcuaacauauuaagguguagaaauaucccagaggaauccgcaaacuuuggaaaacuuaaauggaaagacaaacuuaacauuucugguaggcagauuuuuuuagacuuuaguuaugcauaaagaaauuauuuucuaaaauagaagacagauuuagagguaauuaugaagagaaugugagaaggaacaggauacuuugugaauauacuacuugagcaacaguauuaaaugccucaguaggucuugaaaggaugaacaccacugaaauauaagaauaaauaaagugaacacaauauauacuagauuaauuauaagggaaaggaauaaugauuaaccauuucugaaaacaauuuuacucacaauuaggaaacaaaaaccaauacaauggcaucauuugaaugucccacuaguucugaaggggacaagcgacgggcagucacacagcccaacagagaugaaugcgacuaacuguuguauggacauucuucagagaugaaaggccacugugucacacaggacagccuacagcaauuagcaaaguaauuagugagaacucaccacaaagccaucauuuauaagcagagggagaaccagggugccagcucuucuggcaaaccugcacacagauucuacaugcuggccaaggccuguucaauuggaucccaugugaaaaugaaagcauacuguggaucugauacucuuguccuguuggguucuuucuaguuggaagauguagagacauucuaucugccacagucucauccuuucucuauuucauauccaagccuuucaauggcaaaucgauguuauucuuggguuuggccucauugggagacuuggugggagggaagaaaagggaaagaguuugcuaacugggacagcucuugggaaaccgaucuuaagaucuguguuauucagagcacaaguaugggggcuuuaccaaugcccuugagggggaggggaaaggugcagccuggggcugaggacauagcucgguagcaugcacacuggccugacacacagagaccuuggguuucagucccacacugccagaaagaaagaaaagguucgccuuacaacucacuaaaacgccuacuuuccaaauguccugguuaucaacaaagauuuagggaaaucaucucuagcugucagcgaagcucagccagggccacagauaauuaauucaucaggccucaagcacaccaucccauacucacuccucaggaccccaccaccagcuuccagagaccugacguuaagucugugccccaaaccuggcucaagccuuuagccuucuucaaucugacauggcuagaacucaaaccaagaagacgcugaaaucacucagccacucagcacucagaagcaacaaggggagcaggagcagacauuuucuaauauucuaagcagccuucgucacagggcucugccaaacacacaagaaugugaccuaaggcgagaagggcccuuuagcucuugcucucugagguuuaugcccagagucagccgcucagcagggcccauguggcaaacacugcucaauucauggaggccaggaaacagcagggugaaagacagcccggaagaucuacuucccccagccaggccccgccuccuaauguguccaucauccuaaaauaguaacaucagcuggggacuaagccauuaacccacuagccuguggggggcauuucauauucaaaccaccauaauggccaaauuuuuagaaucacauauguuccacaaauaaacagauauaccgggucauuaaauguccauuuccuugcuuugaguugaaauaucaucuugguuuugagucccuggcuaugcuacauuccaugcgcugacaaaugcacuaaauugggaguucugucuauuuuuuucccuuagcuacuaaaaaaaaaaaaaaaaaaagguggcuuuaccaacucuuguuaaaucagcuugcuucagacgcccaccucuuuaagcucuaagcuccuacaaaguauacaagaauacuuuuccaagaaaagaaguuauuccuaaaaugagucaaaugucugacauauacauuggaaacaccaaacacaacucuaccagccccccucucuccauaaggaaggaaaaucugauagaaaaaaaaaauaagauuaaaggcaaauaagggaagaugucaggcauagugagacacaccugcaaucccagaauuugggugccugaggcagcaggauuuuaaguuugaggcuagcuugggcuauauugugaguucaaagcuagccugaguuucauaguuuaaacuugucucacaaauuuuaaauaaauaaauaaauaaauuaaagaaagaaaagaaaaggaaaagaagaaagaaaggaaggagcugggcgugauggcgcacgccuuuaaucccagcacucgggaggcagaggcaggcagauuucugaguuugaggccagccuggucuacaaagugaguucagccagagcuacacagagaaacccugucucgaaaaaacucaaaaaaaaaaaaaaaaagaagaagaaaaaagaaaaaauaaaaaaaaaaaagaaaggaagggagggacggagggggagaggagagggaggaaagggagagggagaggaagcugggagggggaagagagauaaagaccaacaaagcuacucaaugcagggaaaugcugaaggcaguaggaagggacauggcucaggugucauuagcucacaggacuuuugaucaagaagaagacaagugucugagcuacagagaaggcucagugguccagagcaagcacgaacugcucuuucugaguucaguaacacugccacugucagguagcucaguuccuaacuccaguucuaggggauaggaaucccucuuuuggugucugugagcacggcacucacacacacacacacacacacaaauuuaaaaauauguauuuugagaacaauuuuuaaauaaauacuuuuaaaaauauuuugauuucaagggcaugccaagcucucuaugccccgcucacggaaguguauuacaggaaacuggaaaucuggagaugaaggcuccacaucuagaacauggaagugauagucauaucagucguuuugcucugaggacugugggugagagguagggcagugccuccauaaaacaaugaaguucaguagaaaagcuacagauuguguucgcugccgcaaagcuuuggagaguugagcugcaaguucauuuaauguguucuacuucacugaagaaguaaagagcucggagacacaugagagaaagacuugucuacgcauggcuggauuuauagcguugguggagcccaucuauggggcugccuucauauguacuggcaggccugugacacaagacagcacaaaacacccaauuaagugagccagacugcaacuugccacgggaguuuuuacauguccauacugaaggaaagcaagcuccagggagauccuggaacucaggagacacucaaaagaaucaagccagugccucucuuguuccuuguuuauucgucucucuaguguuccucucuagggauguaagagaucagacucaaagccuugcaaauacuaggcaagcccucuauagcugcccuacacuuccagcacuccuggacggguuugguuugcuuuuaucuuguuucagguuguuuuuguugcugucguugcuuugcuuugcuuuguuuuguuuugugaguuguugguuuauuuguuuguuuuuugugaucagcuucugcccaugcuuaggucagacuacuucuaaauguaccuuuaaucccaccaggaucacaugauccuggacaaaggaaguccaggaucaugugaucucccgaucgccacuaucaaccuugaccagacagucccuugccgggauacugccauggaguuaagaggugaaccccuccucugugucacuaaagauuuaagcccaagagcaauauauagcccuuggccuguccauacuucuccacagcagccuacuugggcuuaacggcucugccaucagugucugucauguagagggaucugcuugaagucccauccuucucauuucaaacccuuggaaaacauuuacuguuuaaguugaacccguuaacaaauaagugcaccacaucauagaaaaauuccaaauggaggaaauuuccaagggaggaaaugugcuucugcccgcucucuagccgaagaagaugucaacaaaaauuugagaaacuaaauuaacucgaagcugcacuggagggguuuccagagacuucuaccugcccugacaugagugagcaggguuguuucucaggucauuauuucaaauaaaacauaauaacuagaucccuuuuauaauagaauuucuagcauuaaccucaauuaaaguuguacuaaauauacauaaauucuaagcacaaagacuccccaggaacacuacaaaacccagacuuugacugagaguucacuaaauugugcuaaaguuccuaaaggguaccuucauucauugagaacugaauacuuugggugaauaaaaccuuaugauugugugcuuugugcuuuaugcgcuuucuugaaagaaaaacaacuuauucugaaaacucaaaccuuaggaacaacuaguuauucaggccuuaaaaauggauaugacaagaaccucugagcuaaguaggaauuuaauggaauuuggaccucaaagccucaggacacauuagugauggauucguuucuuuccauggagcacaaagguuuucuggaaguagccucauagucuggacagcuauggaugaaaucaugcccacagacuucccccacacauggacugacacuuggacaaacagacacagaagaaugcugaaugagaaagaccacgguggcucugugggguaggagggaagcagagguguaucaccugugcucugccugaggaaaacuuaccuagcugaaguucugcuugcugcauguggagaaaucgagucgcgugaugaaauaaguguuccaguaagauuaaucugucagaggugggacugauggauugacagagaacgagacaagaaguggugacaagagcacaauguggugaggaggggguggauucggggagcagcaucaagacuugguaagugacuauuuauaggcaggaaaugaaggaaagaagagucaaagaugacuucccaaguucacucuuccaugcugagaggcagcagucccagugagaaaaauagggaccgugaggacagcucucuccuugaaauacaacuaucgugcaauggcuaaagucacuaaaccuggccaaugccaccagacaaaggguccuggcuuauuuucugacugucagaagaaaggggcagugggcuacuaaccccaagaagagaggaugccagcaguuagacaguuggcaagaauaaggcaggcccugagcaggaagcaaggcucagcugugagcuacucaaauugauuuuuuuaaaaaacugaucuagacuugauagaagaaaaaaaaaaucaaagacaaggauccaaagcuaaacacccaaagacaccaagaaagaaaaagaaauaaagaaggguugaacugaggcaggagacuuuccauccguugucuauuacuguaacugaauacugcagacuagaugacuuacaaaaaacacaggugcauuuagcucaugauucuggaggcugcaaaaccccccaaucauggcacuaguguauacagaagacccucuugaugcagcaugaccaggcugagagcaucccauggcaaaccaaauguucuagccagagucuuucuugcucuucauauaaagcuacugaugccgucgugggguuccucccaucaugacauccuacaauccuacagacuucccaaggacuuuaccaccacauaccgcuaccauaugaguuugaaauagcauuuccaacacaaaauuguguagaacagguucaaaguacagucuaaggaaauuaggauuggggagcagcccaguucuuucuucccucugcuuuccuugagcaaagguugcucucuccucugccugucuaccaucuucuguuccaacagcuaguaauggcacagacacuccacagcgcgauccugacucuccaccaggagagaguggagacuaagcgcugcugucuuucuccagccuuuuucuccuauucuuaucuaaagcauacacccaccuccucuacauaggagcuucuucuuaacacucgguggaccugucacacccagcaucuaggcccacucugcccuucaaaggaaaccaccauucucucccauguucuguuauuuuaucuucuccaagcacuugucaacacuucuaauuaacaggcugguguuguuaguaggcuugucugugccccuccccccacccccuuuggaagguaagcgcucugugagccacaggauugguguuggacaccaugcucauuuccugagcccccuccuaugacucaccccaugacauggaauaaaucaaaccccugcaucugucucuccugucuauacagccucucacuucugacacucacuaucucuguccaccaagagcucugcccaggaaagagguggauucaaacccuggcucugucugcagcucucuagcuauuaguccuguuugaagacaccaaugauaaaucucaacugcugcauguaaaauaaaccuuggucacuagauuucuaaggaauugugaagggcuuuuguucuuacuagccacacucccauuuccggucucucacauaccuaaugcacugucugcguccuucuccuuacucacaagacugaaaugccuaaaagaaaauuugcaaaugaagcaggggggccacuauagagguguuuuugcaaguuuaaauaguauaagcauagguuuagcgacucccacaauggcaaaacucaagacuacaauuaccacuccugaugaucuagucaaguacaaaaaaaaaaucuagaagaaucuguaggcuauuuguuuuuaauuucagugugauuauaacaggagauguacggcaaucacucaauucuuucucuauauauuuucuuauauauggguguuccaugucccacaauagugaaacuuccuuuuaauaaauaaggaucauaaaaacauauacuccguacuucuaaaacuauauaagaacaucuugcaggagaacuccuugggacuuccuuaugccuuacugcucuuucuguugucccauacuaaggaaaacggagcuucuggcuucuagaaaaucaagaacugugggaccagccuugcccugaaguaaacucaaaugcauaaucacuacaguccaaauucgcuuacagcugacaugacccucugugguagacauauguucagcacacacgagugucuggauucaacucccaacaccaaaauaaaaagggaacugacuuuacuaaacucccccguuucucucuuuaaccuggaauuguggggaguagggaguagccuguuuaccuaaaagucaguugugacaagagguaauuuguuuaggugacuccaaugauaugugggucacccuccccgacccuaaacuaugccucgugucccucucccacucccucccuaucagacgagagaccacauaaaagacaaguaaauuuugaucaacauucucaggaaaagacuucccagcaucaucuuaaaggggagugaaugaaugaagaaugaaugagucaguuucuccugcuguucauguuuacuguccguuagauuuguauacuguauugaugauauauuguuauguguaauaaucauauaacgucgcauagacucauaaagacuggcaagucuugauaacaagcaggcauaggaaaaugcaaagcucuucuuccauccucauucucacucaacacucaacacaacacuguuggcaugaguugccccggucuucuuucccacacgccaagcaaucugaggauucuccgcaaugaacaagccagguccucuaauucaguuuuguucagacacuauccaucugaaugaagauaguguuagaucucacagguuggagguugacucccacaagacuucagaugccaaucacaagcuccaagcuaggaccugagcgagcaggcuauaaaucaggccucucaacacucccucagaguugacugacuugcuaagagaagcucacugaauucagggaaaacauuuacuaguugccaaaaaagacauuauaaaagugacagguuaaacagccagguggaagaaauacacaaggcaagauaugaaagaaagguaugagcucugggccuccgcaggugccacacccagaaucuggucccuuugggucagaagcuuuggagaaccuucauuuuauaagugugguugaucacgccccuagacauugaugaucaacuauaucuuaagguccuuuccagauggcugaggaugaaagucccaacccuucaaucacaccuucaucuuucuagugacuagacucccaucauaaaaaacaucuuagaaggccccagucaccaggcauugucacauuaccccaugaaagagcagucucucaucacucugaugauuucaagagucugugugacagaaaaugggaugauaccaaauauauauuuuccaguacccacaaaauuaaaauucuucauuaccaugcccugauacuacugcuauguaauacuaaacugacaucuuagguaguaaggagauugcuauaauaaacgaucagauaagauugccuaucaaaaaaaucuuaauuuggagaaguacgaaaaguagaaagaaaaccuaagguaucuauucauccccugcccacucucagacuggcuugguuuuaugccucauauccagguacaguuauaauuguucccuucucucaaaaauggagccaugugggcuuuaacuauuucuucaacaucacucuaugcagacauugaaaugauucccguucucauucacuuucaauugcugugauaaaacaccaugaccaaagcaacauggagaaugaagggaugcuuuggcucacacaugccaggucaugaccuaucacugaaagaagucagaguagggguucaaggcaggaacugaaguagagacaggaacugagguagagaccacggagaagugcuacucacugacucuuguuccaugguuugcucugcuugcuuucucauauacuccaggaccaucagcccaggggaucacugaccugaggaagggggaccucccacaucaauuguuaaucaaaagaguguccccaagauuugcuugcaggccaucugauuagggcauuuucucaacugagauuuccucugcccaaaugcuccuaguuugcgugucaaaacgacagaucaaaaaggaaaaaacaaacaaacaaacaaaaacuaaccugcaaaauuccuaagcauucuuugacauagaaaugcuaaagcuuucagagccaauaccauauacacagguccaccacacauccagcuuucagacuaucccuuuaugaaagaguuaauaagcauuucaacuuucguggcuguuaaguaugaaggacccauccacacacaagauuacaaaacuucuucagacauaaauguggagcguggccuugcaaccuagauuuggaaaugucccaguccaaaucugcacccaaucacagggauccaugggagaaccacagugauucagcauuucuaaggcauucauuaaaaugugcuugccugcagcagagcccgagcaaggacaggucccaaguacauggauauuaaaaucaaguucuuuuuuuuuagaagcaaggaugaggggaauucuguacuuucucguugugacuuuuagaaagcagcugagcuggcaagugugucugcuauucagcaagucauccuaagauccaguggaaaacacgaaacacguccuacugaccaguccacagaagcuuaaagaccuagggggaaaaggaacucagagaucacaaaaggaaaagucagggugcaaccaaaucagauuuguacuauaaaucuaacccaggccucagaaucuugcuuaugucaucucggugucuccuggagaauaaauguggcuuuuucacccuugagaaccccaucaucucuuaucugugaaccuuuaccauacagcuuugcauaugagaaauaaacagauguuuaucgaauuaaguuaauaagaaaagaaaaagacugucaaauaucaugucugucuaaacguucuuuucaaaaguagaaaagaagucaggcuaccagggugaggagagucaagaaauucagucaguccaacagcaagccaguacuccacaggagaaacccauucaucuacauaagugacaggugaaaggucaacagaccugauuaucauaaagucagacauaugcaguaaauggcacccauaaacaaagcagccaucuaaggcuagaccauaggaccaacauuagucauaacauccaacgcccacguuaaaaagaaguuucacugaaaucucuuucagaucucagcuguggaggcuuuagaccuucuuuaaagcaggcuuugagguagcuaugggcuuccuccaguacccuguacaaaggcccuagaguuuaagaacuauaaacaaguaaugcaaucuauccccgacuuagcauagggaucacuuauaagggaagcuagcugguccucacugcauguuaucaagggggccuugggcaucucuuccuaaagacaacaucuauuccuucuauccuuaagacaugaaguauuaguuacuccacuaaguuacagaaaccuucuaagcgaaaggccugcuaggggagaagcucacagucucagccauggugggcaacacccccuucaaaaucacacaaagguggcuaaccagguuaacaaaguuauucaguauaaaggacacuuuuucucagggacuucacuuguuuuaaaaauaguagcaauuaacugcucaaaccuaauagcugcuuuaaaccguaagaagagucccacaaaggccuuuuaucccugucuccccauaaauggggagaggcauggcaguccuaccaaucacaugcugaugcaaaccacggacgcacugccuaaguucuacacguuuaaccagcuccugcucgugccggcuaaacagggacaguucagaaggcaaugugugaccuuauuaucauaaagucagacaugugccgugaaaucacgcccacaaacagaacagccuguuuucugugcccaaugcagagcaaaguuuccacuaccgcacuguguagacuugcuucagauccaaaauaucauuggaucaaacaauaagacccaggacaggggauucuuuaaacucuuggaccauuagauacuuucgucuuuguuuggguaucuuucucaggcuccgggccacuuucacgaccaaccuaaaaggaaagccaaugcucaccauccaugcagagggcccucaagggugaugucaaucaaaacuggucuauaucuuauauaagucguuguuuucuguucuucacagucucuugaaaugcugaauuguuuccugacaagacaucauaguaaugcuuccccccgccaugcccaauucaagaaauaaagugaacucaagugcaaguucugcauggaaagucugcuggggaaaggacagccacacugccuucuguggacagacugccaggacuuauaucuccugggagguagcuuccugcaccuuuacauaaaugcucccagaaacaagucagaacugcaaacaaguucacucuauugcuuagugccaagguaccugagagacacggggacccaguuugucacaggacgucugaaaauguucaguuuccauuucagucaaagagacaaacaguaaacccugucccggucgaucccaaguuaauucccucuaguuucucuucuaccaucguauuaauugcuuacuuaauaaaaugcugcgcuaaaauucgugaaaucagauucuggcagaaaaucaaaugaaaagagaacuccuuguggcagcaaguuggacauauucagccuccugccuaccuuauuguguuucuguuggugucuggccuuugugucaagaacaugauaggggcuuucugaguccugguugauguaauacaccagucuugaaggcagugugauuucuuuuugcacugcacugcuguagcugguauuucugcugcugcuauuuuguugcaauguguugucuucaucugccaggacucccaggguuuuuucugcaguuucauuccagugcggagcuggggggguugggggggagggaagcacaaauauacacaaauacacacagauacauccaguaaauauauaaacucuaaaauacaucuuuccauuaauuacauuaacaaaguuuucuauugcuaaaaaguuagaaaguggagacaccaaaagacaaguuacuguaacagugguuuggccuggauagguuacacaaccauguccuguacucagguauaucuuuucuauccacucuuagagccgaacaucugaacuguaaggggucagaaagcagaaugcgcuuagggaaaagucagcaacuaacaugcucaaggguccugacccuugucccaucccuccucagaggaugcagcagcucaacuguacccaucuuaacaucaccucaucugagagccaagaacacuccagacaaaacuuggguccugaauucauggacacugaauguaaagugauacuuucaaauauauuuguguguguguguguguguguguguguguguguguguguuuauguguauuaugugugugugaauguagaaauauauauauguguguguguguauauauauauguauauacacacacacauauauacauacauauaugaaugauuucuauuucuuucuaacuuugagaugagaaaaaaaacuguuuugccauaaagggcuauaguugcuggcaacuuuccaaauucuuucuuuuuuacugccaaggccagcuuucugcuuucagugacuuccaaucaccagugugcucaacauuguauuauucugauugcucauuaugacaagcauuuugggaaaacacagccaaaggucaugcgcaaagagugucuuggagacuuucauucucugguccccaaauuaugccucucucaccuuaauuccaacaguagggacuaaaccugguggggaauuugagggaucaagcauuugucacuauuauugcaugccccccaccccuccgcauucauaugaagguuccccaaggcaaaaagcaacuugcuagcucacugcaucuuccugucacuggaaguuacauagagagcgcuaaaggacucaggagccaccaaauaccucuggguggaacccacagucacuggaaugggucuuuagugaaugcaacagaaacggacuuccaaaagugaaccagcaugaaccugggcuugggacggacaaggguggagagguggacagggaggcgcucgaaggccaggcuggggacccacucguccggguuacacgcaccugcgugcccuucucucuccuccccagggccccgcggggaaggcaacgcaaagggcaccggccauacccaccgcugggcgcagcggccccccgggcacggggccgggaugagguggcgagcgcagguagcaggagaaggacgaggagcaggcggcagggcggcgcgcgggccggcaccgggccggcggggcagcggccggggccgcaggaggcgccgggaaggcugcaacccgucagggucggccgccgggagaugcugccgggcggcuucauggcucaucgcucccgggcgccgguccgagugacccgcgagagagccgggcugggcugcggggcggcugcgggcggagccggucacgccggcugggcgcgcaugcugcggccgcgggcaggggucaggggcuggggucucggggacggcggcgcgccguccucugcucuuuccgccuuuccgggagcggcccgcagagagggguccccgccgcuccaccaacuuggagccuccuccaguggcugcacccucccaguggcgggcgcggccgcaccagugacugcggggguugcugccgggccuaaggaugcugaggaggcgcgcgcaggagcgagcggcacgggcacgcgcggcgcgggcgcgagacucggggacgcgcagcgcgguacugcaccccacccuccgggagcgcgcccgaacgggguuucgggugcggaugcugaugcucuugcagaugcugaugcuguagccugcaugggccgcgcugcgcaug

SEQ ID NO: 193 - RNA, 71754 nt, Mus musculus
cugcgcacucggcacugggcggcgcuggcuggcucccuggcugcggcuccucagucggcggcggcugcugcugccuguggcccgggcggcugggagaagcggaguguuggugagugacgcggcggagguguaguuugacgcgguguguuacgugggggagagaauaaaacuccagcgagauccgggccgcgaacgaaagcagugacggaggagcuuguaccaccgguaagaggagcaggaggaggaggcaggagccggagagagccggggggacagaggggggccggggaggcgccggacacccgcgcucggggccuuccccucgcaggaggggccgcgguaaagauggagccuccgcccgagccccacaacaccgccgccgcucgcagcgaacaaagaauaauggcggcggacuggagccagcggcggccgggcggcagcgacucugccugcagccagcggcggcgcucauggcggggggcggccgggccggggcggggugcgagcgagcgggcggccggccgcggcaagcuggcgcccgcguucccgccgccgggccgggccgggcccggccgugccgggcgcggagccggagccggcgcggagcggagccgccccgggggaggccgcccgccgccgccccccguuccucgccgccgccgcccgccugcucgcacgcucgcucgccccggcugugccgggcuggccgcccgggccgccgccugggugcccgugggggguggaggaggaggaagaagaaggagacaguugagggcagaggaggugaaggugcugccgccuucgcggcggugcccgcucggcgagccgcaacguccgaccugcuuuccucuacagcgcucuuugugcaauaaaguucgaaacccaagguuuucucuggugcuguauuuuauucuugccccucuccccggcucccacgcggucggagaaaaugcuguuuucugcccuaggcuguuuuaaggguuugggguuuuuuguuuuuguuuuguuugguuuguuuuuguuuuuuguuuuuuuuuuacuauuucccucaccccucggcuuugaagaugaagaacgaaucaguaguccugggaaugcauucuuuugggaaggaaagaggugcuaagaaaacauacauguaauaacuuuuugcagaaacuguugggaucuuguaaaagggaagcuggugcuugaaaacaguuucgguuuuaacccuuuccacuaagauaaugaucacuugaggucaaucauucugaaacccuuagaaauuaucgaaggggaaauuaguauuagcgaagguacuuuucguuuucugucauuugaagggaggcagucuugccaagguuuuuugagucauccguaucuccccuuagccucugccaugcuccucacacgcuucugucugaacuuuaauggaggauugauauaauucucacucuaaaaauaguuauugaaacuauccauuauuuguauauugccguagguaaucccagccugagguugauggcaguuuaagccagcagggguugugguguuccuuuuuuuccuucaccuagaacaucugcaaaggggacugucaaaagucauugacaccuuaaagauccaaagacauuuuuaaagggcauugcaguaugaccuauuuaaaccugccauaucuucucaaaguuaagaguuugauccuagccucaguuuugcaccacaucugccuucaaaagaucuagcacaaaauaccuuugggccaucuauugaaaucuugugcccugaugaucauuucccaauugaaaagcaaagcccaaaauuuuaguugauuugaaaggugcacaguuuuuuauauauuuggggggggggguugcuuguuucuuuuacaauacaaccaguuacuguaccauugaauugugauugguccauacaaggcuuuugguuaggaauaaauauugauugguaauagaaccauuguguuugauuuuuuuucuaugcgucaggacucugaaacuugacaaguuacauugcuagucuuuagcacuccaauuugcaauuguuaagaaaauuaagaugcaauagaaggaguuguuuccauaggguugagaagaugauuuuguuuccacacagugaagacucuauacaugguaauguugaugauaaaauaguuuuuucaaaagauuuucuacaagccaauagugaugauacaugaggaugauucuuccccugugagaauaaaaaaaaauuccuauguguccuuucuucaguguugaccaaaagauacuuuagguuuuauuuaugggaucuuuuauggagaaucaaauugauucucagcaauugcaagugaaacuuggaacacuuuuugugugcauuaauuuucaagcauucaccuggaaccugacaauaaauuacaguucucucuugcagaggucagugaaaguucuagcacggugugcuucccuccucuuccuccuuccucuccuuuaguuguuuauuuuugauggaccuauguauuuuagaaagcuaaugaauuauuuacaaaaacuuaccuaaugaauacuaagugagcauuccuuuggaauuuaaaacuaguguuaaacacuuuugaacagaauuucacacaagggccugaagaaacagaccauaauauucuuuuuuccuacccucagauacucauagggauuuuaguuuucuuagagaaguaguuuugucacuuguaaagcccuuggguuuguuuuuuuaaaucucauaugccuuuuuuaaaacaauagagaacauuguuuacuugugacagugcuuauacgauauaaaauguuuauuacaaauacguuagcagauacagccauauaaacucaccuguuauacauucgugugagcaucuuucuugcuguauuacuucuagugguagcuucauuauuuugaauaaauagagcucaaaucuuagcuuaagaauauaauagauaucagaaaauagauaauuauagcaguuuauuccucaugcaugugugaacuugacugccccgcugaauacuugacaguagucacuggugaugugaauauuuaacacauauagugaugggcaguacauugaaagaucgucuaucugguuugggaaaucacgaguguggguuugaaacugcuagucuugucacaugccugcacuuggggaguuuugugaccaugggacacugucugcuaucucugccucaguuucuucacuuguaaaguuaaaauaauagcauauacuccuggggguuuugagauaaauagaaaguacuuuuucuagggugaguuuaacuguucaucuuaguuuuuaccucuuaccuuugggacuucccaaagaugucauaauuucuccaaacuuacuguguuuaauacaguuggccagaaagaccaacaaauccaacgaggaauuuuacugguuuuaugcuuaaggaacuguugggaacaguuauuugucauuugaaaacaaucaaaggaaagagaacacucuuggugagcugaaaaggagucuuuguauuuucaguuuuguguuuuaauuauuuuugugguuauaguguaaaacauaaguuauagcaacauauccuauauucugugucauccaguguugcccacauguuuucagagaugcucuguccauaugcaaguaaacauguauguguaucguccucuauacaagcaguagcauacuauacaaucugucuugaauucuguccucccuuaccuguuugacacucauuucccaggcuacuuauaaugacuuagcaauugauuuguauaagcauguaaagaccuuuuuaaaaagaucuuuaaauuguauguguauauguguauguuugaguguaugaaugggcacagugucuguaggagcccaaaauggugagaagaggacaucggauccccuggagcugcacuugugagccaccguguggauguuggaacacaaccugggucuucugcaagagcacuuaaccacugggcugucucuccaaccugaaccuuuuuuccuuuuccauuuuuuauuagguauuuagcucauuuacauuuccaaugcuauaccaaaagucccccauacccgcccacuccccuacccacccacucccccuuuuuggcccuggcguuccccuguacuggggcauauaaaguuugcaaguccaaugggccucucuuuccagugauggccgacuaggccaucuuuugaugcauaugcagcuagagucaagagcuccgggguacugguuaguucauaauguuguuccacccauaggguugcagaucucuuuagcuccuugaguacuuucucuagcuccuccaucaaccugaaccuuuuaaaagaagcauguauauagggauauacuuaaauuuauuaaccuuuuaguaagcugauucuauuucuaggucaugcacggccuuuuaaauuguaaugccaccaagcuugguauuaguucaugccuuuaaucccagcacuuggggcaaaggcugcuggaucucuaaauucaaggccagccuuguuuuacaaaguaaguuccagcaagggcuacauaguaaaaccuagucucaaacacaaacuuuauuuaaguaacacucaucugagugaaaaguaauggacuaguuaauaaguggaaguugagguuuaauuuaaacugccuuauuuuuagcuccacuuuauaaaagcuuuaguuaaaagauugagauguacauagcaacaagcaaacuaugaguuuagaaggaaugacuuugcuucauuagaauucuuaccaagcugaacuuucaauuacuauuuugaccaaaaaaagucuuggaaguuuucucuacugguaaaaaacaaaaaaagaaugguuaauuaaauuuagugcaguguuuuguuugagagggagaacggcucuuuucuguuuauuugguuguuugaggagggucuugguguguaaucuagacuauccuagaacucauuauggagcguaggcuggccucagacuugaagucauuuugccuuagcuuguagccuugugaguacugagguuacaguuuuguuuuuuaaacauuucuugguguaauuuaccagugaguuuuguauuucuugcucaaauagaaaacaaguagguuggcacacgucuaucuccugggagucacacuguacugcugccuuuuuuaauuguugaaagcucuuagucagucagcuggacuauguaaaaugcauuucagccccagcacugaacaagucucaguagcucuuuguuucuuucuuggcucuucaaagcagcuuaaagcuauaguagguuuuaaguauacaugcuacagauuuucuaaacagugcaucccccuguuuucuuuuaguuauuaaauaaagcugucacaauagagugaauuguuuguaugguuaaaggcuuaaguugagaaugacaguguuguggucaugcagguugcaguuuuacaagacuacucuuacugcucuuuggagcuuuucuuaguauuauaaauauuaacaugcugcuuuuaccugcugcauaguuaaaggacuacacaaagcauguguauagauuugguaaaaaugggguagauaauugaaguuuauaaaggcaggugacuugcggguauuugcaagcuaucagcaagguacauacaugguuucuugaugucuuugggucuuccuucaguuuaguauuuuguucuaaucauugggguuuguuuguuuguuuguuuuuucuagucugggcuucucuguguucccuaacuguccuggagcuugugcuguauguagaacaggcuggccuugaauucagagaucaccugugucugcuucccagacguugggauuaaaggcauggcugauguagaauaauuguuuuauauacacacagaugcugaguuuauuuuauaaauguggguuuuaaaguuugaaugaggguagccauuucgucuucuccgucacucagauuguauuucuucccuuacuaugagcacacucuugucucagguccugacuuuguuuagcuuauggucucuuuucuuaauucuuccagacuaguucauuuaaaauauauguuauuauuauuuugucuagauuuuugguuaucucuuggguuacccuaaauugccuuucauauucuccuccacuuuaggagaggaacauaaucuguaauuucugcacacauuagauaguccagccaugaaaaauuguucagaacuaaguaccuaauucuugaggcuauuuacauaaauaucaaagcaguaguugggacugaucacgugacucgaugagagcacuugccuaugaugaacaagaccuaaauagaugcaagcaagguuugugaggaggugaucuaggggauuuauagagcuuuuuuuuuucuaaaaggagaaaagauugauacuuugguucaagaagagugagcugagugggaagauaaaauagccacuuccuguuccuggaguaaagggugugucuuaaugcugacuaauacuaguaggaauggaaauuucuuucccaaacauuaauggauccucuuugaaacugagauuuauucaaucgauuguaguuguauccuaauaaccuggugauuugcaugugaaauucugguugugauuaugauauagauguagcaagcaauguuuaauucggcaaggguauaaugaaacauucuccagaaauuuaucccugcuugcuuuagcaauugacaaaaagagacuuggaagucucuuauuuuucaucaccaaaguaauaauuauugcucauuugaagcauuuuuauucuucuuaggguuuuucuuuuuugugugauuuuguuuguuugucuugagacagaaaucuucccuuguggauugguuguccuguaucuaccuaccuccgccuucugugcugggguuaaaagugguaucauuuucuugaaucaauagaagccugcaaauaauaauaguaauauucugcuguucuuuguugcuauuuaucaaccuaauuugaucauggaacauuugaugaucaucaauucaaaguugaugagcaaaucacaagaaaauguauucagguaguuaagaaaauaauuccuagccaggcagugguggugcacgccuuugaucacaguacuugggaggcagaggcaggcggauuucugaguucgaggccagccuggucuacagagugaguuccaggacagccagggcuacacagagaaacccugucuggaaaaaaacaaaaaacaaaacaaaaaaaaaaaaaaaaaaagaaaaaaaauaauuccugaauguuacaugaagauguuuagauguuauaaguaaaaaaaguccaaauaugucucuuacccacaaagaauuugcaguacauacuguaggguauggugaugcaaggacaaguuucugcugucaugaagagcuauagcguuuagaagagaaaagaauucacauggggaacuuggugggaagauagcauucaaauggaguauugaagaauuuguauagguagaaguaaaaagggugugucauagacaguaaaauggaaaaccguaagaggacgacgcugaggugcaaugaacuugauauacacacaaauuggugaagagaauguuagauuagcuacagaucaacacuuuaaggaauccugaauaugaauccucauggcacagguuuaaguuuuauguaaguaguguguguguguguguguguguguguguguguguguguguuuguguuauauguguauaugaacaauacaaugacuaccuuaaaaguguaguuuuuuuuacuuccaguguguuguauuauaaaggacacaauagcuucucuauaaacuuuuuugaaguguuauauauaaucuucccauuugguagguacaguuccaugauuuuuaauguuguuagccaguugugcaucuacugccacagucagcccugggacauauucaccaccucagaaagaaacuaucaccccuuaaacuuccuacacaacagcccaagacaacagcuaaucugcuuugugcuuuauuaauuuguuuuuggacauuucauaugaauaaaagcauacaguguauuaucaucuuagcauaauuuuuucaaaguccaccuauguaguauuuaucaguauuaauuucuguugccaaauaauaguccacauuaugcucaauauuuuacucauucguucauggacacugggcuuuuugauuugaguuauacuaauauaaacauuuucauuucucuuguauagauaucuaggaaagaacguguuggguuguaugcuaacccuguuaaagcuguuuugaggaacugccaggccauuuucuaaaacuacugcacauauuuuauaaggaguguauaaggguuuuaaugccuccauguccucacuaauacuugcuauaaucuaucuuuuccauuauauccauucgugugggugacaaggaagcuauuuugauuuguauuuuccuaacgguaucaggcaucuuuucaaauguguuuauugguccuuuauauaucuuugaaaaauguauuuguuuagauccuuugccuuaccagguacauauauaauuuauauuuuucccucccauuguauagauugucauuuuauguuuuguuuuguuuuguuuuguuuuuuccagacaaguucucacuauauagcucugacuggccuuggauuugcucuguagacuaugccuaccucaagcuuacagagaucugccugcuucuaccucucagguucuagaauuaaacgugugugccaucaugcuugaggcauaaaauuuuucauuuuuauuucugguucaucaauuuuauuuuucuucuguugcuuguacccuuagaaucuuuuucuaaacaucacauuuuuuuucccccaaguaacugaaagcccagcaaacaauagcauugcuuaaugaaaaacaguuaacugaauggaugcaggacuauguucuacuuucuucugcucuucuccauuaaucuguguccuuaugccuuuuuuuuuuuuuuggagugacuuauguaaaaaaaaaaugaaaagaugaaaaaucaagaaauggcaauuuugaauauaacauaauaauugguuauauuuuuuuaguucauuuauggugucagaguaaguauaguguauuacuuauaaacuaccuuacuugggaaauuuauauauaaguuuggaaguuuauauaaacuuagaugugagggaaauuuuagugccuuuguuuguguguuuguuuguuuguuuguuuguuuaaagaagacuaaauugguccuguggacuguaaaugauguacuuacugucauagacugcucguuuuuuggucacauuaucucuguggaaaaaguuuucaaggcucuuguuuuauuaauaacuccuaaaguuugucucuaagcaauaucagcuuuaguuuauaaauagcucacuuggaggugauuauccuaguauaggucauggaaaaugcauuaauuuccuuauuuuauuaaucagaucuuuaucaguagagagguuauacccuccacucccaauuucuuaaauccuagucauuuccaaauggacaugcauacuuuucaauaacuuaccaaacagaaaugcuuguuuagagggaauauuuauagguacccaaguuauaacuauuacauuauacuugucuccuuugauacaauauuucaucucuaacuagauuguaagcucuucaagaggaccgucuuguguguuuuaaucuguuacuuccuggagauccaucgugcaggaaacacagaacauuucuuuagugauuuauucuuuuuagggccauacauuuuaaaggaaggguuagcaguauucuuuuagaguuguacagauuagaggaagcagaaaaaacauguuuacuauaauuuaauugauuuuucuuucccugagacagaguuucucaguguagaccuggccuugaacucagagaugagucugccucugcuuuccaagugcugggauuuaggugugggccgccaggcccagcguaauugcagguuuugucuuuuguuuuuucuuuuuuaaagauaaagaggaaguuuauuuuuauaccuuaaaaaaagucuucugugcuuuggauucccuuucauccuuaugcuuuacacaguggcaucuuccucuggaaccuaagcauagugcugagauuguguugcucagaauaacuucucgagaagucggggucacgguaguaaagaagcgcgccucccucgaaggcuggacuugguguugauuaugucacaaucaaagaaaaaaacacugaauucaaaauaagucuucucaaaacuacacauaaagaacaauauucggucugauacuauauaguggauaugcaugucauucuauauguccagauucagugcgaaguaccaagauaaaccgugaugucaaaaaauaaauacaguaaaaauacauaaagcuuguaucauugucuacaugcuauuuaucaguuuuauagacuauccauggacuguuuuaaguauaaucuguugcaucuuacauuuuucauuugcuggaugacugguaagcaauguauuaaaaugacuugcauauuucuuucuauucuguagagcuuuauuguugacaauacagacaguucuccacuuuuauaauauugaagacagugaggauagcccugaagccuauaaauuccuuacagacuucucagcaucuccaguugucugguuaaaugcagaauauguguucuuugaccuugccuucaugcagucccaccucagggagcugaguuuucacuguuccaugucugacuuguaaauauuucaucaagaauucaagaccuaauucaaaaucacucacacugaugcuuaaacuuacagaccucuuaaaaaaaucuaccaacaacaauaucaaacuguguaggccuucagcguccuuugaauguagucuuacacagucauuuaggauuugcugaccaccucagauagaauacuaaauauuuaacugcaggucauacauaacuuugugguucuuucaguucaggaauugaacuaguuuauaaagcaaaacuuaaagacagcuucacucucuuucagugugaaaacuaguuuuagaaaaguaacuacuuguugaagauguagugcuuuuuauuuuuaagaaaugagcuucuggggcugaagagaugguucaucggcuaagaguacuggaugcucuuccagagguccugaauucaguuuccagcaaucacgugguccacaaccucuaugaugagaucugaugcccucuucuggcaagcaccauauauagacacagaacacucauacauaaauaaaaaaaauuuuuuaaaugaacuucaggguccauuucguagcacuuuacacauaggcauugcgugaaggguuggcuuucuaaaaaggcucaguguagagagcugugugaggugcucaugucugcgaagguaguucacugggaagacguggcauaaaaguguugccaaaaaaagccagugugugguuuguuguguaaaggugcuugcugccaagcuuggugaccugaguucagucccaggaaccugcaugguagaagguaagaauccgcuacauaaguuguccucugaucaccauacucacacaugcacaugauaaauaaaucuuaaaaaaaaauaaggcacuuaauaccaucauaaaagauguauaaauagugcuguguaguugcaauugcuuaccggguagcaggaagcuuguuuuuagaaccauguguagucucaccuuaaagaaaacaaggcaagaaaauguugccaguacuuuaaaaacaagacaaaaaacuuggauuugauaauguuugacaacuuucuuguugaaagaaacuauauaugagauauucauaaaugucauaaguuacacagcguuuacauaaaucacauaacauuuuccuaauuuacucuugcugaauauuugcuuugagaacaguauuuuucuuaagcugugcuauauguuaaaauuuguuaaaacuggcauuccaauaaucugguaauuacaaaauuacaguaaaccauuaaauacugaaauaaacuuucucuguguuaagcaaauaaaucaggagauuuacuaaauaacauugcaguguugcuauuugcuguuuccauuuggaguggugguuagguuacacugguguuuacucauggcacauauugucuaugaaaauaugaaaacugaaaagucuuccuuugcaucuggaauuuacuuuaggauuugugugugcgcaacacauguuugggugcuugcagaggugagaaaugugugucugauuuccugaagcaggaguuacaggcaguuguaaaccaccugaugugggugcuggaaccuaaguuugauuacggaagaguaacaaacacuuuuaacugaugagcugucucuccagccccuagaguucuagucauuacauuacagucaccuugauauuaccuuucuucccccucccccucccccacccccuccccccacccccggguuucucuguauagcccuggcuguccuggaacucacuuuguagaccaggcuguccucgaacucagaaauccgccugccucugccuccagagugcugggauuaaaggcgugugccaccaugcccggcucauauuacauuucuugccuuuguuaucuagaggagagacuuuaaguauagauucauucucuguuugaaaaaggccuuaauaggggcucugaaaauuugagaagagaauuuaauaaacuuaguguagauagcauuuagugaugucauugucuugacuuguucuuucaaaauauacaacauuuccauuuuguuagaacauagucugacuuaaucucagguuuagacaguucggguuaauaaguauuaaauuggguauguauguaggagaugacugaauaugcuguuuucuugucuggauucgaugaaggggugcuauauugaccaccgggagacuauucgcagagauuuggaacauugcucaguuucuguugauuauauacauuucaguucugauagauuagacauacaaaaugucuaauggcaaauauuucaaggugaacaagaaagaacugugcaaggauaagguagagaaguacaggcagugccacaaggucauuggcugugaaacgucugucacacagaacccaagcuuuugucccucgucagugacacuucagaaaaggagcauauauaucagcggugaaaggauggguuggcaaggcuuuuaaacuucacaaaacuaaaaacaaguacaaaagaacuagaaaucacuguaccccauguaaggcuggauauacuucugcagaacuugcacaagcgugugugugugugugugugugugugugugugugugugugugugugucuacaugcaggcaccugcugagaccccauguaaggcuggauauacuucugcagaacuugcacaagcgugugugugugugugugugugugugugugugucuacaugcaggcaccugcugagaccaggggugucagauccuucuggagcuggguuguagcugagugugagugugagcugcuugcuagacauaugacugcuggaaaacagacacagguccucugaaugagagauacacacacacuucaacugcugacucaucucccuaacccuagucaguuuuuaaauuacaugcccaaauaugccuuuugcugaaguugcccuagaaacuucaguucuguuuaugugguugccuuaaauccuuggaauuuuaagcguuaaggaugaacuaagaucuuauucuuaugcugaaaaaucguuuucucauuucuaacagguuauuuucuuuuuaacagacagcauauguuucacuaguuagaaaagcauuucuuugaaauauuaucucauaucuuuguaauaauuaaauuugaauuuaagacuuaaauagccagguuaugaggaguauggauuuguuuugcuuuaagauuuauuucauuuuuaaauaugaaugcaugugagacugggcauguuugugcaggugcuugcagaagccaggaguuagccuuggauccaggggguggaguuucagguuauugugagcugccucuggugggugcugggaauuaaacuuaggugcucuacaggaacaguauacacugaugaaccauauccagccuccugaagauagauuuauuucucaaaaacuuguagagugaugaagaucuuaaggacugagguucuuaagaaaaucagaauauuuuaggaaaaagaaguggaaguauacaaccucccuucacuuggugauuaugaaagugacaguuugacuuucuuugaugagcuuuaauuuucaguuucaugacaauuuguguuaacuugguguagauagauagggagguagugcugccaaauuuauuucugauacagcacacuucuguguaggugcuacuuaggggaauuuaaaugcuagccuguuagacagguucacuggucagccuucauaauacuggcuaguaugucacgcauaauauugccacuguuuguacuaggcuaauuuuccuacacacuuccacccucugacuugguggacauuuuauaugccugcucuuuuguacuguuccugcacagcagaaugaaagcuuuauaaaagaaagauauuuacgguuucacucaauagcuugaaugaugcuuagcauguagagguaaauugaucaacuuuaagacuauuguuaguaaaguauauuaguaaaggaaauuauuuuguugugaauuagcccauugcaauuuuuaaaauucuaaguccaguaacaucaaguguuaugauuuaaaauauauaauuacaugcaugaugggugcgguagugauggcagcuagaggcugacuuuguggugucaguuugguuuucucuuucugccauugagggagcuuccagggauuaaacucagguugcuaggauugcauggcaagcgucuuuaccugcuuagccagucucagcccuagggauuaguuuuuauauuuucauuguucaggauccuacaaauuguuucugauagguaauucuguaccuggauacaacacugggguuaauagaaaaaugaagauccuacacgugaugcuccauacucuguccuucccauacgagcagacaagcagguggaaugggccugcuccaaaugucagcgcaggccaaccggcagaauggugguguaaugucuuuaaggugaaaaccaagaguguuguaguugaguccaagaaccuucucaucugucguaguaaucuuacuagcacuuucuucuuaggaaagacacuauucgugucacugcccauuugguuggcaucuguuuaagguaaaagguaaccauuuaaaacuggcuccuaccuugaauaagggccaguagccaccugacuaaagugguaauaaaacacuagcaguuuaguugaggacccguugcuacuggaaauaccauaguguccagugauagagaggauuaucuagaugcaggaaggggaugugaaaaucauagccauuuucauacauagucugcagcuguaacuacuuaaauuuucuguuccaaaaacucaucaagaagccuuauaccuuaaauuuaaauuaaaaaaaaaaaaaaaaggcaaguagccucaggcuguucucaauagaaacaaggaaugggacccaucuguaggcucccuuugaucaaaugguaaagugaaacuauguguggauggcaacauagguauaaauaaguaaguagacagaauuuugaagagguaugguuuggaagaacgucuuaaaaugaucauuuauauuugucuuuucuuucuuucuuucuuuuuuuuuuuucccuuuuugguauuuugagacaggguuucucuguguagcccuggcuguccuggaacucacuuuguagaccaggcuggccuggaacucagaaauccaccugccucugccucccgagugcugggauuaaaggcaugcaccaccauugccgggccucacaugucauuuucauucaagucaaagguguagauuuguuuugggauagccaacuuguuuuuuaaugguuuggguuuuuuuguuguuguugguuuuuuuuguuuguuuguuuguuuuuuuacguacuauguuucuuuuaaaaaaauuaguauaacugauaugauaauuuuauaaauuuucauaacuacauuauuuguuuuuccuucauuuauaaaaacagaguaaacaguucagccaaaauaaguacuuuuacuuaaaaaagaaaaagugagggggcuggagagauagcucagugguuaagaggacccagguucaauucccagcaccuacauggcagcuuacaacugucuguaacuccaguuucaggggaucugacacucucacacaguuauacaugcagucaaaacaccaaugcauauaaaaaauaauucaguaauuuuuuuuuaaaaagugagguuugagaaaaugucaguggauaucuccaaaucacuguugaaauacaguuuuuguauuggugaauuauugaauuauugcuuaaacuauacaaacacucuugaaucuauguuuccuagaaggaaaauagucuucaaccagugcugauauuaaaggauguaaaaagaguaccagaugaugagacuugccauccuauaaaagauuuuuauagaucccacuuccagcuuaguguuuaauuccccacacccuuuuuguggccacaccuucacacuucuuuuuuaauuauaagugggauuccacuguauuuaaugucauuacauuguagacaggcuucuuuuuacugcauuaauucuuuucauaucccuccuaaaaauaguguuucuaguuuugugguuuuaaaaacaaaagaaaacaaaacaccaaaauucuaucccagauaccuuugaacuacuuuuuuuuuguaaacugccuguugaggguuucauauugacucagaguugcauuuugcacgaucucgugguggucuuggcaguuacuucucccagugccucaugagcuugaugacuguuuuaauacccaugcugacaagucugcugaucuuuuuucuuugucaucuauguuuuauggauacugguauuucuaacuuuuuauauuaauuuuugaaauggcauuuuaucuuaaauuuaaaguauuauaaauaaugacauguuaaauauuggauacauuuaauaguauauaaugauuauaaggaugaaugucuguuuugauuaguuuuagaguuguuugguaaagcauugagauuucucugguuuaugagagaugaguauagauaccacucaugguaaguucaucuugucugguaauauguaggcauugagcuauaagaaggauacacuauagagguauucccuuuuuucuuguccccaaaauuuagaaaggguugcuuccccaguuaucugaaagcuuaguaaaaugugcauuuaacuucugcaccuaggaguucuucucucuugaaucuugcugcugagagguguuagagaacuccacagguaugcaaaacaaggucuuaaaaguucaagaguccaauauugacuuauccagaauuuuacaaucauaaaaaguugcuuugcuucucucuguguguauagguaucguguuguacucugccaugagugaggaguaggacaccaugaccuucgcaguguuugaagucucugauuaggcucuggccauauauuuuccuuuuuaccucugugcccuacuugauuuguccuguuaccaguuaccuucuagggagcagcuuacaguugcucuucuugcucugauaggaagaaaugccuagagggaucugaagccagaccucaggccugacuucacuccugcuuucuacacucuuucugaaccuggcuggugcagcuugggaaaaucagcuuugcugccuccucuggccuccuggcuaguaagggaccaaucaagacagggaccauuccucauuuccuauuaggaagaaacacacagagaagacuuuguauuucuucauuguuuguuuuuguuauuugaaguuacuaagauuuauagcuaaucagauuugagcaaguugaguaaaagaucagcugcauucuguuuuagcuagauuuuuaagugcauuugcuaacuuaaccaccacauagccuauucauaacuugaaguuugccuuuaaagucacucaaguacaaagcacuguagugcucguaacgaucuuccauauuauuguagguaacuaaaugaccauggaaucuggagcagacaaccagcagaguggagaugcugcuguaacagaagcugaaaaucaacaaaugacaguucaagcccagccacagauugccacauuagcccagguauaaaaauacauggagagauuccaagcuguaucucuuuuaagaguaauauguuuccaagagaauuuaauuuuuaauaaacauauacauagaaugaguggaaauuuucuuuaaaauaucagaauuccuguucaguauuagcauuagcuuauguuuagaaaugaaaguaaugauaaauuaacauauuaguaaaauguaucauuaaacauuaauauaauguguguagugacaugauucagaaauaauuacuuuuuuguuaauaaaugaauuggcccucucaaggcaaugaugacaacugccuuguuuuucuuuguuuguuuguuuguuuguuuguuuuuguuauuuuuguuuuaaauaccacacaagcuuauuuugggaccuugaggugcagacgauuugaaagucuaaauuuauauauucuaauacuaaaaugcagagucaaaggucgguguggaacucaguccuaaaggugauaacagccguucuuuccugugcauuuuaaaugcguuagucggauuuuguuuuaagaguccugcccuugccaggugugguggcacacaccuuuaauuccagcacuugggaggcagaugcaggcagauuucugaguucgaggccagccuggucuacagagugaguuccaggacagccagggcuacacagagaaacccugucucagaaagaguccugcccuugaggcugucaucucugugcuugcuuuauuguucauaucuguuuuucuuuauuaacaucuuugcuuaaauauuaguggaaacagugcuuaauauaagaaccaaauaaguguuaaaccugcuaggguaagaaugugguauuuccuucucugauuuuuggacacagaaugucacuguguagcccugaguggccuccaccucagagauccaccuuccucuggauuaaaggugcguaguaccacgccuguguguuuuuaaagugaaggcucccaaagaaaaauaauccuggcaaagcuuugcuuugcuuaucuucaguuucuccaggaguuaaaaaucuccauuggaaguggcuaauuagaauaaguccugggaaauacaggguuaaccacggcuggggugagggugggaaugagucagauacuggagcuccaggccaaauagucagaguaagcaagcugacuguccuuccuccuaagaacagggcuucccugcagaucucacgaguaagacaacaccacauaugcuuggagauaagauauaucagaugagguagcacuuaauaggcuuaguaaaacaggcauggagaaauuggggcacaucugaccauuuagcugagcagucuccuugaugaagacagccuucagcauguugucuauucugguuaccauauucuauccagcuugguuguucccugaguugacuuuauagagucaucuuggaaauucuuuuugcucucauuauuuuuucuuugggaauuuguauucuugaugaaguagaacauguagguagcauaauuuugagaauaaaagauuaacugagauaaaaauucuugguaagauacuuucuuuggaaguuuucuaugguccacuuaguguugcuuacaaauuuuuagaagacuuaauuucuuauaucucacauguuauaaaauaccuuagaucuccucacaaugaauguucauuuuuuuucuuguggaggauggaaacucacacccucuguuuuaggaaauuucuuucaauuaguuguuggugguuuuguuuuucauugucagaauccuugugacccagauguuacgcuucugugacugguuuuguggugguacguuuuuguuuguuucuuccauuuccuuauauuuuccuugcaauuuuucacuuuuugcucuacuuccuaggaauguauucacuccauccugccugcugaauuuuuuuuuuuaaauaaacaguucauuuacaaaacauggguuuguuuuguuucuuuuaagaagcugugcaacuguuuuuuguguuuuguguuuuguuuuguuguuuuagauuuauaacauauacagcauucugccugcacauaucccugcagcacagagagggcaccagaucucauuauagaugauuaugagccaucuuguuacugggaauugaacucaggaccucugggagugcagcuacugcucuuaaccacugagccaucucuccagccccugacugaugaauugcuaucauguuuccaagaguguuauguuuguucccuggguagucuuuugguauuuucuuuuugcuuuguuuuguuuuguuuuuguuguuuuuguuuuucgagacaggguuucuuuguauagcccuggcuguccuggaacucacuuuguguagaccaggcugaccucgaacucagaaauccgccugccuuugccucucgagugcugggauuaaaggcgugugccaccacacccggcugguauuuucauaguauccuguguuuuauaaguauucuguuuauuuucaggaaaagggguuuguuuacggugugguuuucgccuuauucgguacuuauuuugaguuucuauuucucacauggccacauaacucuucaucuucauuuccauuuguuuuaguguccaucuuuccuaguagaggcuuucaccagauucuuaauacucugugaaugucugcucaggauuaaaguagaggaagacuaggagauaggauuguagcuuaaugguagagcauguacuuagcacuuguaaagcccugggcucgugucucaacauuaagugaaucguaggcagauauaaaaugacgaagaagcuacuuugaaagcuuuguguauauaguagcuccaagccaagaacuuaacugcaggacagugguugucuuaacuuuuaguaccuuggaucuugaauuugaucagauccccagagguuucacuaacccucuguuuauauauaaaaggccugagagccaagggaaagaagagggcugggauaucauagugacuuucaguaaaccugguaugacgugguuaagacccauuaucuguguaaugcugcacucuucucucacagcgggccagacuucuuuccugcacggauugaguaaggauucauuuguuuuuaaagagcuuccagugaacccuuuacuuauuuucagcccuucucuucaugcuuccguuugcaguguugcagaccccaaguaccuaucugcauuuguguggugcaagucaggcuuuccuuccuccaagauuggaccaucugugggcagcuuaguuuguuacuguugacccaucuguuccacugccuccuuuccuaguccuugcacuuauuugauugugcauauagaagugaaauuaauuucaugaaauauaacuuggaauccagaagggaacauacucaguuuacuaucaggcagccuuuuagcauagaagacuuagaauggaaugcguaguugaccguggauuuuaagaaagcuuuucuuucuucuugucuaguuacaguuuuacuuuuuaguuacuaucugaguuuuuuuuaacaaaaacaccauacuaauaaaaauuaucuuuuuuuuuugagaguuugauacauguauauaauguauugugucacauguaucaccucuauacucuuuugcucccaccagacuucuucuuuccaagauaccuucuacuuuguugucuucuucuggugguaguggugguggugguggugguggugaugacccacugaguguaauuaugaaugcuuacaugaacgugaguggggaguuacauaacaccuugucaguggcuaucccacugaagacaaugucugucccucuuccaguaaccauuaacugcuaauaguuccuaagagagcuuaugaaauccugccucuauccaugguaggauguuacaggccccaucuuauacauguuuuaugcaggucaucagaguuguuguagcaguuuguuaguguaacagcagugucaugcccagaacucagaguuuaccagcauuccuucccauccucuguuacauuccuuccagcuguucucuuaaaguguucccugagccuugagggagguguauaucauagauguugacacaccuccuguuaauucugacuccagauaauguuugaaugcuaguuuuuaaauacuaggaaaacauuguaaagugaaggcagaaugauugugcuuuugccaaugaauaggaggggaggaagcaaguagugaaggaaagcaacguuaggauuguguaggcuggccucacccgugcugucuccucaguaccacacaggggagaauguuacauccaguaaaucuaagcaaaaaguaaucauaggacuuuauuaagcaauaaagaauuaaacagaaauaaugaacuucuacaauguagcucuauuuuuagacuaugucaagauauuauaauuacccuaaaaccaaaaaaauagguuauggugguguguuguaaaaauugaaugugucugugugucuugagagacaucugucaagcauggcucacuuugaccaggccauaagcuucccagaauaguugugaauauggcccaacaacauuauaauaucaaaagauaggacaucugugauaggagagugcuuaccuagcaggcgggaggacuugaguuuaaucuguggcacagaauaaaaaaagcuagaacacagcaaaaaugccauggugauucugguaguagagacagaugggauuuuuaggcaggccuuaucagacagccuugugagauaacugcuccuugggagucugagcaggaggaccauaaguucaagaucagccugaguagucaagugagacacugucuuaaaauugaaaaaaaggaggauggugauacauuuccauguuagauuacuugucugcuacucacccauacacacacgaaagagggcuuacuuaauacuuuauguuugcuuccugugucuguguaaccuaaauguaaggagcuuugauaaauagcuaggauaauucacuggaguagcuuguuagguuuacccuugaaggaugcagguaagaagucacugauacuguaauugcuucaaauacucaaauagcuuuccuaugaaauuaagaugagacgcucagcucauaauaacuuuauggcugagccuuuuaaaccuaaggaaucagcauucuuaguuuccucuucaauuugucauuacaaacaggacaacaugugcgacucugcagauaguccuugcaccacauuuauagaaccaaguaaaauaaaacaugacugaaaauaggacuaguacagaaggcuuuuguggaugucuaaggaaaggaaacuucuaguuuuaaucuguguguuaaagaucacuugucuucaagaggccuugcuggguagguaugucugcaaacuggcauucaguacuauaccuuucaccucaaccccagcucucccaaacccugucccucuuucauucugucucgucuuuaauuccucucagacagccuuucagaaagcccguggucugccucaggauguucauaugagcugcuucucuuggaccuguccuuaccaccuacuacccuacuucuggcucucaucagccuacccuaacuauauaggcuuucucaugguacaccacuuccacuuuucucugucugaaguguauaucagucauucagccacuaaagugauugaucuaaaaugcaaacauucuauuuaguucagcaguucuuccuauauauucucagaauaaaugaaguuuuauuuuugagacauggccuugaauggcucaggcuggccuuccuuuacagcaauccuucugcccaaauaucuuuaguauuggaauuacaaacaugugacacuuuuacugacuaaaaugcaagauuuuuguuuguauugaaacagggucucacuacaccucugguuugccugaaagucacagagaucuggcuaucugccucccaagugcugggcuuaaacacaugagacaauaggucuggcuugaaagcuuuuuuaaucugacauauagagaggugugggguuuuguuuguuuuaauuauuuuguguaugugaguacacuguugcugucuucagacacaccagaagaggacauuggaucccauuaaagauguuugugagccgccaugugguugcugggaauugaacucaggaccucuggaagagcaaucagugcucuuaacugcugagccaucucuccaggcccauauagggagguguuuauaacuagaccauugaagacuuuuagaaccucuguuacuuuaucucuacuucugacauuagcaaugugugugccuuuccuccauuuuacauacacacacauucacguauacauaugcgugcaucacaugcgcacacacacauagacacacacaaacaggugcacaccuacacacaggucaacuuuuugaaagcagggcccuauaucuuucuccuuuuugugguuuuuauuauaacauugcucucaguacauguguugugguuacuauuuaucaaaugcaaugaaaguuucuuaaauauguuggugcuuaggaacaauaaauacuauuugauagacaugucaguaaacucuuaagaucuggacauugaaucauuaauauugacuucuuugugcuucaagaaaaacuaguuuccuuuuaauauucuuuuagcucugcuccuuuuucauccaaaauuaaaacacuucuuaaaauuccaccuguuaccagauuaguguuuuuugugaaugugaaaaaucgaaauuuuuaauuacaaugcauguaccuucuuguuaaugaaaaaacauacuuuuuuaaaaaguaaaucuuuuucuuucuuucuuuuuaauuaauuaacuuauuuauuuauuauaugaaaguacacuuuagcuguuuucagacacaccagaagagggcaucagauuucauuauggaugguugugagccaccaugugguuccugggauuugaacuuaggaccuuuggaagagcaaucagugcucuuaacagcugagccaucucuccagcccagaaacuuacuuguaauuagucuaaaguagcauacuaaagucuuuauuuagcauguguuguucugaacuuagcaaguccuuguugcccagauuggaaaagcuaagauuuuaaaacaugauuuaacagcaggguguugugaaaacuuuuguacuuaagaccaguagcaugucugucguugaccuugagugaaucagucucuuagcauauuuuugucuuuacguaaauauaauccuuauuacucaaccuuuaaaaagaaggagagaaaauuuggauauaaaaaagcagacagggaaauguagacaccgaaugaaugggguauucauuagcuucagagaaugacuggguugcauguuuugaagcuacaggagauagcuggcucuugguuguuuugcuuugucacuugggaauggcugaaaaguagagaagauuuguaggguuugaacuuuuuuuaagacuaguaaauuguuggcuucuuguacauuguuaaaauauguaucaagcagaacggucauaguuuugcuuauuagaagucacucaacauuaaaccugaguagucccacagaguuuucugugguggucauugcuuucuguguuucuauagguauccaugccagcagcucaugcaacaucaucugcucccacuguaaccuuagugcagcugcccaaugggcagacaguccagguccauggcguuauccaggcggcccagccaucaguuauccagucuccacaaguccaaacaguucagguauguguauaaaaguuuuguauguacuuuaauaacuuguuuauagccauuucugucuccuuucauuaguugugaaaauaaagacacaucuaguuuagauuuauuuuacuugacaguaaaggaguauguuguaucugcauaguucuguuauauguaccaagucagaccucaagaaaauuacuuuuuuuaagcuucaaaagaaaaagcauuuauuuagacagauaaauaguaaauacaugugauaaaggaaauguugggaaagacuguaggacugauguaaccuuagugcagcugcccaaugggcagacaguccagguccauggcguuauccaggcggcccagccaucaguuauccagucuccacaaguccaaacaguucagguauguguauaaaaguuuuguauguacuuuaauaacuuguuuauagccauuucugucuccuuucauuaguugugaaaauaaagacacaucuaguuuagauuuauuuuacuugacaguaaaggaguauguuguaucugcauaguucuguuauauguaccaagucagaccucaagaaaauuacuuuuuuuaagcuucaaaagaaaaagcauuuauuuagacagauaaauaguaaauacaugugauaaaggaaauguugggaaagacuguaggacugauguaccucaauuaaggaaaauuaacuuaaaaugaaccuaaguuuguauggggaaaggguugauaaaaauuaauuaauagccuuaccugagauagaauuuguacuuagagaucacaucagacaucauauugucuguugagcuuuuagguagaguauguaacucugaaauaauacuauauucagaagguacaucauaaggaucauugauuguaucacauauaucugauucuuuggagagcuugcuucuuugggguuuugggaauaaaggcauucugaaggugacuacuuagaucuagggaccaagagcaguaacaggauaauucuuuaccaaucagcuaauugaaggaaaaaaacaaagacugaacauucaugcaaguaggccauaaccccagccucccguuucauauuuuuuuacuucacagucuuccuguaaggacuuaaaaagacuuuucuccggaacucaggugaguccuagguccuagauuugaagaaaguuauuuuuagaaaggaaggugagaaauuauuuacgucuuuuguccuucucugugaacauggaguuuugggguuugagucaaagucuacaccuccguuguacugcucacugcauaguuacugcucaggucucuguaacagcucuccucccccagaacugcaugaaugccuugagaaaaggaagcugaaccuccugaggucuagacaauuagacaugaagccuaacugcuggcauacugugugacuagccagaguauacuuucuaaaauugggaccugguaaccccaagaacucagcaaaucucacucauuucugucagacuucuuccuuucccuucuuuccccacacccuucccacuguacagcaaguuuucuagauucaacaagcuucuauuuuucuaaagcacuuauuauaugguguauguugauuucucuugcccagccuuggcuguuucugcuguguuuuccuuguaugguagccagaacugauuaguauuuuugcaaaggggaaaggugcuuccuccuuuguccaggaaccauucuguuauuguuaucaaagcccacauaagguucauuagcgguuucuucccuuugggcuucugauuugcuguaacauuuacaggguagaaaacuguuacgugaaauccugguuacuaguuucccgaagaugcugggaauggacauuauuaacaagccuugacaguauuagccagauuaaggccuauuuuugagaaaccacagugauaaguaguccugugacuuaguuuguauuucaugaaaugccaccuugccaaucuccauaugaucuuagcauuaguaccgucccugaauucuucucuagggcuuaccugcuagucaagaguuuuagagaucagaccuacuuuggauaguaauaggucaagugaugguaagcacaaauggcccuuacuuucucuuuuucacuuacagaaaguuuuuguuauuaaaaaauaaaguuaagcuacaaaauacauauuauaggauuugggguuuguuuguuuguuuguuuguuuguuuguuuguuugagacaggguuucucuguguagcccuggcuguccuggaacucacuuuguagaccaggcuggccucgaacucagaaauccaccugccucugccucccaagugcugggauuaaaggcgugcgccaccacagcccagcccauauuacaguuuuuaauuaauaaaacaugauauuuaauuguugccuguauucuuauuuuuaaucuuaucuuggggcaaaauaauuugaacucaaguauuaaauguccuuaacuuugauagaaaucuguguuugucuuuuuaagaauacauuuuuaucacagugagcuauguuuauaacuuuaaaaaaacauguuugaaaaagaaaacuggcuccuugaagccuggacuauauggagauguaaauguguuucuuuugcauuaaacacucuacaccggaagaauguguuaaacuuugaugguuacuugagccagccaacagugguuaguuuuaauaacuaggaaguagugguuuacaauagcuuaucaaacaggguggaaguaucccucaaacuucuagaugguagaaugauagcguuauauauaaaguuuccaaaauagacaagguaugacucuccuaauggaagaguaggaauaguaggacaucgcuugauauauuucaauauaguaauauuggagacuguacuaauauuuuauguacagcuucacuuuauaauucuuacguguauaaaucacaucucauaggugacaugagaauucuugcaaaaugacagcaguuucacaguguauauaggguuaguaguggcacuuaccaauuugggccacauuucaauauagugcugucuaaauguaccagaaaggauucauagauuuuuaugaguguaaauuauuacauccauuucuucaacaaauguuuauugaugacaugcuaugugccagucauuguucuaggugcuaucaaaggcagcagugaacaaacaguacaucucuguucucaugaagaucacauuugagugaagagagacauacuaugagaaaauaaaauaugucaggugaggauaagugcugcagaguuaaucaaacaggggaaaggguagggcaagaugcaaagggaagugugcuggaacucauugacggugguugggcaguacagugagcagaaaccagacagcaggagagggagcuaagccaagccaaagauguggaaaugaggauguuugugauuugaaagaguagcauguuccugcugguuaaagugagugagaaggggaaggaaaacgauggagacucccucaguguugauagacucgucaaugauaugauggagacagugguaaagccuucuacaacauagguagugguuccguucucuggcuaucauauagcaucgcugugucugaauuaagaaugaguaguggguuuggggaccugggggguugggagggauauuugguuuuuguuuugcuagcccaagacaaguguuccaaaauuucugaucuuggugauggcaagcaagggcuuugagggauauuuuaccuaauagaaaucccuuuguacuaucuuuguggggagggggcauuagccacaagugaaaggauuauuaguuauaagaaauugucgagagaaauuugaaaaugcuuucuuaacuuuuuccaugguaaacaguguaaguuuaucugcuuuaagucuuagaguuuccucaguuguaucacugucagccuuaguggagguuuauauacuaagaucuuguugcaaaaaaggaaaaaaaguaucuucuuacuggagugcaauauguaaaugaaaauaauuauuuucuaagcacagcuaaaaggcacuuuuuuuuuguuaaucucuacauuuagaguucucuuuuaaauugguagauauccagccacauuuccaaaaauguagaccuaggcaggcaggguauuacuguauagguagcccucaaagucuuugccucagugcugggauuaaaggcaugugccuccauacuugacuugaaucaccguugaaagauguuaaugaucuuuuggguuuuccagaugggcuuucucuguguagccuuagcugucccagaacuagcucuguagaccaagcugccucuaacccaaauaacgcuuucuucuaccuccugagugaugggauuaaagauguauccacuaucuaccuccugagugauggguguaaagaugucaccacuggcuguuagugaucuuuuaaugaaguacauuuaaugacauuguucuuacuguuagugaaaaacuuaauucuacuugaauaauuuauuuauuuagccuauccuaagaacuuuuaaaauaaauaacauuuaaaauuuacaaauaaacauauauguccacgugaaauuuuuuuauuugucugcaugugugccuguacaagaugugcaugccugguaccuguugaugccagaaggaagguauccugaagacuggauuagaaaugguugugagcuuccauguaggugcugggaauuaaacucaggauuuguaagaccagcugguguuuuuuuuguuuuguuguuuuguuguugguggugguguuguuuguuuuuugguuuugguuuuucaagacaggguuucucuguauagcccuggcuggccucgaacucagaaauccgccugucucugccucugaagugcugggauuaaaggcaugugccaccacaccuggccccagcugguguuauuaucugagccauuucuccaacccccaguuuucuuaauguaagggagauagcagaucaaguuuuaagauccggccuuauuuugauccauugaguaaaaaguuaucuaaaccagccaagcaaaacacuuaaguuugcaaaggauuguauaguuuuaauaauguuuuagcauuucuuaauuucuagucacuguuugguucuguuaaaauuucaaauuauaaaaauaaguaaugauuuggguuuuggcaauguccagacuguuacaaagagccaaagguaaaaaccuguuuaaggaauuuggggagauagacauuaagagacguggcaggaggugugaggacugggggggggggguguuacuggaaugugauaauuaugaaaccuauauuagguuuuuaauuuuacaugauuacuuuuaauuucuuacacuuaugaaguuauaaaauugaauuuugauauuuuuauuaguguaaaaagcauguauccuguauaauuuuuuaagacuucauuuuucaagagcagcuugauucacagcaaaauugagaguuaaagaguuuucccauguauuccuggcccccacauguguagcuucuuccauguuaacaccccuauaccagauugcuacauuuguuagagcugcugcaucauaaccauccaagcccaaguguaaaaugauacacaggcucucaguguugguaugcuucauagccaugugguuuggauuuuucauuuuaguuaauacuuucuguuugaaaagacaaaaucuuuuagauuagagaaaggccacaaagucuacugaguugguguaggaaacaaaguugcaacuaaaaaagcagaauuuuauuucaaaacuaaucuguacuuuauuucuuuauauauuuugauuuuuguuguuguugaaacauaaagcccaaguugacuuuggacuuacuguauggcauguauaaccuugaacuacuaauccuucugucuccaccucccaggugcuacguuuguaggcauaaggcaccauacuuucuugguccugagaaucaaacccaggguuuuguucauguuaaacaaacacucuaccaacugagcuacauccccaagcccaguauguaaggaacuagcucauagagcuugcuuuauugaguuucaacaugaaugagguauuccucugucaguguguauccuuaagaucuugauaguuguuaagaguagggcauggcaguacauagcuauugcuccagcauuuagaagcaagacuaggaggucugucugucugaggccagccuagcugaccaggaaagacucucugccucuucuuuccccuagggaaaaauauuaagaugguuguaaggaugggggauaucauaugugagagucaaagguagaaagccaaaggggaagaaagauuagccaaaauaaguacauuugccauaguggugccuacuaugaauguauuuauuggcuauugacuuuuucuuguucuggguuuuuuguuugguuuuuuuguuuuuuuguuuuccuagcuucugaucuucucuuuauccguaagaacauuuguauagagacacuagagugggcuagguauagcagcuagagcauuccuuauuuuucucugcaaugagcauauacaucauacagcacugucaaaagacaugaguguccaccuugagcuuaaguccuugagcuuagauugcauguggaauuccuuuggaauuucucaaauuugucugaauaugguuuuacauguugcuguuguugacuauuuugaggcaaugcuaacacacacucuuguauuguuuaagacacuaccgagaaguagugugacagcaucaugucacauggaggaaagcacaugagacuuauaguauaggcuagaaaaacuuggucauauaaauuuuacagauuuggaguccagagugaucuaaagugcugugagcuuguugcuaugacagcacugacacugggaccaccaggauuuuaaugcguguaaaguggaagugcugagugcagcaaaggccacacuccuuagcuuugcggccccauagaguugucuauccugcuugugccuuagcucuucuaucuucuucaaugaacauaagaccaauggacucaucugguaccugauacuuaugaaauaauggcaccacccacaauggacuggaccuuaccccaucaaucacuaauaagaaaauguccuacaggcuggucugcagccagaucuuacagagaaguauuuucucaauugaggcuuccaccucucugauaacucuagcuugugucagguugacauaaaacuagccaauagucuacuacuugguaaagaaucacuaacuuacuuauacaacuguaaaucuguguuugcacaacaguuacaggaaaucauauuauuauuauagacucauaacucaugucggaauccuuauuuuucuuggcaguucuguucuaacaacugcaagaaaucacugcuguggugauauauuuaggauugauugcuugguagaaauuaaaaacauuuucuggacaaacauuuuuguuuccauggcaucauguuagucuguaggagaugaaucuuaguggugugguugucuccguuaaaaacugaaguguguauaagauuuauauauacaucuuguguuggacuuaaauauuuuaugggaacuaaauuugauaaauuugauaaucaagauaaaguuauucuuugcuuucagauuucaacuauugcagaaagugaagauucacaggagucuguggauaguguaacugauucccaaaaacgaagggaaauccuuucaaggaggccuuccuacagguaugugauuuaauaguuacagucagagacgugcaggaagacuuaguacuuggcagguagagaugucagacaccaauaaagcugguccagaaaguacuuugcauauuauuucucuugaguuacuucucaaauaagcugauguuuauaguacaaaauaagacuauuacucuaaacuagugguucucaaaccugugguuugcgaucccugaaaaccauuggaaaaacagguuacuuacauuaugauucauaguaguggaaaauuauaguuacaaaguaacaacgaaaauaauuuucuaggugagggucagcacacuaugaggaacuguguuaaggguuaggagauugggaagcacugcucuggcagcuguaggacauuucccuccuguuuuuguagcugugcagacuguugcucucccuuuaaaaagcuuggguuaccuuugaguguuagcaucguucuuggugcacuguugaucugcuuaguuacacauuuauaggcgauuuuuaugucaugguccuuagcaaacagcuguauuuaauaguuuucaggguaauucuuugcuaacauccucaaguuugagugcaacugugauguuaccuaccuagucuaugccuugccucaaaagaaggucaaaaccaauuacuacaauauaucaauugguuccauguuaaguauaucaagaaacaacauuaucuauuaaucucaugcuuacuuaagaauucccuuaacagaguuaacagagacaaaguuuggagcugagacaaaaggauggacaaucuagagacugccauaucugggcauccaucccauaauuagccuccaaacgaugacaccauugcauacacuagcaagauuuugcugaaaggacccugauauagcugucucuugugagacuaugcagggccuagcaaacacauaaguagaugcucacagucagcuauuggauggaucacagggcccccaauggaggagcuagagaaaguacccaaggagcuaaagagaucugcaacccuguaggugcaacaacauuaugaacuaaccaguaccccggagcucuugacucuagcugcauauguaucagaagauggccuagucggccaucacuggaaagagaggcccauuggacuugcaaaguuuauaugccccaguacaggggaaugccagggccaaaaaagggaauggguggguagggaaaugggggggaggguaugagggacuuuugggguagcauucuaaauguaauugaggaaaauacguaauaauaaaaaauaaaaaagaaaagaauuccguuaacuucagaauuuuacaguaaccuucuguguuaguuuaaauuaugccuauuuauguacauuucuauucauuauuuguuuuuagauuuauuuuguuuuauguuaauggauguuuugucugcauaugucuguacaccaguugugugcauagugccaacaaaggucagaagauguuggauccccuagaacugaguuacccaugguugugaaucacucuggaugcugggaaucaaaacaggccuuauaauagagcagccagugcucuuaaccucugagccgucuaucuagccuuacuccuuuuuuuaaaaaguaguugauugccuuaucucccuccauguacuuacuuagaguuacuacuaagcucuuuuucaauccucauccaauuauaaauuccaaauauuauuaguuaauuaauuuugagguccuaagaaauuuuauguuguaagauauauauuauaggcauuuauauguauagucuuuacuauuuguuuuauuuugugugugugaguauuuguauuucuguacaccaugugcaugacguaccugcagaggcuagaagugaugucaggcccucuaguacuagaguuagaaacagugugagcugcuucucuuuuguuuucaauauagcauguguuagaucuugagacauugaaguauaucuuauguuaguauguaauaccuuugauccugaagcaaauccaacaaaguauuaagaagcaagucacaugacuucuccuaaauccuaagcaaaucauagcugccagauggcuccagcagauaaacaugcugaugcaagcuuggugaccugagucucagccacauaaggcuggaaggcaagaaccaaguccaccaaauuguucuaugaccuccacacagggaccuccuacuacauucacacuuaaacaaacaaacagacaaaacccacacaaaggccagcuuuauguuugucuuaauauuucucuggccaaaauccuagcaaaaguuauuuaaaucaaccaugcuuuacuaaugaaaggaaagcucucuaaagaaagcauggagagaaaggguuauaaaggguacuguuaccuuaccuuagaguuaaaccuucacacugagauacuauuuauaugaagguuaugaauuccugaaauguagccuuuauaucuaucuagauuauaacaagcuauuuaacagaugcuuauaguaugcuugcaagguuagaaaaaugaaauugauugauuauacaaaauagguuaaagcaguuaauuuguauacagcagaaaggugcuccauuuugucucuuguggcuugauauuuucaccaguaauuguucugaaaaaauagaagccaugcauaucagauuugcaaaugauagaaccaucaggcuuaauaaagugcccuggugcuaggagcaugagugccuugaaaggucacagcaggcaaaggaaaugggcuggaaaaauaaggugaaacuguaaugacaacuguaaagucucugagacagcuuacaaaauaaacaaguuguucaaauaucugauucuggauuuauugaugaagaaguaaaguuauuuauuuuuaucagccaauauaaucuagagcaaaaagaacuaaagugugaauaaugucuuagcuguggguuuggauucucaugcaaaggggagcuagauuagauugugagacuaaauugaugauguuuaaacuuccaacgauaauccuaaauaaggaauauuucuucauguuauaauagcgccaggcauacaagguauguaacuguaaucccaguacuggugaggcuaaggcaggaggauugugaucuucccaaccugagauucauaauaagacacugucuggacagugguggcacacgacuuuaaucccagcacucuggaggcagaggcaggcggauuucugaguuccaggacagccagggcuacacagagaaaaaaaaacaaaaaaaaagccagguggugguggugcaugccuuuuaucucagcacuuaggaagcagagaggcagaucucuugaauuugggcuagccuguucuauacagggugacaaggugaguuucagaauaaccagggccacacagagaaacccugucuuggaaaaaaccaaacauacauacauucauacguauguaugugcauauauguauacacauagacacauggcuugugaaggcuggagugaguaaggggagauggucuaaaggacccagauucaauccccaggucacauaguaucucacaaccaucuggaacucuagucuaagauacacaguggccucuucuggccucugcaggcaccaggcaugugcagauaaaacacccaaacacaucacaaaaaauaaaauaaacauauguaguuuuauuuuuuauacugccccaccaccaccaccaccaccacgcaauucuugcauuugaaguuccugcuuuguuuggaguuuauucauguguuugaauuuuuguccuauacguuaguaguuuucuaaucucuauuuguacuuagugaauuuuuuuaaaauuaaaauagcucuuuauuuuucuaggaaaauuuugaaugacuuaucuucugaugcaccaggggugccaaggauugaagaagaaaagucagaagaggagacuucagccccugccaucaccacuguaacagugccaacccccauuuaccaaacuagcagugggcaguacagugaguaauacauuuuucuauuaugaaaagugagaaggaaaacuguuagagucucuuuaagaaagugauaaaugccaaggcuuuugcugccaauauuguuugcccuacugucagacauuauuaaagaauuguuaagaggcauuuauuggaaaugucacuuuuuuuuucuuuuauccuaucuucccuuucgccaugucucuuacaugauucaugcacaaauuacuauuuuuaauuuuagaaugauguuggcuugccagccuguaauuuguauuccagcuguauuuaaaguagauuccuaaaggaaaauuuuuagcuuuuccaacacugaaacuuuuaguauuauuuauaagggaggggguuuuuuuuguuguuuuuuuuuuuuuuuuuaagauuugcuauuuuuauucaugcgugugugugcugcaugaguuuauaugcaucaccugugugcagcaguucugggaaaccuuuggaucaaauccuuugaaacuagagugacagacacuugugagccaccuaauaugggugcggggaaccaagccuaaguacccuagaggauuaagcauucuuagccaccacgucaucggucugaaccguaaggauggugcuuuugauaaacugccuuuacuaucugugauaacugagcuaaauaagcuuagauagauuuuuuuuuccuuaaauuauugguggcuguaaaaagguauaucuuccucacccugccugugugugucuguguguguguuuaguuugagcuaauuucauuuccaguuuaaguguucaagaugguucuuuucugacauuguacaagacuucuuuuuccaccagcaugaacauacugaggguauaucauauuccuguccuaacuuacuaccucggggauucuuacuugaacuagaaaagaugauuuuuagaaaagacauacaggagcugacugggagaaguauuagauuacuaccauccccuuagauacuuuaguuuaaauguacuauacuuugagauuuuucucuaaaccuuuauucauuuauauacugccccuuugguacaugcaugugugccuuuaaugaaacugguuuagcauuguguucuugauuuuucuuuuccacuaagaaacaacauaaugaauacucacauguauggcaaacuacuuauuuuuguaacuuauuuauuuguaauuuuuaaaaaaauuuauguguaugauagcuuugucugcauguauaucaacaccacauguaugugguaccuguaaaagguagaagagggcguuggauuccucugauacugaaguuacaggugguuguuagccaccaugcugaugcugggaauugaaucugggucuuuuggaagaguagucagugcucuuaaccuuuaaucaucucuacagcccuguauuuuguaacuuguaaaguuaacaugguuaccaaacuugaaggguuggauuuauaauauccauaaacuguaaaccucuuucagccuuucccaugaggaaggauuguauauaucucuccucucucauucuauuuuucaauaagcuguccuguacagauucucagcuaauacaguuuaauuguauuuagauuauuaaaguuaaaauuuuacguaauuauauuuccuuguucauauuucucaguaguaauuuaauuaaaccuagagauaauaauuuucuuaaugaauuugguuuugucaaaacugucuuauacuuuuaaagugaucaaauggacagguaaauauugcauaguuaaagacauguuuaaaucuuagaugagacgaauauauucaaagaaucgucauuuguguguguguuagacaccuuauuuaguguuuaaaacaacuaugcaucuguuauguaagagcagauguuuuuagauuuccaggaaaauuacaaagucgaaugaucuuaacagaguagcccauaucuuuucuuguguaguuuuuuccuuccauucacuuugagccuguuacuguguaaucaagaaaaaaguagaguguugauuaaaugaagagguuuuguuaaccuucugauucuuuaaaguacccuuccccacccucuugguguauuguuacuuuauaugcguggauguuuuccuugugcaccacaugugugcagcgccugcaaaggccaaaagaggguguccaguccccuggaacuagcugcacauggcuaugagccucccugucggugcugggaauagaaagagcagccacgucuccaggucuucccaaguaaucuuacagaauuaguuguagaacaauucuuagacauuuuuuuaacaucuaagauaaaaaaaaucugugauuagcuaacauaggaggauuauauaugcuaguauguuaauuuccacaaauuuaucaccuugauaaagugacuaaauaauaaugcucuugauugaacagugaauuaucaauuuucuguguacacaccacucaggaugguauaauuccccagaucucacugauacucccaaacuaauucacuucuguuagacaguaacaucauuagauacauugauaccacacuuuuuaaacuuuccuuuuaaugcaauuauaauccauuauggagagcugggaacaaaccucaaucaauggagugcauuccuacugugagugaaaguuuuauucucaauacucacccaugcauauacacacacauacacacuuuaugaaauugcucagguaaaauuaacaauuuuuagucuuuuuuuggaaaacgugauccuuagauuuaucugagaagucaaucauauuuucaguucuaguaucuaaagauuauguauugcaaacaagguaagaacuuaccuuucaagucacuuuuccuguguacuguuguauaagggugacuugugugaguauugauuaauuuucauuugccagauaguagcuagugugcuuacucaucagucaguagaaggcucugugaagacccagacauggagcuuagaacaagaugaggugcaucuagcugagggucuuggaucugaguuuaaacuugaugagacacacauaguaacugagauccaggguauuuccugucuuucuugaugagauuuuugguggagaugguggaugguaggugcuagagacugaacccagggccuugcacauuaauguauuacugauuccucuuuuucuuuucuuaaauaugacuaauuuccuggauuuauuuugagaugcugucuuacuguguuucccaggcuagucuuaaacuccuagcucagugauuuuuuuguuguuguuguuguugcuuuagcccccugagaaguaucaugcuuucacauggcugucuaaguacacuacugacagaguuuauaaauuguuuuaagaguuagaaaauauaauucacugacagauggcuuuauuaaauacacuuuuaacaaauauuuauugggugcuucuuauauuaauuaauuaguuuucuaccaaaaaauguauuuacaauuaaagcagcagauaguaaaaauaucugagggaguuuccagugcuguaaaggaaaguguuguuguaaagcaugcccuccuuggaguuuaaauaaguucaaaaagaguuuguguuuucacuuuuuauauuguuaccaugcauuauuuauuauaguacaauucauagaguauauuucucucauagaaauuggauaugguuuccuggguacacgguuacuugaauauaccaaguuuuucuuggugauauuauuuucuagaauaauuucuccuagauuaugcuuugcuaauugcauggguuuaguguauuuuaaaagucuugugugguaugaauuaaacuuguaacaauaaaauucauuggguuuuaguugccauuacccagggaggagcaauacagcuggcuaacaaugguacggaugggguacagggccugcagacauuaaccaugaccaaugcagcugccacucagccggguacuaccauucuacaguaugcacagaccacugauggacagcagauucuagugcccagcaaccaaguuguuguucaagguaauagaauuaagaauucauacauaugguacauucuuuuaaaaauuaauguguauacucaugaaaaguaaguauauuacaaagcacuacuaaaauaguuuucuucaguauagauuuagauauuaacaguuuagauaugcauguauuuaauacauaaauaucucucaugcaacuuuccacucagaugaaaaugucauggcauaaaaacaacuaucuuuuagcuuaaaagggguuuuuccugucuuuaaugccuucaguagucaggauuggaagaaccaaaauauguuagaagagaacugaggaaguuauagccaggcugaauggccucaaguaacacuagcuccccugggccccuuucuuucccuccucugugugcuaugucacuauuaaagaguucuaguggauucugcuguuuuaucuguuuugucuuguuuuuauuauuuuuaauuuaaaaggaauauagagcuuuucugaagucaucaauuuggauuuuggauaagaacaagcaucauuaugcagauccuugcucauuggagaacaaguuguccuuuagccucgguggacgagaggauuuuguuuuguuuuguuuuguuuuguuucccaaaauuucaagagucuggagaguguuaacuauucagcauuaauucacugagcaguucauaguucaauauuaccagauuaaaaauuuauagauuaaaaaaauaauauuugcuucuaaaaauauuuuauuaauaauaacuaauguugccuguguuaaugagaguuauaucccuucaccauggauaauuacuuuuggaucauaccacaacaccaaguagaacaucuuuuguuuaacaaugucuaauaaauuuauacuauauaucuuguuauuagaccaaugauauuuaaaaaauauuuugcuuauuagugggaguaaaacaccuuuucacuuuacaugcagguacucaaaaaauuguaaagcaggaugucagugaauuugaauucucaacgucaguuugaauaugguaacauguuuaguauauaaaucuuugucccucaaacgauacaaucgguguuuuuaacugauaugaaugauuuuauaaagacauucaaaaucucucacauaguauuaggguacuuaugaaagcauaucaugacacuguuucuagaagcaaauaauggacaaauagugauuuuuuuuuucacauauggagauuguauggugaggaaaacccaaacuacacgccuuuaauuccagcacuugggaggcagaggcagaggcagguggaucucuugaauucuaagccagccuggucuacauaaugaguucuagacagccagggcuacauaguaagucccugucuuagaaaacugaaaugaaaacaauucagcuuuuacuuacuuaguuuuagucacuuauauuaagauauguuuacauauaccaugauuggcagcaaauguccaguuuuucauacuuggaguuuuguuugaauuagaaauuuauaacaguuucuauaugcuuauuuuuuuucuucuauuuugcuauuuuaugaaaaaucauggucguuuuuaugucguggcaagagucuacuugaguuuuuuggguuuuguuuuaaaugugaauuuauguaaagcaagggaagauacugaggccugugugggaggacaucucugcucagcuccuuuagacuuaaagcugacaagcaugcaaaccacagacugcaucucccucccagcacaacaugaauaagacccgcagggacgcugaggcacccugccccguaccuguacuaauaaauaggacagacaauuggagucuucuucuuagauagagucccauucccuguuucccuuuuaaucuaaguauguuuagauugauugagacacaguugaauuaaauuguaguguuucugugucuuauaccuuguucgcucuucucugcagcugccucaggcgauguacaaacauaccagauccgcacagcacccacgagcaccauugccccuggaguuguuauggcguccuccccagcacuuccuacacagccugcugaagaagcagcacggaagagagagguccgucuaaugaagaacagguacagauuccaaacacuuaaaugcuaugggucaaguaugucuauaaacucuucugugugugccuuuacaucugcuaacaguagguucugugcauugauuuucuuuuucugguagaauuaguggaucuugcuaaagcuucuuuguuuauuaaguugcauuuauaagauggcuaauggaacuuuaggucagucuucaaucaaaaaaguaauuuuucuucauaguuuuuccacaagagaaauacauagcuuuaaugaauuuguacuuuauucuagcuaauaggauauguuaauuaaaaaaauuuguaaguaauauucaucaaagugucacauauguauacuaacauuagacucuaguuuauuugcauuaaauuuauuuauaacaaguauacaguagccauuuuuguuuuaaugaauacuuucuuuugcauuuuuauacacuuacagauuuauuuaugcauguuuuaugcauaugugucaaugccuacauguauguauauguaccacauucauaccacaaagggcagaagaaugcauuagaucucuuggaacuagagugagagggguuggucagccaccugccuuguucuuuguuuggggucagagucuugcugugugggccaaaguugccuggagcucuuauccucccgccucugggagugagugcuggaaucacaaccuugggccuggccuuaggggcaggggcuuucuuuacucaguaauaacuuaacauccaaacacuuuuaaaacagagaaauucuaaaaaguaugguauucccgacaaagccuuaaugcacaguuaauguuagucuuaagaaguuaaagugguacagaagagaagcuauaaaacacagguaaagccuuucuuagaaauuuauuugcuuucaaauguuuuugccaucuuaaaaaaaaggaaguuauuaauguggaaaugaucaaaacaaaacaaaacaaauggucugaggaggccaucguugguuaauguguucaccauccaagcaagaacacuggaguucagauccccagaacccauauaaaauucuugguagggcccuguaauuccucugauggcacaggugggguuuucaggguaagcuugucuguaagcucuggguugaagaaaccaugacucaagaguaagcgaaaaagcaacauuagggaagauagccugcacacacauaaaacaugugaguaaacaucaaggggcuauaaugggggagggaggugaaaacuaaaagagaaucaagguguauagagauguaaacuauuuaaauucuucuuuuuaccccaagaguguaagaacuaugauaaaguaaaugagacagaaauugaacuuagcagaucuaacuucaauuccugcauucacccuuuagcuaugacucuggaagaauacauuaauuuccuaaacuuggguuucuaccuuugaguaaaauaagaucucuccuugcacccaaagcuuggcucucagggucagguaagacagcacauggcaucucuacugcuccuucucuuccaacaauuuuauuuuugguaggucagcaucauuguuccugaaauagucuuaacugucacagucuuaguaaauuauaucuagcuaugaaaaaggagaaacccauucugagauaguaagggaaucuugaaaagaagcccugugaccuuuauugugcaccaaacuguagucuccccucccccagccugaaaccugcuugcucagggguggagcuucccacucaaucguucugccacgcccacugcuggaccugcggcuuugcuguuuggagccgugcacguggucacccugcuauuugaccccaagacuaauuggcgggaaucgggcccccuuccccugcuucauaacugcguguagaacaguaaaauagaacuuugaucagaaugccugucuuagcugcauuucuuuaucucgccaccuaguccucuucucuuccagguuuccaaaaugccuuuccaggcuagaacccauguugugaucugcuggccggacacaacaccaaacaacuauaaguaguuaagauauaauagaaauguacugccuaacucuuauuuaaauguuauuuggaaauacgaauuaaguuacacauuaaucuguucaguuuuaaaguauuuguuaagaaauaguugaccuuuucuaaaauaagaaagaaugguguuuaagaugucucaaguaaagaucuaauuguaaaauuucagacagcagcacuuacuaaagaaacaauucuaaggggacagaguaaucagaauguuuuuuaaggacuugaaaucauggcugcauacuuuggcucuguagagugaaggcucaucucuuacagagaaccucagagaggugugggaccaugugcaggggcagcaccagcuccuuucuuccucccuuccuugcaguacuggggauuguccugagggccuguucauaguagacaggcgcccuaccacugauuuagacucaacccagccuuuuuacaauuuuuaaaacuuccagacaggguguugcuguuacccagguugaucugaauucacucugagauccgguggcacauuacccaucccuaccucaucucuggaauccugaagcaaagcuuaguuucaauaaaaaagagccaggcuacuuuuuccagucuuucugucucagcuuccugaguagcugagauuacaaccugugccagccaagccuacucauauuacaccuucuuagcugcccagagcauugccugcuuauaaacacuuguuagguuuaccaguaggcacaaugcugcuuuuucuccacuucucaguguucugaaagucacucugacagaauccccgagaaaccaacuuaaagaagaaaaguuuuaaaagacgcucaguuucagcacuccaugguuacugggcaccauugauuuuggucucauggugaggcagaacaucauggccaggagccugcaguggaacagaguggcucacguuuuagcagacuagaggcagagaaagaaaaacaugucuggagagacugguaguggaucucacacaauggaaagaaaguaacucuccaaaauuguccucuguuccccuucugugugcuuuggggugugugugugugugugugugugugagugugaguguguguguguucccccuaguuaucuucccuggacacacaaaaauaaguaaauguaaaagguugguaauguaggaaugauagacaacacucaucgaccucugguuuccacaagcauauguaccuguacagaccugcacauuacacaagcuuagaccacacugauaggaaugagugaauguaaguuguuuuuaagugauuggaaauuauggccuagucuucaagggcauaacuuauugacccacuucucuucagcuaaguucuaucucccaaguuuuccgauaccuuccuaugcaauugugaacguauccauggauuaacccguaagugaggcgaagguccucauaacucacaacauugcuuuuauucauagccaagccuuuucaggaacacuccauugaaaccauaggccacucuacuacugucacuaccuccaaaccacaccagguuaggaaggcaggucauuuuuuuuuuuuaaucauaaucuucucagaugguuuauuuuugcuuggaaacaucaucaaaaggauaaauaguguacauaaaauuuaaaaacaagaucuuccauuuaggaagucaacuaguauuuuauuuaugaauuuucagggaggaaagucacauuguaaaaugauauuuuacaucuucaagugucccaggaguagaugaaaaaccacgcuguccaagauggccauccuuaguuugccugcugugaggauauauacuguugcuggccccaacuaacagcuguguaucagcacacaccagauuuccacaauugggacaaaauaaaagaguacaauauccaaauaauuuuauauuaacugugcauuaaaaugauaauacuuuaggauaaaugagguuaaguaaaauucauuucaaauaaauuuuguuucucuuuaaguguauaaucaaauauauguaucuaauauucagcguacaaagcaaaaagauacuauuuuauuauguauuguugacauauaaaugggcuucagaaucuaugcuuuaaaaaaacaaacaugaacaaagaaaggucaugaacugcagggcaguucccugggaauucauacaaaaccaguguuugcucugauggauacugacgcaguauuaacuucaucauuuacugugcaugaaggcagggcagauggugagacagcuguggcagacgguuuaaagaucaauaaacacacaucuaacuuuguaucucuuaucucuuguccuuaauggaagguaaacagugauaugcgugcaagcgugccgugggugcgugcgugcgugcgugcgugcgugcgugcgugugugugugugugugugugugugugugugugugcuauguaugugcuucuugguguguucacaugcacacauacacgcacgcagcucaagguuuccaagaggaaaugaaaagggcuaacuaaacaggaaggcaguuguuaagauaguugcuuacaagaggucuacaaagcugccugauuacaagcagggacuguaauaagaugcuuuugcuuagauuuaguuacugucugucaaagggaaguugcccauacucugaaguaguucucuuuccucuacccagggaacuuuuuaagcuuuccuagaaucuggcuucuuaccauaucacuuacaugugccuagaaaaguacaggcuuucccauaccccuggcaagucuagcauacucuucucaguuauuucuaccucugugguuagccaacuuuugaauguucaguauccuaagcuucccugguuuauucuaaguuacaguguguauuagacacuagccuucacacgcagucugucucuuauagccaaauaagaucuuuuuccacuuugcagaagagaaagaagguaaauaccagagaaaagcuaaauagcagucagauguccgguaucuuagguaaaaagccugaaagacaguuugacccugugucuaaugacaagucuccugagcuuguuucacccugcugugccucuaagcagaguaaaacacacuguugucaggauacauagccccaggaaauaacuguagaaugcuuuccugggauguccauuuugcucagagucaagagaaacaaacucuaauuuuaagaggaaguaaauucaaaagacauuaguacuguaguaguugcuuuaagcuguaucuccagaaucaccuaccauauuggugucauuauuacuguaagucuucaguagacaaguuagagcaucauugaccacaauaagugacccucguguacauugaucacagcccaucucacacugaacuuggggaggugguuugaggaaccccaaaauucuauugugugagaguugucaauuauuccaaagugaagauaauuggcauacauuuuguguuacuauagcaacagucauaaaaucucagcaucuuggaacagcaugaccucuuccucucauuauaaguuguacauugucaguuccaagucaguugcuguggcuugucuucauaucucaucgucauugccaguugcuuccuggauccccacugaguaagagcagcauguucaagacauagccuuucuauggcaaauggggaaggcacagggccugagcguaagauccaaccauuuuuuucaggagcuggcucuccgcuucuaccuuguuuugaggcaugucucauuucugccacugcacugcauuagggcugcuguaguacagauccagcuuugugugugcaaugaaacaguuaggcuuguucagugugcgcuuucaugcccugagacaucucccaaccuacauaugcuuuggcucacuauguccauuuguguccacuggcuacaacucugggaaggcaagcccaagucagugggcugugcauggggauucuuuccacagagaggauugugagaguaauacaguuugcugcccuuacuuuuagauagccuacaguguagaggggccuuaaauaggguuuccaaagaugaaguuaauaaaccguuaaauagauuucacacuaaauuuaaaaaccuuacuucagugaagaacaaaagaaaaauagcaaaguaaacauuaaacugggggauuagaguugaggauauggauuggcagauuuacagaaaaugaauauguucuugaguuucauguguuucccaaauuguaucuuauaucuuggguauucuaaguuucugggcuaauauacacuuaccacugagaacauaucauaugaguucuuuugugauuggguuaccucacacaggaugaugcccuccaggucaaaccauuugccuaggaauuucauaaauucauucuuuuugguagcugguaguacuccauuguguaaauguaccacauuuucuguauccauuccucuguugaggggcaucuggguucuuuccagcuucuggcuauuauaaauaaggcugcuaugaacauaguggagcauguguccuuauuacaugcuggaacaucuucuggauauaugcccaggagagguauugcgggauccuccgguaguacuauguccaauuuucugaggaaccgccagacggauuuccagagugguuguacaagccugcaaucccaccaacaauggaggaguguuccucuuucuccacauccucgucagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccaauuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauuggucuauuugucugucauuauaccaguaccaugcaguuuuuaucacaauugcucuguaguaaagcuuuaggucaggcauggugauuccaccagagguucuuuuauccuugagaagaguuguugcucuccuagguuuuuuguuauuacagaugaauuugcagauuguccuuucuaauucguugaagaauugaguuggaauuuugauggggauugaauugaaucuguagauugcuuuuggcaagguagccauuuuuacuauauugauccugccaauccaugagcaugggagaucuuuccaucuucugaaaucuuuuuuaauuucuuucuucagagacuugaaguucuuaucauacagaucuuucacuuccuuaguuagagucacgccaagguauuuuauauuauuuuugacuauuaagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuucuuccuuuccaauuuguauccccuugaucuccuuauauugucgaauuccucuggcuaggacuucaaguacaauguugaauagguagggagaaagugggcagccuugucuagucccugauuuuagugggauggcuucuagcuucucaccauuuacuuugauguuggcuacugguuuacuguagauugcuuuuauaauguuuagguaugggccuugaauuccugauauuuccaagacuuuuaucaugaauggguguuggaucuugucaaaugcuuuuucugcaucuaacgagaugaucaugugguuuuugucuuugaguuuguuuauauaauggauuacguugauggauuucuguauauuaaaccaucccugcaucccuagaauaaaaccuacuuggucaggauggaugauuguuuuaauguguucuuggauucgguuagcaagaacuuuauugaggauuuuugcaucgauauucauaagggaaaucggucugaaguucucuaucuuuguuagaucuuucugugguuuagguaucagaguaauuguggcuucauagaaugaguuggguagaguaccuucuacuucuauuuuguggaauagucugugcagaacuggaauuagaucuuauuugaaggucugauagaacucugcacuaaacccauaugguccugggcuuuuuuugguugggagacuguaaaugacugcuucuauuacuuuaggggauaugggacuguuuagaucguuaacuugauccugauuuaacuuugguaccugauauuugucuagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucccugugcccucuagugagucuggcuaaggguuuaucuaucuuguugauuuucucaaagaaccagcuccucguuugguugauucuuugaauaguucuucuuguuuccacuugguuaauuucgccccgaguuugauuauuuccugccgucuacuccucuugggugaauuugcuuacuuuuuuucuagagcuuuuagguguguugucaagcugcuagugugugcucucucuaguuucuuuuuggaggcacucagagcuaugaguuucccucuuagaaaugcuuucauugugucccauagguuuggguauguugaggcuucauuuucauuaaacucuaaaaagucuuuaauuucuuucuuuauuccuuccuugaccaacguaucauugagaagaguguuguucaguuuccacgugaauguuggcuuuccauuauuuguguuguuauugaagaucagccuuaguccaugguggucugauaggaugcaugggacaauuucaauauuuuuguaucuguugaggccuguuuugugaccaauuauauggucaguuuuggagaagguaccaugaggugcugagaagaagguauauccuuuuguuuuaggauaaaauguucuguagauaucuguuaaguccauuuguuucauaacuucuguuaguuucacugugucccuguuuaguuucuguuuccacgaucuguccauugaugaaagugggguguugaagucucccacuauuauugugugaggugcaaugugugcuuugagcuuuacuaaaguuucuuuaaugaauguggcuauccuugcauuuggagcauauauauucagaauugagaguuccucuuggaggauuuuaccuuugaugaguaugaagugucccuccuugucuuuuuugauaacuuuggguuggaagucgauuuuauucgauauuagaaugucuacuccagcuuauaucuucagaccauuugcuuggaaaauuguuuuccagcuuucauucugagguagugucugucuuuugcccugggauggguuuccuguaagcagcaaaauguuggguccuguuuguguagccagucuguuagucuaugucuuuuuuauuggggaauugaguccauugauauuaagagauauuaagaaaaguaauuguugcuuccuauuauuuuuguuguuagaguuggcauucuguucuuguggcugucuucuuuuagguuuguugaaggauuacuuucuugcuuuuucuagggcgugguuuccguccuuuuauugguuuuuuucuguuauuaucuuuugaaaggcuggauucguggaaagauaaugugugaauuugguuuuuucaugaaauacuuugguuucuccaucuaugguaauugagaguuuggcuggguauaguagccugggcuugcguuuguguucucuuagugucuguauaacaucuguccaggaucuucuggcuuucauagucucuggugaaaagucugguguaauucugauaggccuuccuuuauguuacuugaccuuucucccuuacugcuuuuaauauucuaucuuuauuuagugcauuuguuguucugauuauuaugugucgggaggacuuucuuuucugguccagucuauuuggaguucuguaggcuucuugugugcucgugggcaugucuuucuuuagguuuaggaaguuuucuuccauaauuuuguugaagauauuugcuggcccuuuaguugaaaaucuucauucucaucuacuccuauuguccguagguuuggucuucucauuguguccuggauuuccuggauguuuugaguuaggaucuuuuugcguuuuguauuuucuuugauuguugugccgauguucuccauggaaucuucugcaccugagauucucucuuccaucucuuguauucuguugcugauguucgcaucuaugguuccagauuucuuuccuaggguuucuaucuccagcguugccucacuuuggguuuucuuuauugugucuacuucccuuuuuaggucuuggaugguuuuauucaguuccaucaccuguuuggucguguuuuccugcaauucuuuaaggccaggaauguugcccuucccuucauugcuuuaaaccuuacucaaccacgguguggugggcuccuguaaucccagcacucaggccagacaggacugaaauuuugaggccaaccaggucuacucagcaagacuuugagacagaacaggcuguugugcacauaaugcccccauuucuuguuucucccagccagcuguguuccuucuuccaugucuguaccacauaguaaggaugugcaaggaauagaucucugcuucuauuacaaaugguugccuguaaaauugcucauuuuuucauguuuuacaaaacuagaauauuuuuacuuucuauugcuaggauuauugaacuauagauagagcuuuugaguuuaugaguuuguuuugaagcuugccgaauaauaaauuuuuauucuuuuaauuuguuaagauuuuucaaccucccuuuuaauccuuaaaaaaaaaagcagaauuucuaucuugaccauuuuuaaguguacaguuccgaaauacuauauauauccccaucaugguuuaauagauuuccagaacauuuuuaucuugcaaaacacucaaccugauagucaugcuuauaauucauguggacacuacccacgaaacugaguauguaguauggaaucauaucucaaaacaagaacccccaaacucucucuguauucgacaguucuccacuaaccccauuccaaucuuucggcaaacgcauccaguccuauaaaauuuuauucuaacaaacucuuagaagcagaauucuacaguuuuguuuuuuaugacuagcuuacuucacaaagcaauauccacauuauagcauauaccaaaguuuucuucauuuuaaaggccauguaacauuucauugucuguaagcacuuuguuuucuuuuuuuucuauuuuuuuaagauuuauuuauuuauuauauauaaguccacuauagcugucuucagacacucuagaagagggcaucagaucucauuacggauggugugagccaccauaugguugcugggauuugaacuugggaccuuuagaaagucaguccgugcucuuaaccugaaccaucucuccagacccgcacuuuguuuucuucauccauuugucaagggacacuuggauugcuuuuguacaucuugaauauugugaagagugcuagagacacagguauacaaagauuucuuuuaaaucuagugaaauugaugaauuguauugcuuaauucuauucauaauguucuacacacacacacaacacccacccacccacccaccauucuguuuggucaaucuuggcagaaauugggccuuuuguaaaugugaugcauucuacagauuugcuccacuguagcagcaauuauagauaaaacugugcuagagccgggcaguaguggcacaggccuuuagucccagcacuugggaggcagagacagguggauuucugaguucaaggcuagccuggucuacagagugagcuccaggacagccaggguuacuucugaacguauaagccagccccaaauaauuguuuuccuuuauaagaguugccuuggccucugggucuguucacagcaguacaaccuaaaacagcuauuaggacauuucagaauuaaugauaaggauaaaugugguagaguaacccugucucgaggggcagguugggggggguggggggugcugugcuaguuucuuuucauccuuucaguuauuucuuaagauagugauuaucauuuuuaguauggccauccuaauaguugugaaguacuaucuugugguuuugauuuucaucccccuagugauugauauugagcaccuuuucaugugccuguuggcuaucuguacaucaucuaagucugcuaaaauuguguguguguguguguguguguguguguguguguguguguguguguguuccuuugcuugaugucaggugucuucuuuaaucauucuucacauuuuuugugaaaaguuucucauugaaccuggagccuugcaguuagcuagaauggcucccuggcaagccccagggaccugccuuucacugcuuccucuucacaggauuacaggcuugcaccucgcauugguggggaucagacucaggcgccaucucccagccagugcuuauuuucuaaacugcuuauuuuauugucaaauuguaauuauucuuaacuaguuaucaucuauuauucaaaaauagucucauuuuagucugccuuuuuacugaucauuguaucuuuaacguacagaaacuuuuuaaauguggugaauccucauugucuguuuugaccguuuacagugcuguacacaagaaaucacugcgaagcaaaauucagaacuauuuuguuguaaaaguguuacacauuuaggucucauauuuagauccuugauccauuaugaguuaaauuuugcauaugguaaauggcaagggaaaaacuucauuauuuuaccuguggagauccaauuuuccuaacagcauuuauuuauuuuuauucuuugaauguagauguuacuguaaguauguauacacuugcauaugcauuuguguggugggcuaaggguagcaucaggacuuuucuuuaauuacuauuuaacuugcucuuaauauugauuuauuuuuauaauguauauaagcauugcuuguauuaauucauuuuuauaauguauauaaguguauuaauugcauaucugucugcaaaccauaguguguguagugucuauagaggccagaaaagagugucagauccucuggaacuagaguaaauaggcaugacgugggagcugggaauaaaaccuggguccuuuggaagagcaacaagugcuucugaccacugcaccauuucucuagccccuccaacguugauuguggauuguuguucuuguuguuuucccuuuuacuggaauagauguuuucgcacauauauauccuuauuaguuuccccucccccuacuccuuccaguuccuucccacuucccuucccuuccggauccacucccuuucuguuucucauuagaaaacaagcaggaaacuuuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaaaaguaaagaaaaaaaaaagaaaacaagcaggauuaugaaggauuauaauaaaauaaaauauaagauuaaaaaaauaacauaccagaauuggacaaaacaaauggaaaagaguccaagagaaggcacaauaaaucucauucacacauucgggguuucuauagacucauaacauauaugcagaggacuuggaacauagcuaugcagacccugugcauacagcaucaaucucaaugaguacauaccauguguguucuuuugugacugggcuaccccacucgggaugauauuucuagguccauccauuugccugcaaauuucaugaagucauuguuuuuaauagcugaguaauauuauauuguguaaauguaccacauuuucuguauccguuccucuguugagggacaucuggauauuuccagcuacuagcuauuauaaauaaggcugcuaugaauauaguggagcauguaucguuguuauauguuggagcaucuuuuggguauaugcccaggagugguaagcuggguccucaggaagugcuauguccaauuuucugaggaacugccagacugauuuccagagugauuguaacagcuugcaaucccaccaacaauggaggaguguuccuuuuucuccacauccucgccagcaucugcugucaccugaauuuuugaucuuagccauucugaguggugugagguggaaucucaggauuguuuugauuugcauuucccugaugacuaaggauguugaacauuucuuuaggugcuucuugaccauucgagauucuuuaguugagaauucuuuguuuagcucuguaccucauuuuuaauaggguuauuugguucuccagagucuaacuuauugaguucuuuauauauauuggacauuagccuucugucagauguagaauagguaaaaaccuuuccccaaucuguacguugccauuuuguucugacaguguccuuugccuuacagaagcuuugcaauuuuaugaggucccauuugucuauaauucauuuuagagccugggccauuaguguucuauugagaaauuccccccugugccgauauauucaaggcucuuuccugcuuucucuuuuaauagauucaguauaucugguuuuauguggaggucuuugauucacuuggacuugaacuuuguacaaggacauaacagugggucaauuugcauucuucuacauguugacugccaguuggaccagcaccauuccauuuguugaaaaugcugucuuuuuuccacugaauggcuuuagcuucuuugucaaauaucaaggucuauggguucauuucugggucuucaauucuauuccauugaucuaccugccugucacuguaccaauacuaugagguuuuuaucacuguugcucuguaguagagcuugaggucagggauagugauuuccccagaaguuuucuuauuguugagaauguuuuuucacuauccuggguuucuuguuauuccaaaugaauuugagaauugcucucucuaucucagaaaaauugaauuggaauuuucauagggauugcauugaaucuauagaugacuuuugguaagguggccauuuuuacuauguuaauccugccaaugcaugagcauaggagaucuuuccaucuucugaggucuucauuuucuuucuucagagacuugaaguuuuugucauacagaucuuucacuugcuugguuagagucccaccaguauauuuuauauuauuugugacuauugugaaggguguuauuucccuaauuucuugcucagccagcuuauucuuugaguagaaaaaggcuacugauuuguuugaguaaauuuuauauccagacacuuugcugaaguaguuuaucagcugaaggaguuuucuggugcaauuuuugaggucacuuaaguauacuaucugcaaauagugauguguugacuucuuccuuucuaauuuguaucccuuugacauccuuuuguugcuugauugcucuggcuagaacuucaaguacuauauugaguacauagggagagagugggcagcuuugucuagucccugauuuuaauggaauugcuucaaguuucucuccauuuaguuugauguuggcuacuaguuugcuguauguugcuuuuacuaucuuuagguauggaccuugaauuccugaucuuuccaagacuuuuaacaugaagggcugucaaauuuuguaaaauccuuuuucagcaucuaaugagauuuuuuucuuugaguuaguuuauauaguguauuauauugaugaauuucuguuuauugaaccaugcuuacaucccauuaaaaugaagccuacuugaucauggugagugaucauuuugauguguucuuggauucgguuugugagaauuuuauugaguauuuuugcauuguuaugcauaaaggaaauuggucugaaguucucuuucuuuguugggucuuugugugguuuugguaucaguguguaacuguggcuucauagaaugaauuagguaguguuccuucuguuucuauuuuguggaaaaguuugaaaaguauagguaguaggucuucuuugaagaucugauagaacucugcacuaaaaccaucuggucuuggguucauuuuuugguugggagacuuuuaaugacuguuucuauuagggguuaugggacuguuuagaugguuuaucugauccugauuuaacuuuggcaccugguaucugucuagaaaauuguccauuucacccagguuuuccaguuuuguugaguauaggcuuuuguaauaggaucugauuuuuuuuuuuaauuucuuugguuucuguuguuaugucuccuuuucauuucugauuuuguuaauuuagauacugucucugugcccucugguuagucuggcuaaggguuuaucuaucuuguugauuuuucucaaagaaccagcuccugguuuggcugauucuuuguauaguucuuuuuguuuccacuugguugauuucagcccugaguuugauuauuuucugccagauuauuuccugccuucuacuccucuugggugaauuugcuuccuuuucuucuagaccuuuuagguguguugucaagcugcgaaugugugcucucucuaguuucuuuuuggaggcacucagagcuaugaguuuuccucuuaguacugcuuucauugugucccauagguuuggguauguugugccuucauuuucauuaaauucuagaaagucuuuuauuucugccuuuauuucucuccugaccaaauugugauugaauagagaguuguucagcuuccauguguaugugggcuuucugguguuuuguuuuguuuuguuuuguuuuguuuuguuuuguuuuguuauugaagaccaaccuuagucccuggcaaucugaugggaugcaugggauuauuucaguauuuuuauaucuguugaggccuguuuugugaccaauuauauggucaguuuuggauaagguaccauaagaugcugagaagacaguauauugauuguuuguuuuaggaugaaauguccaauagauaucuauuaaacccauucaguucauaacuucuguucauugcauuguuucucuauguaguuucuuagacaugucauagaugauaguuucaucaucuaugguaauugagaguuuuguuggguauaguagucugggcugacauuuuguucuguuagggucuguaugacaacugcucaagaucuucugacuuucauagucucuggugagaagucugguguaauucugauaggucugccuucauauguuacuugaccuuuuucccuuauugcuuuuaauauucuuucuuuguuuugugcauuugguguuuugauuauuaucugacaggaggaauuuuuuucugauccaaucuauuuaggacucuaucaucuucuuauauguuuauggucaucucuuucuuuaggaaaguuuuauucuauaauuuuguugaacuuguuuacuggcccuuuugacuugggaaucuuugcuuucuucuaugccuguuauccuucgguuuggucuucucauuguguccuggauuuccuggauguuuuugguuaggaucuuuuugcauuuucuuugacuguugugucaagguugagacucuuucuucuaucucuugucuucugucggugaugcuugcaucuaugaauccugaucucuuuccuagguguguuuuguguuuuuugguugguugguugguugguugguugguugguugguuugguuuuuuuguuuuucgagacaggauuucucuguauagcccuggcuguccuggaacucacuuuguagaccaggcuggccucgaacucagaaaucugccugccucugccucccaagugcugggauuaaaggcgugcgccaccacgcccagcuucuccuagguuuucuaacaccagggcugucucccuuugugauuucuuuauuguuucuauucccauuuuuagauccugaauaaccauguucaauuccuuuaccuguuugguuauguuuucuuguguuucuuuaugggauuuauguguuuccucuuuaagagcuucuaccuguuugcuuguguucuccuguauuucuuuaagagaguuauuucuguccaucuuaaaguccacuaucauuaucaugagaugugauuuuaaaucagaaucuugcuuuuucagguguguugggguauccaaggcuugcuguggugggagaacuggguucuaauaauaucaagucgucuugguuucuguugcuuauguucuuguacuugccucuugccaucugguuaucucugguguuaguggucuugcugucucugacuggagcuuguucuccuggcuuguuagcacuccugggagaugaggggcaggauuugggugcagauagcucuguggcacagggucagcuccagggcgcagauggaaaccucuagaaggauccuguccccagcugcaccaugguuccuggguccugugggcucugguugggucucauaggucucagcugugaucuuaugugugucagcacucgugggagauucgcuuucucgggucgggacuggggagcagauaguuuuggcacagggucaacuccaggucccauauggaaaccaaugaucuggguuucuuauccuuccuguccgacuguuauuuuuagauuuuguggugucccguauuucuaggaugucuuuugccaggaauuuuuagauuuaacauuuuccuugauugaucaauuucuucuguccugucuucaaaaccagagauuaccucaucaucuuugcauucuguucaugugacuugcuucugugauuccuguucaaguuuuaaagguuuuauuugcagaguguccucagcuuggguuccuuuauucuguuugcacuuucagacuuugaguuguuuuaucccuuccaucccacugcuuguugugacuucaugggagucuuuaagggauuuguucauuucuucuuuaaggcccucuaucauauuaauaaaggcuauuuuaaaaucgguuucuuguuuucggcucuguugcaauacucaaggccugcucugguaaguuugcugagcccugcuggauacauuguccuagcuguuacuauuuuuaugcugacaucuaggcaucugguuugagaagaauguaauucuagguguugauaucagaucuuguguuugugagcaugauuuauuccuugguuucuguugcucucugguucuuuggagaaugugguuacucucuguuguuacucuuuguugucuggugggacauucuucugggaucucacacacaguugaucuaugaugguccuggagguggggugcacagggaagagcaaagcaggguguuccaccaggaucugcucagaccccugggagugaggccagagugagaaguuacaaguagucuucuacagaguuggggaugagacucggggacagacuuggaggaauacaggaagaggugaggagaugggcgcaggagguggcacagaggccucagagguaaucuacauagcuauggaugugacuggggaauugguuuuggaggagagaaaauauaggugaagaucggaaauuagucugccuguuucccuggugagaguggcaugcagauuccuagggagucccuguuggaguuggggucugagauaaggcaacgaguugggggggccggaggagggagguuagagguguucaaggaagaaaccucugcaggugacacgggauuggauuuggagggacagagggaaaaaaagagaagaucuccacuuagccuccauccuucccaccaacuuccauuuuugaaagucuuucauuaaaucuggagcucaaggauugagguaggcuuuauggccaguucauuccauggagcuuucugccuucugucugagcccguugugggcuuuuaucagggugcuaagcaucugaauccaguccacugcuugugcguugguacuuuaccuacugagcuauuuuuagguaguuggaaaagauacauuuuuuaccuagugcguguacacaugcaugggagcagauaaguaaagaagaagcaguagguucucaccaucagccaugugggguucaggggcugcgcucagauuguccagcuuagcagcaaggggcauuaccagugugcugccgcaucaggcaaugccaguaucauuuccugagcauuucuuguauaauacugaacguuugcuuauuucagcuguuucucuagaaaacauucuguucuaaaauuaguggaauggaguuuaugaacauaaauuuuuuuguguuuuucauuuuuagggaggcagcaagagaaugucguagaaagaagaaagaauaugugaaauguuuagagaacagaguggcagugcuugaaaaccaaaacaaaacauugauugaggagcuaaaagcacuuaaggaccuuuacugccacaaaucagauuaauuugggauuuaaguucucuccuguuacgguggagaauggacuggcuuggccacaaccagaaagacaaguaaacauuuauuuucuaaacauuucuuuuuuucuaugcgcaaaacugccugaaagcaacuacagaauuucauucauuucugcuuuugcauuaaacugugaauguuccaaaaacuacuuccacuucugcccucaagaaaugugcagcgccaggaaucaugaagagacuucugcccuccgucuccaccacccucaagaaguaaucauuugcuuauuuguaaauuguugggggaaaugaggaaaaugaaaucuuggcuuucuuauuuuuguuuuagguuuguuuuguuuguuuucuuauuaaugacuucaagguuuguugagcuccaugauugccuuagggacaguuacccagccugcugagcugacguaaugugugggccacacaggaaaguaaggaaggugcaaugaagaaguguugacugccaaauuaauguuuuuacacuuucauugugaauuaugucgaacuauuaaaaacauccuuuaaauaaggauauuagugugguguugggaguaaacuuuauauguauguuccuuucuucagcacugacaaguuguccuuggugcugagaagcacgguauuggcuacaguuccucuguagggcaguuguugcuucuucauucaguucuguguguucagcaguuugaauacauuaacagaaguaaccaacugaauggaaagcaugguuuugaauuuugaguuaaguuaaaaucauacuauaaagcuuauucuggugaguacuaagucuuaaugaguaggugcuggccaggaagcuaacuccuugaguuauacaauaagguguuuaauaaauaaagacuuuuguccuugcuuuccgaauccucauacugucacucauuuaccuaguccacugcugcauuuacacugugcagccaacaggagcguuuucaagauguccagccaaagugauggaaaguacuaaauagacaaccuuuucuauagucauauuuuuaucagagaaucucuugggauuuuuuuuuuuaaaucaaagaaguuacaaggaugugauucuaaaacauuguguuaaaugcacacaagaaaaguaauuuccuucagacauuggagugugugcuaugguacaauauuuggcaaacacuuuuuuuuuucuccuaaaaaaggugguacugcuuuaacuauccaaaagcuguucuguuucugaagauguuucuacuuacauccuuaccuauagucuacauuuauguguaacauuguuucugauaagacuuaguaauaacucauuuuuuuuuuauuaaaccuaauaaaaucuaagaguuaccucuuuaaaagacaaauaugaggacaguggaggcuggcauguuagguuacuucacguuugaggaagaacucagacucagaagagugucuuauauuugcuuugggauauuaagaaaguuaauauuaauaucaguauacguaugagcgggaacuguuuggcccauuucuaagcuaagacuagguugcuaucuguaaauguucuacguuguuuauaacaaaccauugucuuuuuucaaggaugaacaguuugugaaggacaugauucuaggaguugagugauguaauaauccuucugucuggacaguucaccagauucuccagaaggcuuucaaacggcuaaaguuugaucuuuguccugcugagcuugcugggaaggagauagcauaaaagcugucugugcuagcaaguagauguaucauuugcuaaacguggugaaacaaaaaggaagcagaaucacaaaucugucaacaaacuggaauuacuucacauuaagucagaaugucagauugaacauuuuaaaugucacaaguggaaaauuugccuagcgugcagaaguuguaaucucuaagugucuaucuucaaaagucgagguuuucuacauaaugaggaaacagguggucuccuuaacccuuuagagaccaaggcagucucagccauacuuccuaguuggauggauauuaauuuacagaggccugggucuuuaugcuuggagcaugacuguacuaguuugacaccaguuacuugauaaugugagaaauauaugguguugugaaaccugacuuugaaauuucaguucauacagaaagaaaucaaagccucuuuaaugcaagcuggauuuuuuuuuuaacaugagaaugagaaaaacaaaaacaaaaacuuguuuuugagcuauguggagaaucuuuauuaagaaaaugacauaauuuuuuaaaaacucuuauauccaaaauuguauguggccacauuaucgguaauguuuucucuucauguuggccaaaagggaauggaacugucauaggaaucuguacauaugcuacugauuugccuagagaauagaaguuugguacugcucacuuugcauauauauaguggcacuuuuaucuauagggcagauuaacucuaauaaaaaugaaauggggauagguuuauuuuugauauauuacucuucugaguuuucaagcuuugauaguguuuaacugaaaaaugguuuagaaagggcuagauccaauauguucauauuuaaaaaauugauaugagauacaauuuaaguucuuuaucaaaagcaaguaccauauuagcaaccaucauauuguccuaggugcugugcuuguuuagaugguauaguguggguggggacguggcauuuuguaauauauguguacauauauacauacauacaguauaucaucuaaaugcucugagagcugguaugucaggaaugcugaguauuauagcguauugagguccggugagauuccacuuugcugugcuuucuccugcaucucuucugguguuucagugacuguuuuacuccagcacucacaacuggguuuucucuuuucuuccaguuuuuuauuagguuuuuguuuuguuuggcuugaugcuuuugaguauguuaccagucacuuaaaaacuccuaaaccccaagcucuuuucccccugcuuuguuucuggcagcuauaaaauugguaagaacauuuugaaaaaagguuuuaagagaauuguuucaagaaucauuuugggcaaagacuuuucauguuucauuugaacagggauuuuugucaagauguguuuugaugguaggccagcaagcagugcuacugucuaaagcacaaaccagucaggcaggcuguccagccagaagcccucuuggcugaagccggucucugccucucaggacuccucccuacuauuuucgaccauuuagggugacauggaaucauacaaauauuggggcuuagaaacaaacauuuauauaacccggaaugcuuuuacguacuugaagugacuucagucaaaauguugccuuuccuguuuaggaagcuuugguucucuguugacucgucagcuaguaacacaaaucgguuucucuaccaauagcugcuucauuuucaguuccuuccagaggcuuuuguucugccuuuguaacacugaaacucuggauuggcacagcaucccggggcccaguacacaggcuguauguugacuugagguuguauuuacaguaguucuuuguaaagguuugcuguaacuugcacuuuuuuuuaaggacccaguuuggguaucagcaacuugggaaauuccuuaucaaugaguucucagcugacccuuuugucuuccuccuucaaaucaugacuccuuaauggaagcguuucauugaucacaguaucauagcuagccuuaagcauguuauaaaagcuaaauaucugggaauuagguuugacuaauagugaaggaaaaauaaguacuuauaauuuuaaauuucauccuccaacuuuaguucuauguagagcaugccaaaaguuuuuuuucagaagauuacaaaccuuguuaaagcaauuaauuuguugucaucaugggaaaccauguaaucgauguuacuaaaucauuuuaauuuggcuuuguuaacuuccgagaaaugcugccuaaacguaacugguuucugacugcgggggaguacaguaugcuuuguuaggccuguaggugacucauucuagaauaaacguguucacugagauguacaaagcacaacuagaguuuuggguggcuugugugugucuugauuacuuucaauguuaauguugacuuuuuaaguuaacagucacuguuauguacuaggaacugguuuccuugacuuucuagaaucaauggccaagagaggcauauaauccuugagggguugaagguaucaugaaguugagucaguauggaagaauuucaaacaaaucaaacagggugcugaaguuccggcugacucaucugcucaugguaugcuuacugauuagugaauguaguuuuaagccuuuguguguguccucaggggcagacagacuuuaacaaggaccagauaacauuugaauggaggaauuauauuucagguguuuuagcuugaaauuuauuuuuuaaaaaaaagaaaaauuaaaaaaaaaauaagagagcaaaguuugggaagcgaguugacaguaugaaagcagcagagcugaggaugagcuggccugucccacugcugcaguggggugggucccagcuggggaaauguuacauuguuaccagcaagaaaaaggaagaagggucaaaaaguaggaaacuccuacuuuugcaggcaugauuuacuacuuguccauaguaguauagcauuucuaagcuucuaagggcaucucaaaagauaagaguaaguccgagauguugaaaaaaucaguagggaagaaagaucacugcagaucauaaucuauguuggccacaugaaaugauuuauuauauuugggaaguuuuauuuucuuauguuuuuuaaaauugaauugguaagugcuuuauagacguauuuuuacccaggugccacuucaauguguauguaauaaaauuauuuauauuaaaagugggaaauuuugugaacauuuuucuguguguguagauuuauuaggauggugaagaagugugcuaguuagcaguuuucuguguaaagcugucuugagcugaucuguacacaucgguuauaaugccccaguggaaccuagacaugucacuugagacuuuugaaaaacaaaauaaccagggaaguccuagaaugguauuuggcuguuugguuuuuccuugaguacuggaguagagaauaccuccccagaacugucagcacaaaacaggguaucagcuuuaacucugauguuccuauuggaguagaguacuaauaacuaugagaaggggaauacauuucuaauaaccuucccuacaaucuagaaacgucccuguuuaaauuuuuuaccuaaaucuuuuugugcuuuauguguaaagaauaaaaguaccaagacaccaugcauuuuauuaacacuauguacauacuggcugcuuuguguucagaaugguagcaguuacuuuguauauuaaagugauccuugugaauuugugaaauauugucuuaaagugcuuuucuuacuguaaucuuugugguaucaacugucauaaugcccuuuuuacacagacauuuaugugcagucacauaaacaugcuuuuaaaaacucuguaaagucucuuuuuugggccugggacaccccuccccaagcuaguauuuguuuacccucauuuucuuggacuugauguuauuuugucaaaugagcaaagauuacauugaaugaucacaagcuuguaaugcuuagcaacagaaaacuguaauucauacaacacaucuaaacacucaauuuuacugaauucuuuuuagcacuuuuuugaguaaggcugagcaugaucuaaaacucccaagugcuguucucccgucaaguaacuaauggagauguguuccgcaguuuaaaguuaagacgugugcaugcccugaaagaacaauaaaaacucggaucaccuuuauucugaaauaugugacuguauaaaaugcagaaggaagguggguacaauagcauggccuuguaaucccagccucaugagaacaggaggcagaaccagggacuaggugggcuaucugguagagauccuguagggaaggugggaaggguaugaacaagggaauccugaaaugcacguaucuauuauugccaaagaacuaauaagaucccuauaauguucugaaguucuggaacuuaggaacuuuauuaguaagcuguguaauguucccugguugcuugucagaugugguuuugaagcucgggucacauggauuuccuguuucuccuuucugcagagcaaccacacuuaaccgaauuaccgagacuuaauauuuuaaaaaugaaaggauggaagcuggcaugguagcacguaccuuuaaucccagguuuugggagacagaggccagccuggucuacauaagugaguuccaggacagccagggcuacauagugagaucccuuaaaaaaaaaaucacaaccugaaaggcagguguaaaccagaguuguaccaagcaguucaguucugugaucauauuacuuguaagcuauugggccuccggaaagauaauagugccuaucuuccuguagcugugacuuggcauucauuugaggaccuaggaacuagaguaacagaagaaaaguacuucucaaaaucgaaaauaguccuccaagaauauaacuugguagaguugguaucccuuuccucuacaaugaauucuagacuuccauguguuuguuagaugggaagcacaggucccaaacagaacaaauuucuccuccaaaucugucccuucaggcauuuuccaugucauacacacggugccacuuuccauuaaguugacugucaagcccaggaaagcacuguucguccgugccaccuugccugagacugaauuuucuucaguuuuaagcauucuucagauaaagacuuagcaucaaguggaaggcaggcucauuuccagcgaugaguauuauuuuugcuuuuuaacugauaagugguuaacagaaccauaaagugacccauuugcguucacacacuugggcaacuaccauuccugugcaguucacagacauuuccaucaucuggauaaaacccuacaccuacuaaaugguuaucuuuccccuuuuuccuucugccucuggcaaccagagucugccuucuguaaauugagaaauuucaaauaaauggaaucauaauguguau

SEQ ID NO: 194 - RNA, 35193 nt, Mus musculus
ugcaacuuacuugggugagcaaagggaagcugucaaacauggagagaccaaacugcugacaaaaccaacucuucaccaggccggaccuucggggcccgccuugaagggcggccucgaguaacaaacugccgcagcuccccaguaggagccggacucggcgcagcucgagaugaauggaaaccagaauucgcgcggcucagcuuaagggacggggcggggcuuugugagucacgugccugggccguaggcgggugcguggagggaaguccgggucugauuggcuacccgucaccaggugaccgcggagcgcguuccgguuggcaggagccggcuagcggccuucaguucggaggcggcgacggaaggaggaggagcuccggccgcgcucucggcccgcaguggcugcgucucccagcgcuugucggguccccaccccuuuuaaauaagccgggcuggucgccgcccucgcagacuaguccgcuguggggaggcggcggcggcgagccggcgggggugcggccgaggccggagcccugccccgggcugggcggcggggcgggcgggcgcgcagcgggcgcggcggcgagugcgggcgggcgcagccccgcucugcccggggcugccggcgccgaccgcgccauuguugggggagggggcgggcgcggaguccggggcgagcggaggcgcaggcgucggccgagcggagcggacgcuccccauggggaacacgcugaccuguugcgugucccccaaugccagccccaagcugggccggcgcgcggggccggcagagcccgacuacgaguccgaggucuacgaggcggcggccggggacgcgguggcgguagcgccggcgcccgcugcggccguggagcccgccgaguuggauuucggagccggcgagggccaccaccugcagcacaucagugaccgagagaugcccgaaggugaggaggcagcgggcgcguccgggccguggcgcaccucuggccuccaccgacucccugggucccgcugggaggcggccgccgccucggguuccuuccugccgggauuauuccuggcgcaggccuggacaccgggaaugagggcuguggcucguguucccaccccuuauucuuucucggccacgucuggccaguuucucucccaccccuacgcccaguucuucacucuucccauucucucauucugacccgggacccuguacccggcaccgcuuccucuuuguacugcuguguaccguccaguggaacuuaagacuucaagagacuauaauugccccuuuucuuaauaaaacucccagguaccccuaaccucagaauagccaucccaucucucuguccuuacuuaggcagaugguacguaagguaagagcauaauguuccucuugcucugaacgaguugaguaacugauacuagagcaaucuagauucagcaugguuaaagauuucuuauuuacguucaaguagagauugccaccaaaauguguaugguauuaaguaggauuuugaaaguagccucaauaauaaagguugcuuuauuacuuucaguuauaguuggaacacagaaagaggagacuucugugaaagauguuaguuucuuuccaggcuucagaaaaguacugcuuccccucccuaacaaggaguaguucugcuugcuuuaaaauuaucauuuugguaaauacaucgccauuuaacaaauuucauuuauuuuaccucuuccaaaggaagcaggguggggagagauuguucauugggcguuuaaauggagccaaaagcuuaaauuuagcuuuaaauuaguaauguaaagguuugggauuuaagaagacagcccccugcgggugccuguaauauuuguuucuauggcuccauuucccugcacaccuucagccuggagguucuuacuuggugcuaagaaaguugaagcucgaaaacugauccauugcagggugagcuggcuggguagguaggagggagaagaggaaauacuugguguuuuauaauuauaaaauuuuugaaaaucugugaauuggguaaaaaguaauucuagauagcagugugguuauugaaugaaggcuacagaucuauaagacaacguaucaugagauguuuaagcuacauuggcuuguuggcuucacuacaaaugaguuccuuuagaauaacuuaaggcccaugaucgauacacuuuuguaacuuuuuguaauagucaaauguuguaaaagaauguaaagguaauuguaucuuuaaacaguggaguguguguuuaugaaaacuguccaguuucaauguuguaaguuaagccucuggauuuacaaacaguauauggguaguguugagugagaguccaaauaggaccuuuuuauaauucuugagggauuacagcacaguaucauguaugccuauuuguuccucccagauacaaaggaagccuguaugcauucucacuguauuguugaugaggaugcaaaguuaagauaugacugaaacugcuucugcauagaacugcucuaaacuguggagguggaagaugugcuguggaggugggagaugugcugaguuggacucuuaacaggaaaaaaaaaucuugucaaaaugucuauuguauuuugacuuguacaguagaacaugugguacgugguccuccccgucuuagucucaguuagcugaugcagaggcaaccuuucuuuccuuagaucucguagcucauauguacucucagugaaagaggaaagaaaagggcagguaagagugggaccuacauugauccuguaagugggucuguucugcuaacugugaguugaagcugagaaugcuuugacaacauuaagaaaggcuggcaagaggaaugucagcauaaaguuauaggacaggaaaugcuuagaaguuuuuguaaaauaagugugugugugaucauagaauuucaguuuacuaaugugcccauuaaaauuucaguucaguauuuucucuaaauuucauuuuuagaucuggaggacuaguuuaaguauagcaaauacaaacucauaggcuugauccuuagugcugccaaaacugucaaauuaaauuccuuggcauucacuacagugauaagaaaugucagcauuugacuggaucaaagcaccaaauauauauaaacacaugaaaauuuucauuuaauaucuuuauuuuagaaaaaaguuuuauaaguuuccuuggaaucugagaaauauuuauuuagauuuaaagguagcuuuuuauuauaaugaauuguuuugacuuuuuuagauaaaaucauaaaugauguucucuuuuccuuugaaacauguagggcauuuaaagucacuuuccagacuuucugauuaguauucccuaaccauuggcucuagcacuguaucugauauaacugaugggaagugacuugaguaacuagagcagaguaaggauacuacuaaggcuuuuuccuucucagccuuucaugcagcucucaugcucucucaugcucucucaagcgacccuuucuccccaucccuuagaagggugauaguagggaaagccuccgagcaaaaacuccccuggccaguagcuuuugaccauuuuuuuaaaaagacauguugguaagauacagaaaauacaaauaaacgauuuguucacagucaucaaagcuaacauuuauuaauauuugggugcugcugcuuccugaaccuuucauaugccuguaaaucgaacauuucauuuuauagagcugagauccaucugugugcgcugcuuccuguuccuagaacagugcuucucucgagagugcacgauccugugccagugcaugcugcucuauggcaggcucuagucaauggcuggggugucugauacaccuguccuucaugguaaaaguauacauacucuccuagguagcacauucggugacaggugcauucugccucuggauugaauucagacagaauauuuaggguuuugauuuugguccuuauaaugugucauuggcauuaaaagcauuuauuucugaugacaauuugaugguaauguugacuuuuuacuagcauuaaaauuccugaucuagauuuugugauucuuaguagacuaucucaagucuuuaauucuaaauagauacugguguaagaagugugucaguaauacugaucuaagguuaaaaaaaaaaucaaaaaauggcauuagaugaagucuagaaauauuggaaaacugaaagauacuuaacugcuuugaguacccugagacauauuuauugaacaccuuugaauaaccaggcaguauuccggaaagagacagugauaagcaagguaguuccuuccuauacccugauccuucuguucuaaagacaggugggaauagacugaaucaucaagaaugugcugagcugguaggaagaaagucagauaggguaaugauugggaauggggacaguuuuacacuggguugauuaaaggugguuauuguccuuaagugauaugugaacugaccuaaaaggaaaggaagcagugggggugaagagagacugccuuguagacagcucucgagagcuuuucauauuggaacaaacuugcgucuguaaaugacagaaaggaagagacacagaauagagagacacagaagagagagggacaccuggagaaaugauggauuagaccuuaauaugguaaguuggucuugacaacaauguggacucugguuguaaugagaaaccacuggaagauuauacccaggggaaccaagauccuuaugaaaaagaccagacuaugacuaugacguaugcaagggaaccaggugggagacuggacaguaauuuagagaaagccauggugacuagaacagaacagcaguauugccuggggucuaaaacagacugacuuacauaaauuaaguaaauuuaaaaguaacaaagauggauggacaugcuaaugagugacagaggaaggcaggggaucugagaagcaugaaugaaaagugcugcaguuuuuuuugguagggcgggagagaaauccaaacaucugacaguacuuagugcaguacuuagugcgguugcuaggggaguuauagucauauauuguuaauggaaaugcaaaaugauuugacuacuaaugugaaggagaauuuagcaaaguaacaauauugcuaacuuauuuagucuagaaacccuacuuuaaggaauuuauaccaaagauguaugaaacaauauaucuucaaaguucuugcuguauucuuuuccuuaagaugguauugacagccaugccgugguggugcgugccuuuaaucccagcacuuggaaggcagaggcaggcagauuucugaguucaaggccagccugguuuacaaaaugaguuccaggacagccagggcuacacagagaaacccugucacccugucucgaaaaaccaaaaaaaaaaaaaaaaugguauugacagcaacucaugcaguaagggacagguaagacaaacaggcuuacccacaugacugugcauucguaucuguaaaaguaaguaugaaguaugcagaaaaguaaauauggaaccauaaaauaaaucagagcucugguuagagccaccuucaggguguaaugcaugaauggaggagugguagggagaggucaucuauuugggagacuauuuucuauggggaaauaaguguuugcuucuuuaaaaacaaaacaaaacaaaacauuaugacauucuugaccuccugugagugauuacguuauaugcccuuuuaucuaguguugagccaaagcacguauauauuugucugagaauuacuuugguauuuggauuuaccaaggaaauggcaccauuuacuuguuugcuuuuguggguguggaaauuuuguaaaguauuguguguguccuguguauuucauuuuaucuucucaguguuuugaguuaagcaguacaggaaucauagcugguuuacauaugagaagaaagcuaccaagaacuauaaauugaguuuucuaagguuuuaacaaguaagacauggucgauaggaauguaaauuccaguuguagaacuuaucagcauagugauuacagaagaugacccaaagugggcuguucccgugccacuuuucgcccuucugguuuaggauaggaagauuugguguucagacaguaacauugaggaggauacaaugaagcagaaauaaguguguaacagaaaugaucuuuaaaguuugaguaaaaugcucucaaggaagaaauauauaaauauauaaaaauucaauauguaaauaauuacagcuuuuaaaacauagacuggaaauuaaagcagggcaagacagaacugauggagacagaugcagaagaggaucugaucuuuggagguuagaaaaacugggcaggacugagcucuagauugaccuacugcgguaagcuugcuugaggcugucaaguaagaauuacuuaaugaugcaaaauguagacucagugauagauucaucaguuggcaauacaggugugaaucuuggaaugucuguguuggaagccauaaaacuaguacuguaucauguuaaggaaugaaggggcucgucagugagacuaagccuuuucacaagugccugauuuugauaaggacauuuuugugaugggguaugauugcauaauuuuaacauuuuuagccuuuagcaaugcauuuaguuauucuaaguugcauuuuuuuuuaguauuuuugacauguauaauuaaaguaaaucauacaacuuacagaaucuuggguugaggaaagacaguuuauuuaccuaccuuugcuuucaaauuaaauugcaacuaaaauugauaacucaauaauaauggaucuuauaauuuuaauuauaauccuugucuugagauauuuguucuaguugaaaacauucuuagaggcuucuuuauggaggcugugucuuguacguguguacaaguucacaauggaggaaaggcuucaucuuccucauuccugcuguacuuacuuaagacagucugggcugauugagaagugaguucagagaucugccugucacuaccucucugccacuaggaucccagaugcaagcuggcuauuuacaugcgugcuggcucuccaaacugaguuccucauccuucugcguuuccaacugagcuuucagcagccccucugacagcuuucuaaagguuuccuaaauccauaaguauguggagaguguguguuuauagagccuagagcuuucuuugguucauaguugucuuguaagggugacuagaguaguaugauuuaucagcaucuccauaggcucuagggaauggagcuaaugaguacagaaauguguugugcauauaauguaaguauagggucacagucuacugacuuguuuccauucuauauaaaauagcaaaauguaguauuuacaauaaguggaaaggguaaguuacauagcaaacuucgguagcuacauaaaauuuauauucucucaaaacacugugcaaauugucauugcaucccuaguggauauaauuccuauaggcuuuauuuauacacaugauuuuaaguaucuaaagcuaagacaggagugaaagcugacauaaaugguacuauaccucagugugccuucuuuagaaagcugcauagugcauauugagccauugaaauuagccauuuguguauccauacuugaagaacuuucuuaaggaguuuuuaaaauauaguaugcaaaaaagaguacuauguacucauaagggcagaauuuuaugccuaaauccucaacuuuggauuggcuaagcuaaaguggggauaacacuuaacucuuaucauuauauaauuauucaacuaaaaaacauugaguuugaggauggguuuuuguuuguuuguuuguuuguuuauugcagcacaaguugugagcugaaaagaggcuuuguuguuuugaacuguuaagaggguuuguuuucuugugauuuagugcccaggggccuuggaugugcuaggaccagguacuuaauggcugaacuacaaucccaacccaagaacugauuuuuaagaaaugcauaagaaacauaacugaagguuaaugauugugaguguaucuauugguaguuuuaaagugaagcauuacuuuagcuuucucuaauucuugguuaaggaggaguuuuacccaucucauuuuuaaugugauccauaguaguaacuguauguacuguaaacauaacuguuuacaauuauacaucaaaaucucagaauccaugcaaggaguucaaagagagaagcuagauauagguugaccugggaauuaagugaacucagaguccauuugauucuccuccuucccucugucugucuuugcuggaaaggcuuuucuccagugagccacugcaucuucuaacuagcuaauguuccccagcacauuugcuuuucuucccuggcuuuugagaagucucaagaguugcgauuauuuggccagccucgggauguauaccucgcuaugacauguugucacugccuuuaucacaaccuucuuagauuucaccuuuagaaccacaagaguauaucuugauuugacuuuuuuucucccuaagauauauuugaugugaauguauguguaucugaguguaugucuguguguaugcacaugcucguauaugaacacuagaaggccagaaaaggaugucagauucccccaaaguuguuguuuuaggccauuaugagccacccaacaugaaugcuaggaacuaaaccuaagucuuuuucaagaggaaauguucuuaacuauugagccaucuccuugauuugacauguauauuguaaacuucaguucucuuuaauuuuaauaauuuucuuguacuggugaaauuccuuggauuuuuuuuuucuaguacugggaauugaacccagggaaaucuguauugauucauaaugauauauaacuucagcuccaucuucugaaauuuuuaauuuuauugucacaguggggacugcucauucuauaaauugauuuuaguagugugaucugcaaauuacauuuuaauucagaugguguuugguuuuagaaggaaguaguccucugucucuuuagaaaagagcuuuagcuuagaaacagcuuagauuucugucugucacuuuaugcacacauggcuuuguuugcccauauaagcuaacuuuaucucacucuuaaaaaugucagaaaagucuuuaaaaaauuguguguguguguggggggguauuuucagaagaaucagcugauuguacaacuauaacucuuagcccucuugaggcugagguagaaggauccaagaguuuaaggccaaccugaacaauauaguaagauacuaucacaaaauaaauaauuuaaaaauaaaguagguaauucagauuccuguugcauuggaauuccugaauauauucaugugauagucuaaguuuguuauuuggaauaaggaaaggagaucuaaguacauguauuggugacaugcugaguuagugacaguagugcugguagaguagggguuuuuagauuuguguuuguuuauuguuugcguauaugaacaagugcagguaccugaggaugacagaagagaguguuggcccccaggagcuggagugauagguaguugugagccaccuccuguggguacuagagaccaaacucaaaucuucgaagaacaguaucuuuaacugcugagcugucucuccagcccaguagaguagcuuuuaauaugucaaguguauauucuguaaaagcaaaggauauaguagguacccugugguuaccacuaaacccccuuuucaaagaguagaaugcuggcuggcaggguucaggaauguugccuuaucauuucuccaccuugaucuuguuucaguuucugacaagauugguuaaauggcuugaggugagcauugcuaaggagugucuuagauuuugaccuuucuccuacaugaugcacaguguacauuaugauuaguuaaggcucuaucuugaauccuuaguuaaauagaagauuaucccaucuuguucccaagguagacuguagcaagaagugaguguguccuuagaaauugagggcaaaaguuaaaaguccuauauucaaggacauuauguggauuaggcuauugagucuuuaugcagcccuaaauauacguggugaaguacuccuuccuauacaguuagcuaaacaaauucucuugucuaaugaaguuagagcuagccaagugaguaaagaagaucaagaccaagugucuuuuuuuguaguguaucugaugcauugaacaguacguggcugucuuggaaacauuuuaguaauaucagcauagauaaguagagggaagggcauacauaugacccuacuaaaguuucauaagauuacuuagguguaaauuaaggagucuaagccaucccuguuccacaugaauggagugauucuucagaauuucaguagaauuuguauauuguugccuuuauuacucucauguucauguuuaaaaacccuuucccugaaaguuagaaguguucgucacaauuuucaaaaacaccuacuuuuuuccugacauaauacaucuuuuucuuuccuucuguagaucuagcuuuggaaucaaacccuuccgaccacccgagggcaagcacaauuuuccugagcaaaucucaaacggaugguaaggcuauuuccccacccacccaccucggagaagacugacuaacuacugcugauacucaguguguuacaguaucagaagcacuccauagggccugugcacugacuuuugaugugggaugaugugcuuugcuuuguuuacuagcagucuuguaggggagcaugucgcuuuuauaaacacacucccaccuuguugccgauacagaugcaugauuuagaaguggugugggcuuacggcugucugucucuuuccuuuucuuccuuaauccaacaguguguuucaaagauuaaugauaaauaagauuuuggguucuguuauauuuuuaugugaaacauccaaacaaguguuucauauaugucauuugaccuuauuuuacauaguacccccuccauguaagccugugucacacccagauauguguaacucaaaacuuucaggcuauguaaaacuucauccuauugcaacagaccucagaucagacauguccuaauaauuccuaaaagguuugguaguguguagauuucugcuuguuuauguugagggucugaacuauggaguuuguuuguuuguuuguuuguacuauuuucugugauuuugguuggcccucuccuccguuuuuaaaagguaacuaacuuuuucuguugguuuugacugugacuguaauggagaauucuccagcaauacuggaauggugcaguaaugcagcccaacacuaaggggacauggugcuuuuagcauguauuuuuguacuugcguguauuuugugagccuugagcuauacccauucugguuacuacugcuguaucuucaugcacaaagggcgagaaagcaguaaaagaaaagcuaucuguucccucucaucaguggggaggaauguguugaguaugcagccuaguguugacagagguggcaguguggggaacugguguggccaagucucuucuggacucugugugcuguggaugucaugcucgguuagguuagcacacucccuucaagggcuuauuaagguaggcucaguguuuagguguauugcacaauauuuuuauuagcugaauuucucaccugcccuagaguauuuccacauuaucuuuuguauauggaaauucacauuugugccuauuagcuguuagcuuuauagaguugauuuugacaaauuuauuuuguuagaaacuauucuuuaaaguagaacugaauuuuaccuuugcauguugauaguccaucagauaauaguagcaauuauuuuuauuuuucuguggcauuuguaucagaauugaucaauuaauuuuuuuuuauucuuagugcgugaaaagaggaagagcaaccauuuaaaccauguaaguaaauaguugaaaaggaauuaguaguuugguuaaaagugugucuguagugacuuuaggagaauguauugagugcaguacuguuagcauggacgguuucuguacauuuucuaaaauucuuuucucauaauauauugacuuaggaaaguuuaacuuaauaccauuuuuaaaacaggauucugacauuuuauuuacuuaugguuagauaacaugggcauaaauacaggcaugcaugaauuuuuguccauuuuuacucuaauauuuuugaagauuuauuuaucauuuauguguaugccugcaagaguguauguguacaugugccugcagaggccagaagagggaaucggauccccaggagcuggaguugaaaguagcugugggcugccugaugugggugcugggaacugaaccuggguucucugcaaaagcagguaaaagcucugaauuacugagcuauuuuuccagccucuucgccuaauuuuuaauugaaguaacaagccauuaauuucaguacuagcugcugauuucccaucauauagguaaaaguuguuucuacugugaccaucauuuccuucuuccauauccuuuuuuuuuuuaaaucaugucaguguuucauuaugacuaugcacauaguuaguugcugucuuuugucuucagugguuuugaaucugaauucuucaugcccucuggauggauaacuuuuccuggcccuaugagcucacacagccaaaugcaggcugcagcccuugcuggucucccuguggauacagacauucuuguuuucaguguauaguauuaacuuucuaaccagccaucuuuuuuuuaccccaaauguugucacauuugucacaugucugucaaaaaaauauuuuccaucuacuaaauacaucuugguuuucuccugcaggcaccccuucacagccuuugccauccuauucuggguuuggcuggguuuggcuuaagccggcucacuuuauuuaauuuuuuuccuggaauaugucuuugagguuacugaggucucaagacuucucucuuguguuguuaccucaauguccuagauucucuguuucccuuugucuucuuauauuguaccagaacaccuuuucuugagaggggacauguagguauguguagugaucuggccuggauaauuccuccuauagauagaguucuagguugaaacuaauuuucaacaguccuugggauacuuuucuguuacuaucucaaguacauaggauauagugugucuguuaauuuguuuuuauuuauuucuugugaucgggggauugaaaccugcaauuaaaaccuuagccaagugcccugggucauaucuccgaucuguaaugcggugguuaaaaaucgguugcuauuuguuguaugauacaugcacauucuccuucucgggaaguuaaggacuuagucucuagcauucugaaggguuaugauauaguuuguuauggaccuuuaaauuuuauugagagccaguaggucugcaaacaauucauucucacgguuuuuuuuuuccuuguguuucuuugauauuuuuuucuuguguuuuuguuauuugaaaguugagucucuagaccaggauuucaguacaacugucuauuucugucuccucuuuacuuucuaguuuaucuuuuucuucuugacgauuccuuugcuuuguauuuuaacccuucuugaguguuuucuagggcuuuguuuacuucugaaauuuuagcauucucauuaauucccuuuugcugucgccuuaaucugcuugucuugcuagaggcuucacucaacuguagagcugcccuuggcuuccugugacuggaaguaccauaaacuuuuaacugaagagucaccuuguaaggauuuggaggccaaaccuacuuggccucaguaucuuuuucugggauccccaucuguagggcaguuuuuuuuugucuguuuguuuguuuguuuuucagagaagacucaguuuucugccuauaaacuuuguuugcucacagaagauuugcuuucuagcaauugccaaagugagccaguugugcuuuucagugcauauuucugcccuugcaucucugagacugucagcuuugguagcuagaauaaauauggguaaggcagagccagguagaaugagggcucugucacagaccuagcuggcuuuggcuccacuguauguuuuuucuuacuucccaagggcggugucucugaauucucgucugcucauacuccugucccauuagauauccguaggugccaacaucguguucccaugccccuccuuuugcuguuuugagacacggcucuaauggguuaguacuuuacuccugauccuccugccccaccucugcaauguuggaauuguaggcaaacaccaccaugcccaauuuaacuuucaucuuuuaaaaacauuaaaaauccucucaauccugcuuccuggucuugauauaaacuuuucuuucuuucacucaaaugguauuucauaaagaaauagguuuguggucaguccaugguguuuaaaugaauuuagaauccauauuuagagcuggaaagaugacuuggugguuaagagugcugcuuccugcaaguuugguuucccagcacccacauguuggcucucaaccauccacaacuucagauccagggggucugaggcccucuucugaccgcuuccggcaucaagcugcacauguacacaugcaugcacaugucacgcuuuguucuuuuuuacuaaccgccuauuagauagggguuugcugggauuuguuuucuuuuuacauuuugcagacuuggguuuauuacuguaguuuauggaauuacaggccagcaaugguaaagugcuaaccacaacuggcaacuauuacguuuucaagcaacaucaagagaaagcucccuuuagcaccugucuuacaggcuucgacagagauugccuucugccguugucuaguuuccagacugaaaaguuugacuagcugcauguuagcucuguccccugcuguauacagauuaguggcaagaugucuuaugaaggguuuucucuugaaacucggaguguguccugaagagggcagcagagcugaguagaagaaguagcucauuuccuagguucgguacagaacucugucuuaguaggaguuuacacccugaacugacagacacagagguugauguuucuagccaguaguuugcugauuugcaaaaugaacagcagcuagagggcuaaaaaacgaucuaauuaaauguuuuaauauuuucaaaucaagcccacuguacauucauaauuagaaacuguauugaggacaaugggaggaucacuagacagccugccagcuagucuguaguuuguuccuacuucaucucuaguguuuguuuugucaaaauugacuuuuguuaccauguauaugcucugcuacuccuuaauacaaguuguacuuccuuaauuuagaauccauaauguuccaacauaugaaaucugaaacuuuuuaagugucaaccuaauaccagaaguagaaaauuccacaccugaccucaugagguagcaggcaaacaacaaaaacugcauaaaauuaccuuuuacuuuuugugugaauaagaaauauaaaauguuuguccuuagacuugggucccauccccaggaaauccaacgauuuauguaguguguguguguguguguguauguguguguguguguaauaagaauauuccaaaacccacuuucuucauuaaggauuucuauuguuguaaugacuaaaagcaacuuggggagaaaaggauuuauuuggcuuauacuuugauaucacaguccgucaccauggaaggaagucaggaggaaugaucagccauggagaagugcugccaacuggcuuguucagaauguuccucuuucuuauagcaacccuaagaccagcagcccagagguggcaccacccacagugaaccaggcccucccucaaucaugaugauucuugaucaagcaccauucaagaaaaugaaccauaggugugcccauagggcaaucugagaggggcauuuuuuuuucaacugagauuucuuccaaaugacuguaacuugugucaaguuuacaaaaacacuagccaacacaccuacaauacuuucugucccaaggaauuuugauuugggauccccagucuauaauaguaacucuaaaugauaucuucuuccacuggaauaaaagcauuucaaugaaucaguuucauuuucauguuuuguuuaucuuuggguuuauaaaaguauauacuuuaacacauagguaauguaaaguacauauauuaacugaguagcuuaaacaucauagcuuuagauauaacuaaaacacuucuaucuugaaaagauacuuaauguuucagauagcaccaucuggggcauuaugauaaagagcaagaggcuuuauagugaaacaucugaaacaaacagaaggcuguucugucuaccaugugcauguuucugacugugggcuucuggcaguuuuuauaugcucugcucuucgaaccaugucuucugccuuccccucuuacaugugguucuaaaaaaaggcugaugggcacagugaccgugugauggagaggaaaggaaggcacaucugaauuagugguuuucuuuaagaaugcuaaguuauugguauuuuguucuaaagagugcuucuguugaucuuuauucagugacacuauuugaccauggaccuaauggaucuuaccauacuuuagacuguuugaguauuugauaauugcucuauuccugcauucuuugcaaaugaauggauacuucuaaaguguuuuaaagauaguugagaggacucaaaaaguuaaugucuucuuucucuaguacagguaauucuucacuaucucccagauuauaguuaguuucucaguacuagaguugaauggagggccucaagcauacuagugaaguucucuaccaaugagcuacaucuccagucuuguuuuuaacuguuccaucuaccaagugaggguuucugacugugggcuucuggcaauuuuuacaugcucugcccuuugaaccaugucuucugccugccccucuuacauguguuuaugaguuuuaaaacuguaauuauguaaucuaauuacaguuaaauuacacuguaauauuuauuauuuuauauuauaauauuuuaacuguaauaaauaauucuucaaauacuugaacuccaugaagcuauuaagauugugugcucagcauuucgagguaggaccauugagaauuauucuucuggaaaagcagguuaggagaacccaaagagaaacauuuugcgguguggucguuggcagagauaugcuggaagguagauggagucaggggauagagggaguaaggcucccguggagagcacaauaggaaggugucuugauaaauaacuucagaaacaaacagaauggcagcacacuuaacacaggaaauaaagguuaacuucccaaguugcuuuugucuuuuguuuucagaugugaagaaauguuaaugcuuaagggaacagcccagagaaacuuggggccucuggcuuguaggcaacaggcacaccaacucuagccacuaagauauuuauuauucaccuuguauuucuuagaguaagaugcucuuaugccaguauucaaggcauuauguuuuauuauagugacuguauagaaguagaaagcugccauuuguuuaagagaaaauaccgaaaccuuacuuaacaguguauaauguuuauaaaggaaguuuguaauaggaacuuggcagguuugauugguagguaccauacugagggcagccuucuauagcacaucucuccaaugugauuuguggacauucaaagccugcuugguucccugcaggaccacacaugcugcugcacucacuccuggacuguagaaguaaauaccuuaaugcuuuaucauuugacauucuaaccaaggaaaaagaaaacacauuuuauagguuuaacuuaccgugacauucucuucuauuucccuuccccuucagguaucuccagggcagcuuacuaaaaaguauagcucaugcucaacaauauuucuagaugacagcacagucagccagccuaaccuuagaaccacaauaaaauggugaguacaacuaggcugccagcgcugagcaacagaccccucugcuagagcacccgagccaugccuggucguuucagucguuugauugucauguuaagacaaaguuuaagacauuggggucaauuagauacugauuuuuaagggacuaaguguaaaauuucaguuuccauuuuaucuuagacugcaugguggaaaggagagccaguuagcaaacaagaaaucccagggaaaaugugccucugucaggugcauuuauguugugaaagcacugaugaacgugauagauguguccagguugaucaguuauaggccuaaaacaaugcuuacuguuucagaaacuacucugaguaguuuguccucuccuggcaccauaguacaggagcagccccgugcauagguuacagucggaggugaguucuccugcgacagugacaggagaagagcgcaggguuggagcuucccagggaacccgauuccuugguuucuaacuauugauuuuuuuauuuaacauaguuugggaaauguuugauuuuagagugcuaaugcuuuuaaucccuaauuuuacuccucagucuaaaacucauaaugagcuuauaauucuaauuuuguuucuaauauccuagcuuuagaaaaaacuggccaauuaucaguaauuucuucauuuaaaaucugcaaguucucauguguuguaguuuaucuuuccuuucacacuuaaaacaacaguugagauuaaauuguguuucagcaaaaacugagccccaccucugcgggucuugaguuaaucaucuguucaauaauuccuggguguggguuuuuaggaaagccucaaucugugagacuaaaaagauaacggaaguuucauuagaguccucagaucauuuugaacucaaauaauucugauguuccuauaugcaauuuguauauuuuuaaagaguaacuuuggucacaccaauaguuuucauccccuucucccaauuccaauguagucuaacuuuuaggaaucuacuuuugaaaguacaguuuuuaauuuguuuucuuuaauuauauuuuaaaagucaguaaauuuacuuggugaaguaaacauuuaccaaaaagauuaaagcaaauuuugaaaaauguuuaucauaggcaacaacgcaugauuuucgaggaaauuaaaaaacuguuuuagccgggcagugauggcgcaugccuuuaaucucagaacuugggaggcagaagcaggcggauuucugaguuugaggccagccuggucuacagagugaguuccaggucagccagggcuacacagaaacccuguaucaaaaaacaaaacaaaacaaacaaaaacaauaacaaaaaaaacuguuuugacucauacaacuuuuuucaguauacaugccugcaugugaacaugguggcucauaucugcauucccagcaauugggaggcugagguggcaagauccaggaguuucaaaucauccucagcuacauagcaaguuaggggccaaccucagcuacaugagacuuuguuucuaagacaagagaaauauggccuggagagaugccucguugguuaagagcauugucugcuuaaaaccaucuauacugggaucugaugcccucuucuggcaugcagguguaccugcagauagaauucucauacauaaaauaaaugaaaaaacccgugucugugagcacaugcauuuuuucaguuuugccuuccuuucaauucauagauaaguucagaugacuuuaagaaaggagaugggagugaggcauuaaugccauuggcagaaaguggcugagcaaguccuuugaucuuccuuaaccccuucccagccuuuucagcacaguggagucacccugggaacuuguuaccuuagacuuaaaccaaugccaguuuaucagaaugccuugagcuaaucuuauaucagggugacuuuggugugaggcaaaguuuaggagccacugcuuaaugaaaauaaagaacugugccugcccaccuggugugggaccuuagauucaugaguuuuaaacauugguccccucccuuuucuauaaaagugguuguugggugaacuguuguguaagucuuaguguccuuuucagaaccaauuuuuuuugugugugauuuuaaaaaucagucugaggguaaaacugaagcacuguagaaguauccaucuuuuaugccaauaauguuacaaaguucaaauuuuuaaauuuauauccaacuacuucuaaaauucagauuugccuucccucaaacauuuucacuuuacauuuuagaugguaugggcagauggcaaauagaacccuuuguucccuaguuuacaucaucuguggcaaacuuaggaguaaaguaauauagugucuaaagggucgugucuacuuacuaauauuucacuuaaacuaauucggaauaccugccauuaauacuauaccuugugcuauacugaaagcacuacuuacuucaggguagcuagucuuaucagcagauuugugggcacucauucauauuuacuaaguuugcuacuaauaaucauacagaagugauuuuaaaugcuuuuauucaauaugcagaacuuuucauuacuuacuuuagggagcuaauggucugugguguuaaauggauaucaucugcaaucugagaccuaauccgaaauuccuacuguuuaaaguuuaaacauauguacaaauacugcaacuugcacagaacaaaagauucuauagguagaagggcaaaugauaggagggauagauaagcauuuuuacauggccauagucaacagaaaucauaugucuucuaaaaucauguugucuaguuguguaagaaaucagagcacuguaaguagaaugguacuguucuaacugcaggacaucagggcuucccgggaagucagcccugcuugaaaaugagaaaacaaauugcuucaaauauuuuuuuuccuuucacagugugaccuuagcaauauauuaccacauaaagaacaggugagcauguuaaauccaacuuccuaucccagcugauuaccuugcugauaccaaauaguaugcuauagcaugccuuuauuacaguccugaaaugaaucuuuauuauaauagaguuccuuguuugaagauucuaaacuugcugguuuauauauauuaaaauguaaaaauauacauugaaaccagcacauaauuuuucaaacuugauccuaauaauuuaacuaauuucuuguugugguaucuccugcaugcauuauagauuguuuaacagugucacaauugucuguucccauugugacaguaaaaaaaucacagcaaagagccaucuuguuagcauaauuuuuucaaaugacuuuccuacguaaaauugagagaaaauauuucauuugcauaucuauaaauuuuaauguaggucuugguagaaagacaaauagauuuccuuguuucucugucuuucuuucaguuuguuuuaaagaaccaagaaaccaguucucacacauauacauuugacggaaaguuauuuuuaaagcguucagauuuuuugaugcucuacagcacuacacuaagggugucucauuguaauagaguuuuguaucucuccgugaacucuuaaacacuguacucauuguauaaaugugcaaauguuuaauaaguguaucuuuuacuagugcauaguuggaugauguauccuggucauauggagaauaaugagucacccuuauuauaauguuagcagaaagugugagcacggagaagcuguaagacacauagcagaaggcacaaggucccaagcuuggcuuuuacagagcuugacagcuugaauuuuaucaugacaaauuauguuuuccucaaagugacaaguuacuacauucaauuuugagaguauuuguaguuacacaugaaagugauauucuguaauaaggggcugguugaguucacaaguaaaucacauucagaauauuaaaaaagaaaggucaggauuuagugacauuaguuauccuguuucaucaaagacguaagcaggcucaggaaacaagugcagugcaguugugggggggggggggcggcuggcacagccgggaccaugccaggaucagcucguucacacucgcucacagucggcaggcauaagaagcaggcaaugcuucauguauaugaugaacgguuuuggaggccgugugccuccggcucagggacucuccugaguccacgaccucagagaagcagugcuuaaaugagugcacuuuauuuguuugaugaacuuuuacacacacaccauuguguguuuuaaaaaaggggggcagcgacguuuuaauuaauacucuuuauaagaagcaaguguauaucuuaaacauauaacaaucagagaauuaaagaaaggcagaaacuugugaaauuuaaauguuguucacauugaucaaaguucuaaguucuucauguccacugcugccuuuaugaggaggaaggauaacgugcuuaucggcacugcuaagcgugucagugcuucgcaagcacucauagcaaaggugccgcagcgcuggcuaaacccaggaagaaccgcuugccuuguuaaagguuggccucccccgucggccucacccuacaucuagcaguuguuaacuaagacacuacuaacguccuguauuguuacauuuuacagagaugcaaauagaucccuggacauuuuugaugagcggucacauccucucacaguaaguaucuguuugcuuuucuuaaaauuauauuuuucuuuccuagaauuguguuuuguuucugucugcguguuauguagcugauuacugugagaaaauuagucccucuagcuugaguuaggagugugccguggcuaugauaaaguaacaauugccuugaugcuuugcuuaaguagugagccaagggaaauaaguguauugucuuaaauaauagaaaauucagcuuuucaaaagauaaucuuuaaguaacaucaagcaauauaaauaucuguaaacaaauucaacaaauauguuuuaaaaaaagggaaauaaggaaacuuuaaauuaguuaaaaugggucuaucuguaauuucaguaccuugaaggcugacuagugauuugaaagacagucuaccuauuaagagcaaccuaguauuaagagcaaccuaguaauaagagcaaccuaguaauaagagcaaccuaguaaggcccuaacuugaaaacaaccagucagucgaaccuguaaaaauuuaagaagucacuucaccagacauaugcuggccagucuugauacuugacacacauacuguuggcuguuauauggacaauguuaagaagagccuaugguuauaggaaacuaaaaauauuuuggguuuuuuuuucccccaaaguauauugcaaacagcugucaccccugugacacuuuuaagaucaguaugauuucaggauuaaaaaaaaaaaaaaaaaaaaaccuggguaggagaauggaaggguauaucugacauuccugugcuuguggucguguguccuuuuauaaaggauggguggguaugaauaguuguaguauagccauagauugcuuaacaguggguacauccucaaauauguauuaggugauuuuguucugcaaaaauuguagaguacuucaucuaagauggcuguaguauuacacacugaugguuuacggaacugguauuauguauuuaguucaucauugccugaaaaggucauucuugccaauugccauaagaugccacacucuuuauauugaaagcacaaugaaagucacugggcauggugacacacacucuuaaccucugcacucaggaggaagucucaagacaagcauacaaacaagauggcucagcaggugaagcacuugcugccaagccugagggucugugcuugacccccaguauuguaaagggaaaggaccaacucucaaaguugcccuuugaccucgugugugcacuguggcugugcaugcccauacacauaguuauacaaauguacacaaucauucuacccaauugaaauuaucuuaaggaacaggugagcacaauguggagacagacucaaguauuuuuaagaauacuuaaaagauuuccuucagucaauauuuauuuauucauuuauuuuucuuucagagagagaaaguuccagaggaguacuuuaagcaugacccugaacacaaauuuauuuacagauuuguucguacacuuuuuagugcugcacagcugacagcggaaugugcaauagugacguugguaagcuuccugccaagcuucauuaaaaagcuuguacccagauauguuuaaucccugaaaugaucauaaaaccuuuaauaagaaccuucugaaggaaugacuguuaauuuaacagccuuuaugguuuaaaaauguuacauugccuuuauuacaaaaaaaaaaaauugcuauuaaaggcaguaagagaguucucccaucaugccucaguacacauauaugggcauguugauggggcaggaggggaaagcaguaacaagcgcaggugguucaccagucugauuugcugaaguuuaagguucaugccaggcuguguuccucagggccuucuguuguaugcuaugcuggaucacugucuaguucucugacccuuggaugauggguguuaaucuaccucugcugaugacuuauuucugccuaugaaguugcccaggauuauaguacaguaguucuuagaguggcuuugugaacuugcuaagcuacagguauaugcuugccuuuauguuauccauugagaaggccuguaguaagacuauuguuucacauagugcauguuauuguagcauuuaggauuucacugccccuacaacagaugcacggagauaagucagaugcuuggcccugaggaaaggugacuaccuccuccuuuaccaucaguuagacucagaagaagccaugugcuguguucaugagcagaaucgcccugugggcaccagugcugugaaauuggguuggaaagagagguggcaagguccuuguuagugagggaagcugcauuccuggaagaacagaauggcccugccuggccagugaauagccaagacugcagagugaauuugagucagaaguaaagaauuaaaaauauuuguugaagugcagagaacauuagcaaugaaaauaggcagccagcccucacagaucuaucuucaguguuugagagacaagucuacuggggaggaggaaaugcaggaaugaguaauagaaggcaagauaagacacucccacaaugguaaggcacucccaccaggcaaaugcugaaagaggccucaagcgcuccacaccucuguuguagcaccaggcagagggaggggagagggagggagggugggagagagagagaaagagagagagagagagaggagagagagagaaagaaugugagagcgagcacaugagauggaagucuugccuugagaugauguccugguaaggaagaccacggguguuuuugcagauaguugcuuuuagccaugaaaauuaagcaugguaaaaacaacuggagaguuuuuguuuuagauaaaugagcagaauaccuccuuagagaaguggcauuuaaacagcagccuaacugcaaagaggaagcaagaagcuuagguguuauaggcaguggagcagugccagaccaaugauuuucaacuuuugggucgugaccucuucuaucuccaaaaauauuuuauauuaugauucauaacaauagcaaaauuagaguuaucaaguagcagcaaaaacaguuuuaugguuauggguccugcauuaaagggucgcagcauuagugagauggagauccucuggguaagucugugaugaaagaacauuccauguacucaaggaaaguaggauggccauguggggggaguaaggacuaagggaaauuaggggucagucucacagggagggagguuccagguugguuagugacuauugcuaagucuugagcauggggaaagugacauuaauuuaggaggcuuuucuaccuguuuuuggagagauagacuauaauuggaggucagaagagaggcaaguagaacguuaggaagcuguacaaugguaugugcaagcagugaaaaaugcccaggauagagauuuguuagauugccaauaacagacagguguugcuugcagacuggagaaggauaacagaguuuaagcuucuacaaccaggcagguggagagguaaagaggucugaaucucuaagugaaggcacugaugaauggcuuggcaagagcuguuucagaauagugauagcagccagagacagaaacaagugggugcacuaagugguuggcuggaggugggcuggcauguucgugaucugcugcugagcugagcugaacagagcaaccagacauugacauugaacuaaucucuggcugagaugcugugcacaguggaauggagccagacccacaaaacacaagaguuggcuuugguuugaagaaaaccaaguccucucuugcagugacacaggacaaguguuacugaggaccaggaccuaccauaccugucaguaagggcagccacgguuugccagugcgccacugcucucugacuacuucuggaacagccgggguguccugagagaaagauucauuccucagauaguugagaguuccaaguaugggggcuggaggauaaacucauagagaacgugucauauuuggcagacauuuguguuugggaaaaaaaaauugaguuugaagaacauuacgaaaucugagccguuagucuaaugaccuuaaaaaaauagugauuaucucuuacaaguaaauuccuuuuuugccuuuuuuaucuugauaaaaagcacuucauaccauauaugggcugccuuccacagcugaacuugacaucuaguuucuaccaauuaaagaucauaaauacuuguuggggagcuucucuugccguccuccaaacgggacuguuugcauuagcauagcacuugcauugucucuaggguggucacuaaucuagaggagauuuaaaaccgcgucagaaaacagucauaacaggaguucagggccagccugagcuguauguauagugauacccugucuaacaaagcaaacacucaugaucugccugcuucagucugugcagugauuaaaggcaagggaauuaaugaaauuucagauuauguaagagagaaaauggcuuuuaggaagugagagcagagaaggggaaaugacuguguaaaggaccauccuuaggugcagguggcucugugauggcacagugccugugaugcugcucuacccagcagccacugggaggcucucuuguccuaguuccacacaggguuacugugaacugggaaagguuuaaauaaucucaggguagcuugguuuuuauacacuuaagcccagcauuagcaugccuguaaaauuacaugugagaaacuuggguuuaaugaacagccugaaucugcacugagccuguuugcugcucugcaagcaugaaaaugacaccaguaucacucacucuucaggaugcccuuaacuagugacaguccuuguucugaugaaugggccgagugggcagcuuuagaucuagccucuugcuuagguagagcagagucucugaagaccugccuagggaagcacagaggaggccugucauccacacauucagcacacaccaugaacuaaagcucagcucucuauuccucagguuuacuuagagaggcuccuaacuuaugcugagaucgacauuugucccaccaacuggaaaagaauuguucugggagccauucuucuugccuccaagguuugggaugaccaggcuguauggaauguagacuacugccagauccucaaggacauuacgguugaggacaugugaguauauaagguuuuggaaugcuuucagaaccauuuuucuaguacucuuaauuugcuacuauaaaguuuuacauaaaacuuaaagaauguuuuuaaaggcuguuuaaaacucuuguuuaaaguucuuuuuuguuuguuuuccaagacaggguuuuucucuguauagccuuagcuguccuggagcucacucuguagaccaggcuggccucgaacucagaaauucaccugacucugccucccgagugcugggauuaaaggcgugugccaccuccgcccagucuuguuuaaaguucuuaaaacuuuccaccauguauguguuuuguuauauuguauuucuguucaaaagaauaaguuaacuaagcagcuacuuaagcaguggaaauagucauaaaacuacauucuuaucucuaacuuuacagcaguucauagcuuccaucauuaauugguaggucuuguuauaauauguuuaauaauaugcuugauaaauuauuuuucuuguugguuuuggugaccuuugcaaggacagcauaguacaguauauaugcuauuacuuuuuaaaagccuccuccccuuuuaaggggcuuuugaaaggaucugccuguguugaugucucagagcaucuagucuucuguaagguuuagcuugaggcugagucauucauugucuauuuacucuugcuguccccacuuuuaaucugagcauuuauaacagaaacugugagguacaaaaguaaaaguuuuacucugcauguggagaguuuguuuuuagaaauggucucaugagccaggaagcuccaggauuccucucaggcaguccuagaagcagcucagagguuucacuggguuaugaggacacucagcacuugcccaguuacagcagcgcucugcaggccccaagcucacugagagcauagccuuagugauggccacuagcaugggcuucaugcuguaauggacaaggcugugugugcaagcaggaugcacacaggggagguuuccagcaaacucugaaagugcccacuugacacugaagaugucacuuuguggauagcacucaagaaaucuuguaguuaggaagaaacuccuugauuauagugaacaucauaggaagaugaagguaugaggguaauagaaguuacccauuucuguagguaggaugucagucaaaauuacuaaacuguuuauaacugaaguaacuaaggaaccaguggcagcaacuggaauguuuggugaaaaugacuguucauaagugguuacugcacugguagccaucuuagcagaggaugugacaacaaaagaaucugaaauaaacagacacuugcgaggccagagugacugguuacugugucaguccucuucagacuggcuccugggaaaacgcaagauguguaaucauaugccacucgugacagccgaaaauaaucauacacaccacacgugauagcugaaaaugucucaaaacuuaaacucagauaccagggacucugguuguaguuauaagaucagaaaagauuuagaaaaauguuuagauuucccagacaugaauccacugcaggagcagugguggcagggcugaggcucugguccucacaaaccuuuuguacugaacagagaaacaccaggagccauguuccuaacagucgccuuuuguuuaugaucucugcuaaccaaagagcaugacaacaagguuaauacacauuugucuccuucccccgcuguuguuaaaaaugugugucuaucauauuuuucuuuaaacuuuccaccauguauauguuuuguuauaauguauuucuguucaaaagaauaaguuaacucagcagcugcugcucagaaaaugugcugugccuguaaauggcacgucauucaggcauguggaaaacccagaaggugcauauucuguuggcauagugcuuuucuucagugauuaaaccucuauuaauagacaugcuaauccugugaagggcuguauuuuaacacaguuaaaauguauuaguagagaaaauauaaaagggauagugaaguauguuuguuccaguagcaaauuaagucuugauuaccugauuaucaaaacauuaucugauuuacauuucuauaggcuuauugccauaugaacaggaaauuaauuuggaaguaagcuguuuagcuuuaauuucaguaaaugagaaaaccauauuuucuacuguccauauagaaauacuuuuugaggcacuuagaaaaaaaaaagaagagaaaagaaagaaaaaggaaaaaaauuaaaaacuuagaaccaauaaacuaaguauguucuaagauaagcuucggucauguuugcuuaaguauuuauaauuucuagagaggauugugacuguucagguguacucucauuuuauguugaguaaggcuuagcacggucacagagcuacaauuaucaccccgucuccuccuagaccacauuucccacuuuacuaagcucuuuccucugugucugugucccagguagggcagcaaaugcuugcaguucuuauucucugcacaggaaccagauuuguuuguccaguucucuacuagguguaguauacuaaaguggguuuaguguagccaggacaucugccuuugauuucucugcuuuccagaauuuaaaaugagugucuugacugucauauuaagaguuugucaccuuagugcaguauuaaggugagcagaaacuuggauuaugcccuuuugacauagccuuaugugcuggggcagggggaagggauugccuuucccauccaguguagcuuauguauuuauuuauuuauuuauuugagaugaauccuuguugccucaagaguuuuucccccucagagauaauagcguagcucucgauggauccauuuguugccguggugaugugcccacuccuuuuguuggcgcuucucuacuucaauaagccccuuccuguuaucagcccggugaaaaugucugcaaguucuucagagcuaauaaacagcauacaucauuccuuucaucugcucacuauagcaggccuugugagugagcacgaagcaugaaucguacagcugcacuaauggaacucugaagaaugagccugcaagucagcagcacagaugcaugagagggcuggacccuuccccuccgcccaaacccaagagcgcugggauguggaaaggaccacaaauagcugaaccuuauuugaacauuaguauuuuaauccagcuggguagucuucacguguuccaaaauagaauuuagaacaauccuagaagcucugaaugauacuuuugaagauagcccaguugacuaaaauuguccugugugaguuuugauauguuucuccuccuccaggaaugagauggaaaggcauuucuuggagcuacuccaguuuaauauuaauguuccugccaguguuuaugccaaauacuacuuugaccuucgcuccuuagcagaugacaacaaccugaauuuucuguuugcuccucucagcaaagaaagagcacagaaccuagagguaaggcuguguucacuaagugggguuuccuuccagccaccuggccagcaucuguggagacaauggaaagcuuuaaacuaacacauugaagagggcauuaucucuuuggcaucguauuuucugggccuuuuaugguuucuccaaguaucuacauuauauagagagguaaauauugccgccucugaucauaauucagagucauuuuaaucaaauguaauguaguuuuaauaguuucccuauugaugggguuggagagauggcucagcaguuaagaguauugaaugcacguccagagguccugggguucaauuccuaguaccacguggcagcucacagcuaacugucuuuuaauuccaagaucugacauucucacacagauaugcaugcaggcaaaauaccaaugcacauaaaauaaaaauaauuguuccauauuuaagcucuguauucccacaaaacccuucuugaaacuucuugaaauuauacccuuaaucacaacucugcuucauuucacucaguugacaaauugucaggguuuagauaccaugacuguauuagcauuaggggcucaacugagaccuuuguuaagagugguaauggggccagagagcuggcucagagauugaaaagugcuuccuguucuucuagaggaucugaguucaaauaccagcagucacauccagugcuucacgauugugggacuccagcucuaagagauggaucaagcaccuucagauauccaugaguagcccucccccuccucccuaccacaaucauaaauaaaaauguuuuaaaaaugaaagugguaucuuauauaaggcaaggugauauuucuggcuuaaaauuuuuaauaaauuuaaauuagaaauaauagaaacuaauaaaaaucaguaaauaagucauaccgauucacauacuuuagaauggaacuccuuaaggcccuuaguaauuuagaauguuuuucuacuauuaaaugugcuagugaaauaacaacuuuauaaaugcuucagucauuagacuccugccaucgcauacagcauuugcccaccuuguuagccuuguuuuuagacuaaugaaaagugaguaaauacuaauuaugucugcacaggugugugcuguuuaaaaaaaacgguuacacaaguaacaugaugaugauguaaaaaccugucagaucaucuucugugucuuugagaacugugcgugguacauguaucugcagcuggcauagguggcuuccugacucacucuucauuuacaauuuaaaauaaggucucucauugaaucuggagcucaccaguugcuagacagaccauugagguccugggcuucuccuaucaccacugccuagcacugggaaaacaggcauaugccacugugccuggccccuuccauccaugccagggaaugcaaacucgaguucugcgugcacugccagcauuuuacucucaggacaggggugucucucccguaacuuaauaaaguugcccuuuaauaggcauuugagucaggacucuggaaagauuagucaguagcuggaaguaccuuccgcaagacagcacuguugcccuucucuucagauaccucauguggcugcauuuguuaagaaucuaaaggauggcuuaguauaccaggagguccucgccugcuccuuggaguaguuuguguugcuuuuuauuuuguuuccuuaaaguugcauuccuuuucaaaccucucuguuguuugauucccuuuucuaggccauuucaagauugugugaagacaaauacaaagacuuguguagagcugcuaugagaagaucuuuaagcgcugauaauuucauugguauucagcgcucuaaugccauccucucuuaagagagagacucgaggaguaagaacaccagggacuccucauagacaggcuggagcaacagcaccucuccugaucagagagcagcagaggugggacuccacgggaugggaagaccucggauucaagagacucuggacagugacugcugacuccauaggaaagaaugggaccuugucaaagcaacagcucucuguccuuuguaauguaaacgguuacagaaaccacuccacagcaacagcgcugaccacagaucgugcuuaccauguaggccaauggcugugaaauaugcgagguuuuuacauuguuucaauguuuagacuuuuguuugagacagggucuuacauagccugggcuggccucaaacuaaguauacgauugaggcuguccuugaacuccuaucuuccugccucuaccucccaaaugcugggauuaccaugccuggcucagauuuuuagacuuuaaagacacuaaccauauaacuuugguuuuucuugccccugccccacccaacugcugcauaugcuuuuagaauugaugcauuucaguauuaccauuaaaacaugagaauccuucuccauuuuuguggugcugggaaucaaauugaagaccuagcaagugcuugguaagcauuugaccacugagcaacacuccucagccccaaacaggauucuuaacacucaugaaaccaccuaggagcagauuguagccucauuagguauuaaagguucucucacuguaucaucagagcugcuagucauuacuggcaaucaguuuaaauuaccagaaagcugcuggaaacacucgccauucacguuguucguaagcgcugcuugcuggcauuuugguguguuuggagccauagagagagaguguccugugcugaccacuucuguugcguccacgcugcguucauuuccuguucacuacuaauggugcuucucauccucugaucucuucucucucguguguuaaacaaguguauuaaagaugcuucauaaugccaacaacauagcaggucagugaacaugaucccauaguaaaauacaagggguccccaaaauuagugauugcuucacacuuacugcccugugggcucucuggggacacugcaacagaagccacaaacuugcacaaaacaucauuugaaaguuuuaauuuuaccaauuugaagcuaauuuaauuuuauuguuucucaguuauaaccguaaaccaaaaauauuccaaaugugggaaauuaaguugaagggaaaggugacuuaaaacuuucaaauaauguuucauuaguuuuguagcguuugugauuguaaggcaucagagcugacaacuacguggagcugugggagcugccgugccuuuccauggaagcacucuguucucaaguguucuuugccaggcugggcucuagccgcuuugaucaccuaagugucuuuacgcucagucaagggaggcuauuaaaguggugguaacucacauggaacaaaucaaaagaaaucagauccucaaacagcaggugaaaugagcaauuaaaacccugcgcgcucuccugggugcaggucucucucaagccgcauccuugcaggccuaugcaccggcuuucaacggcagggagcgaagacugggaaagggauggcaguagcagcuaaagcugaaauaauaaaagauuugcauccuacaacuaugugcauucuauuucuucucacaucuaaccuugggagucuuaccuaaaaagccuuuugugggccacgaauacuuccucuugaggcugcaaugcuucccaugcucgucagugcugccaggcucaucacuuucaagggacagacauaaguguuacggaaggauguaugaaauauuacaaucuaccaccucaaaaaacauuguuuauggaguucagagcuuagagauucaaguauugauugcaguuuuauuuugaaaagaaugcuacaacuuaacgugguuuuucuuucucauguuuauauuaaaagcuaauaaauucuauuuuaauuaaaaua

SEQ ID NO: 195 - RNA, 7196 nt, Mus musculus
auuacauuuucuucaccauugcuuuaaugcauuuuaaaaaguuaucuacauuaauugggaacaaagaaacaaaaauagacauuucuuuguuuuucauaaauaacuaaucuccauauuugauaaaaaucuuaaaaucauuauuuuaccuucccacaaauauaauacaaaaaaauuuccaaaauaauaaggucaacaaguuaaggaucuugagacuaacauaagcacauacaguugcuguuguacugacugacucccaggcacaaaaccaaaccaaacgucucuccaagacgcucugggucuccuuuugcgagcguuauggguucaggauuauaaucauuugccagucauaaaaucuauagauucaagcugauugucuacaaauaaaauauugcuggcucugaguucugaguacuggauguggcaugccgguggugauucuuacugcacgggauaggcacuguacauguaugccaaccaugcacagcacugaaugcccuggacuccaacugcugacucgguaugugccucauuuggcucaguaauaaauucaccugcaccaacccguaucaaaagucacuaaaucucucucucucauauauauauauauauaauauauauuacguauauacacacccacaaaacauacauacuauacauaguuuguaacaacaugaauuaauauucuuuuaaaauuauguaccacagacagacacuauccuggaugaaaucaauccugcgauugucaccacacuaccagaaggcucugagagucugaagcagguuagcuacaucuucccuacccuucuuuacugucuuguuagguuucccuucugagcgcacuccccaagccaggcuguuucuuucccaggaucacuugauuggacuuuggcgacaagaaagggcagagagaggcagcagacaauucuuagccgcuguaccucacaccugccuggauuugugaugugcucaguccuguuugccaguguuagaacgcacuuauucaaagcuuugucccuccuaccccccugggucuuucuguagauagagcacaaaagugaaagcagcuuccuuagcaggggcagcaguucauuaaaauauacaaccgugcuuccuagcucugggguucccagccacacucgccggugcaggucacugaugcuguuauuaagguucaguguaugauccaugauguuuucuccuggcagccggugucaagauuagugcugcccuggcccaggagggaacagccuaaugaauaccaacuuagaaccagugccauccgcacauuauuuaagcuuguacaugcgcacaagugcacacaaggcaagcgugcgcgcgcgcgcacacacacuggcccuggccacugguaaugaucacaggaaacugugacaaaaaggauugcaagaagaaaccaauaaggcaccaagaaaaaggauuuucuuccaacucagacaacuucaaaaugugaggagggaaauuauauaaauuuaaaaaacaaaaagccuuccuaauaucuggccaucggagucauugagguccugcuucuuucuuuaaacuaccuaaauccucacucucuaaucugugaagcaucccagggguugagaggugagugagguggccaaaggcacgcgcccuggaucugagaccaacccuaguccucucagcuacacaaggcuggcggugcacaaguugcugaacucccccaaggcuuuucauuucgcuucuuguuaucaguacagauaugcaaaguggaggaaaacgugcggugggaagagggugggaagaggggguagucauccgaaggcagcuucccucuucccuccccuagggcuggcuagaaacuccuguuggcuucagggaagcaggugcgcuuugucucucuaaggguaagggagaggggagcagaggacagaaaacuccaggccucugaagcuccauccaaaggcauucccggccuccagcucuagcauugcgcccacuucaacugcuguauuguucaaaggguauuauuaaucauucuuuuuuuuuacagcuuuggcauguugcuuagauggaaaaaaauaaucauucuaaaaaagaugaauuaaaucacuuucauccgcuccaccccacaacuuuuagauacacuguauguccaauucucgauuuucuuugugagagaggaacaacccuaacuaugcacagcagacugaggggggguggguggggagggagcagcagauucugggaagaccaugcuaaacaaggcaagagggcaaggugauaagaaaagaaccucauuugaaaaacagaaguggugcauagccagugaguguguugagguucccggaaggaaaagggcaucggaauaagaccuucacagaguccugcaucuagguguacaaggucuuguggaagccacugaaauucuaauucugacuccagugagcgagggcagaguauuuuacaaaugugaacacccucugacugcuuacauucccagugggaacuacgcuuuuuuccacucagucccuggggcauaaagcuggcucaggcuuaacucucccuacccccaacccaccccccagcugcugcaaaagaaaaucgggaugccuagacuccagcuguuucucuaggaaagcuuggugacauuucaguggcuuggccauuuuagaucccuaaauucaguccccgcucugccuuggucacugguacgcccugccauuuccuucccaguaauggccccacacucuuagugaaugaauaguuaaauagauuaggaaagcaaacagacucuucuaauagcagggaaacuggguaaggggguguccaucacuauacaggcucucucaaaaggggggggaaagaaaccuggucucuccagcaguggcuuuacacuuacaguagcccccauauuacaaagcuuaaguuaggagucuuguugguuuucaggcuacuagggcaugguguagcugcuuuggggaauauaucuaucuggcuuuaaaccuugaguucagggccauuuguuuucccccugagccaagguuuguucccagguaacuaaccucccucccccagucugagcacuucauuggugggugggugugguuucuaaucaccacucuccaccaggaggaauaagaaaagcaaggaggacuguuuaacaugauaaaggaggugggccggagccgcagauucgaagcaaugggaauuuacuuuaauuacuggaagcauauccguuuuuuguccuuuaaucuaaaagagagcccccuuuagcaaagaguccuaacuacuuccagaaaaagggagugaauuuauuuuuacugaaauuuguagccuaauuuuuuauucucaaaagcucgggggugggggguggggguggggcucucuggagcaucuuaagagccacccucuccagcagaaggcucaccaccucacuaguucagaauucacauucagccaauccccaucccucaggcuccaaggcaaauguuuagguccgcucuauaaugccuccucuaacuuauucaagacacgacaagggcggcuggcucuaucggggaugagaaagauggcagcucggcugccaagagcccaacgcuugcugagcaagguuaaggaggcucacaaaacucuaaccuuaucaugugagggaugguccuaaccacaucauggucuacuuucacagaggacuugagggggcuagacacagaaagagcagauggccucuggccucuaaguguccuggacauuuuaagcacuguaagaagaaacuaccuuaaaacacacacacacacacacacacacacacacacuccacaccuucccacucacagcagccuuucacuguucacauuuauaaaaaaaaaaaaaaaagacacguauaggaaauauauuuuccuaauuuagaccacacaguccaaaaaaaccugaaccaacaguaaccucauuacaaugccaauuugaggauuauguagcccccaaagcaaagguaaauuuuguugccaaaaugcaacaaaguuaaaacuuaaaauacauauaaauuaaaaacaagguacuucuaaagaaagcaguaagaaaugcaaacuagaauacacuuaacccacugcccugcgagccgagcccccuguagaagacuggggacagguaaucucuugaaaccgcccccuuuuccucuccaagccacucugggagggggcaucagcaccaagaagguaaacggaagugaccuucacaaagcuaccaagcgaaacaacugcccccuucaacuuccagcacugucccugggccucggccuccaggccuuccuauacgugcgacagggacacuugcuugugguaugcggcgguggggccaggcggcccgguccugccggugagcgcggcgcuggccuccgcauagucuccugcggccauagcgccaccgcucuuguggccccgccgagagcugcagcagcagcggcuggugaaccgccgccaagacuccagagucuugccggaccagauccagacucccgacgugaugcccaccaccaggcacaugaaguacuugagcaugagcacccaguacucggguuuggcgcguggcuggccagcguccggucccggacacgcgcaggugagggcugccucccagcucucccgguagugcugcucauacagguagcaggccaccacgaugcuggcuggcaccguguagagcagggugaagaugccgaugcggaucaugagcuucucuagcuuguccgucuuagugccacccugcuugaugacgcuccggaugcggaagagugacacgaagccugccagaaggaagagcgugcccaccaacagguacagcaccagugggcccaagacaaagccucguagugaguucagguuuugguugcccacauagcagaugccagccacuggguccccguccaccgagcucagugccagcgccguaauggacuugacacuggggaugagccaggcagcaagguggaaguacugugcauaaccugcgauggcuucauugccccacuucaugccagccgccaagaaccaggugagcgacaggaugacccaccagauggagcuggccaugccaaagaaauagacuaagaggaagacaaccgugcacagcgcagggccgguagucucauagugaauguggcugugcucacggcugcaagcgacgcuggcauggcccacuaccaggcgcaccaagaaucccagugacacacacagguagcacgcagacaagaagaugauggggcgcucaggguagcggaaucguuccaugucaaugaggaagguggcaacggugguggacguggagaugaagcacagcacagaccacaggccaauccagaagguggcgaaugugcgcucguccgggcugaaggacggcugguagcagggcaccgcgcaguugggcacuuggccggugcgcaccuuguuguagagugggugugacuccuucaggaugggcacgaagggcucgcggcacgugcacacggaugggccucccgaggggcacucgcccccggaagauggcgccccuggugguccugggaguguagguuuggccgggaaggacuuaggggacgcggugguggcuucgcuucgguuauaauccauacacagaaccucggcgucgccgcccagcacagggaggcggucgcagcucaugcgcucgggccaggcgaagccguacuggcgcaugagcggcgagcagccggccuuggcgcgcucgcacacggaacggcacggugguagcggcuugugguagucaggcaaacagaugggcguguacauagagcacaggaagaagcgcagguccggugagcaguggaucuccacaagcggccagaauuggugcaccuccaggccugcuucguccugcgugucaugguugaacugguugggcaugugcgucagguuguagccgaugccucggcacaugggcaccgugauuuccuggcacaccggggccuuggaggcggccgcugcccggcccaccagcugcgccagcaacagcagcagaagagagggaggcgcagacgggucgggucgagccaucgucuccuucuucccuuugccucccgcugccugagagggucugcguuggccgacgaaucugcggccggggcuucccucuccggagucuugagugugacgcccgggcuggcaaccuguugguuucuuuuucucuuaaagaaauccguccaaagauaaacuguuucuggaaggcgcugccuccgccggcagcacucaguuccacaccagauagggcuggagggaugauuagggcuccgacuccaaggacagaacucuuaaaagagaagguaggggaaaagaaaaaucgcaaccacuccucuuagaggagcgccaaccacuuggucuccgcaaaccagcuccaaucucaagauuaacuccuuuccuccccuccuccuagaaccaaacuucagacgcccccacccccuccaccccacugcccgcgcccgccucucuuuucuggcccggcccugcaggcugugccuggggccagagagcucaguccccgagaugggggcagaggaaccgggugaacugggaagacgcgggcucucaccucggaggauccugcugggcggcagaugucugcgaccagccgggcuccucagucgcgcgacuccgaaucgggccagagcugggaaaguuuaacgacaagcuagguaccuguggcggcgacacauggcagcagguggagggcguuucagagagcagggcgccccucgaccaugggcggcgcgggccggucacucgccuucucuuccuucggggcccccugcaugauucgggcagagcaaggcaggggcaggccgugccuuccaccggcgucccggggccgggacgaagggcaagggcgccgggcagcacuugaacugcgcggaggggugcggcagccggaggggaccccgccaccucacagcacagcgagcagccagcgcuggucgggcggggacugcauaguccgcacccgccgccgcgucccgccagccgcucgccgccuccccugcagggggcuccgcgcuccagcagacuccggggggcgguggcggcgcucucgggacgcgccccgcucggcuccucccccgcgcucucgcacucuuucgcccaccuccagggagcuccgagcugugcgcgacggcagaggacaagucgcggccgcaggcugacugcccucucccg

SEQ ID NO: 196 - RNA, 771 nt, Mus musculus
auuucuuuuuuuuuuuuuuuuuuuuuuuuuuuuuuuuuuuuuuuuuuuugaguggcagcagugagguuuauuggagcauccuaauacagacgcuggggcuugcccauggugcucuugauguacagagcccgcacguuuugccaguuuuucuuaagcaaggacaccaagaaauugacagccagaugaauguuguagacuagcucaucaucggucaucuucacguggccaacagcgacggccaaacacagcaccuucuucaucuggaacuugauugucgauuucaccucauccacuuuggccaccauguuuucauugugugucagcagggaggggaacuugccagccuuguuuaggccugggcccaggauacgugggaucugcuuaaucagagacucagaggccaaaaaggcaucguacuucuuagccagcuucuugaccaacuucuuguuuuuguuaagcuucuugagcgccucgauguccaugugggggauauccacggccuuggcuucaucacagugcugcuggucccccagaacgcacaccgagaacuuggggcgugggguggacuugagccugacggugcccgagaaacguuuguccuucugagggucguaguucuucaggcugaucugcagcuccaccgucuccagaaacuugcggcgcuugcgcugguucccgugcaggacuucccgcaccgccucguacagggugucgcgugagacuuugcugcucauggcugcggcugccgcggaaaccggaaaaagcaaaagg

SEQ ID NO: 197 - RNA, 1057 nt, Mus musculus
uggguuuuuguguuugacuuauuuuuuuuuuuuuuuauaaaagacaacauuuauuuggggcugguuuacagguucagagauucaguacaguaucaucaaaguaggaacauggaagcauccccacaggcaagguacaggaggagcugagaguuuuacaucuucaucugaagguugcuaguggaugaccgucugacuuauuuuuaaaacaucuucuaauucaugcacuuuuaaaaaaugacaaauuuggcaccagccccuccccuuccuguccgcuccuauuugcuucccccaggacccauguguguuugggaagacgugaaccugggaguaguugcggcugcccucugugaaauugucauaucuggacaucguggggccucgguggccaagacauugccaugccuaaaggacugaaaggaaaaaugguaggauggggaaaaaacgucaucgauccguacaguagaaaagcagcucagauuacaagagagucucacaaacaagacaagaagcaaagauuggagacugagagggccuugcgucucaaccuuauuggugacaaacuucagugguuucacaguuaucuggauacaaaaagacccgauauauucaaagaaagaugccugugaauuaauugaaagguacuuggaucaguucagcagugagcuggagcagauugaauuacacaacagcaucaaggacaggcagggaagcggcacccuucccgggaggccgucaucaagcagaccucgaagcgggagcagcagcaguaagaaggcuauggcuuugagaucccagacauuuuagacucuaauacuuggcagacuuuccgggaaugggauuuugaucugaagaaauugccaaacaucaaaacuuugugcuaaagaugcaguuccuaagaagcgcaaacauaaaaauauuuuaaauauagaaaaggauuuaggagaauuagaacuaucaggugaaacuggagacacuacagaugggaaacuggaaccagcacgugaaucaagugacacgggugaagagaucacuccagugccugucagcccucauugaa

SEQ ID NO: 198 - RNA, 92513 nt, Mus musculus
cagggcagcugcuuccggcagaguccggaagagagugcgaggugggagggggcggagccagugcggcgcgcccaaucgggacggagucuuggcuggcccgggcucucgugggcucacucgcucuagggaaccggcaccauggcgucgggcugcaagaucggcccguccauccucaacagcgaccuggccaaccugggggccgagugccugcgcaugcuggacucgggggccgacuaccugcaccuggauguaauggacggguaacuccgcggggcucggggcgggcuggccgcgcgggucggcgucgcugcaccucagcgagcgccuguugggugcacggcgccccugugcgacgacgggcugccuggccaagcgcgcugccgagggcaccgagccggcccuggcugacuuuggggcccgguccuuuccccgccaccccguaaccuguggugauaggacccgggagccaccuccaguguucaggaucuuccucuggugaacucguagagaaacugaggcccaacgggacaggcgcgacuugcucgaucgaacucagauaacuaacuaguucucgacaaagccggcagacagccucagcuugacaccuggaugggcuuccggaguucgaccacuugccgacuugucuuaggcaagccgcuucagccuugauugggacucggguucagugugaggaaaauggaaggauuauugaucauagaacgcuuccgcgucuuggggaacuugaaacgagcaaguccagugccuggcguguaacagauucucugcaguuguuaguuguaucgaauaacccauucgaauucugauuuuccugucuauuuucucuucaggcacccugcucuucagggaggucaguuuuuuuguaaguaauuuuuaagcacuguaguuauaaugcucagaaucaggguacaaguuuccuaaguugguucuaaagugaggaaacaaaccuagacccaaaggaggcuggaggacuugcucaagauuacagaagauugugacagacuuggaacuugaaucuucuuggcuuuuugacuagcauuucccaccgaaaguuuacauaaaauuauaaaagaccuugggagugagauagaaaaauaaauuuauuucaaauaagcaaaaucuguuugcccucagucacauuggcaaauauguguuauuuacaucaguuucguuucuuguuggagguuuugcuguucuuucugguuuuuuugagacaaggucuguauaaaucuuaacuggccucaaacucaaaaucuugccucagcuucccaaaugcugggauuaugggcacggguccccacacucaguuacacuaauucuuuuuaacaucacugcuguuuuguccauagcaguuuuguuucuuuuggcucuccgugguuaaaucucauuuuucuuaacacuuacuugaaagcccuugaccggcuggaauguguaccccagagaugguguugauuucgaugccugagaaaauguagggguccuagcauggcacagacugcagguguaaugagccugcuugaugcagaggggagggguggacaccagugcuuucacuuugcuaauacaaauguugcuguagaccaggcuugccucaccugcuucugccuccugagugugcccagcuuuuuuaaccuuauuuuuaaacgugucuaguuuuugagauucuauauaauauaacuaaaucauucccccuucucuuuccucccacaaacccucacacagacccuauaccuccuugcucuuuuucaaaaccaugaccuuuuaaaauauuauuaaauacauauguaaaaauacagacacacauauaucccuaaauacauaaauuugaccugcucagucuguauaaugccacuuguguguauauuuucagagcuggccauuugguauuggaugagacugugucuccugcucucagaauuccuuagauaucugguccuuuguguagggccagggcucugugggcuguccagguacucuuugagguuaauauguuaucgugaagaguaagguauauugcuaugucucucucuccugguguacuguaaacuuuccaagagcaggaucugacuuuccuugauaagagacauuaaagcauguuaucauugcuuaguaauaguagaaagcaucucugagaaucaccgaugccccccccuucccccagcuggcccccuuccccauaucagacuuaaguuaguaaauaaggcaaaaaaauuauuuuaaaucguucuacuuuuaacaauuuuuaugccuuuaaaucuauaccuaccuuuuuucuuuccuuugaaguaaaagcuauuuccauucaucuuuugcaaaagaggaaaccaguuuggggaaguacagcuccuuucccaucacucuggcagaauagacaaagccugaugucuccagaagagagcugugggaucccuuuacaaagguggccagccuccucugcuuacucuccaccccuccguuuucuucucuguuucaaacugaucuuaucuagaaagucagaaacuaggcuaagaaacacuagguggccagacacaaguaugguuaaauaucugaaguaaagaacagguuuguuuuucuggaaacacauuuugagaaaagcacaaaacacaccauggcagaaugcuagcuggaaugugcugaucccaacuaugggagcaacgcacacacggcuacuucuaaauuagucauuggcauuucauuuacguuggagagauuuuauauaaauacugaauuucugacuuuugcuggagauaucaaagauuuggaauucucuucuguauucugguaaggccuugauuguguggaauugagcaaggcaagcaucuguaaccaguuucucauuguguccugggcccuaccuucucuagccuggcucaccugcucaguuuuccuuuugccaccagccaaagacucuccaguuccugauccccgggaagauuuucugguuccugucuuggugcguuuuguaccaaccguaauccucuuacauuuuguuuguugguuugucugcaguagacugccuuccaguuauuacuaaaguauagggaugcugaugggaccugcuaagagaggagacguagauuccucuguuacagcagcuauggauuauccccagcaagucccugguuucaggcacgaggaacccuuuguuacacuuuccuucugaggagggucguggggaaugucagagugaaauagugaugaagcuggcauuucuggugaauuccuuugcuuucgagaaaauuaauuuaggauuuccuauucugguaagaaaucugaggcauuugauaaaaaaaucauguucuuugguuuuuggaaccucaguaccucucauaaagaggcuggaaauccuuugauaauucauguuguccgguaguuccgaaacaccugauugcaugccuagguuuuugcaccuuuuaguuauggcuuagccacaagccuuuaguuucucaugaaaacuuuggugcauauugggcucuuagugaauuuauuaaacccaggucauugaguuuauuaccaagagcacaaauuguucacuuaacuuggaggucaguacuuuuacauguuauucuuguguuucucaaguaaauuuguauuuauuagauucucagcuucucagcccaugauacuugucaugauuguuuuaauaauaaauggaaccuaaauuugagcaaacuaauuuucaagaccacacgguacaagcacaguauaugcgacugaagacuuagugugaaguugcagaacagccuguugcugccugcuuaccagccccguaucucugguggaguuaacaucggugugugauugagcccugacaguaauggcccuuggacaggcaguggaauaaucuuugaaccuccagggaucaguugguuagagaacguagccauggcccacucguucugacccucucaggucgaucccgagaaugugaguugcuguucccuccccaggacuauuguucuaguaucuguacuggcaggugaaugcugagacugcccuuuguagccucauugccuguguuaacuccuccugccagcacuuacugauuguaugacacugggcuagaagaaaacuuaacucuuuuacucccugcugcaucuaaucaguuguugacaggcccucuuuuuuuauuuuccuauuuuugucauuuuuaucgauucuuagcauuaacaccugccuuccuucuugcacuuaucacucaguccaucuuugugcuuuauuguauuuauuacuucuuaagaagcucauaccccacuugauaguuacagcgcaguaaacuccgaacaccugcguguaacguugaccauccuuaauccgauggcgucuaccccugcuguggucaacacccugucccuuugaccuaagcgugcuuuuuuuuuuuuuuuuuuuuugccuucucuuccuuuucggcuuuucugguccuacagauaucaauguuucauaaauccugugaucuucuaauauuucagaauucuacagaauacuuaaaguauuuauuauaaucuuccuuuugcuauuuucuuucuucacauuuccgugggcauuauuguuaagcuuuucucagucuacauuucaggaccauagcacuauaguuuauuuuuuguuaacgcagcaguugagugugauuccaugcacuuguucugggauuucgucgucuuccaucccaugguucuauucaucaagagcuggaucggccauuuagugaggacugggaggggugcagauugaauuccucucauccaaaauucuugugagcagaauugucucagauuugggguuuuauuuggauuucagaauauuugugugcaccuaguauuuaaggaguuuaaagguuaagugcguugggguugaggucagacugacuuaacuugaauucugucccacagauuaugaaccaggugauugaaggguguuaaguuaccauguuuucaaagaggcuguaaaucauaucuguuuuuacuaagucugagguaugaagaaaguuauaaccccuggcgugaacugagcucucaauacacuaugacuagcuccaauaaguaccguuacuuuuuuuuuuuaauuuuuuuuuauuauuauauguaaguacacuguagcugucuucagacacuacuaucugaagagggugucagaucucauuacagaugguugugagccaccaugugauugcugggauggauuugaacucaggaccuuuggaagagcagucagugcucuuaaccacugagccaucucaccaaccaucguuauuuuuuuuuuaaugguuauuauuuaaaggguuuaaacaauaguuuaguggccugugguugaaguagauuagaggcuaagauucaggacgccugugauagaauccuguauuaaccggugcuccccuugaacaagucuggaagugucuuuugucaucuuuccaucucugcuugcuauggacuaugaauugcagacuugucauuaugaagauauaugugacagcacacaucaauuguaaacuugaucuuaccugguuauuucuguuuaauuugucuaauacuaaaaauguuaaggauuauuugggggggggauggaauucuaaacuuuccuuguucucuugucagaauucauauugaaaaaugcagaagugggauuagaaauguuuucggaguaagauuuuccuuuugucuugcaggcauuuuguucccaauaucacuuuuggucacccugugguugaaagccuccgaaagcagcuaggccaggacccuuucuuugguaaguggguuguuauaccauuuaaaacugcuucuauugcuuaaauaaggagagugguugguuggucaaguuuaucuugcacccuuuuccuaauuucuccucugcuccugcgucaucagcuugauuuuagcagucuaacaccuucccuuccccagggccuugacagagauucuaccuggaaaaacucuugugugagggucucccgucagcccuaguuuguuugucaucuccucagaggggccuucaaagcgcggaggccaaguuaacucuucucuacugucccgugagacagacugacuuuucccacugugcagucuguucuuccagcucacuuuacuuuaucagacucuaagauccaaagguagagcuggaacucaccuugugauuuucuauuauuauuauaguucacugguuuggauguuuugccugaaugugcauguguguaccuucaggcccgaggauggcauuggauucccuggaauuggaauuacagaagguuuugagccauuaugugggugcaaggaacugagccaggguccuggaugagcauccuguccucuuaagugcugagucaccucuccauccccaaccuuugcuuuucucuaggcuaaacacacacgauuacacuucuuaguguaacuacuaguugaauuuaugaagcaaacaaccaauuuacuucuuccauuguaggcuuucugcagauaugguuccuuucagugucauaggguaggaaguccgaaggguuuuuuuuguccauuuugguugugguuucuuuuuagaucauuccaaacuagaaguuauuugaacugaaaugaauccaaguuuauaauguuuucuguaacuuguauaacuaagugaaucuuaaaguuuuuugccaguagagcaauuuugugaaugacucuagcuguacuguucagugugguagcucuaaaacccauauuuagauacguuaauuaaaauaaaaauuuaguuuguaacuuacaauagucacaaguccucgguagccacaugugucuuuugacuauuaucagcagagcagacacaggacauuccuacuaaggcagaccguccugaaugcaggcucuggugaguguguccaugcugggugcagcaucuaacaaauguguccagccuuuugacauacaacaugcuauugucaucuacaaaauucacaucugagaaucagaguugagauauaaaaacuaaagaaaaccaagcaccucaugaagaacaguuacaguuuugcgugggucuuauucauagccaucccucaccuuacucaggcugaaaagaugcaucuguuuugagagaaccaaagaaaaugugaauauuaccucauguuugcuaacauguucaucuuuuuaaauuucauguaguugaauauaaucuuguguuaaacauuauugcuuuggaaaggaguuuucaaaguaagagucuucuugaauaugcuaguaaugugugccaggacuuuaaaauuacauguuacacuaugagaaaugauuaaauaaaucacucuguucccacaucucaaugcugucuuucucauguguuuauuggucuuuccucuuauauucugauucauauucucacuucucauuaauuuuuauauauuuuaucaucagucuuuccugauacaaugccagucccauauaucuacuuuuucuucuuggauuuaggugguuauguaugauguuuguguauauaaauuugcuaauuaauauuucaggaaauuuuuccaaaguaaagaugaauacacuguguuauuacuugggguuugagcccuuuguuuuuuauagcuaagcaguuugauuugguuguuggauaauuggcacauugcugcauuuuaacaaguacaucagggcuagaggugcaguuccacaguuaagagcaugcccugcucuuacagaggaccaggguuugguucccaccacccacaucugauggcucacaaccacuguaacucucuuuucugaccucuguaagccccugcuuaugugcacauacccacacagacauucauuuuuacauauuggaaaguaaauucuuuaaaaguaaauaguucauaaguuguaucuacaaccuauaaagaucuagaguuuuauugacguaacuggagcucagcugaggauuugcacaugccaauuccaaccauggccuuuuacuauuuuuaaauauaucuauuuguguguggggggguagggagugugaguguguaugugcucgugugugcaccugugugcaugcaugcagguauacaugugccuguggaagggaggucaggacagcuuuugggagucaucugucaucucccacccuauugaagcaggcucugucuuacugccuacuccacuuccucuauauucaggcuucccuugaacuuggaaucuuucugccuuccccucuggagauacuuaugucacagcuuuugaaagcucugaacuauuuauucaguguuaguuuuaaauacaaaagacauuuaagaaguaacguaacaagaaaaagccuuuauuaucuaaggcaguggucuguacuguugagaaucaugguggucuucuuuagcucauuuaugaggucaaaggcauuuucauacuaagauguuaucugucacuauccauacuggcucugcaaaucagugaugaguuaguuuuuugguguuguaaccaacuuaguggugcaguggcauugguuuccugugguagagacuaugcuucacugcuguaugcaugcuguuauguguuuacaguacauagcauugguaaagcaguuuagaguauguauuuuaauagguucaucuuugaguaaugucucuuugguuaucauaggacuggguaagaacucguccacuguacuuguggaggagucacauuccucugaccagacaccuugcaccauuguuuaagcucaacuagcugccuuuuccaaacaccaguuuucucuuauuuguuugggguuuuuuuuuuguuuguuuguuuguuuuuuguuuuuuguuuuucaagacaggguuucucuggauagcggugacuguccuggaacucacuuuguagaccaggcuggccucgaacucagaaauccaccugccucugccucccaaguucugggauuaaaggcaugcagccccauuaccaggcugaaagcaagauuucuuaaacuuuguccagcuuugacuccuuuuuccugacaaaguuuuacucagcuccagguauacagauauauaaaauaagcauauaaaccacagauuuacuaguuauaaaucauaaaguaauugauaucaaacaaauuuuugguauacauaugauuuuuaccauuuauuaaagaucaguauaaaauagcaugcuaacaagaugauguacauauuuuuaaauaaggacuaucuuggcugaauauuugcaacugcaggaaacagcaucauuuucuugcacaccuauguuaaagccuaacauaauuaaacacagugauuaguaagcaacaacuggugauaaaccagaacaggacaauguacuguaauggugugaauguauucuuugugguuuuuuuccuuucuuuuuuuuuuauuagauauuuucuuuauuuacauuucuaauguuauucccuuuucuaguuuccccuccaaaaaucgccuauccucucccucccacccucccugcuccccaacccacccauucccacuuccuagcccaggcauuccccuauacuggggcauagaaccuucacagaaccaagugccucuccucccacuggugaccgucuaggccauccucagcuacauaugcagcuagagccaugaguaucucuguguguuuucuuugauuggugauuuagucccagggagcucugggguuacugguuaguucauauuguuguuccuccuagggggcugcaaaccccuucagcuccuugagugcuuucucuagcuccuucauuggggacccuguauucuaauaggugacugugagcauccauuucuguauuagacagacacugguagaaccucucaggagaaagccguguaagucuccuaucagcaagcucuuguuggcaucugcaauagugucuggguuuggugguuguuuaugggauagauccccagguguggcagucucuggguggucaugccuucagucucugcuccgaacuuuguguuuguaacuccuuccauggguguuuuguucccccuucuaagaaggauugaaguguucacacuuuggucuuccuucuugaguuucauguguuuugcaaauuguaucuuggguauucugagcuucugggcuaauaucuacuuaucagugaguacauaucauguguguucuuuugugauuggguuaccucacuuaggaugauauccuccagaucuguccauuugucuaagaauuuuaugaaucauuguuuuuaauaaauagcugaguaguacuccauuguguaaauguaccauauuuucuguauucauuccucuguugagggacaucuggauucuuuccaguuucuugcuauuauaaauaaggcugcuaugaacauaguggaacauguguccuuauuacaggcuggagcaucuucuggguauaugcccaggagugguauugcuggaucuuccaguagaacuguguccaauuuucugaggaacugucaaacugauuuccagagugguuguaccagcuugcaaucccaccagcaauggaggagcguuccucuuucuccacauccuugccagcaucugcugucaccugaguuuuugaucuuagccauucugacuggugugagguggaauuucaggguuguuuugauuugcauuucccugaugauuaagaauauugaacauuuuuuuaggugcuucucagccauucgguauuccucaguugagaauucuuuguuuagcucuguaccccguuuuuaauaggguuauuuaguucucuggagucacuucuugaguucuuuguauauauuggauaguagcccuuuguuggauguaggauugguaaagaucuuuuccccaaucuguugguugccgucuugucuuauugacgguguccuuugccuuacagaagcuuugcaauuuuaugaggucccauuugucaauucuugaucuuacagcacaggccauugguguucuguucagggauuuuuuuccccugugcgaauaucuucaaggcuuuuccccacuuucuccucuauaaguuucagugucucugguuuuauguggaguuccuuaauccacuuaacuuugagcuuuguacaaggagauaggaauggaucaauucacauucuucuacaugcuaacuaccaguugagccagcaccauuuguugacaaugcugucuuuuuuuuccacuggaugguuuuagcucccuugucaaagaucaagugaccauagguauguggguucauuucugggucuucaauucuauucuauugauuuaccugucugucgcuauaccaguaccaugaaguuuugcucuguaguacagcuuaggucaggcauggugauccaccagagguucuuuuauuguugagaaugguuuuugcuauccuagguuuuuuauuauuccagaugaauuugcaaauugcccuuucuaacucggugaagaauugaguuggaaauuugauggggauugcauugaaucuguagauugccuucagcaagauagccauuuugacuauauuaauccugucaauuccugccaaaaugggagaucuuccuaucuucugagauccucuuugauuucuuucuucagagaccugaaguucuuaucauacagaucuuucacuuccuuauauaaaacuuacuaugugucuauuuguagaauuauuuuguuuaaguuuuguaaaaauaacuuacauagcauaaauauguggguguuuugccugcagguuugucuaggaaccacuugcaugcguggggcccgcagaggguauauguggggcucggauccucugagacuggaguuauggacaguuucaaacugccaaauaggugcugggaauagaacaacaguauucuagaagagcagccagaacuucuaacuccugagccaucucuucagccuucuguuuaacauuuuaaaccacacuugacaccagaaaaccuccaaaaugaagcugugcaauaagcucucuuuaauagugugugugccgauuaguacugugaaaugucuuaauucaaauaucuaacacuuaacaccuguauuguauaucuugccaguaucaacuagagaacgccagacccuguucuaggacugcuguuuuuacaugaaguuuuuaucuacuaucauguuuuuguuaguuuagaaauauaugcugcuuguauuaucuagcucuuuuccaaagcuuuugaauuuuuuaauauuaguuuuauucugaaguauuagaauuuauuuauaaaauauaucuuagcaacaccagaaauggacuuccucugaccaaaaaaaaaaaaaaaaaagcucauuacuccccgcauugcccuguacagaauuggucacaggauaguuucuguggucuugacucuuugaagcaaccauuuccucaugaaacacauucgguuuuuguaaauguugcuuuuauuuccuccgaugagguaauaagagcccagucauacugaguccagaguguuuccuucucuguuuuaacuaucccuaggccuagccuggaagcuucuagccucuguauaaucuuaucuuccaagcugucugaaacagucuggcuuuucuuggcuucugacugaaaugcucugucuggccucauacuaauuuuggcaauauguucuaaucuucuggcucugucucauucuuuagcuacuucugucuucucuccugucuagcuugcucuccacugucucuguaaaacuguccagguaaaacugccuugcauacacaccacccgccaaaccauccauuuuuccucucuugcugcucuuacauggccuuucuuugucuacucuucucauauguguuggguguauccuauuucugacuuauucuaguaaguguuucucugguuugucacuuugucugccccucaauuagaugucacuuuacaacauggcugcuuucuucaacuaaaacuuaccuucguuguuaaagauuagagguauguacuuaaucuagagugugucugcaaucugcagguucauaucuuuagaugugaucccuugccagagcagccauguugcuggauuagaauugcucuacagguuuuagaaacuuuaagaaggcuaugccuguguuuaaguacaucaaacuuuaggcugccacccgcccucccagcuugcuuucucucugucauucagugaacugcagcucuccucuucuugcucaggccaaauccuuggcagcaucuacaauuuccuuucaccuuuuauacagcucugcauccagagcaggacuucuucccggguuccugucucagcagccccuguggugaccuuaucacuugacugaaauguuuguuuucugcaucucaucaggaauaaaucccagcagccuacagagcuccgcuguccucccuaccugccaguuuccuugacaucaugcccuccuaguauggcccaauuucaguugugcuggcauuagcuguucaaccuaacucauauuugaucuuauuuugcauacuaucucacuaagaaugaccccaaaggcaguagagaaacagcucgauuucuaggaccuagagcauccauuacuguagcaguucaauaagaucauaugaagaagcauauggaaaggauuacauggagcuuucuggaagagaacaaagcuguguagguaguguaacuucuuuaaaccuuugaaaguagcguuuccuggacuuagaucucaguuuucugauuucauuucuuuuuacauauagcagaugugguuuuuguggaaaaacuauuucauaagugaauauaaccaaacuguaucuuuaggauaaagacuauaacaaaguauagcuaaacacuuuuuuaaugccagaauaauuuauguacauaaugacaaaauaaacaaaccuauaggcugacuucaucccaugagcuggguauauuccucucaguaauguauaggagacgucuuuucuuccuagauaugcacaugauggugucuaggccagaacaguggguaaaaccaauggcuguggcaggugccaaucaauauaccuuucaucuugaggcaacugagaacccaggggcuuugauuaaagacauccgggagaaugggaugaagguaaguugauaauaggagucuuauuuuauacuagugccugucagagcugguaagaugggugggagaaaaugauugauagggaaaggucuggacaugggcaguuggauuuuaaagaaauaaagauagaaaauauaaagcugggcggcuagggaggaccuggaaggaguugagggcaugaucaaauauauuguaagaagaauaacuguuuaauaagaacaaaaaauaagguagcaaaaauaaaucuaaguuaaacagaaacaaaacaaaaaaccuguuauacucuggaugauuuucauauuguuuuguaagaugaguuuuuuuguuuuuguuuuuguuuuaacuaggccacuauaauacaauaggaaaauaaugugauuuagcauuuguuuguuacagguuggccuugccaucaaaccaggaacuacaguugaauauuuggccccaugggcuaaucaaauagauauggccuugguaaugaccguagaaccuggguuuggagggcagaaauucauggaagacaugaugcccaagguaaaagcaagacucuguucuggggugagguuuuuguuauaguugucuauucaguagacauaacugcaauauaugucauugagacauguccuauuuuguuauaguugucuguucaguagacauacugcauauaugucauugagacauuuccuauuuuguuauaguugucuguucaguagacauacugcauauaugucauugagacauuuccuauuuuguuauaguugucuauucaguagacauacugcauauaugucauugagacauuuccuauuuuguuauaguugucuauucaguagacauacugcauauaugucauugagacauguccuauuuuguuauaguugucuguucaguagacauacugcauauaugucauugagacauguccuauuuauuugggaagugaagggacagagaugccuucagauacuauaauacagcaugauaaguuuuaaacuuauuuuugugaccuuuggucacuugaaaguuuucauugcagucuucguaaagcugucacaaauugaaugucauuugcugaacugcuuuuacaagcauaauaugcuuagucuauugaagugacccccaguaaugucuugugcaguguggguggcuuagccgguucauggcuaguguuagcugcgguguucugugugcuugcuucccccugcauguccacuguagaagucacuguuuguucgugucgucuagguucacugguugaggacccaguuuccaacuuuggauauagaggucgauggcggaguagguccugacacuguucagaagugugcggaggugagacgacuccucaacuggggccgggacaguuuccauagcugauaccugcaggacacucucagcaccaaaggauugcucaaauagauuuuuuuccuugagaaaguauuuuuuguucaaauguaggauuagaaaguaaaggacaagugagucacuaacuagcauaaauugucaaauagugaacccuggucuccagaaggaauaaguuguuaaauagugaacccuggucucccgaaggaauaaguugcccuuagcaaaaccuccaaguucuuuuaaaagauaacuucucaacuggagaaaaguagauacauuuaacuggccuaauaaugcugucuuuagaauuuaaaauuuauuagcuaccugcuuguguuuuauaagaagugacgagauguaguucugaugaaaaucaaggccgagcucccauuuaccaagcuuagucuguuuugccuagggagcuacccuagccuggaucugcugcugggugucauuagauggcagcccuuccugagaacaagucaaaugguucguuuuuauuccuauuccucuaugguggccauacuuuuuugccugauacaaacgauuaaaagcuuggcaguuacuaagaaaguagagaaaugagggacgggagaaauuugaguuuuaaguugaaggccagcuuagcaaggcuacacauagcaaggccuuaacuuuaaaaacaaacuaaaaggcuuggcagugcugaguccuuccaaagcagcuggacagaggguuacugagcaggccauccuuuacauacuauuguuuuuguuuuuguuuuuuuuuuuuaagaaaacaaaauuuuucuguugugcuguuccugcucaaauuaagagacauguuaaucaauaaauuuuaauuccugaaaagaguauuuuugauggaacccugugcuaucagguaacuaagucuaauuggagaauuguuccucagcuuguaguuuucuagcuuccagcugagacuugcacaacauauuggguuucccucagaucaaauuccaggcccuaaguuuggaguucucucauuugagguuguuaggguauauguaacaccgcacucccucccauuuccuugucuccacauuuaaaaauaucacccagcacucuaagccauaguggaaccuaagagugcauugagagauaauuuuacauucuuuuuggcacaaaauggcgaggcauuguuugugauguuuuauggauagcuucugcuuucauauugucuuucagacugucuagaaaugaacagauacaauauuuccuuagugucuguggccauugaaaugcauagaaagaaacaaacgaaugcaacuguuuccuuuguguguguguguguguguguguguguguguguguguguguguguguguguguguguguguguggcauucaauucauaugcauaggaaagaccugaauggaauucagguccuagagcuuaaugcuuuaccuaaguaguugcagagauacugugugcagcuuaggguuaguuaacccaacaguccaguggcuugguagacuuauuuacaaaugauaguguggccucauuuauaagcauucccuucuuaacucagugaauuaagagugcuacagucagcuucuggaaaaauggugacagaagcaaggguggaaaugcuaguccuggacuuagguuucgauuuuuucccugcuaacacauagcuguguacuucuuacaggcaggagcuaacaugauugugucuggcagugccauuaugaggagugaugaccccagagcuguuaucaacuuacuaagaaacguuugcucagaagcggcucagaaacguucccuugaucgaugaagccacaaggaacccaguuucugcucaugaaaccuuuuuuuacuggaaaaaggaauauugacuaccaaaucacauugcaaucgaagcagugcugcauuccagugauuaaaaucaauugugcaggauguucaagagguuagaaauaacuaccuuuauagagaugucauuuagaaauuuagcgugaugaaaauauucauguuuauacugggagaaugauuuuuguaaagagugaaaauaugauuucuuaagauuacagacagaaaugugucuuaauggcuaaagaggaaaauuagauacuaugaaaaacauuuuucuguauuuuuacaaagaauguucuguugauucccugguuuauuccuaaagcaaaugacauccacauuuucucuaguucaugucauuugugauuugcuuauaugccugagaauaugaauggaaugagacuaaaauuagaagcuuuggugggguggcaugucauggucuggcauuggaauuauuuuuacuuuuuaaucuuacacuugguuuauuaaaaacuauaaaaaacaauguaugaagccuaggguuucugaaaugcaagcacagacuuaucaagguauuuacuuugucacagcagacuacucugucauuccuuccugccccugggucucacucaaccacccuucugaggggaaugaaauagccagaggcagaaaggaaccauacaguuucucuuggaagugccacuggguuggacaccaauagaacagaguacccuauucuagcucuuuaacuuuaauaaaaucacccaacuguuuucacuauaaacgcuuauguauaucgaaugaaaccauaacuauugugcauuugagaauuaaaagcauaacaugauuuuggaaggcuuauaguuguacuccuagacuguagaagaugcucaacacaaaauggcaagcaucaugucuguuuuaugaguuauuaagcacuuuucuauaaucauauuaacugcuaaauuguccuauaauuguuagaacaggaauuuuuuucccuauuuuaagacuaaaaaccguaaagcucuccaguagccuggcacauagaaaggguccagucagaagcaguuuucugguguguacuacugcucugacuacaaacagagccccugaaguggauuagaaaaaaaaguuuuuacuuuucuuauuuucaguguaacugaauccucuggcagaaucagaguaaguuaagaauauucuggaaguauagauuuugacuccaagaauggauagauggauauauauauauauaauuucuaagaaggaagaaguaggcuaagaugauacaguacagacuuaauccauaaauaaguaguaauaaaauaagaacacugacaaauaggcauggaauagagagcuugcuugggcuuuuuccugcccuguaagauaaaaguuuauuaauacuuguuuuuauuuuagcuuacgaaagguuugugcauuuaaucaaaucacacaauacaaggcauauagaaauaacuuuaauuaaaaaaaaacuauguagaagguuauaauaucagucaugacaaagauuugaaauuauuuguugggacaacuuguauuuuucuggcuuuuguuaucuuuuucuuuaaaaauaaauguacaguaaaacuauaagcaaaaguuuguaaguauugaauuuaaaugguuccccaccccccuucugcagggaucaguuuaauuucuaauccucaacaaaaccuuauauaucuaaucccauagaguccaagcucaguggccaggauuuucaguaguaugggaacuacaaauugaguaaccuuucuuugcauaacaaaaagugguugauacaaauuguccuuaacuuucaucuaggaaaaaaaaaugguauggcuucaaaaagaauuuuccuuaauguacacuccucaguauucuauauuaaaguuuuggucuuggaaaacuugaauucuugaucuaggaugccuguaagcauagguauuuaugaaagcuaugguaaggaaaaaccaaauuagaagcuucuagcuguacaucagcuagaaauacagccauauuaugauuugugugcuguuuuacacuuuaaauugcugucuugaggagguccauaaagcaaguaaacucggugaauucccaacgacaauaguuuuaaauguaucaauauauuaaacucuuaaguugcuucucuuaauucuguuaggaguaagcagaaagccugugguuaguucaggagagaacagugauuucaaauaaaugaauauugcguuaucugauauaagaauuuccauaaauaacuuauauugguuaaacaauguuuagaauaaaagaaaaaacaacucccucuccacagucaaagcuuucaggugucugcuauaagucagcaccugugcuagguauucauggcaacuuauauugcauagaguaauucauacaugcaguuuuaagacuacauaugugugcacuguauguguauauauucuguauacacacuagcauauucucauauuauugaggcaguuuuagugaacugccaugagaauagaaacaaagaauaguugucauuugaugcaaaucaacaguacuaucagggaggggcucguaccucaacaaaugccccgaggugugauuugucaucaaauugcagcaguuaauaucuuagugcuugugauuuguauuauuggcaaacacaaguuacuagcauuuguguagguaagaagcuagcuacuucugugauucaggaagaaaaaaaagacaucggcauguucccugaacaugaaagauggaugcaugugggccuccuccuguucuggaacccugaccggaggagguggggauggauccagcagagaggguuguaggcuuuuuccucuuuuccuuucaguuacauauuuuucuuaauacguucccugucaccuauuucuuuuaacauuaguaacuccuauaccaaagcuuuuauauucuuccauuccaucuaacugcaucuuuggaggguggccacucucagguguaguacuacagaagacuucaucguggaaggcugugcuuguccccccagucugauccuuucuuucaucuuggcacaauaaggcugcuguauccucauccuucaguggaaaugcucgccgcucccaccgcaaagacugaaagggaaagcauuuucaguuaaguuucaccuaauuuaauuauuaaggaaucuaucaugucaguuuuuauaguuauucuucuaguauauaaguucaaguuuuuguuuuccucuuauguccauauggauauccugagaauuuccugacuuuaggaauuguuucuucauuuugcuucugcuaagaagagaaaauacugccucagaauacuugucucuauucaauguaaggauaucugagcaaagccuuguaaggugggcuguacuuccuuucuaccucacuguuauuacagauacacauugacucuuucuugcugauuuucuacaacuuggauaugcauuucuaaaguuccacuccaugucugaccuagugcaagugggaaagcugcaugaacuuuguauagugcuaggauacuuccuaaaaguaggacuggauuuauguggcacuuguuacaagcagaaaaagaguaaugguguuuacugugcacccagugugaguccccaguggaaagauuuguucuuuaaagcaaggugauagaaucuccauugccuaacaguuaaguacauagauagaugaaaguuuuuacugauaugcuaugccuccaaaaauuaaauaaaaagaaauuguuaauauaaugggacuagggcauuccacuauagaccuuccuggacauacuagacugaacaucucauugacuuugaucuguaaugaagcccuuuacagcuaacaguuucuacacauaagugaaauaaagugaaaaggcaauuaaaagaaaacagucaaauaacucaggcuuaccuugucuucuugaccaucauuuaaagaaagggaguccugagcacacagacuguggcuuucugcugggaguucaaaaggacuuucugcaguacccugcugagcacugccaaguucacuugaguguuccuucagaaccaaguccugcccuuccacauuuuuacuguaagcucuagcagggaaauaaaugaauacaggguaucgcuaggucaguacugcuuuuuucucagcauuucuacccacggucaucugaggaucuucccaguguugucauuaggaaagguuuuauccaaggcuuaaacccagugcuucauggucacuaagcguccuaucacauuuguuacuugguuuuuaaaagacagaaagagccaugcacuugaccuuuacaguucugaauucucaaguuagucuguaauuauuuuuauaucauacauggaauccucgagucacauuuguccucuguauuucuggaaaguuguguuuccaggauguguaaaagaacagcaaucuagagucucacuuauauuaggagaacucuuucaacaaauauuuacaguccaucugagcgucuaagcagagaaaggacuuuaauguuauuuagcuaauugaaaaaugucuaaguuaagagacuacuacauuuucuaugaacuugcuuaguuguggauauauuaaaaaugugucaauauuuuuugaauauauauuuuuaauauguuaaaaauaaugaaauuuaacugcaaaaacacuagagauauccucaaauagguaacuacuaacugucauauucucuccgaaagucuaccuaugagcuuguuucuguuuuuuuaagacagaauugucucuacagcaaaugcucuaucuaacucauuaucauccugcuucagacuccugagcauggaacuuugggcauaugcuuauauccaauauaauauuuuuaaaagucccauggacuuuuugccuuuuauacuaaaaaacauuucuugaagacuuugcauaguauuauuucugagauguuugcuaaaaugaauuccauaagcucccgcccuagugcagcucaccguguacaggacauggaguugacuggcuuugaggcucuggagaagaggugcccauugugcaaucuauucuggccuuaaacuggaaagccccagccucagccuccuaauuacuggcauaaaccaucauuccugaauaaaaugacguuacuuuauauaauguuccuguccuuuaaugcuagguaaguaauauaaauaauagugauauuguggcuagcagcaugaaacucauauauaauuuccuagaugaguuuuuaguauaaguuugcauaugaugaugccacuucacacaacagcugauccuguaucuucuguuuuccuucucaguggucuuucucaagcuuuauggcuagcuuauguucauuccuuauauauuguggcuuugauguuuuaaacuucaaauacuugccuguuauuucuucugugccauuugcuuuguucccacagugaccaccuagcuugcucucucucuucauauuuucugugucuuagggagaagacaucaucagaaagaucuucuaucugguaagauuuggaaacagaacagguucagauagucucugagcaggaagcuguuuacggcagccuguucuuggccuguguuuuaguauguaccuagauuacagauggacucacagugcucuucauuugucacaguuuauggaaugguuuuguuguuuggggacaggaucuuacuguguagcucaagcuaguuuugaauaaguauucuuuguaccuuaaccucuggagugcagagauugcagguauaugcuaucuugcccaaucuauaaaaagagaguguuauacuuuauuccauugaguaauuaugcauuaucuuuuaugacguacacaguauucugagaacauguuaaugucaaaaaaaaguaaaacugauugagguaaaucaguauucaguuaccgacuuaucugggggcuggggguuuaacugaguaacucuggggaauuucuuucuccuggaagugaucauucugacuuagcaagagugugcaaugaaaagugaagugcauuaauaguaagauaugauucuauagcugaaaaacaagaccacugggcagagaagcacugugaauucauagaaacucuauguacuuucuauagaauuccauuauuuaccuaaagauagaaucagcuguuacguaguauuucccuucuguuuuuuuuucauuaguucuuugagaguuuagaguuucaauacaguguguuuugauuccugccauuguucuuaauguaauauaaucucuacgaguucagaauuuaccaguacuuucaguauccaagaaucugaaaaagcagcuccucauacaauucacagccugaacugaaaagcugugacaauauuuauucuuaguguuuugacccauuagcuauauauauuuuacuauagaagcauuaauauuuaauuauuugcuaggcuuauccuugacucuugguauuagcacuauauguguaccacauugcccuuuuguuuggguuggcuuggaggauacacuaugcuauauguuacguuuguagucaaauuuacaaagaaacuuuuuuuuuuuaaaaaaaauuacuauccuuuaaaaaaucuuucucaaauaaaaaaacauguuuuauauuuccuuuuauauauuuaaauauuaaaugauuaaagcucuauaauauagaagguucaauuaucccauuaaacauaaagcaacauaccucuucuuuguuuaaguuaugcucaucaaggggcugaagaacaaccuuccuccagcuguugaaaauacaaaagaauuucaagcagcuuucauccaaauauaacaauuuuauuuucuauaaacagcuaaauacauuaggguuuuauuuccucgagacuuccauaauucaaaugguugcauuuuaauaguuugucauuuacaauacuuuuagaaaaagaaaacagaagauuaaucuuuauaccuuacaguaaguaguuucuucuauauaguuguucuucuauauaguucaaauuaugugcugguuuugaauuaacccagugguaaucuaauaaacuggcuugagcaaaaaugagaagucuaaccugauucauaguaucugccaguuuucuuugguaugaaaaugugugucaugcccccuuggaauuaguuacuaacugcuuaacaacuggcucacagaauucuccaguguagguugaaaauguugcuauggaacacuauaacuacaagaacauuccuuauuguagaaaaugccaauccuguaucuauauaacuauaguaccuaauaagaaugcccggcuuauuccucagauuaacugagaaguaguaagugaacuuauggaaauaaaauggagauggauggcagacagaauauggcugauaccugucuguguuuaucuccagcguuuucuauuuucuagggccauauuuauaucuuauaagagacugcuuucauuguugcuauaaaacauggcugccuucacugcaaauggaugcagaucuaugcauguauucaaggaacacuguaaucugggucuucuuuagcccagccuucuuguauaaacuauuccaaaccuccaugucuggccaggccuuccacacuugugucuguguaaccauuuuccuagacuuucccuuucauuuuucuauuugauuuuuuuuuuauuggugaauuagaaauaaaucagaaacuuauuuuuguuaacaagcauuacugucuuaacagugugaauacacauacaaauauagccaaguauaucucuaucguaaaagguaaggacuguuuguuguaguaguuuuuacauggcuaaaguaccaugcuaguaaaauacacacaauagauaaagucaauuauaucuauacucaauagauaaaaucaauuuugaaugcuaauaucaauuaguuuauuauaaaguuuccuuuuaccauuuuccuucugugcaaauagggaagggggaaucauucuguuguuaguuauaacuugacucugaauuuaaguuuacugaggaaagaagaaaggaaacauguaaguauacauaccguggaguaaguauuucuuuauacuggaguuucucuaauuuggcuggugcuacuaaugacaugggaaucacaauguuaucuauaucauaagagcucucacuucuuaaccuccgucgugaaguauucugcaacacagaauuauuguacuaauuuacaguaauguuuuaguuauuugugguguuauuucuucauuaguuauauaaaaguaguauguaguauauguuugacauaauuuuguaaauuuauuguuaugaaaucuaauuauaaaaugcuaagaaagccaauuaagagggcuuaucuuuuguaaccaaagacaucucuuuuaaaacauauguaauacuuauuuuguauaaaaacacauaaaauuauuugaaaggccaugaaauuuggggagcuccugagugacguuggcugcuacagaucuucacauaugugcuccugguucagacuacccaucuaaacuuucauaccugucaucucucuauuguccaggcaaaaaauaaaaauagaacaguuuaagaacaacacaaaaccauaugcucauuagcaaaacuguguuuagcuuuggauguuagacauggucauaaguuuauaacaaaaagaauuuauaaauaaaaauuaauaaauugcuagcuuucaaguaaaaaugucuuaauuacccauuacuauuuccuaaugagacaguuguaaaauguacuaguaaguaagucuggcaugaauuagugaaauaauccagcagguuucuuaccagcuuauuuucuuuaaaauucuauaaaacuauuuuagaauguauaagauuuaaaagcaacauacuugugaggauggauucuggguucuugaugugacauuggcauuagagacagcaguaaaauugcaaugagauccugguucugaacguugaaaagcaaauucuucaaaucuaguucuuucuccugcuguggaaagaacccuucagaaugucacauguuaaaaacaaccacguguauuacaauuauuuucccaaaucagugacagggaauugagcuuuauuuguuuuuguuugcuucauuuuaaagacauaaucagaaaccagaagaaaauuauaaacaagcaucucagcgauauccuucuaccaagucuuucuaauuucugggaccucgugcuuuuugccuuguauguuuuguaucauugcguagucuuucucuguugucuucuucaccuucuuguugugcuguacgcacugugucgaggcuguggugucaagacugaccuuaaguugccugucuuacuuguugugaaauuugcucaguugaccaucugaguuuuuauuuuuagugaauuucauauaaauaauuuuaguaauuucaaaaggucugggguuuuauuauucauuugauauagcauccaauaacuuucauuaaugagauucauuuucuuacaauauucauuugauaccugcucuuauucguauguauguuuugucaaguucugcuuauuuuuguacuugguauucuuuaugguaucaaaaucuacauauagaaauuaggaauugcuuuccaguuuucuuuuauccuagaagaauucauuuaucaaggcgaugucuuauuagggggcuaucuggucuauuuuugaucccccuuuaucuauuaaauuugaacauaucauacaucuuuuuagauaaucuauauuucacagucuguuauuaagaaauuaucauuccccaugugauccuugcuuguuggcucuuaugugacaaacaaaaucucuagaugcauuugagagcuuguucauuuucugccacaauguguuuggucagauuguacugauuauagguccauuuugaaagugaaacuacauauucuagaauaguagagauaaauguagauucauuguauaaaauuacaaauagguacauuuuaaauguaauuauuuucuaauuuauuaaguuugucuauguuauugaaauaauacaacugggaaagauuugacuauugaauaugauauuauauucauuaggacaaugagcaggaaccaaauguacacagauugcguucucuucaaaauauauuuugcuguuuuaacaaguauaagaacugucaucuccaaagucucuccaacaaaucaaguuaaguuauuagaacagcucuacuuucaaguguuaggucuuguucaucuuguaaacagagagacuccuaaggagaauuggaaagggucauugacguuccuugguuuaauccugaccacuuucucaaaaucugacauuuaauaauguucauaaauucccaucagagaaccuuacacuguccuagucugagucuaauauauccuuggagacucaauucaguacaaaugaaagcucacagaaggcaaguaaucagaaaacaggaaaaaaauaauugcuacaaaguggaccaauacccagcuuacaaauuccaaauuaagcacauggguauaaucauggggacacagguguguuagguacguagugacuggucuggaucauaaauuucacaagacaaggguucuuugaagaacauuuuuucuuuauuuuuaauauuuaaacuaauggucacgccuucauuuuaaccuaccuaaugcuguuucacuuaaaugucuuuuuuuucuucccuguaauaguuguacagaugguugugaccuuauuugaggcuuacauauaggugaauauccauuucuccacugauucagagaagaaguaccuuguacuaaaacaaaugggaaaaaaaaaagaggcugugugaaguuuuuccccuuuuacagagacagugaacaugcuaacauguuucuauuuaaaaauguugaaauucuuuaucaguucgaaauuacauggaaugaaauaaaagcucgauuaccaaaagggaugguucuuaaaguaaaaauaaaagaaauuguagcauucccccgaaauacucccauaaaaugcccaauuuccaucuuuauuuuuacuuauuuguaaguggguaaaaagaagguucuguguuuucaaugccuucaaaaucagugagcauugguucagauccgucugugaauccugacuaaaugccaguuuaaauacugaaguuguuauccuuaaaucugugaacacaucaguacccagugagcuucaacauacaugguuaugagacauggacugugaaagcaagaaccuuauuucaucccacuuuuauuuaacugugaaaaccugaauuuuaaauaauuuaaguugauaacucugccucaguuucuucaauauauuuaucguagcagcucucuugagaauaugagguuucaauuaauuacugaaauaggugucucucauggaaaaugugccauaaauguuagcuuuauuaucaugaguauuuugcaucugaaccucauagcccaacuauuauuagucuagugaguauauuggcugcuuuuggggaacaggggauaaagguuuagaaauguagaauggaauagaaaaaaauaugaagacucagaugucaauuacacuaaaggcaaaauagaagucacaggcuaacaacaguuauugggaauccaaugauaagauaguagaucauccugcaaguaacaguccagguuccuuuaagauagucuuaugcauauagguacacacauuugucaguaaaaagagaauaugaaucaacguuuacgaagaaucucugcacacguccuguggaacuuagaaaaagaaagacaaagcaagggaagaagauugccacagaaauguaaugaaaguacaguaaaugaauaagagcauuugaggaagaaccgugaauuuuuccugaauugcuuacauuaacucuucagauuucaaagaauucauuugaauccauacagaucuuuuucaaaaaauuuguuguaagucaugauaguauaaauagauagauauacccuaaaaguuacaagaaagaaauuuaaaagauuauuguaaaagacugaggaugaaugacacuggauauaugaaaauaaugaccagaaaaaaaaacauagcagaauucuaaagacauuaaaauucccuucuauccaacaaaaggagagaaagauguuaaauagaaggauaugagacgagcaaucgucauguaccuagacagcaucacugacagacaggaaguuuacaucaguggugcaucuuuacugggagguagaugauauaagcgagucccaucuaacucacccuuucauuaucuucacugccugauaggucauagugagggaaagaggacagaauagccuguguaaagguuggaaauagcuuggugaaaaccagcaggauccaagucugucuugcuggagcuuaagggucuuccauuacuucccuaaaguguaccuuaaaaggauagaggucacaaucaguaaucuaaauaucauuggcuaugaugauugaagggaaauaaaaauuggacuuucaguauaaguaaguuauucuguuggcguuaguguagacauaaagagauuuccaaacaagacgcaugaaggagccugagcucugguucuggauugcuugagauugugcuccucuuguaggcuagguuuuucuuagaggucaugcuucucuuacuccuugcagcuauucacuuuaaaaacauaaaguuagauaacuccgauucacaaaaguccugaaacaaaacaaagaauuuccauaugcccuuuacucauguacucagagccucuucugcauaacaggaaggucuuuacauacccacuaaguugucaagaaccagggaauauuacuggcuaguauauagacugguugaccaguaaaucuauguaaucuuaauggguuuuaaucacaguuccuuaggucuucucccuuacucccuuaguuuugacacuuagauaaagacaggccuuucuauuggcugugcugccauuuccucuugacuagacuaaucauguaguuacucaacuuuauaguuugacuuugccuacuuccucgucuguaguuaacaugacuuuguaaguguaaaacaguauaauaggacaagguaaagugccaaagaccucucugcuuaucucacacauuuacucugaggaauaccaagcuaucuguacagaccuggaagcaccacauugucuugugucaccacaguaugaguuuauuucaauuacuugaagucuuaaguaguauaugucagcauguauguaacaacuaaaugauugugccaguaucugaaucagcugagauaugguugaaauacaggguccuggguccuauaccaaacuuguugaauccgagucugcauuguaacaauauuccucaaguaauguacuugcauguugaguuuuaagaaugcugaucuggaaucuucaucucuuuguaaauuccaaaauggcccucagcauuuuuaucuagaauucuucccugucuauuuuucauccccuuuaccucucuuuuugccuuaagaagaccuaugauagauuguuaucaugggucuuuacaucuuacccuauaagagucauucuuguugacuuucuccuuugcagugugugugugugugugugugugugugugagggagagagagagagagagagagagagagagagagagagauugauugauugauugauuucuggugcuuuaugauuuuucagcauuuaauauuaucuuagcaaaaauaucuucccaaugugaaccucuacuuuuauuuuaggcauaggaagaauuguaaugcucauuugaguugagaaugauaggaaauaagaacagggaaaagaaacugagaaaacacaagagaauauugcacugauuugccuaguagcauaggaacaugaaacucaaguauauucuaacucauacauuuaaauuuuucugauacaauguggcauaugacauaucacuucauuauugcuagguccaauaucaauugcugccuaacauuuaugaccaccauuagaagaaacaaaauugccuucucuaauguauauguucauuuuugcauauucccuuucacucaaauauauguacauuuuaugaucuacacaugucaaaccugaaaucauaauuuaaauuagaauauuaguggguaagaauccuucucucauaccuuaucccucucuauuguucacuuguuguguaacauuucuuugaccauuuaaguauucuguagcugcuagacaucagcuguuaccacuaucacaagcaacuacuguuacagucuucagaauaucauauuucuguauuuuuaaaaaagaauuuauuuucagaauuaaucucaaugagcagaacugucauauagaagugccugaauauaaccuauauuuuauaguacuacugaugucaccuuaaguacagcuaauugcuacuuucucuaggcguuuugaauucuuuuuuauuaugaaaaacuuuaaaacacaagacucuuuaauaaugauuucccaugaauuuugcaccucucuuuagcauagguaacuaaugagcaaccuuuaugcuguaacuuuuuaaaauaaauguagacuuuuuauuuguaucauaugccagcaugaaucuuuaaaaauaacugaaaaguauaggcauaguuaagugaccacaauguauuauuuaaaaugacaaaaaaaaaccacacagcaaaaauccauguucguauuuggguuuucuacaaagugucuuuguuaaguuuuuuguuuuuaauuuuguacauauauaacuaccucaucagaauuccaacagauucuuuauauugaauaugauuuauauaauaacauuuuuacguggcuauaauuguaaaaaaaauacagauuucuaaaauuucauuccauuccauugcaguauuuuuuguuucucuucuuagauucaguuuaagauauuuuucuaaaauugcauauucuaguguauacuuaaccaguuaacauaauucugucauauuuaaguuguuacuaaucuuacauggucacaaaaugcagagacguuucugaauaaagauuuauauuuaugauuagauuagauuuuugaaaacaauugaaucauaauucaaaguuugcaguucaguaaauauucucuguaaguacagaaguagugauuuuagucuuaagaaucuuaaauuuuagugccuccuaaauggucuguaucaauccuuggugcuauuauauuuuauuguuuuuauuguaguaauagaaacuauuuaaaauauucaacuuaucaauagcuugacauucacaaacugucuaacacaaguccucaguaaauguuauauuuucauuuucuuuauaauuaucaccaggcauaucuaguuuuucugauucuauauaaggaaucaucucaaauuuguuuuaaugugcuauauuagaacagauccugguuaguauugaauuauacugaguacuaauaaaaggugguuacuugggcuggagagauggcucagcgguuaagagcacugacugcuuuuccagaggucaugaguucaaauuccagcaaccacaugguggcucacaaccaucuguaaugagaucugaugcccucuucuggugugugaagacagcuacaguguacuuacauauauuaauuaauuaauuaauuaaguuacucagugcacagccuuuggcucacucacucugcucuuuagcuguaccuugcugugauuuguauuaucaagaauaauaaccugccuuuuguuuaaaguagcuaauauaguuuaaagugccuuuagauauuguuggcauauaagaugacaucaagcauuuguuguucuugucauuggcuuaaagauuuauauguaugauuguuuugucugccugucugguacauauggaggucagaaagggcauuaagauccucuggaacuggaguuacagaugguuguaaguuaccaugugggugcuaggaacugaacucagguccucagcaaaaacacaugcucuaacugcuaaacuaucugcagccccuuguuauuucuauuuauugacuaagccuucuuucuacacuuuaggaauacguaguaagucuuuuugucugugucugugccuugggccuuuuguuuauaugaauugaauuccuuucauucaguaccaucauacuuuaaagauuauaacuauaagacauuuugauacaugacaccgccuuuugaucuuuuaaaaauuauauuugcuacuuucaacauuuucugagauaagcuucagaauaauuuuguaaagagacuauuucagccaggccuuaugguguacaccaagaaccacaggauuuaagaggcugagguaagcugaccaagaagugaggacagcagagcugucucacucagucucacuguggccaggaauaauuauuguaguccaggcuucccuaauucuggcagucuuccuccagccucuugagugcuggaauuguaggaaaaacuuaguaauauaacuaaaaauacuuucuugccagauguggugagugguacaugccuuucgucucaguacuacuaggaaggcagaggaaggcagaucucuugaguucuuucgaggacaagccagugcaaauagaaacccugucaaaaaaaaaucaaaagaaaaacgacaaaauccuuuugugauucuaaauaaaauucucuguauacagugagacacagaaagcagacauuuaaguugggaaguguuuucuaaccacagcaguuuauuugucuccauagagcaacaucuuucauguugucucuguaaaaccacaaauuacuaaaguuuucuuaauguaaacccuuguuuauucuagagauauugucacugagugaagaauuuguuccuucagauagucuguguaauuacuacugcaauuauaaaagcugauggguuuuuuuguuuguuuguuuucuuucuuugccuuccagaggucuuaacugaauucaggguucaauguuugaacauugaacaaccuacagcgucccucccagcccuaaaaugacuagauuuuauuauaaaacccacuuaacaucuauuuauuuuccucuggaauuuugcagguagauauguuuugccuggaaauaauguuugcuuucuuucgauacuaaauauacagcuuugcagacagugagaauaugcugauuuuugucauuucauauugcuucuaagcauaguguucauuccuuuucagagcacucauaaacaguuuaauauaauuuccuugagguuuuauuauaugauuuuuuaauuuaaaauuauuaaaaccaacuacaguuuauugugauuuuuguuaugaaauaaguguauaaaaguuuuuacucagaaaaaauccuauacauuagaacgguucucagaucauuucaugauuacacccuuccuaauauaaggaagauagacucuauugugugguuuugacuagucucucucugggguugaccuacauuuuuuaacacuacaguugcuuuucuguuuguuuucaccuccucagugcucuugaugaguuaugcacuacauuccgauugccgagucuacuauauaacacuaacuuacagugcacuaaaucuccgagcugaugcaaagcauugggauccuugauuuuaccauauaagaaggcuguuuucuguuuauagcuuuuucuuuauaacuuuuguucauucauuguuuauucauuuuccuccucccacucuuucucaaauuccacccuuucccucccugccucaugucaaagagccucaaacaguaggcaaucaaacaugcuucucuguguggaugugugacucauggaaaaguauuaacgauuaaggauuugcauuuauucuuuucuuaaauuuuauuuacucagaauguaaaaaaaugaauguagacaauguaaaagcauguacaagcacacacagugugugaaugggacauaccagguggcggugauaugagacagucaccuacaaauugauuuucagcaagcucuccuuucaugucggucuucuugaauaaggucucaaaaugaagaugaaggggaauuucugaaaaaacaaaggaaaacaauuauuuuugguaaacaccauuuuccacagccuaacacuaauuuucuuuccuuuuuauaaauagcacauaggcuuagggaaaaaauuuacacaauaagaacuuugagaaguaaaccuucccaagaagguuaguaagcguuuuucagaauguuaugaguuagguaacauucuaaacgagcauaugaacaguucugaggucucccuuuaguguguaagaguagucaguguaaauguaacagucuucucagaggaauggucacaaaugcaccacaagguuuuuacaaaaauauuuaaaauaauuaaaaaugauuuuuauauugugcuaguuguuacacagaaacacuucuauaagcagaaugcaugaaacgacaaguuucacauuaugaguauaacuaaagcuacuuauauaaagacuaacauccaccaagaaguucucuuccuucagacagagacuuauggauauucaguugaaaaugcugguauauuuuauacucaaagagaagccaagguacagauaagguguguauaaugaauucauucuuuaaugugugugagaggggugaguuuguacaagcgccacaacaugggcaagugaaacucagaggacaccucccucauggaaguugguuuuuccuucugccaugugggucccgggauugaaguagguuugucaggcuguggaaagugccuuuuaccuguugagccaccucacaucaagcugcuuauuagucaagaguuuuuucauucauaacuguaaaaccugggucaauaagauagcuuagagauaaagacacucccaccaagcaugacaacaugguagacagagaaaacugacuccagagaacugaucucuggccuauacacacauguggcauguauacaucuguaacaucgaaacacauaaaaaaugaauaauaaaauaacuuuaaaaagcaugaauagacacauauauuuuccccugagaaacauuuuuaaguguucuuuguuuuuaaaccuauugaauguuuugcaugcaauacacagaauuauuuaugaacgauucuaucaggagagacugaagccgugucuggguuucacacagugagaugaacugcuuucucaacgguugugauuuauuaguguuuuuuugagacaguaucucacuauaacccuggcuguccuggagcuuacuauuuggguuuaguuagccucaaauucacagaaauuugcuuguguaccuccccaguucugagcuuaaagggaugcauccccuugccuggcucagggcuuuaaggacaaguccaugcauacauacaaaaaaguauaauuaaaagucuaaguaucauggaauuugauguaaagaugaaaagaauuaaaugggaaaagaaauuaaauacugugcuuuaaaacacuguugaagcuuuuucaagauuuugccuuccaguugccucaacauaaccuuguuccucuaaagacuuacaaaaauaccaucuguucuaccaccguaaguguuggaaacagaacauaacuggagauggccuuguuccuauguaccuuccuaaaguaccuuuuggccuuuuaguaaaguuauuuuguuaauauaugcauauauuuuauauuuauauacuauauuaaaacuagaauauaauuauaaugagggacuuauuuauacuucuagcaccuuuuuauuaucaaauauaaguagguauuaagauuuuugucaaaugcaagcagcuuuaacugauaaauauaaaggagcugagcuuacuagacuaggaugccuuagaucuaaaggauauauauaaauauauaguuauagauauugauauuauuucagaguuccaaaauuuagaaugaggcuaucucaucucucaaaucaagagaaaaucaaauuacuuaauaauaaaucaauauaaaggauaauacgugugugagucuggggaucaguuaccucagcugcuggcuccaguguucaauagcugaguuaucuugaauagaaaaaccuccaagcuuaauaugcucauguguaagaugaaaaggacagcauaauguguucucaugggguuaugagaauuaaacaaaauauccagugugcuuaguacacauuaauaguccagggcuacauagugaggcccuaucucaacauaaccuuguuccucuaaagacuuacaaaaauaccaucuguucuaccaccguaagcaaucucccacaaugcaaaaauaaaccaaaaacuuucaaauauugccugucuuuauaagaugauguuucauuauagaaaauauucagauuuuuaugaggcagcuuaccugauggcaaugacaaaacaggauggaaggaggaaucgaguuuggaaaccuguucucuuaacaggugagaccuggaacucuguucccaguugucccaacugaacggugaucccguguaaggcgucugugugcuacuuaaaaaugcuucuuuugaagguaaagucugcaagaaaaaaaugucaaacuuucacuuuuugcuuuaagacuuaaaaaaaaaaggacaggugaaauuauaauacaguauauaggagaauaagagccuagcuuaguaagucaucuugauauagaaugagauguauggacuguacaucuagugcuguggcuagaaaagccuucugggucuuucaaacugaacuuauucaugaaaauaagucuuugugccaucacagugaaacacaguaaaaagaaaagaguccauaaaacugcuugucucuucuacuuuguccauauucaauuccuucuacaaaagcuuuacacauuugggacuggagagguggcucagcaguuaagagcacuugcugcuuuucuugaggaccgggcuaaguucccagcacccacaucaagcagaucacagucacaucuaauuccagcuccaaaggaucuaacacccucuuuuagcuuccuugaauaccuugcauacacguugcacacauacacauauacauauacuuuuaaauuauauuuuaaaagcuucacacaguuuuguuagaaguuuucgguuaacauuuuuauugcuuuauaaaagauuuaacuuuuuuuuuuuuuuagacuuuuuaaauugcguaugagugucuugcuugaaugugaguguauguugccuaggaagcccagaagagggugauacucagaacugguguuauguaggcugcaagcugcggugucugugcugggaacugaacucagguccucugcaaaaacaagcacgcuucacugcuaagcaauuucuccaucccuauugaagguauuuuaaaaugaaauuaccuguuauauauucagcauaucuguacaacuaugccaacuuccuuagucuaccagugucuuuauaguuucuuuuagucuucaguagaugagaauccagauguauuguccauauguaauucugguuuggauguuucaauucauucuaaacccuuuguuacuuggaaauguuauccaugcuaaaugugcucagucucauuaauaaauagcaaagggaccaaaggagauacucuuguuuugcaacugguuauaacaggaaugacauaacaauuucaaauguuguauguggggcuggagagagaguucaguagcuaaagaaaaucuuucccaaggaaggauaagaaucugauuauacccaguacacauguaaacucaaggugugcuagcagcuaucaguaaccccagugcucaaaguggugacaggaugauccugggggcucuauggcuacucuagccuauugauaaacucuaguuucaguaagaggcccuaacugaaacgauaaaguaggcagggcuucuuacuacaguggucugaaagcuuacagucuacuuccagaccugucuuaacaaugcucuuuuugugcgaggccaccucuccuggauaacuguugcuaccacccuuugucaaagaaagcucucuuaacaacaaauggagaccaucacagaaaaucguaacuacagccaauguaaagaucaacacaucauaggaaucugcaggauagucagccaugaaaccucaugcauacacgaaaaugaacucagcagcagguuauauauaugagguucuagggaagguaguugagaagggcugaagcaaagggaggcgagaaagugacguaaaacuauuugaaugaaaauaagacaucaaccucuuuuccaccuauacauguauauugcacaccacaugcacacauacauauaccuccacauauacaaauaaaacuuuaaagaugguuuaguuguuggaguuuuuugguuauuuguuuaccaggauauauucccaguuugccaaaauguguuucauuguggauuuuuuuucagagucuauugaaaaucacuauauuuucccagguaaauugcguuaauaauaaagguuaacucuaccuuggauuaauuugaagagucuuaggggugugaaaauguacuuuuucaaagacucaacgauuggucuuuuugauuuuauauauguuuguuuuauauuucacggaucccugccuuucuuuaggauuaaugaaguuccucuguuaacuuauuguuuuacauuuuucugucuguuauuucuguguggugcacaggguggugcauguucaugucugggugcauuugugaguguagguguacuuaccauguauacaugggaugaggccagagguugaugucaaguugucuucccccauugcuuuccacuuguuuacuuguaagacaguguuauucaaccugauguugaccagcaagacaaaaaccucucuuuucucuucucccaucaugagccaccauacuuggcuuguuauguggcuacagauuuucauaaugugugaccuuagucuuuaaguaauguaagcuagauggcuuguaaauaauagaaaguuccagaggcaggaaagucuuaaaugacaguguugacugagucugucuguugauggccuacuuuauucuucauagaugucugcucacauagcagacauauagugauagcucucuggaauugagucaaucaggucacuaguggcccuaauuuuaaauaucacauggagggugaaauuuauauaugugaguuuggggaaauuaauucaauggaauuccacaguggcucucaaggaaaaguuaugucuugaucacuuacaaaaugcauucucucucccaaaauuuuaacucacuccuuguauccacucaaaaguuagcauuucauguaaagauauuaucaaguacaaguaagggucaagauucaauugcauuucauucaauccaacuccccuuugacaaauccccgucuaucugugaacccaacacauuauauacuucaaaaauagagagacagcacagauauucucauauauccaaccaaaagaaaauacuuguacaaaaacagucagcuucaaaauauaucagaaacaucaaaauacccuguaagaauuaaaaagaaagagagauaauauacaaauuuguacuuauuguugggagaucugaaaaguaaaauauguguaaggauauaaaugucuuggucaguacuauuaacuaagugaagcuaauuaaagcgccuauuuaaaaguucaccccacuuucaagugcacaucgaauauuuauaugaacagugcuuuuacacugacccacaaaacaaaucucaguuacuuucaaggccugacgaguguuggagagauggcucugagguuaagagcauuuaauugcucuugcagaggaucaagcucugguuucuuuccuagcacugaccugaugguucccaagcacacaugaccugaguuuuauggucagauacccucuucugaccucugcaggcacugaaugcauacaguacccacacaugcggacaaaacgcagccacaugaaagagagagagagagaacgaaugaaugaacuaaaaggccugacugaaaucauacaaaauggcuuuuaaucacaagacaaauuugagauagcaauagugugguauuuggaaauuauuauauaauuaauauaauuaauuauaaucuauaaucaaagaaaauucauaagaaguaagaaaauacaaagaagcuagaaaaagaaauuaagccucaagugggcaauaugcgccaugccgaucugacugucccguuugacuggcuaguuaucuugugucagagcauauauaagacuguuaacucagguagucagaauauuucugauggcaauguaaaaugaugaccaaaaaucaugacacaaaaaaguguacaauaauauguuugcagcuuuuauuaauauagugccaacucagcaggaacacaaauaagcaauagucacaccauguagucauugcuuuuugaucucuguccucuguagucccuuccuauuuccuuucaugccucuugaaaucauuucauugcauuuuaucuagauuacucuauuuuuauucuuuauuacccaacauacuguaagauuaaaauauuugaaucuauauggaauuguucuauucuucuaguucucuuugucuauacuggagccauuacugaggacauaauacuguaagucacaguacucauucacacucuuccuuuuuaaauguacacuaagcuauucauaaauuugucauuauacauaugaauaaguaacugaguuucaaaaguaucuugcuaaguuuuacugagauuaccuucaauuuaaauaaaauaucugcuauuuaggaagauauuuuacauacuacauaaaacugacagauuccaugcagggagagcugcagugggcaagugagcucccuugagauaguccauagucuugcuggguugcaaugggugcacucuggugaagccccagagacgucccaggauugguuuuuugcugauaugcuuucuccuguuugucauuuccauacuccucauugauuuggcuugguauaaguggacaccaggagacccucaaugccuauagucuagugugaauauuuuccaggugauauagccuauccuauuggguaaauuucuugcagaucaacaugaagaugaaauuugaugaauuaaugcuguuuagauacauuaaggacuuaauagaauucaugauuugauucaaauaauuuuuaggaagaaaguguuagaaucaagaguagcaugugcuccaucgucagaauaaaggcuguauaguaaggaauacaaugagcuuucauaaauuguauuaagaagagaaaggaugcagauacaaguguacauuaugauaaaacaaggccauaugaaacuguugcuuugaacuuaugagcuuauagagugaaauacuguuuugaacuaucaacagccucuguaacucccuuuuguggacauuuuaucagugagguaauuuuauaaagaacuuuugucuaagaaaguauaaaaaggcugagagaaaaaaauaaaguguggcuguuggcgugcugugccuuccauucaauguagauaagucuaucuguauguguguacauacauauguagguauauguguauauauaaauaugcacaugcauuugugaaauugaugaaacagguggucaggccuggccgcaggcugugugugugugucugcaugaagagaucuuuuucuuucucgcucgccauccaccuuuaagagagaguuacgagagaucagaguuucccccugagcacuguugccagcccuagauaauuuuguucugucagucgugccgacccuguacaucgcccaccacugucagcacuuggggcaaggggggagauggguuauaucguugcucuuaucaccaccuuaauuaccaacaucacaucucucugccugccucaguuuacccuguggugucaaagcuggucuuuggcauaaaacuuucauauuucuauguaaagaguuacaugaucuuagaaaauuuacagucuccuuuuggggacauaccuugguuuuuaaaauauauauuuaaaugguucuuauaugguaaauaguuuuaguuuuaauaauuucuugaugugauuguacuuccucuagaauucauaucauaaucaucauaauuuaguuucacuccuaaauuugggguaacuguucccucagaacuucuauuguccuguugcaccuaaaagaaucagucucagcggcagcgccauccuuacccauugugggccuuauguuccuuuagaagccuuaagagcuuauauuuuuuucguaaauuucaugagacucuguuuagguauggguuauuuacauauuuuaguugauaauacugaauagcuaaugaacuuuuucagaauauaugccuuuuuucucagguguuagaaauuuaugcuuuguguguucuaggaaauucuuuuggccuuauauucuaauccuuaaaaagacagauuaaucccaacaauuuuacuuuuaauuuuuaaaaauuugauuuuuuuaugguugcuuauuacaauuguucuggaaguuaaucucuuuccaucagggucagcuuuuaggucuuuuucuuugcuccagaaaccucuaucuccucauuuucauuguauucuuccaaaaaacuguauccauuaacauuuaaauuuugucuuuuucccagcugaguguuagccccauggcggugggaacccuuacaucuucuucaguguaguaucuccacugucuaagcacugcauggcacgagguagguaauguugcuuucuagaagggaggagaaggaagggaaggaggacauaucaaguacauuauuguaaacaucuaaauacugcacugaucuacaugaaggccuguuuccccaguacaaguccuuccugaaagaaguuuucuagaccuguauggauguuguuuccuaccagcuuuagcgcacuggaaggucacacuuuguaaggcucauucauaguaaucagggcugugcugcucuguugugaaagggagaaugcaaacauguuuggccugcaaaugucuccaaaauaagaaauauugggaagaaauagagaaaauaaaucaacacagaaauaugaggagaacaauuaacauuauauuaggcaaacaugacagaaugccacuccucacuggcuugaaagaacuaauacauaacacaaagaaugaguccagggcaaacacaaaacuaaggaccacccuagguuaaaaauaugauaugaauuuguggucugaagaacauuuucuauucacagcacagcagagcuuauacaacuguaaacaacaggcaugaaauagagucagauuugguucauguucuaccauguccuaauucuugauguuaguaugcuauuauuauuagcauuuaugugaggaauuuuaugaaaggaauucaauggcaccauaauugcaaguaaguuuuuucuauuucuccucuucuaaaacuuuuccuuuauuuuaccaaaucaguuaagacaagucauucauucuacaaaauucauucuacaaaaagucuuuuuuccugugauccaagucuucauuacuucuaguuuauucugauaguuccuuguuuuccuagucucucccuauugcaaacugacacuuucagaggcuccauaguaaucauuguaaaauaguacucauauuucacuucccacagagaucaucacugauuccccaacaguacucuaauuuguugacuaucauccucauuccaccagaagaauucuuauguggcaaggacuggguuguauacucuuuuaauauaauuuagucucagcaugacucuuuaagguagccauacaguuucuucucuuugauuucugaaaugagguccaccuauguuuuccaaagcagaccucauuuggaagguugcuuaauagaaaugggcacaaauuccuuccauucuuaaaaguauaaccucuuaugaaaagauuucuguaucaacaaggcuagagagauggcugcaguuaagaguacuuucuacucuuccagaggaucagauuuuggguugcagcccccaucuaagcguauauuuaugcguaucuguaacuccaggguuuguguaucugaccccacuggcuuccauuggcaccugcauucgugugccuauguacacaacuacaccuaguuaaauuuuaaaagucuaaaacucuucuuuaaaagauguuucuccguccucuugacucugggacagacgagugauuuacuuugugcuucacaaagcaguguaaaugauauuugugguuuguaucuuucuucauguugucuugggggcauugcucuuaggugacaugaaagauagccauuuuaacucuuggaauaugagaagucccaggugaauggaacugaagcagacaacuuucuuugcuaucugccagaagaacgacugaggauagcuucuuagagcauggcacaacagugcccuaguaagaaauacaacagguucaagguguagcucuauggcagaguauuuguuuagaaugagcaaaaaaccuuggguucaauucccagugcugcccuccccccacaaaaaauacaacuaggauaucaguccacuguguuuuacagaacacaugaccaaaaugugcaacugccucuagaaaaucauuuuuaauucuuaguaaaauuugauaccaucuagauugaacugcaauuccuaaggcauauuuucucacagaaguaaugguaugcauguaauaaauuaaauuucuucaacucgugaauuccuuggaauauagaagugauguagcuaggaauuccuuuaccacgauuacuuauuaucuaaagaagauauucuuuaugggguaaaguagauaugacucccaggugaggaagagcugguuucucaguaguagacugcuauuacuuaaauacuaguugucaccuccuuuucuucauuuaauuggacaccucagacacuccaauuccccuguuuccuauaucauuguaacucauuaugucuccuacagacuauuuauucucucuucccucaagguacaggagaguagcugagauacuucuguugaaauguaauuugucuaugugccugauuuuuccaacaugaauuuaaaucuauauaaaaucaaauuaacuuugaaauuuuucuaauuuuuguuuguuuguuuguuuguuuuuuguuuuuccagacaggguuucucuguguagcccuggcuguccuggaacucacuuuguagacuaggcugaccucgaacucagaaauccaccugccucugccucccaagugcugggauuaaaggcgugcgccaccacacccggccugaaauuuuucuaauuuuuuaaccaaaggaugaacauaccuauaauuauuuagauguuauccaaaaauauuuuacuuaaguauuuuuaauuaaaaaugaagugcccauuaaucauauaaacaaagucuguaaauccaauuaucuuauauuuuagagagaaaaugaaaacauuaaaauaggaauuugagucuauuuucuucuaaacuccuguuugugcuucugaaugauguugcuaacccacccagcuacacccagcuaagcccugaugcugcuaacccacccggcuacaaccagcuaagcccugaaguaucagugaugagccuuagaaacacuacuuuaccaacuugccuuaaagguuuauuaaggaauuuuagugaaugcaaucuuaauuuuaagauuuauuccaauuuuuaaauuuuaugucuacuagaacuguuuuuguuuuuaugacuuggcuuguagauuacauguuaaaacugaugaguaauggaaaaauuauucucaaaucguuucuuagucuuccauaguuuucuuauggcuuuuuacuauuuagguaaguagcuccuugaagugcaaacauaauucuucagaacaacacuguaagugauaaacaagcuuaaagguuauauuuacauagaaacaagggaagacaaagaaacauaaaagaacuagaauagcauaggcaagggggaaccuuccauuuuugaauguaugugaaauauaauauugaaaaacagugaggccaucaaguagagaguggucuugcuggaggaaggauagaggaaagguaaaauaaaauuaaauuuuaauuuaaaauacauuaaauuuaaaaugcauuuuuaaaauguaaaaacauuuuaaaggggauagaacacaaaaaugagauuccagcaaauaaaauuuagguaaaaauacugaccaggccauguuccuuauauuauaguguaauaauuuauaacuugugcugugaauauauagaauuuuuaggaaaagaguaacuaucccuguccucaccccuaauaugaaugaagagacuguaaacagacuacaaaaacuugggccucuccccaacuccuagccauauucucagcuagcuggcuguacuuuggucaaugaaacauaauaucgccucaaaucuacuguuacaauaaguuuccugauuuauugguuccaauacuuauuaaauaaaaucuuuuuuucuauuuuuaggaacuuuucuuuuuuauuaaauauuuucuucauuuacauuucaaaugcuauccccuuuccuaguuuccucucugaaaguccccuuuacccuccccccacccugcucccuaauccagccacuuccacuuccuggcccuggcauuccucaaauaaaaucuuaaaauaauccugauaucuuaucuuuaaauggaacgaguuauacuauuacauaaacuaugaguaugccuaaucaucuacguccuguuuauuuuuagccaacauacaaacagguucucugauggcauuuccauauauccuuaguuuuggaugauuucccagcuuucuuccuuccauguccacaucaaauguucuauuagcuucugacuguguucuugcaaagccugucuuuuuguuugcuuuuuuuuuucuuuucaugaaccuccuuuuaguuuccaugacuaccuacacauacucccacaugcauacacauauauaaacauuuaaagccaguuucauguaugagagaaaauauguaaucauuaguauuugguuguaagcuauauucagaauuuuaccuugaagucuagaacugucuguucuuucccaauguuaagagaacucccuuugccaggaauuagguaggguggcucccugguaccuacggcuguaaugccaacuacaacagaagguuguauggcagcaauaaagaauaccaagaaguaucuaaacaacauuauggucagauaaucauucuuauuuugauuacuaauuguaacgaauauuacuuuaauguuauugacuauauuuauguguuaaaaaucauacauaguauuuuucuggagaauauuuuuacaucuuauccauaccugccaauauaauuuccuagauuuaaagacaucuauacuguagacaugucaauaauuuuuaauuacauuuuaccaaauauaaaaucauagauucucuaggaauaaaccaauguauccccauaagaaauaagcagacaauaaauaauauaaucugccuagagauuucaaaguuucuagauuugaaaacuuuauggaguuuuagcaacuguuaaccuggucugucccucauuagaaaagaacaggcuucuuagagauaacaaaauaaaaugcaacaagauaaaacaaaaaccaacacaguuagacaaaagaagggacuagaaucagccccacuuuucacacacucaaaaguuucuaccucagaauauuaaauagaaagcuaugugcucaggugacuuggugcaauacauuacuucugcauuaaaaaaaaaaguucugucaguuuuugugugugcgcaugugcacaugcaugaauguacagaccacacagacugucagaggacagaggggcuguuucucuccuuucuacggugcguucacuuacacugcaaguacauuuauccauuggcuuguacccgaacccugaguguuuguaggcagagugcucacaguaacuaaugguuucuugaaauaggagauaaaacauuagcaugaagaugagcuagaagccacugacaacacugagucuuuagucucaagaccuccgauauaagagccuuugugggcuugagaaaagcaccuacuaugggacuugagaaaagcaccuacuacauagagcuccucauagccccaggauugucaggcaggcgagaugcgggacuucugcauguucaaaaccaaagaacuacuucacagacucuaaucaacaagccugcaguguaucuacuuguauuucacaacuaaucuaugccauacauuuccccaaauugcaguuucuuuuucugccuagcuucgucuguuggguauuuauagggcaaauaaccaauaacuuuauucacaaaauuaaacuuguuaauagagaggagcgaugcuugaaagcuguacacaccgagaagucauaccuaaagccucaauacagguaccuauacauguuauugauggugucugagaccucaaacuugauuguaacaccuaaaggggggagguuaagugguuuagaaaugucgcuuucugggauccagaggauggagugugguaauuuuaaaugauaaccccaggcaugucuuuuaguauguauucuuguucuauaaauuuuaagugugagauucucaaaguaaaucccacauucacugaguucagucaguaaauucauuauuugcauuuuggaaagccuggacaauauaaguaguuugcacauucuaaaaaauuguccugagugagauuagugccucacucaucccuuaucggguuagcuucuuggugcagguaggaacuaacacacauauccacaacugacaauaauacuuuggggugcucacucccaaguaggauaucuucaucaagguccucccgccaaggcucaagagucaacgcacaaaaggagguaggaagauuuuaagagucagaggugauggaugacuccagggaaauagugucuugcagacucugcaggacuaacacauacaugaauucguguacaagaagaccugaaagggcucaugccagaagguguccaguacuaggaggggaaguagacaccggguuccaccuuuaaccaagaagcuauuuguaaaugauagcugcuggcaaaggaaaaaguuuucuccaaugaacugucaauagguuuaucuaagauaccccagggcagacugcaugcaggaaguaacugaccaacacaagugguuuguuuuggaguuuuuauauggacuucuuuuguuguuuguuuugguauuuuugagucuuaauuuuuuguaugcauugauuuuuuuuuucaaaagaaugagaggaagaacaaagaugaguagguugguggggaagaucugggaggaguugagggaagggaaaaaacaggaucaaaauguauucuaugaagaauguuuuaguuugaaaaaagaaaaauaauuuggaagacugugagaaauggaucgaagguuaagagcacauacagcucuuccagaggaucugaguucaguucccagcaucucuaaagagugacucacuaccaacuaugcuauacaggggaacuguaucccuugauaaaggcaugaaccaccacugccaggcaagggaaucccuugccucuaugggcaccugcacucaugugcacauaucuauacacagacacauagcgacacacacacacacaaaagaaagcaaucaucuggagaacacauggaaaagccccaagacaauauggacaugaaaagaggcauagcaaccaacaauguuuagacuucaugugauuuauucaauuaugacuauacuuaauaucagagagaccuuaggucaguaaguauaagaaucacuacucagguaaugaaaucaggcucagacucaugaaagcuaauaguaaccaccuuaaaucuguacuccugauuaguuuguuaaguaacaguuaacaagaaggauuaagaaggauaaccauucuaaaagugugccaugggauauauauccauaucuauggaaagauaaauaugacauuucaccuguuuauauaccugacuuugauggucaagauaugaaggugugaucauaauaccaaaucaucauagugcucuuuucuagccagccugaccacucccccaaaguuuauuaguacauauacauuuuaccaggaccuuuuuuuggcuuuccaucuguauucauguaugucacaagccaaaucaagcuaaaucucugcauguuucuuugucucuacuucuauuguucuaucuuuuauuccuugcuuuccuacuggucuguuucucuacagagcucacaaccuauaaaaauaccuaagucaccuuguaaacauacauauuuacuacuaauuacguuuaugaguugauggaucucaagaauaaacaugcauagugguguccuuaguuuuaguuguauuucuuuaaugaguaaugaauuuucaacuuuauuggugacuuacuaggcuaugcuauucuuugaaagcuguucaagucucuuacauuuuuacugacaaauguuuuauuugauaaaaauggaacauacuacuagccauuuuaaccaguauaaccuauaauuucuguuuaugccaaauuuucauuaguuuauuucuuggaaaauauauucauaguaaaaauauauacuaaauauauauuccuccuagauuuaaaacuuuuuuuuuguuucuuguuuuaucuuuuuucuuuuuuuuagauuuauuuauuuuguauaucugaguacaccauugcucucuucagacacaccagaagagggcaucagaucccauuacagaugguugugagccaccaugugguugcuggaaauugaacuuuaaaaccuuuugauauagccagaaauggugguacaugccuuuaagcccagcacucaggagaaagaagcacauaggcccgucugguuuauauagcaaguuccaggacaacauagaggcccugugucaaaaacaaacaaacaaaacaaauccuaacaugcauaugugagugugauauggguauaauaaauguuuucccuuaguauacucgcauacaucuugagagagaggagagagaaaagaggagagagagagagagagagagcgagagauauuaccuagucaccuagccaugaagacauuuucccauuuuuuuuuucaagguuauucuuugacauuaaaaccuaucauuucugcugggcaugguggugcacgccuuuaaucccagcacucgggaggcagaggcaggcggauuucugaguuccaggacagccuggucuacaaagugaguuccaggacagccagggcuacacagagaaacccugucucaaaaaaccaaaaaaaaacaaaaacaaaaacaaaaaaaacuaucauuucaccuuucucugacuugaaggauaauucaagauacacaccacaguauuaucagucugaaaauguagucggucuuaaauuuuuuccuaucacaguaucucuguccuuuuuagugugagcugacacaauucuuagaaacaccaagagccucuauauauuuuauagagauccaugucccuagaccaaaaaguucuuugaggauucugaacuguuagcccuaucuuuauacauggcuucugcugagaugauuuuugcuuacagaugacuuacucacaaaucaaaaccacaauauauuugacaaaaauuuuggcuuuggcucacaccauggcauguucuauauaacucuuccccaacugaagaugagaauuucccaguuaaguucuaguuccuuuuuaccuaacagguccucacacaguuaccucuuccucuuguaguuuaccagaagcagcuagaagaaaccagaucggaagucucccuaauuugcuugcaaauuucuuauaguaacuaucuagauccacugcuccugcauccagguuaaagugggccugccagauagccuaggcaagaagaugaggcuccaacauagugagagcccuugucucaaggaaauaagguggguaauaauagagcaucuauuauuguucuggucucuguaagcaugucuacccucacauucaugugcaagcaccuccuccucacccccaccccacaagcaccacacacacacacacacacacacacacacgugcgugcauauuuucuaagaucucagcacuuuacccucugcacagauguuauccucugcacuuucucuacucaaaggaaucuugacuuuuuuccauuauacacuuuacauuuuuuucauucuuauuaaccaacugcaaagcaacaucuacaauuuuauguauuuguuaugguagcaugcacucuuagggcugccauaacaagaugcuauaaauugagaggguugaaagauuccacguucauuuucuuauaauuauagcaucccagcugucagcaaagccauacugcuugcaccauccaggacuuguauugucccugacugaugguaugcuuucccauauuuucauaaugccuucaucucuuuguuuuccaaauucuaaugucuuuucucuuauaagaacauuuaucacuaaauuuaagguucaucuuacguccaaaaucaccuugguauuguuucuuaaauaaauauacaaaauaaauauacuaaauaaaaguauggcauuugcaugucauaguaaagaaagcaacugaguagcuuagcucuagaguauagaugucacaucaauaugucugcaggguuguuuucuuuaaagaccuaaagaaagaauaguuguguguauucuucuuaguuacugauaguuuuuaaugaucuuuggcucuagaucagugguucucaaccuguggguugcuaccccaaaagggguugcauaucagauauuuacaucacaaaucauaacaauaccaaauuacaguuaugaaguacaaaugaaacaauuuuaugauuggggucagcacaauaugaggaauauuaaaaggcugcaguauucuuugaaucacuuuucacaugcaaaugucauuuaccuuagaagcauucuucuguguccaguuuuaccauuuuuaaaaagcacuaguuguuuuggcuuagagccccucauaaucaccucugcaacaaaucuauuuccaaguuaggucacaucuugaaguauugagggauuagaaugucaacauaaguuaaguuguuggucacuauuuagucuauaguucauucucuuagguacugggugucaggacaugggcaucuuuugggaucaaaaucuuaauauuaguuguuuaaauguuuuauucccaucucugcucccacgcauauuuuuuuaaagucaccuauccuugcacuuuuauucuuauacaguaaagaugcuccccccaccccugucccaaccuaaccccuggcguuuugcaagauuugucuuugucuuugaaauuuugaauguguuuuagauauuagguaauggauagauggauggauggauggauggauggauggauggauggauggauggauggauguucagacugauuauuuuccuaccuuuuuacguguuugguuuguugccauuaauuuuggaaauuucucauuauuucaaauauuucuuucuuuuguccuauucuuuuuugauauuccaauacauaucuugacacugaaacuaccucagaguucugacauguuguguuucauuuuuaagauuccguuuucuguuugaauuguuucuaaaguuucacuagccucugucugcuacguguguuggucuuugcuuugccauguccagucugcugaugaacucaccaguagcaaacaagguucaaguuuuuacauuuuuagcauaaaccuuugguuccucuucauuuuucgucucuuugcauuacaagccuauuauguucuuuuuuaacuuauauacuaaagacccuaauauacuaauacucuuaugcuauaccacaauacucuuaauuaagauuuuccauaugacaaaauaugaccauuuuucauacuugagguuaguucuaauaguuguuuugucuauucuucguaauaugccuuggagauuuuugucaaauauugaguaugauuuaccaugucauaggagguaaguagaccuuuuauuauuauguuauagaaacuaaaaguaauaauugcuauugcuaugaguaccaaauacuucagaauaucacuuuauuaauauauauucaucggaaaaaugaguuaauuaugacauuccuauguacauaagauauucuuugaucuuaacuguucucuuuacccuguucccauucuugucucuuaaugauccucuuucucuucccaaauagucauacuuuguuuucaaccuauuuuuaauaaaaaaauuuaaaaaucuagauuccaaauaugagagaaaacaugagacaaacauuuuucugggccuguuuguuucuuuguuugguuugcuuuuacuuaucaugaugauauguaguuccaucuuuuuuuccugcaaaugauauaauuuguuucauuaugacugaauaauucacucugugugugugugcacgcccguuaacaccuguggaaagacaaucgcugggauaggcagagauaaaauugauuuucuuaccaguauguugacuucagauguaugccuaggagcuacgguagagcaugagauuaugcuauuuuuaguuuuuugaagaaucucuauacugauuuucauggagguggcauuaauuuauauuccacuaauuauguauauaagcugcuuauucauuauuugacagaauuuauauuucuggcuauccugaugauugccauucugacuaaggugagaugggaaucuguuuaguugugguuuucauuaucccgauggcugaggaugcugaacauuuuccuacauguuuauuggccauuuauacaucuuguaagaauugaccaauucauuagcccauuuauugcuuagacaguagaagguuugauguucaguuuuauaaguucuuuuuauauauucugaaucauuuguucuugugacagggccuaauuaugugaaucacuuuucucaguaucauuuguugaaguuguauuuucuguaaguuuuguuuugaacaacucuugaaaaucaaacuguaaccauauggguuuguuucuugaucuucucugccuucccagggguggugagucuuuguuagcauggcucuaugaauugcauuggaucuauaagaacuuugggugguauacauauuuucacaauauuaacucugcugauucauuggcuuaagaugucuucccuucucuaaucuuccuugguuucuuucaucaguuuuuuucacuuuucuauuauagaucgccaucauuuuuauaguucgaauuguuucuuauuguauuugaagcuaaugugaaagguuuauuuccuugauuuccuuuucagcauaauuauaacuguauauuaaaaaguagacuauauuuuauauguugauuuuuauaucccacuauguguugggaauguuuagccaaucuaaaagucuuauggaggagucuuuuaaguauaauauccaaacacuugcacauacgguuaauugaauauuucuuuuauguuguaugcauaucauuuucucaugcuuuacucuuacgaucuagauaagaauucccaugauguauuauauaagaauggggacagugaauaccuuugucuugcuuuugauuuuagggaaaaugcuuuuacuuuuccccuuuuuguauacuuuuggcuguacauuuguuaggcuguguguguguauguguauguguguguauguguguguguauguguaguauaccacacacaaguugguuucauuucagagauuuaggaaugauuuaacauaagaaauuaauaacuauaacacauacauauguaaagagacauaaagcacaugauugucucacuguuccaauggauaagggguccuugaccaaguucaacauuuuuuaaauaaaaucccugcaguugggaauagaaagaacauaaucauagauagauagauagauagauagauagauagauagauagauagauagauagauagauagauaacauaaucauagauagauagauuaaauagauagauuagauagaugauagauagauagauagauagauagauagauagauagauagauagauagauagauagauagagaacauaaucauagauagauagauuaaauagauagauagauuagauagauagauagauagauagauagauagauagauagauagauagauagauagauagagaacauaaucauagauagauagauuaaauagauagauagauuagauagauagauagauagauagauagauagauagauagauagauagauagauagauagauagauagaaagaaagaaagaaagaaagaaagaaagaaagaaagaaagaaagaaagaaagaaagaaagaaagaaagaaagaaugaauacguggaugagaucaugccaugcuuuucuacccucucaggcauucagugagaggaggggucuauuguuccugggauggaaaugccuuuauaaguacacggaaugcuguuguguugugcuuggccuucuguuugcacuuuuaaacagucuugcuguguuacccuccauguguucuccauguggacuacaaacucaccaauggcuacuugacaccucauguagcuuccucauguauuuaauauucuuucuuuguucuguuguuuguauuuaacucuaauguggcauggagagcuucuauucuugccauauuauuagggcuucuuagugccuccagugucuguuucucuguaucacuggguuugagaaguuuucuguuucucuguauuuguaaagguuuguuaugcuuuuagccucaaauucaccucuucuauuaaacguacauuuagguuuuucaaagucacaggcauccuguuuuguuuuguuuugauuugauuugauuugauuugauuugauuugauuugauuugauuuguaaacuaaucucuaaauguacucuugacuuuguuuuuaaucccugguuuguuucuucuucuuugaccuacuccauguuugauaguuuccacuggugguuguggcuguuguuguuauuguuguuguuauuguuauuauuaucauuaauuauuauuauuauuauuauuauuauuuuguuucuuguuugauuaaaguuucagcaauuuuaauauagguccugcauugacauccacacuucagucaccugcuuuuucagacuuuccucucugaagucauuggucauaucuacaguaggcuuuugaauuucuugucuuacacuguaaugauuucagcaucuuugguuuuacuuacugaagaguuagcuaaagagccuuaccagcuaaauuuuucauuuucuugggauuuuuauauugugacuuagacaucucuugagauguauauguauuuuucuuuucuuuaucuauucauaacuuuugagaaggucguuuucucuugggcuuauagucugcaauacucuuuaaaggagaggaaguagagauuaauaacaaaacaacuauuuguccagaaaacaauuauuaaaauguauuaaaaugcaaauuacuacuuaaccaacauccuuaguaagauuauaaagggucucagauuguaauuacaaaagaggaaaguuuaaguuauuaauaaugccaaagcuacuacuaaaaauaaguugaaaaauuggugaguuuggaaagggguaagagagagagaaucaguaaagaaaauaguaaaagcaugaaagcuauaacagagggaggaaaaagcaaucacaagagcaggccaagaggaacaaaaccaagaaaaauaaacagcuaaaaaagugaagaaagagaaaagcaaguuaacugccaguauuuccuuccugcuaagauacuuguggguugucuuuuuaauuuacagucugucuuccacuuccuguuucacuucuggaucccuucagauuccuccucagucaaaagccauaccuguucuuguacuggaguuccuuuagcuuggcaauaaagcgugugaaaaggcaguauucuuaaucuucugauuaauuugcaucuaaaguuuaguguauccuuacacuaaaagcuuacauccuuaagcuaugaauuuaaccaauguuuccuauuuacacacaaacacacccacuugucuucagugaaagauuacuaguaauaacaauaggaaagauguucucuuucccuugaagaauccuuguuacagauaaugaggaagccuauuucacauugucuuccuccuuaccugcuagagccauuagccauccccucucaucuugaagcuuuaaaguggcugaguccauugcggaauggagguucacucaagacuguguaccauuauuaguguacauuacuaguguaccauauggcuucugugucugaauuuagcugugacucuuuuugcacaucucuaaauaguucaggguagcaauuagccugauaaucucacaucucugauagaucccugaaaaggaacuagcuuuuaaguuguucacuguuuuauuagucuaaagauagaagugauacuggaaugaaaccauaaauccugaaaaugccuuuuaauauuuagaagucaaacagaagaacugaugauuagcuaaguacuuccuacauccgguugacuaaagaagagcucuuagccucuucauuacauuguuccuucucaaugcauugccuugaaucagccaggauagaaauguucuuacagacuuguacccucuauucuccaaaggaugacacagaacugauaccauccuaggugcacaggaguuaacuuguuagcuacuacccuuugaaauuucaguggaugcuuccuagaguagguugguuucuuauauaacaagaaaauagccaucacauucagaaaauccaauacugacuuucuguuuguuugauguauugcugggaaugaagccagaauguaguguuggguggaaggcagaugcucuaccauugagcuacauccccaaccugaugaguaucuuuauauaaucuaucaaccauauuucaguuuucucauuguucgaagaauauuguccugcugacaauauucuauucuggaucacauauuaauuugucauauuucucaauaucacaaucaagaacaauucuucaugacaugacauuaaaaacuuuuaaguauaccaagccaguuguuucuuaguuugucuaaucaauacucauguuuaaguuagaguuauacaccccugcagcuggcuuugauaacuuggaugaaauauuuucugauugucaaaaauaaaauuauaaaccucugacaacagguaggaaugguuguuguacuuuuaagucuaugcagauauucuauucuacacucucuucaauccugaccccaggauuauuaccacucucuauucuugccagucauucuuuacuuuaucauccauucuguauuuaacacccuguccuaucuaccugccagucuauauuuacuaugugucaucagugggaauucaugaugcauguccuuuuuguuuuguguugucuuguguugucuugcugugagacauugucugaucuaggccaccauagcuuggagcucacuguguggcgcaggaugaccuugaacuuuucaccucuugccucuaccucccaaauguugagauugcagguaugugccaauaugcccaguuuuaugaaauccugagccucaaaccucaggguuuugcaaauuaccaaacacucauauauagcauucauaaaacuuggguucaacucccagcaaagucaugauccaggcacucuagauaugaaaacggggaucaguucaaaaccaugcuugguuuacuaacacacuaaguuaaggccaacauaguauacauaauacccuguuucagaagggaaggaagcugggaagcaaacaaacaggaaagcaggaagaaagaagggaaggagaaauuauggauuuugauacucaaauauuccuauauauggccagaagaaauuuauucagcuagcuccugaauacccuaaaaggacuccguauuuucuucuaaugguucugugauucuaguaauccacgcuaaucuuauaccucuuauucaccugagcaaauauuucuaagacaaacauguagaacauuuuaguauuaccuguauauuuuagaaaucaccuugacauuuaauuuucuuacaaaguuaguuuaauuuacuuacaaaacagcaacauacuguaauuuaaugacaaaacagcaaccuacauuuguuuuuuuuuuucuuuuuguuuuguuuuguuuuuguuuugaaaccaggggugcaguuuauagcucaguauaaagugcagguuuagcaugcagggggccacguuaaaucuccagcaaagaaaacaacaauuauuucuuuaaaaaacaaaauaagagaaauuucagaauacuucuuuguuuaaaaaaugccaauuuuauuaucaguauguuauuaucuaauuuauaaacuguaucucuguauguaauuauucuaaguaucuauguauaacucacauccaguuguacucaaaaaauacuuguagugaaaucuuucuucaugauuucccaaaugcagccuuaccucgggaguccaguaaaaagugggacucaaucuguagaguuuucucuuauggaaacuuugaaggggccuuguucgcgcagcuguacucaugauagccaaggauggagauuucaaucuuguccugucuuuucuccuuuucuuacugugcuucugauuaaguaaccagcuacuggaggaagagagcucaucuaaauucucugaagcacugaaauguaugaaauaauuggagauggggguaaaauaaaaugaacaaaagcacagaaagcuaaauguaaauuuuaugguuuauuaugauacaaaagcauucaguuuuagccaauuuuacuauaacaauaaguaaaauaauugacauuacuggagaauuacauaguaaaaauauagaaauaaucugaauuuucugcugcaaaauauacaucuucaaagcuaaaacuuugcuuaguauaaaauuaauguuccuuauaaaucauuaauucacauccaacacaguuuuaacaauuuaugccaauuucuuuuugcaugacggugaaguacaucaaaaccaaaggcuuaaaaguacaagggcucauccuugcaccuuucauuucucuuaacuaagcaauuuuacugcauaccaaaucuuagugaauucucauacagcuacauccuauuacaguuuagauacagacauaccaacuauaaaauaaugaaagaaacuauacauggaaaauauaguuuuauaguuauacuuuauaugaauuuuaacauauuuaauauuugugaacugagguucuuggaaauuuuaccaacugacugacagguuacaacuucauaauuauguuauaauaauuauguuacagaucaagagagaauuaucguaggguaucuuuagucccuuaauagccauuuguuacccaucucuaaaucugaucugguuuuauuuugaauagcaguaaaaaccucuggaauauauuaguaacuaaguuauugccagaccaauagguuccaccaaugggggaaaaaaaugucaagggacagccccugaaucgcuaccagccgccccuguguugcugugacuggccuaccugagucuccaacacuguauaugggaaaaguuccuugauguuucugaaauuguuucuacaguuucuaucuguuucuggauguuaggaauuuuggagaguuauuuuauguggacacaucugacuucauuuacauuguauacugcauauuauaauaauauauuuaacauaaaauauauaauaaaauauuuacugauauaaaguaagcuuuucacacacaacagguuccaauuccaacuugauuuaugcaggucagcacaaguugacugaauagucuaacaauaacaaguggauuggagaugggcuagguagacucaaagugacaaacugccuacuagcuaaagggugauacaguuguaguggauuauggcagagcauucugugacgacucaaaaacugcuggcacaacuacagacuauccuuugcuucauuauaaugguaucuccauaucauuagccuugcaaguuugcuugcuucuagcauguaucugauaaaaugcuacaucugaagaaucccacaaagggcagagaagcugaguuaacccuaggccaggauggacacacacacacacacacacacacacacacacacacacacacgacgucauucaauuccuuccuuuccucuaccuuaauucaccaauauuccucuauucauuuuaaguuugggcauagaaggagcuacuggggauuuaagauacacuucuuucugagaaaccagcuauuacugcuuuaccauguaacuugugacaaacuugcuccaaauuccuuguuauuucauuaauguugacaagcacuagaaacacugaauacaggucuccaucugguuccauuaucucugauauaucuguaaccuccauuuggaaguaacaauauuacuauaugugaugcucguagucaauauguaaguucuaaauaauacuauuuggcugaagaacuguugguguuuguaaauacaaguuacgguucuucucugaguagagagauagcucagucuguaaaacaccugcuguggaagcacaagaacaugaguuuggaucccuagcaccuuuguaaagcccaagcacagcagugcugugcccuguguuuuaugcauaaccucaauaguggggcuagggacaggcuuagauggaaucuagaacucagcagaauggauucacuucagguucaugaagagugcuugaggaagacacccaacacaacaugcaugaacauaagacaagaacauauaucauaccccaauacauucauacccacacacauacccacacaaaagauacugcuuucuacaauaguauuauuacuuuuaaaucauauuacagcuacuguaaaaauauucuucuagagugaaugaaacaaaacauucaagaaugcugguacaagcaaugggaaaccaaaaagauacaaagaagcuuggagaaucuaugucaaugagaacagaaccaagaauuaaacaggcaagacaguaacuguaaugcauuaaacaaauaucucacugauauuuguagcaauugguaauaacaaaaaagcugucaccuaaagucuuuugccaguccaagugacacagguuaguaaugcuaguuacucaagacaccuuggcagugaaucaaacuaaguucaggccugccugggauauggaauaaggcaaaaucuggccuaggcaacuuaaugagacccuaucuuaaaauguaaaaaguacaaagugccaggaucacagauaaugggguguuuguuuguuuguuuaguuuuguuuuauuuuuuaguauaaagccaaauaacauguggcuuuuaacuaguuaauauaauuagaucaaguuaaaaaaaaaagugguagcggacaucuuuaauuccucacuugggaggcaaaggcacacucuuugaguuugaggccagccugcucucuagaguggguuccaggauagccagggcuacacagagacccugucuugaaaacugaaacgggggaggaggaagagccuagaauauauauauaucaguauuuacagcacuugcuguguaagacacaguacaaaauaaauauuuaaacuauagucuuuuaaugaaaaaucgacuuaggagacuaucuauccugagaaauuaaucacuaaaagauuaucuuauccuguccccuuaccaggacuccucccaguuaugcugcuguugcccaguaucauggagauccugcagcucuggaucuaaaggaccagcccuuucaugugccccacagguuuacagauaauguagauuuuaggguuggccaacacgaagcccuagccugggugguagcugggauggugagcgcuccagcucuuccuuuccuccaguaccagggcagaaggcagacaccuagaacuagagcacugccccauguacacagaacauuugaaagugaagauguguggacagagggagauacugugggacacgcauuaacacuacagcuuccacaagaucuuuucuaugcuuugugguauuuugcuuaauuuuguuuguguguguguguuguugguuuuuuuauuuuggagaggagguuugcaagggcagaggguagauacgaggggagagagaugaacagcacuuggguacauaauaugaaacucacaaauuaucaggaaaaagauuuaaaaaaaaaaccaagauuaucuuaaggaugaaaaguugaaugugauuaggaacuugguaacaauaauauauuaugcuaacuguauauuuaagaaguacaguuaggagguucaaaaacucaaaaccaagguaacaaaauaugauaaagaauaucacaaaaauauacacaacuguuuaguguuaaaauaguggccuccaaaauuuguuuuuaaaauauuucugaagugaacaaucauuucagaaauaacuuagaugaguuagcaaaauauugagauaauuaagccuagaaguaggaagcuuucuauguucaauggagaaaaaaagaaacugauaauuauagaauuauuucccucuggauauuaccuucaaaugagacuuuuuauuucuuuuuauaguuguuuuugagaaaagcuuuuaccauauaacccaaagcuagccucaaacuuacuauccccgaggcuggggaugacaggcauguacugcaucgccugccuaaagaguauaucuuaauuuacuuggacuugagcuuuauacacuggaucgaauaaaagagaaagugggagagagcuuugaacucauuggcacaggguggggcaguuuccuagacagaacuccaacgacucagggucuaagaucaaaauuugauggauggaacuucaugaaacuggaaagcuucuuuacggcaaaggacauaguccauuggacaaaucagcagccuauacauuagaaaaaaaaucuucacuaaccccacaugcaaaagagggcugauauccaaaauauauaaggaacucaagaaguuaaccuuaaaaaaaagccaauaaaaaaugaaguguagaauucacaauagaggacuuucaaauggcugagaagcgcuuaaaagaaauguucaaaucccuaguaaucagggaaaugcaaaucaaaaugacccugagauucgacauuacaccaaggaaaacggcuaagaucaaaaacucacguaacagcagaugcuggugagaacguggagaaaggaacacuccuccauugcugguaggauugcaagcugguacaaccacucuggaaaucaaucuggagguuccucagaaaauuggaaauagaucuaccugaagacccagcuauaccacucuugggcauauacccaagaugccccaccaugcuacagggggacaugucccacuaauuucauagcagccuuaucugugauagccagaagcuagaaacaacccagaugucccacaguggaagaauggauacagaaagugugguccauuuacacaacaaaauaauacucagcuaaucaugaguuuugcaagcaaauggauggaacuagaaaauaucaucuugagugagguaacucagauccaaaaggauaugaaugacaucuacucacgaauaaguggauauuugccaaaaaaguaaagaauaccgaggauacaauccacagaacucaagauuaacacacagaagagcccaaguaaggaugccucaaucccucuugggaggaagaagaaagcaauugugggggagcagagugaggaaagcaccugggugggagagggaagggggaggggaaaagaacaagaucagguauuggggugcggggaacaggagugaagcccugaggaccagcagaaugaaugaaaauaugcaagcaugggagauugggggacccucuagaaugagccagagacuugguaggugagacacacucaguacucuaagggagagaacuuaagugccaaacagugggcagaggaaacuuauaguccaugucuaauaaaaagacaaggcaucagguggauggaugggguugccaucacauagucaaaaacgcugaccuagaacuguuccugucuaaacaaacugcagggaccaaaauggagaagagacugaaggaaaacaugaacccaaauuggcauccaucucaagagauugcuccaaggccugacaauuauuacugaugugcauauaaaugggccuagcauggcugcccuccaagaggcccaacaagcagcugagacagaagcagguauuuaugcccaaccaauggacugaagucagggacccaugugguucaauuagggaaaggcuggaagaaguugaggagggcggccccauaagaagaccaacagucucaacuaaccuggacccccgagaucugucagacacuaagccaccaaccaggcagcauacacuagcugguacaagcuccucccgccccccaaaacauauacagcagagaauugccugcuuuuaccucagugaaagaagaugcaccuaacccuggcgagauuugaggccccagggaguggggaggccuggcagggugggauagagaaggggugaggaggagggcauucucuuggaggugggggaggaggaaugggaugaggaacugucagaggguggaccaggagggggauaacaacugaagguaauuuaaaaaaaaaaaaaacaagacaucuuaaaagcauuacaacaaaacaaaaaccccaaaugcagaaagccagugauugcuagucaaacauuauuccuuaucugugcucagaaaaccuaggguuuucuaucguuugaaacuuuggaaacacacacaaaaagaaaguggggaggagugaaggaaauagggagccagcuccacaagcauuagaacaggauuuuggauugcucagaaaccaugugaggaguaugggacgacuguaucccuguaagcccagcaauagcaugacaguagacgacaggccuguccuugcaagcuaggucuaccugguaaagauuccuuucugaaaaggugagagguaccggaaggccaaccccuaaaguugcccucuggcauuuauaggcauacugggcacauggacacauggguacccacauguaccaccacauaaaaauaaaagagagaucacuucaaacccugccuacuaagaugaaguacuguuuucauuaacauuuuacuguauaucucucaaauauuuuuucuaagaaacgacuguauaauacauuuuauauucucauuuugccaauuaauagugcaaaacaaaacuguucuuauauaacuacauauuuucuagacauaacuuuaauaguauaccaauaacuucccuaagauaaaauuauguuuuacacuuacaucauuagagauuaaaaaggaaaagaagccauuuuacaaaugaaaauaacuccuccuggcacuacucuuuuaagaacacagcgggaaagguuuauuuccccauuggcaucauacaucuagcuaauaugauuacugucauguacagaaagcacugacucagaaaacauugcuaucaaacaacacucuuggaauugggaaaagacuacugaaacauccuuaugguaacauuauuucuuuauguugugauuauuuugacaacagaccuugguuuuuaaauuaugacacccauuuagaaggaaugguuucauuuacaugagauaauuaccauuaaugaaaauaaauaguauggcaaugauucacuagaauuuaauuucauaccccauuauggaacucauuaagacaaaaaauaaaccacaaaauuuagaccuuguuucaaauagaaauuuacuuucucagagauaauacucaaggaugucauuagagcaucguauguucauuucagaauaacaguucuaaaagcguauaaccaccucauugacagaauguaauccucaaucuuuugaaggcuuaauaauacuuauauuugguucuuagugccaugauuaauaagguaaaaaauaauuacaauuauaguacccucagauggugcccuuaaauaauaaaugaguuaggaaucaauaacacauuuacagauaaguuccccccagaauaacagugauuuugaagacaauaugaaaaaaggucaucaaguacauauaaaaaugauuuaaaauauuuaaaauauauauaucauaaauaguaaguuuuagaugacccaccccaaaaguucucucuuaaagaauagcuaaacuuuuaaauuuuaaaauucuuccauaauaugcaaaguuaugauauaauguaauguaaagcuagaaugaggacacuuugagagaacuaaaauauuuuacgugugagaguccuuguauaacauuucagcuacauagaaugcagcuaaaacucacaaaaggcucauugaaccaaagaaggcuucaguguuugcaggccuucuugcuuacucaaauuccuucugagaagcauucucuuccuuuaggaguuuccuuacuacagcacagauauuucuucugcuuugaauuucucguuuucuuugagauuuuucuuuuguaguauauauauguguguauacauaugugugugaaugcuuauggagagaagaaaaggaucucuugaguccgguuucuuugagcuguguuaggaucaggaaaccuaauccccaugauagggcagcaagcucugggaacugcucagcaccucccggcaucacucucuguauguucuaauccggagccaacuuagaugagaagcaaaacugaaggagaugggcaugaaagcaacaggguacugaugugacuauuucagaauuaaaauaagaacaaucucccuuuuauuuuuauuuuuugauacaagaucuacuacaucccagaggagcaucauaacccugauccuccugccccaacuuucucagugcuacaauuagaaauguggaccuccacauccaguuucuaucauaccgggaauggaaccuagagccuuaugcaggcuaacacuauuaucaacugagguacauccccagccuacccccaauauuuuuuuuaagaaugucaguuaucuacaaaaaaagugcaaagcauauuggcaugguguggguccugagucuaccaaauaucuacaugcuaagaguugguaaacaggcuggcauuaagggaggagguagacucguuagcaguaagauagagaaguucuggagucauaagagguaugaccuuaagaaguguucuugagagcccagacucugucuuccuuuuugcucccugguuccugaugcuuuguucuaccaaauaugcuugccaugcugugcuuucucauugccagccgccaacugacugugaacccugaaaacugcaagccaggauaaauggauccuaguucaaaguugauuaucccagguauuuuuucuauacugaaagaugaccaacaaauauuucauacacucaguauucauucccauucauaauaugucauuugcugauccagguguucgaacuaaaacaauaaaccacaauuuaacaagacaaaccaaagaaauccuacuauuuugaagcuuauauaaaauccaaaacagaagacaaaaaaaguacauaugucaaaacauugacaaaacaaaucccaguugucagcugauauucaugaccacucgugaaauaacuugacuguucccauguauuuucuuuuaauaguaacuaaauguagaguuucaaacaugcuaagcaaauguacuauaacugacccacauucuccagcucuugcaaugcugcugcaccagcuuugcaggugagcagaaugaaagaaaugcauucccgugcuuauuuugacuauucucuuccaguaauauagaaaaaauaugcaagguuaugaugcuacuaguuagcuaaacugggauuagcugaacuuucuaaguuuuggguuugguuuuggucuuauuuuuuacuucugaguauauaugugugcauauaucuugugaggguaugugaacacauuaguacaggugccuguggaguccagaagagacuaucauagucuguggaacugcaauuacaggauguugagagccauuuugcuuggaugcugggaaccaacuucagaucguauguaagagcaguuugugcucuugcucacugagccaucucaccagccugcuugucuuaaaacaggguaucacuguaugucauuuggccuuaaacuacaauccucucgacucagccucccaaguacuaggauuguaggcaugagcuaccaugccucuguagcucaaaaaugacauuuuuagcaaucaaauuuuucuuuagaacauuuuaucagccuuuaaaaucauguauuuaucugaaugaucacgauggcaucauugauuuccucaacuggaaucuacacugccacaagaucagcucccagauccggucuuguucaagauuauauaccagugcauaauuaucuacuauugccauguuaucaucaaauaucuguagauuauauauauauauauauacacacacacauacauacauacauacauacaguaauauagucauggcuacaagcauaguuuagauaagcaaaaugacauagaaaauauauuagccugaauacaauauucauucaucauuuuaugagucaacuuguaauugacuuucacugugaauccccaaaccaggauucuuguaaaugagacacuaucacagcugcccaacaaucagcaaguuuuacauuccaauuaagucucaaugauacaaaggaugacacucaaaaauuaaguaaaaccaguggaaaacuauuuuaauaauagaaccaggcauaaaugacagcauaaagaaaacuggagaaauauuuuaaaccaugauuucaauauaaucagaagaauuaaagaaaaauuuuuuacuuaagaccaaugucauuugagaauggaauggcuauuuaauaugauuuucauugggauaugcauauucuacuuugcuauacuggaaauuucuuaauauaacuaauaugauuaugaauauaaaaaucaauguaaaauuaugaugauauaugccaaucuucugugcccaccucuagaucuaaggucuuuuuaaguuacaaugaacuggagaccaagggaaaaacuauaccaaacagaaaucaugguaacaaggcaguaauugcagagcuaaugcuauccauggcgugaaaucaugguaccaaggcaguacuugcagagcuaauacuauccaugguaugagcuucagaagcacuaaaauuccuagaaaugcaccuccucaugggaagcuuuuaugacugcauuaauuccaugaacucuuuugucuaaaacuguaccuaugauccacugauuguaguauuguaguccuuaauguagaagaaaaauaguuguauuagguauuaaucaacaaagucaaaauaaaauaagccaaauucagaaaccaaacuacucaagugacaccuaccuucuggaaaugccauuagccagacauuuguggcuacaggauuuggaagagaggggugaugaaguuggagacaaguugagaggggcaaucaaacuguuaaugaucucagucaacugugcacucuacaaagaaacaguuaacacuuuaguguagcuaagcaucaugaagauccugaauucuguccugagaauucuuauauuguauuuauugauuuacacauacugaagaauucuuacaucacuaaaaugacgccuauuuagucacaguguuuuuuaaaaauguguucccauuggccuacuaucaagaccucaccuuaugaccaaauuacacaucuauggguuaaucucucaggaucuaaaugacccaaucaccccucaagagcugggauuaugaccuagggacuaaugcugaauacaugugacuuuuggagaaacauuugauaucuaaaucuugccaagcaguuuaagaagcaaaaauguaucuaaaguuauuucguaaagcaagaacucuacauaccuguuucucuauguuucgaagaaguaguguagggcugcuuggugacaucucaaaaucguguucugguaaaggcucuucacuccucuggggaaccugagaauucacugaaguguuuaaugaaacugcuugguuugaaaacuguauuuguuuuuucaaaaugucuuuuggaagcugacauucuucuaagaucacuauccccuaggggguaaaaaacaguaaagugaucacauccuacuauccucauaggaaacauaagaugaagaauugaaaauauaguuuauaugucuaaaacagcuggcugauuaggcugggagagauggcucagcaauaaaaguauguacuauuuauucuuucagaggaacuaguuugcucccagcaccugucggucagucuccagccaugggcagucuccaacuccacaccuccagcuccagggcauccaaccgacuguuauggccucugugugugguaugcacacgcacacacacacauggagaaauuucaaaacaguauauuuuaugcccugugugauuauaccucuaaggaaagauaguagacuagaaacugccucuaugugucuaugccauaguuacagaaaagugccaagauuuuaaaaaaauaaauguaaguaaguaaauaaauaaaaggccuuaauccaaagagaaaagagggaaaagagcuuuggaaauccaccaaaaaagugauagagcaucugaaaauaacagcagagaaacaagugauagacugaaaaaaaggaagacgagccacacacaguuucaccuacccaccugcagagggaaggaaaaaaggggggccacaucaaaaaguagagcugggaacuaaaugcacaggaguauucaaauaacaaaaaugauacccccaaacuagaaaagauccaaaccaacagugacuaucaaaagacacaaaaccaaaacccuaauauaacaacuccaaaacaacaguaacuacuaaaucuacuaaauucaaaaccuaaaaaagauaaaacuuuaagaccuaaaaaugaucaaugaccucaaagaggacucaaaaauauaaaaguaaggaaaucaauauugccuacagagagaaaagauaacaacauaaaaaaaggccaggagaaaaucaacagaguagaggagaaaaucagcacaauaauugauauuuuugagaaaagaaauauuggaaauaaaaagcacguaagaacaaauacaugagaacuauaauauaaaagcaagcaguacuacacacagcaaugauuugugagcccaccauugucuucuauugcuauuuaagaacuauucaacagcaccauauacauuguacauuuccagaccauauacugagccacaugaauuaaauaucaaaauaagaauaaaaaaauuuaaauuuuccauacaaaaauguaaaaaaguaaaaccaucccuuuugcagaugauauaugauauuagagaucccaaaaagucuaucauaaaauuucuagaaaugauaaaauucagcaucauagaucaacuugcacaaaauacaugaacagacagaaaagaaaagaugauggacacacucccauucacaauggccucagaauaagccaagccaaggaaaugaagaaccucuauaaugaaaaccacuggaaaaaaagagauagacauuacaaaauggaaagacacccuugcucauggguuguuaguacuaacauugugaaaaugucauuucuggaaaaauauauuuacagauucagugcaauccaaaucaaaauuccaaucucauuccucacagaaacagaaggcauucuaaacuucauauggaaucacaaagaucccagcuauccagagcaauucugaacaaaaaaagaaacaaugcagggaguuuaauuccagauuugagauaaauuacagagccacaguaguaaacacaacauauagacacaaaaacagacauggggcuaauggaacaaaaugcaaagacccaaauaugaccacaucucacuuagccacuuaauauuugacaaagagaccaaaaacacacacuggaagaaaaaaagaaaucaucuucucaaauaguucugaggaaauuggaugaccacaugcagaagaaugaaauuagacccauuuuuuaucaccuugcuugaaaacuauaaguggaucaacgaccaaaccugagauccaaaacuacuggaagaaaacacagggagugcccuacaugguugaggguaggaaaggucaccguuuuccccaagaagcaaggcuucgauuguuuagugagauuucacagaaguaacaagccucugcauagcuaaagaaagagccaggugaagaggaggaccacagaaugggagagacucuucaccagcuagacaucugacagagguuuaauauccacaacauagaacuaaaaaauacaaagaggagucugggacaugaauggagaguuucaaaagaaggaaaaaauuacuaagaaauaucucaaaaucuguucaccauccauagcaauuagcaaaaucuaaaucaaaacuuugugauuucauuugauccuagugagaauggcuggaaucaacaaacaaccuacaucaaacgcugaguacucguuuacugcuguggguauugcaaauagguacagguacuguugaaaucaguggagagaacucucaaaagguuaaacaauauauauauuguaugacucagcuauaccgccccuuggcauaugcccaaaggguucaacauucuacuccacagaaauuuguucagcuguguucauugcuguucuacucacuauagcuaggaaauagaaacaaaacauaaaccaaaaacuggaagaccuacuccuugauucuaaaaugacuagaauaaccaaaauaauauaacagcaguauaaacauaggcagauguauagaacaguagaacaaagaacagagaaaguauuugcauauauggucaaaugaguuuugagaaauagugucaaaaccauucaacagaaaaagcaaaguaugaucuuucaacuaaugccccugggaaaacuggagaucuacaugcaaaagaacuaacuccacauaccaaaauuaacucaaaauggaccaaauaccucacuagaagauccuugaagaaaauauaagaacaccaaaggcacagauaaaaauacaauagauaaaauagacuucauaaaaauaauaaaguaaaaagacaacaaacaaaagaauaaagauaugaaaauuaaauacuauguaagcaauuauuaucaagauaaagacucccuaaaauacagcaacaacaaagccacucagaaauaggcaaaaggccugauuuauagauauuucuccagagaacauauacaaauaaccaauaaacauaaaaauaucuaaacaccauuaauacuaggaaauuguaaacugaaauugaaaagagauaccaccugacauucaguauuauuaucaguuaaaaaauaagcaaaaaaccaaacuguuggccacaacuuagagaaauggaaacuauuauauacuauaguucauuaaaaauuaaaaacagaauuaucauacaauccucuaacuccauuucuggauguauagccaaaagauuuuuuuuuuuugguuucuuuguuucucagaaaggaucacaccauugagcccuggcuggcuuggaaaucacuaucuaggcagggagaccuguacucaaagaaauccacuugccucccuuucccaugugcugugguuaaaggcauacauccuuguuccacugaaaagagugcuuugaaaagagaauuucuuucacucuauucacagcacacagacaacagcuaaaaugugaaacaauuuacauaucuaucauugguaaacaaaaugugaugaauauacagcuauucagcuuucaaaaaggaaauucaaguauauacuacaauguccauaaaugaaaggaccacgggcuauauaauaagccagccacaaaaaaccuagguauuauuauguuuccacuauaaacagacaugguuauuaauguuauggagacugaaaacuagauagucacuguuuaauagguauaguuuucagucuuaaaagaggccaggcagggagugaugcaugccuuuaaccguagcacucugaaggcagaggcaggcaaaucucuaugaauucaggccagccugaucuacaacaugaguuccaggauugccaaggcuacaaaaagaaaaaaaagguggaaaaaaggaaaagaaauagaaagaaaauggaugccugauauuauuaaauuacuuaauacuauuauguuguacacauaaaaaugaauacauuaacaaauuguguuauacacacauuugacaauaaaaagguuuuaaaauguauaauauuucuauuaacuuaagcucaauguuuuuaauuguuuaaacauacugucaaauuauauauacauauauguauauauauacaggcuugagaaaagcaacauuaauauuaagaaauuaauauuugaaaaccugaaacuagcuccuuucaugaaauuuaauaaaaauuaauuuaugugaaaaauuauacagguaacaauuuuaacaaaaaacuaacaauaccuuagaggcacgaaucugccuguggauaucuguuagcugcuggauuuuguauuccagcucugaaaucugagcuugaagccaaguccaucggcugccaacuugugcucugucuacaagccacuuccauucaguacuagaguugcugggaacaaaacaaacacuguuagucaaagcacaaagucagauugucagagugcuaauaacuuccuugacuaguuucauaaaauguaauuucuuuuagaagacauguacacuacaucaagggaaaauagcagacugauuucuuaucaaaggaaauuugauuccuuaccuuucuaccacaugaauacuuggcuuucgucaauauuauguaccuaacaguaggauaaucccucuguaauuuaauaugcuacugaugcuaagggcuugcauggggaaugaaccaguaaggaaaaggaaacaagaauaacaacuccaacaucccguaacaucuguucugugaggauuuuacaaguaaaaguggaagucaaguacuagauaacccaucugaacuauaccuaaauucacuuacuaaacucuaguguaccugauuuaacuguaauuucuacuuaguagacuauagcaucauuauauuacuaauacuuaaaauuaaaggcauugacaauaauuuacaaaaaugaauccucugcuguauuuccuucucauuuucccucuccucccuuucccuucccucccucccuccauuccucucucccucugccccuugcuuccucucuuucuuucuuuuaauaguaucucacugaauacguuggauggccugaaccaagcucuguagcccaggcuggccucaaacucagaaaucuaccugccucugacucccaaaugccugugccacuaugaccagacuuuacauuucaaaucacuauuuugaauacauaggucuuccauuguuuuuuuaagauaaauaucuaguuaaaaauuuaaugacuauguugcacaauacgaggaacaaaaagaauuuauaaagaccucuacuuucauuuauguuuugaaauaaauguugaaaccucuuaguuccucuaucuuuuagcaggggcacucuuagaagcuauaguuuuggggacuacaaaugaauuauuucaugaaaauaguguaagugcaugagcuagaaaaauaaauaauuguaauaacacaugguauggcaggagguagugggaaauaagggaaggaggaaggaaauuuaauagacugccaaggagaaaauaucaccaaaaauuaaaaguauaauuccaaacuaauaacuguaauagaaaaauauaugaauauuuuuaaaauuaucuaaaauguauauauuuccaugaucauagaaugagcuauaaugauaauuacaggugauaauaacagaucaauaucagaugguaauugauauggaaguugugagugaacuuguggggacagagaggacacaggaauucugauauuuacuguuuuacuuugaagccaaaacuacucuaaaagugaagaaaauguauaauggaaacaaaacaaaucaaaugaaauaggucauacaaaauggcacaugccuuuuaucccagcacucagaagacacaggcaggcugauugcucugcauucaaggacagccuggucuacauagugaguuccaggacagccagagcauaggaagacucuguuuugaaaacaacaacaauaauaauaacuuuaugauggaaugugcauauaaacucagccagaggagauagugaagaaaauuuucugucagauaaaaaaaagucaauuauuguaacuuugcuacauacaauuuaguaaguauaagauuuuauaucaguauuucuaugauaccauaugcaguagaguuucucuagacauauuuacauuuucaguuuacaaucaaaauuuuaauuuuucaaauuuugaacauuuuuaaaucaaagugagagaguacauguuuuaaauucauuuuauagagauaguauuuaguaguacuaaaugccuaucaugaaguuuggagaguaaagcaagagucauaccaacacaacuugaacaggugagaauaaugauuuaguguaaagugggagcuacuuagaaaguacuaacaaaauuauuuccccaagcaguguugcuacuaaagccaugagacaugaaaagaaacaaggaagauaucacugguguauaaacuguagucuccaaauacccugugugcuacuaguauuuuauauauagccuucuuuguacugaaguuggagucaugugacuacuaccaaucaacaggcucugagcaaaauagacuauuauuuuguauacccaagaaucuugaaauccacuggugcagauagaauagcuauaaaaccauacuagauaguagaggauaucccaaagcuauguaugguagaucucuauuauguuaaagcugugagauuaugagcuuaacuuauuacugaauauaaccuauucugacuggaacaaucugaaaauagguuggacugacaagaggagaagauaaauaagauaaguggguaaagucauuuaaaauuuacagcagaucauuauggaagagaccauaaggaaagcaaaggucauuucucaaguucuuucauuacauuuugcuucaguuagaaaauuuccuuauuaacauucaguuggacuugaauauguaguugaugacaaauaauaaaauauaaaaaacuuaauuucuuaauacaauacuuaugggaaagauacucucaccaaaguuaauaccaaaacucauuuuuacuuuuacaaauuguaucaaauuauaguaagagacauuacaauacuagauuaaauguaaaugaagcaaaucaugcugaagcuuugugaugcguggaaugaguuuguuauaaugauucauuuuucccauacuuuacuaggaauaauuaaaagccuguuugcugaauguaaaggggguaaacaagcuuuuucauccaaagagcuuccuugcuuagaaacauguuuuucaccuaagacagaugcagauacagccaaccauuggacugagcccggggaacccaauggaagaguuaggggaagggcaggaggagcugaagaggauugcaaccccauaggaagaacaacaauaccaacuaagcagaccucucagagcucccagggacuaaaccgucaauaaagaguauacaugggcuugcuacauauguaguagaggucugggcaucagugugaggggaggugcucaguccuguggaggcuugaugccccagcaaagaggcaugcuagaggggugacgcaagaguagguggguggguggaggaacacauucuuagagggaaagggguggggcaugggugaggaguucguggaagggagaccaggaaagagaguaacauuugaaauguaaacaaauugauuaauaaacauguuuuucuuuaaaauacuguugcaaacauaacagauaacagguaaguuuauagucgacuuuuuuugaagacagauuuaaagucaaaauaugucuuauauaaacaacauauauguuguaacuguagaguagaccaaugauguaacuauagaguagaccaaucagaauauagguuagguauauuagagaaccuauacgauuuaaucuguauguaauugguguauaaguuugggcugcuaaaucucuaagaacaauggcucucugcauuucagagguacacaaaacugagcucaaacuaccagcugcugaccacuggugguauuccuaucuucaacaaagaaaaaggcaaggacaucuguacauggacaccacuugggcugcguaaaaacaguacaucuuccaaaugguggccuaugccuuacaauucuaugcuugcuugcuuguagucaaugcuuaacuugucggaaauacuacaagguucuuuucuuaaaauguuaguauggagguguuugccugcauguaugcauguauagcacauccacacucaguaccaugggaacccaggucaccggccccagcacuguacuuacagagcugggugcugagggaaaaacccgggcccucuauaaaagcagcaugugcucuuaacccacugugccaccucguaaguuccagccuaaauacuugaaccuagagucuagauucuugucuuugaaguauaguuacugaaauaagaacuuuccagaaugacaucuuagauuuccaaggcuuaaagagagacauguuuaauguaaucuuuccuuuaacacagguuuuguuaguucaccauacagcaaauugaugacuaaucaagacacaaggucuaguuguaagaaaugaauguuaaaaaaaaaaaaaaaagaaagauugguccuagaaaaauaaacugaucaaccuucucaacugguauuugcucaccuaggacaaccuuucuacccuagaauuggguuccuuuagaucagagguuagcaaacuuuaucucugcagacacauauaacaaaugcuuuagguuuuguggucagaggaucucuguaacuauucaacucugccuuugaaauaugagaguggcuauaggccauacacaccacgggguggcuguguuccaauguaacuauuuucaagacaggaacuaaaucccauuugguucaugagucugcuugccaacaccugcugaagauuauuuucucauaugcaccuucugcuuugcaaaggauuaugcagaguuccguuaauaacaugccugugcaaauagcauguccacauuuaacugggcuauagcuuccugguguaacuucuuuaucaacucuaacuuacuggaaauauuucauuuccaauuuacacaugauucgacagacaaaugauaaacagccuaaaguaugugucuauguaacauugcauucugaguagguuuuguuuuaucuugaaacacugccuauguaacucaggcugauauguugucaguuauaaguggguuugaaauuugucaaauuacuuuugauguuaauuuauuuaaaguuugaauguuaaugaugugugugcucaugauuaaauuauuaugcccaauucuaugugacauuuguuaugaaugcucugauggcuagugugaaaggagcugcguuucuccugcuuucuucuauguuuguccagugucagacucacgcuaaugcuggccucagaguaaacuagcaagaauuuuuucucuuuuacucuaucaaagaguuuuuaauauaauuggaauuauuuacacacguuucaaaaauaaucagugaaaauagcuaggcuggaaauuacaucuggaaagauuaucaauuuaauguuucuaaaugauauaacaucuaucaugucuuuuauuucuuuagcaauauuugauaaauuuuguuauaaaucauaagacuauuugguucaaauauuuucauugauaagcacauaaucacucauaauauuccauuauuguuuuaguaauaugacaucuuuaguucuauuuuuggucauuuucuucuaaucauccuagauauguuuaucaacucugucagaacaaagacuuguggcuuguuauuccuugauuucuacgguuuucucccuuuuuauuucauauuuuauuugcuacaggucuuagugaacacagaccaaagauuuuauaccauucuuuccuacauauacauucagagccaaacaaauuccuaucagcaucacuucaguaauuuacuaaauggaauuaaaauaacagcauaaauauacaagguaugcaauuuguaauauacauaucuaaaauauuucguaucucgauuuuuuaucaccuauauuauuuggaaauguaugcuuuacauauuuuagaucuagaauguuuaccauuuccuaccaguccuucuuuuucugcagauaugaguauaagucgaauaugauuuuccuuagccugaacaucuuguauaaauguagucuggccacgcugcugacacauagcugaccaucugccuccccaccgacucucccaccaacacccugcagaaaugcuucacuccccacaauucuuagacagugaccagugucccacacacuggcuccuccacucacucaagcuuaugacaaagacagaaugccuuaauguccaggcagccaagcacaccucuuagccaaugcuguggcuauuacaauggaucugagaugaauaauaauaauuuggggacaucccaaaguaacaaaagauaguagaauuauugcaaagacaauugauuuaaaggauaaauauaagaauauuaaauuuguucaagauguaccaguaacacaaaugaagaggguguggaaggucccagcauugcuguuugggcaugcucuaguacuaaaggcggcuuucagaagaucagggaaggggcuaauccuaugaaaaucaaagaugucaugcugccuauugauguuauuaauugcugaucuuuaaaagcaauauaaaccuauaacaaccagggaagagaugucuuacauugcuacaauuucuacaaauagaagcaaaaaaguuggaaacuucauuuggauucagugacaaaggucuagaagaaaguauuaucacaguaaaggauggaaaacaagccgaccguggugguacacgucuuuaaucccagcaauugggagacagaggcaggcggguuucugaguucgaggccagccuggucuacaaagugaguuccaggacagccaggguuaucuagagaaacccuaucuugaaaaaaaccccaaaaaagagaggagaaaaaauauggaaaacauugaacagggaacuguauugaagacagaacauuugauugagauauauuuuccaauguguuauuacuacguccaaaggaugaaaauguaauuuccaagaugcagauguuuuuauugagugagaaaaaaauucuaguguccagucuguuguaccuacuuuugaaauuucuuugguuguaaucacugaaaauguuggagaaauuguaaauauacuauuuuugaaugggauaaaaguugauuuucaaguuguaacaaucaaaacuccaggauuacagagaauaggaacagcuuaaaaaauguauacuagucuaaagauuuuuccauucuucugggaacuagcucuuguuguaccagaaggcaacauacaagccuccaaaggauagaggcaacaaacaacccuacauagcuaugacaccuaugauucacaaugacgcgcauaacauaauaucccuaaagguguuaauaguuauacacaaacuuuagcauugaccaacagcucuauaauuguacuuaggacccacuaaacaagagagaaauccuccauucccuggccuagugaaacauggaucuuagagaagagccuacagccacuuuacuaaaccagcaucaucuguaacuacauucuaaaucuuuguccucguacagauaaauguacuccucgccccucagcaaggaaacuucuccuuaaaaccacaacauaucaaacuguauagcgggauccaguuccaauaaauacaucuacaaaacgacuccugucccuaaggcucgggaauauuacagaaaaaguugaaaaaauugucagagacauacaaucaaggagucuguugugaggugucgccuaguaauuucagaaaguaaacccauaaacucucaccaacagacagccuuauaugagcugaacaaggacaacaacagacaugccaaaauggauagggcucaaccacauacaaagaacugcagacaagggaugcugagagcaacagaaauacuauuucucagggaaaaacaaaacaaaacaaaacaccaauugguuauucaaugccaaauggucagcaaaaacauacaaggaacauuauacaaacuaaguggguuauauuuaagaauauauauguauagacauacauucaugugaccaauuaacuauugaaaaaagagacugaauuagaagaaaagaggagaggggucuauguuugggcuucaguggaagaaagggaagaggaaaauuauuucauuauaaucucaaaaaauaaaauaauuuaaaaagaaaaaaguuguaaauauugcuauugguaauucaguguuuagagaagaggggcugaaacuaaaucuugaacauaugacaaaguucaaauugaaaagcuaaaugaaugagcugcuaaacuagcugauggaguagcugugccgagucuuggaggacaagugauguuggaguaaaugacaaguuacagaugcucacagucuuacaagagcagcuguagaagguggcccuguuuaaggcuucaggagagcucuguuuggacuccuuaaaguauccuaguauagauuagaacauugguagaaauuaaaagaacacuuaaaauuccuguaaugacuaucucuaagaacauagguauugaaggaucugugaaauuugagaaaauuuugugacacugcuuagaagucaguuaugauguuaugcuuggagauuugugaacaugguagaaaaagcaaucacugcucuaacaaacguugagagaacugcuuuacuaaaucccgcugaggcaguuucucuguuaacuacagcagaugcuguagacagaaauuccuaaagcaggaacgaacacaauggaugaaauggguuaaauuucauuaacaggugggaugcaacgggcauagucuuaacaccuggaauaggauuuggcccucauaacugaacugugacaugaagcucacggcagagcucaacaauaacuuuagagauguggguugaagaaaaggaugucugauguuuaagauaaacuaucuaaucgucaauuacugguuuuagucagccauacauaauagcuuacuaucauuguccaugccuacagauuauucauuuuuuauuuuucaagaaaggacauucauaauccugggugcaaagaaaacauguuuuagugcacucauacugacuuuugucaguuuuuacuuacuuggaauugccauucacguuuguuaaaacucacugcauugaauagauaacucauaugguuuuuuucaacauuucuauuaucauuccauugacuucugaaaucauacuucuaauaaaagcuaucaauguuuuauuuaguguauucuaaauagccauucucuugcuaagaugaaaaauagguuacuauuuuggauacugagaguucagcgguuauuuuaucuucaauucucaugauuuaugacuucauuaaguuuguucaaaacaaauauuuuacucacaucaucucugucauuucaagguccaugucuauugcuacuuauucuucuguguauauguacauauacaucuaucuaguaacugaccauacaaacacacaaacauacaaauagaagauuguugagugugguccuccucuagaaaauaauuuucuuuuacuugguuauuaaauuacuugcuuauuuaacugcauaaacuucaucuuucuuuaaagcuuuguucaagccaaguauauaguaaccuugacacuaagacaacucacuaaauuaaugaagaaaaagaaauuaacaaaacuuaauuaccagcaaaggaagaaauuugacuugguuauuuucauaugucacucauaagauggaaaaaaaaaaagugaaacacugagaacucuguuagcaaaagcuaccacaagacuaacagaaacuaaaccuuggagccaggguuaauaacagaguacaacauccaauaaugguuuacuaugacggcauauaaucauaaaagauaugaguacauucccaugcagcaaagugauauucuauagaaaacaaaggaaaagacuuuuaacuuggcaaagcaaaacugggguuccucuaagaccuuacucuacugcuacagcagguuuugguacuguaaaaaccaggaacuauugugcauauccacauuuuucuuuuaaccaguuagaguacuuuuguguaugauguuggacaaaccuguggaagccagagguagacaucaggugucuucuuaaagugcuguccuuauuuugggagacagggcuucuuacuagaugagcuggaguucacccaugaaauacacucagugccccacuaucccagacuucccucucuccguaccccaggacugguauugcaguuacacacagauccaugcagcuuuccacucgugagcugggcaucuaaauucugauccuugugcuuccauagcaaauacuuuaacccacuggcuuuuaccuagcagcucuccuaugaacuuuauuggagcuuuccuguccuuucugcaucauauaagaaacagaaagucaaaguacguuugccaguuuguagcucaucacacugaugaaccacaucuuaacacaauggagggauacuguacuucauuguaugauucuagcuugucaucuuugagaaauugguacauuuuauauaagagaaagguguauaugggcauguggaaggccaaagauaaccaaacagacugcaucucugcagucccucucccaaugucuagucauuuuucucucuuuucuguaguuuuugcaagagaacauacuauauuauaggcuaguauuacaucagaaucacuuuauagcccagauuacccucagguuuauaauccuccugccucauuauccagaaugcugggauuauaacagaacucagcucugagcccuaagcagaacaacuguagacuucauuucccagucuagaauucuaguaagucuaaguuucaaagucugacucuaagagguaagccaaaauaaucugcguaucugcaggagcuugccuuuccaucuaauugaauggcuccuuaaaaauagcuggguguggaaaggaagggagugcuagugagucagugcagggagacaacagagcuaacaggccguagcaugccuaauuguuaacuguuaaaugagaagaaaaaaaucaguccuucaucugugauauguggcggucccccugcuaugacagcuuagucuaucuuaaugaagcucuccuucaaagauauuuccugccauuaggaugaguuaacaaguucucaauuaaaauguuuacugucagcuagacaugcuagcucaugacccaauccuaaaacuuaaugauuuguaggcacgauagugugucaaaggacagcauggacaaggcaagauucugccccaauaaccacaaaaacaacauacaauauaaaaguaagaaaggugaagcuuagaaaugcuggcauaaugacaaaaaaauuaaggagugaagguauuaaaggguuucaaauaacaaagaguggcacaaaguaagauauuauuuacauuugacuagaacccugguagaacucagugcauaaaccaucuaaacaaagcuucuagcauaccuuaaaaagaagucaugcauuaaccagaaaaguuagcucuacccucccucuucugcucucaaguccuaucaagucaaaggaagagagaaaaaugagguauauauucauguacagugucgcuaccacacuuuuccucucuguuaaauacucaacuauccuuauacaauucuugugugauacggaacauugacaacuguggacauaaagcaugaauuuuuaaagcagacuaaagcauacuaacaaaggaaaauauaauucaauaaauauccugugcauauacauccaugcauacauauuucuuauguucaaaaaguagacaauuauauagauugaacccuaccuaaaggucuaguugagcggacaguggaguuaaaauuucaacaaaaaguucugaguuucaaauuuaaaacagcucagaggaaaccuaucuuuugcuauggcaccacauauguagauuuauuuguaguccuuccaaacacuacaauggcucuggaaaaaggguaaaagacuauuaaaaccguaucaccagcaacaaaaacaaucagaagccaaaauaaaacuacuuuuguuccucaaaaaggagaacuacacauuaaccaaaaauaaguagagacauuucuguaauaccaccauauaauauacauuuccaaauaaccuuauauucugcaaaauagaagaauuuacauugaaaauacuuaguaccaggccacaaaaaacccauggaacuuuaaaaucugauccuuaacaauaacucuuagaagauaguuucacugauguucauaccuaaaaucaagcaggccauccuuuaaaggcagucuucucccucugcugccaguacuaauagagcuaauauaacuaaugauauuuaaaaugucaucuagaaauagacuucauuacugcauugauuuuguagcaaggaaaauagaagaguguauucaacugaaucugcagccugagaucuuuuaauguagcaagagggaauuucuacagaauuuucaauauuuuguuuagacaguuauauguuguuaaggcuuucucuuuacuugugacaaaacuugacccuaaauauuuaaaaauauuaacaugguugaagugguuuggaaauagggcaaauugaauguugcauuauagucauaauaauucuauauaacacaugugcauaaagccacacuuuaaauguaagaaaaugacauaguuuuuacaguaacaaaugucaguaguguaaaccgucuuuaaagaguuuacaaauucaacuacugcacuuuaaagagucuacauguacaaauucaacuacugcacuuucuugaugcgaagacaacaccaauucaagauagacaaauaaaauaacaaaaaccugcuuuggagaaauaugugaauuuuacucaugaaugcaucucaauguuagaaucacugauguggagccagugguagcacaugccuuaaucccagcacucaggaggcagagaaggcugcccaucucugugaguuguucaacaccagucuggucuacauagcuaguuccaggccagccagaacuacauaauaagaccuugucuccgacaagccaacaaaaauguugacuguuuucaaaaauauacauuaggaaucugagaaauauuacauugaaaguacauauaaauuuccauuagcccuguuuucuaagaauaaaacuuuaauuuaaaaaaguuuuaaugauaucacuuuuauuaaaauuucauuuaucaaaauaguaucuguagggcuuagauuuuucuaagacaacuuaaaacuauuauggauauuuuuuaaaaauuuuaauuuacugagggaaaaaauaacaaaaaauguacaugauuauuguagugugauguuuuccuguauaaaucaaugugaagugauuuaaaugaaguuaauuauauaucaaucauuugacauacauuuuacuugugagaacacuuuagaucuacucuuagcaacuuccaggcacacaacauauucuaugaaauagucagcauauugacaaaagagcucuagaacuuaguuuucuacguggaaacagucacuguugccagcauccuccuccucuccccaccucacccagagcaauccgguaagcacuagucuacuaugcuucuguguuauggcuguuuuagauuuuccuccuaagugagaucagacauucauuuuucaauuauugacaucuaugcucaauuacuugacaagugauguauuucacuuuuuucccaaaggcugaauaauauuucauuccauauuugauuguggaugaagauuacaaugguaaugcagaaaugauuccauuuguugauuucauuuccuuuggauauaucuagaguaggauugcuggaguauacaagauagaucugggguuuuuagcuuaaguuucuuuuccuauaaaggcuguacuaauuuauauuaucaacaauaugcaaaguuccuuuguauucucuccagcacuuaggauaaccauacucacacauguaagacuuuaucucacuguaguuuuacuuugggaucuucugaugauuaguaauguugaguugcauuuuuuuuuuaugucuucuuuagagaaaagucuagucuuuguuuucuuguuacuguuugucuggcuugaguauaucccuugaucauuaacuuguuaaauguaggacuagcaauuuuccauucuauagguuguuuguucacauuguuucuuuuguugggcaucaguuuucaauucaaugcaaugccauuugucuauucuugcauuuguugacgcuuuuaaggccaaauccagaaaaucuuugccagaacuauaugccaagcucuuucucuccacuuucucccaggaguuuuacaucuucauguuuaggucuuuaauccaucuugaacuaaauauggacugguacaagaauucaguucaauucugcauguagauaugcaaucuccccagcauuuaagaaauugucccuuuccauguguaugcucuugacauuuuucuccaggaugaauugaacacaaauaaguuaaacucguucugcaaugaguccuuuccuuaguuauaucuauuuauauugcuagcacugaacuguugagacuuuaacauauucugaaaucgaauagauacuccaacuccucccacuuugaucuccagagagagagaacugaagaauaggauuacaggcauuuggcacagugccuauaauuaauguugaguauuuccacuuacucgggucuacuuugacauuuucaucaaugguuuauagcuuuuaguaugcauguuuuccacugucuuuaucaagucaaucauaaauuguuuucaugcuacuguaaaaagaaucuuuauucuugauuacauuuucaguuuagggguuucuauacauugauuuuguuuuuagcaaguuuacugauuucguauuucagccaauuuucaggauaccuguuuuucucauaagauucuaacauuuuuaaacagccuauuuaacaucuuccuuuuccauuuguguauccuuuccccugacuuggcugagaauuccagagcugccuggaaggaagcagauuaaauguccaggucuacuuaaaauuccuugaagccuacuagcaauguugugaccuuuaagagguaucacugggaagucuggaagugacuaguucuguuccauccuagguuugauguccuuacaaaagaggcuguggacuuguugacucccaggaccaugugagaaacuagauagaagauaaugucaaguuugaagacauuuccaagaauugaaucugcaaguucgcccugaaaacgcccuaccuuccagaacuacaaaucauguuucuaugauucauaauuuccuggucuguuuucuugaaccagucugaacaauaaguauccuugucuuguuucuuaucuuaaaaggaaggcuuucaaguuugcuauuacuaagagauuaucugggaaucuuuuaagguacauuccuuuuauaacuguugguaauuucaacaacaaaaaaaaggauauugauuuuuuccuuguauugaugaucauguaaagaacagguuagacuucaccacagagauccaccugccuugccucucaagugcucagauuaaagguguacucca

SEQ ID NO: 199 - RNA, 99792 nt, Mus musculus
cccagagcuguuaucaacuuacuaagaaacguuugcucagaagcggcucagaaacguucccuugaucgaugaagccacaaggaacccaguuucugcucaugaaaccuuuuuuuacuggaaaaaggaauauugacuaccaaaucacauugcaaucgaagcagugcugcauuccagugauuaaaaucaauugugcaggauguucaagagguuagaaauaacuaccuuuauagagaugucauuuagaaauuuagcgugaugaaaauauucauguuuauacugggagaaugauuuuuguaaagagugaaaauaugauuucuuaagauuacagacagaaaugugucuuaauggcuaaagaggaaaauuagauacuaugaaaaacauuuuucuguauuuuuacaaagaauguucuguugauucccugguuuauuccuaaagcaaaugacauccacauuuucucuaguucaugucauuugugauuugcuuauaugccugagaauaugaauggaaugagacuaaaauuagaagcuuuggugggguggcaugucauggucuggcauuggaauuauuuuuacuuuuuaaucuuacacuugguuuauuaaaaacuauaaaaaacaauguaugaagccuaggguuucugaaaugcaagcacagacuuaucaagguauuuacuuugucacagcagacuacucugucauuccuuccugccccugggucucacucaaccacccuucugaggggaaugaaauagccagaggcagaaaggaaccauacaguuucucuuggaagugccacuggguuggacaccaauagaacagaguacccuauucuagcucuuuaacuuuaauaaaaucacccaacuguuuucacuauaaacgcuuauguauaucgaaugaaaccauaacuauugugcauuugagaauuaaaagcauaacaugauuuuggaaggcuuauaguuguacuccuagacuguagaagaugcucaacacaaaauggcaagcaucaugucuguuuuaugaguuauuaagcacuuuucuauaaucauauuaacugcuaaauuguccuauaauuguuagaacaggaauuuuuuucccuauuuuaagacuaaaaaccguaaagcucuccaguagccuggcacauagaaaggguccagucagaagcaguuuucugguguguacuacugcucugacuacaaacagagccccugaaguggauuagaaaaaaaaguuuuuacuuuucuuauuuucaguguaacugaauccucuggcagaaucagaguaaguuaagaauauucuggaaguauagauuuugacuccaagaauggauagauggauauauauauauauaauuucuaagaaggaagaaguaggcuaagaugauacaguacagacuuaauccauaaauaaguaguaauaaaauaagaacacugacaaauaggcauggaauagagagcuugcuugggcuuuuuccugcccuguaagauaaaaguuuauuaauacuuguuuuuauuuuagcuuacgaaagguuugugcauuuaaucaaaucacacaauacaaggcauauagaaauaacuuuaauuaaaaaaaaacuauguagaagguuauaauaucagucaugacaaagauuugaaauuauuuguugggacaacuuguauuuuucuggcuuuuguuaucuuuuucuuuaaaaauaaauguacaguaaaacuauaagcaaaaguuuguaaguauugaauuuaaaugguuccccaccccccuucugcagggaucaguuuaauuucuaauccucaacaaaaccuuauauaucuaaucccauagaguccaagcucaguggccaggauuuucaguaguaugggaacuacaaauugaguaaccuuucuuugcauaacaaaaagugguugauacaaauuguccuuaacuuucaucuaggaaaaaaaaaugguauggcuucaaaaagaauuuuccuuaauguacacuccucaguauucuauauuaaaguuuuggucuuggaaaacuugaauucuugaucuaggaugccuguaagcauagguauuuaugaaagcuaugguaaggaaaaaccaaauuagaagcuucuagcuguacaucagcuagaaauacagccauauuaugauuugugugcuguuuuacacuuuaaauugcugucuugaggagguccauaaagcaaguaaacucggugaauucccaacgacaauaguuuuaaauguaucaauauauuaaacucuuaaguugcuucucuuaauucuguuaggaguaagcagaaagccugugguuaguucaggagagaacagugauuucaaauaaaugaauauugcguuaucugauauaagaauuuccauaaauaacuuauauugguuaaacaauguuuagaauaaaagaaaaaacaacucccucuccacagucaaagcuuucaggugucugcuauaagucagcaccugugcuagguauucauggcaacuuauauugcauagaguaauucauacaugcaguuuuaagacuacauaugugugcacuguauguguauauauucuguauacacacuagcauauucucauauuauugaggcaguuuuagugaacugccaugagaauagaaacaaagaauaguugucauuugaugcaaaucaacaguacuaucagggaggggcucguaccucaacaaaugccccgaggugugauuugucaucaaauugcagcaguuaauaucuuagugcuugugauuuguauuauuggcaaacacaaguuacuagcauuuguguagguaagaagcuagcuacuucugugauucaggaagaaaaaaaagacaucggcauguucccugaacaugaaagauggaugcaugugggccuccuccuguucuggaacccugaccggaggagguggggauggauccagcagagaggguuguaggcuuuuuccucuuuuccuuucaguuacauauuuuucuuaauacguucccugucaccuauuucuuuuaacauuaguaacuccuauaccaaagcuuuuauauucuuccauuccaucuaacugcaucuuuggaggguggccacucucagguguaguacuacagaagacuucaucguggaaggcugugcuuguccccccagucugauccuuucuuucaucuuggcacaauaaggcugcuguauccucauccuucaguggaaaugcucgccgcucccaccgcaaagacugaaagggaaagcauuuucaguuaaguuucaccuaauuuaauuauuaaggaaucuaucaugucaguuuuuauaguuauucuucuaguauauaaguucaaguuuuuguuuuccucuuauguccauauggauauccugagaauuuccugacuuuaggaauuguuucuucauuuugcuucugcuaagaagagaaaauacugccucagaauacuugucucuauucaauguaaggauaucugagcaaagccuuguaaggugggcuguacuuccuuucuaccucacuguuauuacagauacacauugacucuuucuugcugauuuucuacaacuuggauaugcauuucuaaaguuccacuccaugucugaccuagugcaagugggaaagcugcaugaacuuuguauagugcuaggauacuuccuaaaaguaggacuggauuuauguggcacuuguuacaagcagaaaaagaguaaugguguuuacugugcacccagugugaguccccaguggaaagauuuguucuuuaaagcaaggugauagaaucuccauugccuaacaguuaaguacauagauagaugaaaguuuuuacugauaugcuaugccuccaaaaauuaaauaaaaagaaauuguuaauauaaugggacuagggcauuccacuauagaccuuccuggacauacuagacugaacaucucauugacuuugaucuguaaugaagcccuuuacagcuaacaguuucuacacauaagugaaauaaagugaaaaggcaauuaaaagaaaacagucaaauaacucaggcuuaccuugucuucuugaccaucauuuaaagaaagggaguccugagcacacagacuguggcuuucugcugggaguucaaaaggacuuucugcaguacccugcugagcacugccaaguucacuugaguguuccuucagaaccaaguccugcccuuccacauuuuuacuguaagcucuagcagggaaauaaaugaauacaggguaucgcuaggucaguacugcuuuuuucucagcauuucuacccacggucaucugaggaucuucccaguguugucauuaggaaagguuuuauccaaggcuuaaacccagugcuucauggucacuaagcguccuaucacauuuguuacuugguuuuuaaaagacagaaagagccaugcacuugaccuuuacaguucugaauucucaaguuagucuguaauuauuuuuauaucauacauggaauccucgagucacauuuguccucuguauuucuggaaaguuguguuuccaggauguguaaaagaacagcaaucuagagucucacuuauauuaggagaacucuuucaacaaauauuuacaguccaucugagcgucuaagcagagaaaggacuuuaauguuauuuagcuaauugaaaaaugucuaaguuaagagacuacuacauuuucuaugaacuugcuuaguuguggauauauuaaaaaugugucaauauuuuuugaauauauauuuuuaauauguuaaaaauaaugaaauuuaacugcaaaaacacuagagauauccucaaauagguaacuacuaacugucauauucucuccgaaagucuaccuaugagcuuguuucuguuuuuuuaagacagaauugucucuacagcaaaugcucuaucuaacucauuaucauccugcuucagacuccugagcauggaacuuugggcauaugcuuauauccaauauaauauuuuuaaaagucccauggacuuuuugccuuuuauacuaaaaaacauuucuugaagacuuugcauaguauuauuucugagauguuugcuaaaaugaauuccauaagcucccgcccuagugcagcucaccguguacaggacauggaguugacuggcuuugaggcucuggagaagaggugcccauugugcaaucuauucuggccuuaaacuggaaagccccagccucagccuccuaauuacuggcauaaaccaucauuccugaauaaaaugacguuacuuuauauaauguuccuguccuuuaaugcuagguaaguaauauaaauaauagugauauuguggcuagcagcaugaaacucauauauaauuuccuagaugaguuuuuaguauaaguuugcauaugaugaugccacuucacacaacagcugauccuguaucuucuguuuuccuucucaguggucuuucucaagcuuuauggcuagcuuauguucauuccuuauauauuguggcuuugauguuuuaaacuucaaauacuugccuguuauuucuucugugccauuugcuuuguucccacagugaccaccuagcuugcucucucucuucauauuuucugugucuuagggagaagacaucaucagaaagaucuucuaucugguaagauuuggaaacagaacagguucagauagucucugagcaggaagcuguuuacggcagccuguucuuggccuguguuuuaguauguaccuagauuacagauggacucacagugcucuucauuugucacaguuuauggaaugguuuuguuguuuggggacaggaucuuacuguguagcucaagcuaguuuugaauaaguauucuuuguaccuuaaccucuggagugcagagauugcagguauaugcuaucuugcccaaucuauaaaaagagaguguuauacuuuauuccauugaguaauuaugcauuaucuuuuaugacguacacaguauucugagaacauguuaaugucaaaaaaaaguaaaacugauugagguaaaucaguauucaguuaccgacuuaucugggggcuggggguuuaacugaguaacucuggggaauuucuuucuccuggaagugaucauucugacuuagcaagagugugcaaugaaaagugaagugcauuaauaguaagauaugauucuauagcugaaaaacaagaccacugggcagagaagcacugugaauucauagaaacucuauguacuuucuauagaauuccauuauuuaccuaaagauagaaucagcuguuacguaguauuucccuucuguuuuuuuuucauuaguucuuugagaguuuagaguuucaauacaguguguuuugauuccugccauuguucuuaauguaauauaaucucuacgaguucagaauuuaccaguacuuucaguauccaagaaucugaaaaagcagcuccucauacaauucacagccugaacugaaaagcugugacaauauuuauucuuaguguuuugacccauuagcuauauauauuuuacuauagaagcauuaauauuuaauuauuugcuaggcuuauccuugacucuugguauuagcacuauauguguaccacauugcccuuuuguuuggguuggcuuggaggauacacuaugcuauauguuacguuuguagucaaauuuacaaagaaacuuuuuuuuuuuaaaaaaaauuacuauccuuuaaaaaaucuuucucaaauaaaaaaacauguuuuauauuuccuuuuauauauuuaaauauuaaaugauuaaagcucuauaauauagaagguucaauuaucccauuaaacauaaagcaacauaccucuucuuuguuuaaguuaugcucaucaaggggcugaagaacaaccuuccuccagcuguugaaaauacaaaagaauuucaagcagcuuucauccaaauauaacaauuuuauuuucuauaaacagcuaaauacauuaggguuuuauuuccucgagacuuccauaauucaaaugguugcauuuuaauaguuugucauuuacaauacuuuuagaaaaagaaaacagaagauuaaucuuuauaccuuacaguaaguaguuucuucuauauaguuguucuucuauauaguucaaauuaugugcugguuuugaauuaacccagugguaaucuaauaaacuggcuugagcaaaaaugagaagucuaaccugauucauaguaucugccaguuuucuuugguaugaaaaugugugucaugcccccuuggaauuaguuacuaacugcuuaacaacuggcucacagaauucuccaguguagguugaaaauguugcuauggaacacuauaacuacaagaacauuccuuauuguagaaaaugccaauccuguaucuauauaacuauaguaccuaauaagaaugcccggcuuauuccucagauuaacugagaaguaguaagugaacuuauggaaauaaaauggagauggauggcagacagaauauggcugauaccugucuguguuuaucuccagcguuuucuauuuucuagggccauauuuauaucuuauaagagacugcuuucauuguugcuauaaaacauggcugccuucacugcaaauggaugcagaucuaugcauguauucaaggaacacuguaaucugggucuucuuuagcccagccuucuuguauaaacuauuccaaaccuccaugucuggccaggccuuccacacuugugucuguguaaccauuuuccuagacuuucccuuucauuuuucuauuugauuuuuuuuuuauuggugaauuagaaauaaaucagaaacuuauuuuuguuaacaagcauuacugucuuaacagugugaauacacauacaaauauagccaaguauaucucuaucguaaaagguaaggacuguuuguuguaguaguuuuuacauggcuaaaguaccaugcuaguaaaauacacacaauagauaaagucaauuauaucuauacucaauagauaaaaucaauuuugaaugcuaauaucaauuaguuuauuauaaaguuuccuuuuaccauuuuccuucugugcaaauagggaagggggaaucauucuguuguuaguuauaacuugacucugaauuuaaguuuacugaggaaagaagaaaggaaacauguaaguauacauaccguggaguaaguauuucuuuauacuggaguuucucuaauuuggcuggugcuacuaaugacaugggaaucacaauguuaucuauaucauaagagcucucacuucuuaaccuccgucgugaaguauucugcaacacagaauuauuguacuaauuuacaguaauguuuuaguuauuugugguguuauuucuucauuaguuauauaaaaguaguauguaguauauguuugacauaauuuuguaaauuuauuguuaugaaaucuaauuauaaaaugcuaagaaagccaauuaagagggcuuaucuuuuguaaccaaagacaucucuuuuaaaacauauguaauacuuauuuuguauaaaaacacauaaaauuauuugaaaggccaugaaauuuggggagcuccugagugacguuggcugcuacagaucuucacauaugugcuccugguucagacuacccaucuaaacuuucauaccugucaucucucuauuguccaggcaaaaaauaaaaauagaacaguuuaagaacaacacaaaaccauaugcucauuagcaaaacuguguuuagcuuuggauguuagacauggucauaaguuuauaacaaaaagaauuuauaaauaaaaauuaauaaauugcuagcuuucaaguaaaaaugucuuaauuacccauuacuauuuccuaaugagacaguuguaaaauguacuaguaaguaagucuggcaugaauuagugaaauaauccagcagguuucuuaccagcuuauuuucuuuaaaauucuauaaaacuauuuuagaauguauaagauuuaaaagcaacauacuugugaggauggauucuggguucuugaugugacauuggcauuagagacagcaguaaaauugcaaugagauccugguucugaacguugaaaagcaaauucuucaaaucuaguucuuucuccugcuguggaaagaacccuucagaaugucacauguuaaaaacaaccacguguauuacaauuauuuucccaaaucagugacagggaauugagcuuuauuuguuuuuguuugcuucauuuuaaagacauaaucagaaaccagaagaaaauuauaaacaagcaucucagcgauauccuucuaccaagucuuucuaauuucugggaccucgugcuuuuugccuuguauguuuuguaucauugcguagucuuucucuguugucuucuucaccuucuuguugugcuguacgcacugugucgaggcuguggugucaagacugaccuuaaguugccugucuuacuuguugugaaauuugcucaguugaccaucugaguuuuuauuuuuagugaauuucauauaaauaauuuuaguaauuucaaaaggucugggguuuuauuauucauuugauauagcauccaauaacuuucauuaaugagauucauuuucuuacaauauucauuugauaccugcucuuauucguauguauguuuugucaaguucugcuuauuuuuguacuugguauucuuuaugguaucaaaaucuacauauagaaauuaggaauugcuuuccaguuuucuuuuauccuagaagaauucauuuaucaaggcgaugucuuauuagggggcuaucuggucuauuuuugaucccccuuuaucuauuaaauuugaacauaucauacaucuuuuuagauaaucuauauuucacagucuguuauuaagaaauuaucauuccccaugugauccuugcuuguuggcucuuaugugacaaacaaaaucucuagaugcauuugagagcuuguucauuuucugccacaauguguuuggucagauuguacugauuauagguccauuuugaaagugaaacuacauauucuagaauaguagagauaaauguagauucauuguauaaaauuacaaauagguacauuuuaaauguaauuauuuucuaauuuauuaaguuugucuauguuauugaaauaauacaacugggaaagauuugacuauugaauaugauauuauauucauuaggacaaugagcaggaaccaaauguacacagauugcguucucuucaaaauauauuuugcuguuuuaacaaguauaagaacugucaucuccaaagucucuccaacaaaucaaguuaaguuauuagaacagcucuacuuucaaguguuaggucuuguucaucuuguaaacagagagacuccuaaggagaauuggaaagggucauugacguuccuugguuuaauccugaccacuuucucaaaaucugacauuuaauaauguucauaaauucccaucagagaaccuuacacuguccuagucugagucuaauauauccuuggagacucaauucaguacaaaugaaagcucacagaaggcaaguaaucagaaaacaggaaaaaaauaauugcuacaaaguggaccaauacccagcuuacaaauuccaaauuaagcacauggguauaaucauggggacacagguguguuagguacguagugacuggucuggaucauaaauuucacaagacaaggguucuuugaagaacauuuuuucuuuauuuuuaauauuuaaacuaauggucacgccuucauuuuaaccuaccuaaugcuguuucacuuaaaugucuuuuuuuucuucccuguaauaguuguacagaugguugugaccuuauuugaggcuuacauauaggugaauauccauuucuccacugauucagagaagaaguaccuuguacuaaaacaaaugggaaaaaaaaaagaggcugugugaaguuuuuccccuuuuacagagacagugaacaugcuaacauguuucuauuuaaaaauguugaaauucuuuaucaguucgaaauuacauggaaugaaauaaaagcucgauuaccaaaagggaugguucuuaaaguaaaaauaaaagaaauuguagcauucccccgaaauacucccauaaaaugcccaauuuccaucuuuauuuuuacuuauuuguaaguggguaaaaagaagguucuguguuuucaaugccuucaaaaucagugagcauugguucagauccgucugugaauccugacuaaaugccaguuuaaauacugaaguuguuauccuuaaaucugugaacacaucaguacccagugagcuucaacauacaugguuaugagacauggacugugaaagcaagaaccuuauuucaucccacuuuuauuuaacugugaaaaccugaauuuuaaauaauuuaaguugauaacucugccucaguuucuucaauauauuuaucguagcagcucucuugagaauaugagguuucaauuaauuacugaaauaggugucucucauggaaaaugugccauaaauguuagcuuuauuaucaugaguauuuugcaucugaaccucauagcccaacuauuauuagucuagugaguauauuggcugcuuuuggggaacaggggauaaagguuuagaaauguagaauggaauagaaaaaaauaugaagacucagaugucaauuacacuaaaggcaaaauagaagucacaggcuaacaacaguuauugggaauccaaugauaagauaguagaucauccugcaaguaacaguccagguuccuuuaagauagucuuaugcauauagguacacacauuugucaguaaaaagagaauaugaaucaacguuuacgaagaaucucugcacacguccuguggaacuuagaaaaagaaagacaaagcaagggaagaagauugccacagaaauguaaugaaaguacaguaaaugaauaagagcauuugaggaagaaccgugaauuuuuccugaauugcuuacauuaacucuucagauuucaaagaauucauuugaauccauacagaucuuuuucaaaaaauuuguuguaagucaugauaguauaaauagauagauauacccuaaaaguuacaagaaagaaauuuaaaagauuauuguaaaagacugaggaugaaugacacuggauauaugaaaauaaugaccagaaaaaaaaacauagcagaauucuaaagacauuaaaauucccuucuauccaacaaaaggagagaaagauguuaaauagaaggauaugagacgagcaaucgucauguaccuagacagcaucacugacagacaggaaguuuacaucaguggugcaucuuuacugggagguagaugauauaagcgagucccaucuaacucacccuuucauuaucuucacugccugauaggucauagugagggaaagaggacagaauagccuguguaaagguuggaaauagcuuggugaaaaccagcaggauccaagucugucuugcuggagcuuaagggucuuccauuacuucccuaaaguguaccuuaaaaggauagaggucacaaucaguaaucuaaauaucauuggcuaugaugauugaagggaaauaaaaauuggacuuucaguauaaguaaguuauucuguuggcguuaguguagacauaaagagauuuccaaacaagacgcaugaaggagccugagcucugguucuggauugcuugagauugugcuccucuuguaggcuagguuuuucuuagaggucaugcuucucuuacuccuugcagcuauucacuuuaaaaacauaaaguuagauaacuccgauucacaaaaguccugaaacaaaacaaagaauuuccauaugcccuuuacucauguacucagagccucuucugcauaacaggaaggucuuuacauacccacuaaguugucaagaaccagggaauauuacuggcuaguauauagacugguugaccaguaaaucuauguaaucuuaauggguuuuaaucacaguuccuuaggucuucucccuuacucccuuaguuuugacacuuagauaaagacaggccuuucuauuggcugugcugccauuuccucuugacuagacuaaucauguaguuacucaacuuuauaguuugacuuugccuacuuccucgucuguaguuaacaugacuuuguaaguguaaaacaguauaauaggacaagguaaagugccaaagaccucucugcuuaucucacacauuuacucugaggaauaccaagcuaucuguacagaccuggaagcaccacauugucuugugucaccacaguaugaguuuauuucaauuacuugaagucuuaaguaguauaugucagcauguauguaacaacuaaaugauugugccaguaucugaaucagcugagauaugguugaaauacaggguccuggguccuauaccaaacuuguugaauccgagucugcauuguaacaauauuccucaaguaauguacuugcauguugaguuuuaagaaugcugaucuggaaucuucaucucuuuguaaauuccaaaauggcccucagcauuuuuaucuagaauucuucccugucuauuuuucauccccuuuaccucucuuuuugccuuaagaagaccuaugauagauuguuaucaugggucuuuacaucuuacccuauaagagucauucuuguugacuuucuccuuugcagugugugugugugugugugugugugugugagggagagagagagagagagagagagagagagagagagagauugauugauugauugauuucuggugcuuuaugauuuuucagcauuuaauauuaucuuagcaaaaauaucuucccaaugugaaccucuacuuuuauuuuaggcauaggaagaauuguaaugcucauuugaguugagaaugauaggaaauaagaacagggaaaagaaacugagaaaacacaagagaauauugcacugauuugccuaguagcauaggaacaugaaacucaaguauauucuaacucauacauuuaaauuuuucugauacaauguggcauaugacauaucacuucauuauugcuagguccaauaucaauugcugccuaacauuuaugaccaccauuagaagaaacaaaauugccuucucuaauguauauguucauuuuugcauauucccuuucacucaaauauauguacauuuuaugaucuacacaugucaaaccugaaaucauaauuuaaauuagaauauuaguggguaagaauccuucucucauaccuuaucccucucuauuguucacuuguuguguaacauuucuuugaccauuuaaguauucuguagcugcuagacaucagcuguuaccacuaucacaagcaacuacuguuacagucuucagaauaucauauuucuguauuuuuaaaaaagaauuuauuuucagaauuaaucucaaugagcagaacugucauauagaagugccugaauauaaccuauauuuuauaguacuacugaugucaccuuaaguacagcuaauugcuacuuucucuaggcguuuugaauucuuuuuuauuaugaaaaacuuuaaaacacaagacucuuuaauaaugauuucccaugaauuuugcaccucucuuuagcauagguaacuaaugagcaaccuuuaugcuguaacuuuuuaaaauaaauguagacuuuuuauuuguaucauaugccagcaugaaucuuuaaaaauaacugaaaaguauaggcauaguuaagugaccacaauguauuauuuaaaaugacaaaaaaaaaccacacagcaaaaauccauguucguauuuggguuuucuacaaagugucuuuguuaaguuuuuuguuuuuaauuuuguacauauauaacuaccucaucagaauuccaacagauucuuuauauugaauaugauuuauauaauaacauuuuuacguggcuauaauuguaaaaaaaauacagauuucuaaaauuucauuccauuccauugcaguauuuuuuguuucucuucuuagauucaguuuaagauauuuuucuaaaauugcauauucuaguguauacuuaaccaguuaacauaauucugucauauuuaaguuguuacuaaucuuacauggucacaaaaugcagagacguuucugaauaaagauuuauauuuaugauuagauuagauuuuugaaaacaauugaaucauaauucaaaguuugcaguucaguaaauauucucuguaaguacagaaguagugauuuuagucuuaagaaucuuaaauuuuagugccuccuaaauggucuguaucaauccuuggugcuauuauauuuuauuguuuuuauuguaguaauagaaacuauuuaaaauauucaacuuaucaauagcuugacauucacaaacugucuaacacaaguccucaguaaauguuauauuuucauuuucuuuauaauuaucaccaggcauaucuaguuuuucugauucuauauaaggaaucaucucaaauuuguuuuaaugugcuauauuagaacagauccugguuaguauugaauuauacugaguacuaauaaaaggugguuacuugggcuggagagauggcucagcgguuaagagcacugacugcuuuuccagaggucaugaguucaaauuccagcaaccacaugguggcucacaaccaucuguaaugagaucugaugcccucuucuggugugugaagacagcuacaguguacuuacauauauuaauuaauuaauuaauuaaguuacucagugcacagccuuuggcucacucacucugcucuuuagcuguaccuugcugugauuuguauuaucaagaauaauaaccugccuuuuguuuaaaguagcuaauauaguuuaaagugccuuuagauauuguuggcauauaagaugacaucaagcauuuguuguucuugucauuggcuuaaagauuuauauguaugauuguuuugucugccugucugguacauauggaggucagaaagggcauuaagauccucuggaacuggaguuacagaugguuguaaguuaccaugugggugcuaggaacugaacucagguccucagcaaaaacacaugcucuaacugcuaaacuaucugcagccccuuguuauuucuauuuauugacuaagccuucuuucuacacuuuaggaauacguaguaagucuuuuugucugugucugugccuugggccuuuuguuuauaugaauugaauuccuuucauucaguaccaucauacuuuaaagauuauaacuauaagacauuuugauacaugacaccgccuuuugaucuuuuaaaaauuauauuugcuacuuucaacauuuucugagauaagcuucagaauaauuuuguaaagagacuauuucagccaggccuuaugguguacaccaagaaccacaggauuuaagaggcugagguaagcugaccaagaagugaggacagcagagcugucucacucagucucacuguggccaggaauaauuauuguaguccaggcuucccuaauucuggcagucuuccuccagccucuugagugcuggaauuguaggaaaaacuuaguaauauaacuaaaaauacuuucuugccagauguggugagugguacaugccuuucgucucaguacuacuaggaaggcagaggaaggcagaucucuugaguucuuucgaggacaagccagugcaaauagaaacccugucaaaaaaaaaucaaaagaaaaacgacaaaauccuuuugugauucuaaauaaaauucucuguauacagugagacacagaaagcagacauuuaaguugggaaguguuuucuaaccacagcaguuuauuugucuccauagagcaacaucuuucauguugucucuguaaaaccacaaauuacuaaaguuuucuuaauguaaacccuuguuuauucuagagauauugucacugagugaagaauuuguuccuucagauagucuguguaauuacuacugcaauuauaaaagcugauggguuuuuuuguuuguuuguuuucuuucuuugccuuccagaggucuuaacugaauucaggguucaauguuugaacauugaacaaccuacagcgucccucccagcccuaaaaugacuagauuuuauuauaaaacccacuuaacaucuauuuauuuuccucuggaauuuugcagguagauauguuuugccuggaaauaauguuugcuuucuuucgauacuaaauauacagcuuugcagacagugagaauaugcugauuuuugucauuucauauugcuucuaagcauaguguucauuccuuuucagagcacucauaaacaguuuaauauaauuuccuugagguuuuauuauaugauuuuuuaauuuaaaauuauuaaaaccaacuacaguuuauugugauuuuuguuaugaaauaaguguauaaaaguuuuuacucagaaaaaauccuauacauuagaacgguucucagaucauuucaugauuacacccuuccuaauauaaggaagauagacucuauugugugguuuugacuagucucucucugggguugaccuacauuuuuuaacacuacaguugcuuuucuguuuguuuucaccuccucagugcucuugaugaguuaugcacuacauuccgauugccgagucuacuauauaacacuaacuuacagugcacuaaaucuccgagcugaugcaaagcauugggauccuugauuuuaccauauaagaaggcuguuuucuguuuauagcuuuuucuuuauaacuuuuguucauucauuguuuauucauuuuccuccucccacucuuucucaaauuccacccuuucccucccugccucaugucaaagagccucaaacaguaggcaaucaaacaugcuucucuguguggaugugugacucauggaaaaguauuaacgauuaaggauuugcauuuauucuuuucuuaaauuuuauuuacucagaauguaaaaaaaugaauguagacaauguaaaagcauguacaagcacacacagugugugaaugggacauaccagguggcggugauaugagacagucaccuacaaauugauuuucagcaagcucuccuuucaugucggucuucuugaauaaggucucaaaaugaagaugaaggggaauuucugaaaaaacaaaggaaaacaauuauuuuugguaaacaccauuuuccacagccuaacacuaauuuucuuuccuuuuuauaaauagcacauaggcuuagggaaaaaauuuacacaauaagaacuuugagaaguaaaccuucccaagaagguuaguaagcguuuuucagaauguuaugaguuagguaacauucuaaacgagcauaugaacaguucugaggucucccuuuaguguguaagaguagucaguguaaauguaacagucuucucagaggaauggucacaaaugcaccacaagguuuuuacaaaaauauuuaaaauaauuaaaaaugauuuuuauauugugcuaguuguuacacagaaacacuucuauaagcagaaugcaugaaacgacaaguuucacauuaugaguauaacuaaagcuacuuauauaaagacuaacauccaccaagaaguucucuuccuucagacagagacuuauggauauucaguugaaaaugcugguauauuuuauacucaaagagaagccaagguacagauaagguguguauaaugaauucauucuuuaaugugugugagaggggugaguuuguacaagcgccacaacaugggcaagugaaacucagaggacaccucccucauggaaguugguuuuuccuucugccaugugggucccgggauugaaguagguuugucaggcuguggaaagugccuuuuaccuguugagccaccucacaucaagcugcuuauuagucaagaguuuuuucauucauaacuguaaaaccugggucaauaagauagcuuagagauaaagacacucccaccaagcaugacaacaugguagacagagaaaacugacuccagagaacugaucucuggccuauacacacauguggcauguauacaucuguaacaucgaaacacauaaaaaaugaauaauaaaauaacuuuaaaaagcaugaauagacacauauauuuuccccugagaaacauuuuuaaguguucuuuguuuuuaaaccuauugaauguuuugcaugcaauacacagaauuauuuaugaacgauucuaucaggagagacugaagccgugucuggguuucacacagugagaugaacugcuuucucaacgguugugauuuauuaguguuuuuuugagacaguaucucacuauaacccuggcuguccuggagcuuacuauuuggguuuaguuagccucaaauucacagaaauuugcuuguguaccuccccaguucugagcuuaaagggaugcauccccuugccuggcucagggcuuuaaggacaaguccaugcauacauacaaaaaaguauaauuaaaagucuaaguaucauggaauuugauguaaagaugaaaagaauuaaaugggaaaagaaauuaaauacugugcuuuaaaacacuguugaagcuuuuucaagauuuugccuuccaguugccucaacauaaccuuguuccucuaaagacuuacaaaaauaccaucuguucuaccaccguaaguguuggaaacagaacauaacuggagauggccuuguuccuauguaccuuccuaaaguaccuuuuggccuuuuaguaaaguuauuuuguuaauauaugcauauauuuuauauuuauauacuauauuaaaacuagaauauaauuauaaugagggacuuauuuauacuucuagcaccuuuuuauuaucaaauauaaguagguauuaagauuuuugucaaaugcaagcagcuuuaacugauaaauauaaaggagcugagcuuacuagacuaggaugccuuagaucuaaaggauauauauaaauauauaguuauagauauugauauuauuucagaguuccaaaauuuagaaugaggcuaucucaucucucaaaucaagagaaaaucaaauuacuuaauaauaaaucaauauaaaggauaauacgugugugagucuggggaucaguuaccucagcugcuggcuccaguguucaauagcugaguuaucuugaauagaaaaaccuccaagcuuaauaugcucauguguaagaugaaaaggacagcauaauguguucucaugggguuaugagaauuaaacaaaauauccagugugcuuaguacacauuaauaguccagggcuacauagugaggcccuaucucaacauaaccuuguuccucuaaagacuuacaaaaauaccaucuguucuaccaccguaagcaaucucccacaaugcaaaaauaaaccaaaaacuuucaaauauugccugucuuuauaagaugauguuucauuauagaaaauauucagauuuuuaugaggcagcuuaccugauggcaaugacaaaacaggauggaaggaggaaucgaguuuggaaaccuguucucuuaacaggugagaccuggaacucuguucccaguugucccaacugaacggugaucccguguaaggcgucugugugcuacuuaaaaaugcuucuuuugaagguaaagucugcaagaaaaaaaugucaaacuuucacuuuuugcuuuaagacuuaaaaaaaaaaggacaggugaaauuauaauacaguauauaggagaauaagagccuagcuuaguaagucaucuugauauagaaugagauguauggacuguacaucuagugcuguggcuagaaaagccuucugggucuuucaaacugaacuuauucaugaaaauaagucuuugugccaucacagugaaacacaguaaaaagaaaagaguccauaaaacugcuugucucuucuacuuuguccauauucaauuccuucuacaaaagcuuuacacauuugggacuggagagguggcucagcaguuaagagcacuugcugcuuuucuugaggaccgggcuaaguucccagcacccacaucaagcagaucacagucacaucuaauuccagcuccaaaggaucuaacacccucuuuuagcuuccuugaauaccuugcauacacguugcacacauacacauauacauauacuuuuaaauuauauuuuaaaagcuucacacaguuuuguuagaaguuuucgguuaacauuuuuauugcuuuauaaaagauuuaacuuuuuuuuuuuuuuagacuuuuuaaauugcguaugagugucuugcuugaaugugaguguauguugccuaggaagcccagaagagggugauacucagaacugguguuauguaggcugcaagcugcggugucugugcugggaacugaacucagguccucugcaaaaacaagcacgcuucacugcuaagcaauuucuccaucccuauugaagguauuuuaaaaugaaauuaccuguuauauauucagcauaucuguacaacuaugccaacuuccuuagucuaccagugucuuuauaguuucuuuuagucuucaguagaugagaauccagauguauuguccauauguaauucugguuuggauguuucaauucauucuaaacccuuuguuacuuggaaauguuauccaugcuaaaugugcucagucucauuaauaaauagcaaagggaccaaaggagauacucuuguuuugcaacugguuauaacaggaaugacauaacaauuucaaauguuguauguggggcuggagagagaguucaguagcuaaagaaaaucuuucccaaggaaggauaagaaucugauuauacccaguacacauguaaacucaaggugugcuagcagcuaucaguaaccccagugcucaaaguggugacaggaugauccugggggcucuauggcuacucuagccuauugauaaacucuaguuucaguaagaggcccuaacugaaacgauaaaguaggcagggcuucuuacuacaguggucugaaagcuuacagucuacuuccagaccugucuuaacaaugcucuuuuugugcgaggccaccucuccuggauaacuguugcuaccacccuuugucaaagaaagcucucuuaacaacaaauggagaccaucacagaaaaucguaacuacagccaauguaaagaucaacacaucauaggaaucugcaggauagucagccaugaaaccucaugcauacacgaaaaugaacucagcagcagguuauauauaugagguucuagggaagguaguugagaagggcugaagcaaagggaggcgagaaagugacguaaaacuauuugaaugaaaauaagacaucaaccucuuuuccaccuauacauguauauugcacaccacaugcacacauacauauaccuccacauauacaaauaaaacuuuaaagaugguuuaguuguuggaguuuuuugguuauuuguuuaccaggauauauucccaguuugccaaaauguguuucauuguggauuuuuuuucagagucuauugaaaaucacuauauuuucccagguaaauugcguuaauaauaaagguuaacucuaccuuggauuaauuugaagagucuuaggggugugaaaauguacuuuuucaaagacucaacgauuggucuuuuugauuuuauauauguuuguuuuauauuucacggaucccugccuuucuuuaggauuaaugaaguuccucuguuaacuuauuguuuuacauuuuucugucuguuauuucuguguggugcacaggguggugcauguucaugucugggugcauuugugaguguagguguacuuaccauguauacaugggaugaggccagagguugaugucaaguugucuucccccauugcuuuccacuuguuuacuuguaagacaguguuauucaaccugauguugaccagcaagacaaaaaccucucuuuucucuucucccaucaugagccaccauacuuggcuuguuauguggcuacagauuuucauaaugugugaccuuagucuuuaaguaauguaagcuagauggcuuguaaauaauagaaaguuccagaggcaggaaagucuuaaaugacaguguugacugagucugucuguugauggccuacuuuauucuucauagaugucugcucacauagcagacauauagugauagcucucuggaauugagucaaucaggucacuaguggcccuaauuuuaaauaucacauggagggugaaauuuauauaugugaguuuggggaaauuaauucaauggaauuccacaguggcucucaaggaaaaguuaugucuugaucacuuacaaaaugcauucucucucccaaaauuuuaacucacuccuuguauccacucaaaaguuagcauuucauguaaagauauuaucaaguacaaguaagggucaagauucaauugcauuucauucaauccaacuccccuuugacaaauccccgucuaucugugaacccaacacauuauauacuucaaaaauagagagacagcacagauauucucauauauccaaccaaaagaaaauacuuguacaaaaacagucagcuucaaaauauaucagaaacaucaaaauacccuguaagaauuaaaaagaaagagagauaauauacaaauuuguacuuauuguugggagaucugaaaaguaaaauauguguaaggauauaaaugucuuggucaguacuauuaacuaagugaagcuaauuaaagcgccuauuuaaaaguucaccccacuuucaagugcacaucgaauauuuauaugaacagugcuuuuacacugacccacaaaacaaaucucaguuacuuucaaggccugacgaguguuggagagauggcucugagguuaagagcauuuaauugcucuugcagaggaucaagcucugguuucuuuccuagcacugaccugaugguucccaagcacacaugaccugaguuuuauggucagauacccucuucugaccucugcaggcacugaaugcauacaguacccacacaugcggacaaaacgcagccacaugaaagagagagagagagaacgaaugaaugaacuaaaaggccugacugaaaucauacaaaauggcuuuuaaucacaagacaaauuugagauagcaauagugugguauuuggaaauuauuauauaauuaauauaauuaauuauaaucuauaaucaaagaaaauucauaagaaguaagaaaauacaaagaagcuagaaaaagaaauuaagccucaagugggcaauaugcgccaugccgaucugacugucccguuugacuggcuaguuaucuugugucagagcauauauaagacuguuaacucagguagucagaauauuucugauggcaauguaaaaugaugaccaaaaaucaugacacaaaaaaguguacaauaauauguuugcagcuuuuauuaauauagugccaacucagcaggaacacaaauaagcaauagucacaccauguagucauugcuuuuugaucucuguccucuguagucccuuccuauuuccuuucaugccucuugaaaucauuucauugcauuuuaucuagauuacucuauuuuuauucuuuauuacccaacauacuguaagauuaaaauauuugaaucuauauggaauuguucuauucuucuaguucucuuugucuauacuggagccauuacugaggacauaauacuguaagucacaguacucauucacacucuuccuuuuuaaauguacacuaagcuauucauaaauuugucauuauacauaugaauaaguaacugaguuucaaaaguaucuugcuaaguuuuacugagauuaccuucaauuuaaauaaaauaucugcuauuuaggaagauauuuuacauacuacauaaaacugacagauuccaugcagggagagcugcagugggcaagugagcucccuugagauaguccauagucuugcuggguugcaaugggugcacucuggugaagccccagagacgucccaggauugguuuuuugcugauaugcuuucuccuguuugucauuuccauacuccucauugauuuggcuugguauaaguggacaccaggagacccucaaugccuauagucuagugugaauauuuuccaggugauauagccuauccuauuggguaaauuucuugcagaucaacaugaagaugaaauuugaugaauuaaugcuguuuagauacauuaaggacuuaauagaauucaugauuugauucaaauaauuuuuaggaagaaaguguuagaaucaagaguagcaugugcuccaucgucagaauaaaggcuguauaguaaggaauacaaugagcuuucauaaauuguauuaagaagagaaaggaugcagauacaaguguacauuaugauaaaacaaggccauaugaaacuguugcuuugaacuuaugagcuuauagagugaaauacuguuuugaacuaucaacagccucuguaacucccuuuuguggacauuuuaucagugagguaauuuuauaaagaacuuuugucuaagaaaguauaaaaaggcugagagaaaaaaauaaaguguggcuguuggcgugcugugccuuccauucaauguagauaagucuaucuguauguguguacauacauauguagguauauguguauauauaaauaugcacaugcauuugugaaauugaugaaacagguggucaggccuggccgcaggcugugugugugugucugcaugaagagaucuuuuucuuucucgcucgccauccaccuuuaagagagaguuacgagagaucagaguuucccccugagcacuguugccagcccuagauaauuuuguucugucagucgugccgacccuguacaucgcccaccacugucagcacuuggggcaaggggggagauggguuauaucguugcucuuaucaccaccuuaauuaccaacaucacaucucucugccugccucaguuuacccuguggugucaaagcuggucuuuggcauaaaacuuucauauuucuauguaaagaguuacaugaucuuagaaaauuuacagucuccuuuuggggacauaccuugguuuuuaaaauauauauuuaaaugguucuuauaugguaaauaguuuuaguuuuaauaauuucuugaugugauuguacuuccucuagaauucauaucauaaucaucauaauuuaguuucacuccuaaauuugggguaacuguucccucagaacuucuauuguccuguugcaccuaaaagaaucagucucagcggcagcgccauccuuacccauugugggccuuauguuccuuuagaagccuuaagagcuuauauuuuuuucguaaauuucaugagacucuguuuagguauggguuauuuacauauuuuaguugauaauacugaauagcuaaugaacuuuuucagaauauaugccuuuuuucucagguguuagaaauuuaugcuuuguguguucuaggaaauucuuuuggccuuauauucuaauccuuaaaaagacagauuaaucccaacaauuuuacuuuuaauuuuuaaaaauuugauuuuuuuaugguugcuuauuacaauuguucuggaaguuaaucucuuuccaucagggucagcuuuuaggucuuuuucuuugcuccagaaaccucuaucuccucauuuucauuguauucuuccaaaaaacuguauccauuaacauuuaaauuuugucuuuuucccagcugaguguuagccccauggcggugggaacccuuacaucuucuucaguguaguaucuccacugucuaagcacugcauggcacgagguagguaauguugcuuucuagaagggaggagaaggaagggaaggaggacauaucaaguacauuauuguaaacaucuaaauacugcacugaucuacaugaaggccuguuuccccaguacaaguccuuccugaaagaaguuuucuagaccuguauggauguuguuuccuaccagcuuuagcgcacuggaaggucacacuuuguaaggcucauucauaguaaucagggcugugcugcucuguugugaaagggagaaugcaaacauguuuggccugcaaaugucuccaaaauaagaaauauugggaagaaauagagaaaauaaaucaacacagaaauaugaggagaacaauuaacauuauauuaggcaaacaugacagaaugccacuccucacuggcuugaaagaacuaauacauaacacaaagaaugaguccagggcaaacacaaaacuaaggaccacccuagguuaaaaauaugauaugaauuuguggucugaagaacauuuucuauucacagcacagcagagcuuauacaacuguaaacaacaggcaugaaauagagucagauuugguucauguucuaccauguccuaauucuugauguuaguaugcuauuauuauuagcauuuaugugaggaauuuuaugaaaggaauucaauggcaccauaauugcaaguaaguuuuuucuauuucuccucuucuaaaacuuuuccuuuauuuuaccaaaucaguuaagacaagucauucauucuacaaaauucauucuacaaaaagucuuuuuuccugugauccaagucuucauuacuucuaguuuauucugauaguuccuuguuuuccuagucucucccuauugcaaacugacacuuucagaggcuccauaguaaucauuguaaaauaguacucauauuucacuucccacagagaucaucacugauuccccaacaguacucuaauuuguugacuaucauccucauuccaccagaagaauucuuauguggcaaggacuggguuguauacucuuuuaauauaauuuagucucagcaugacucuuuaagguagccauacaguuucuucucuuugauuucugaaaugagguccaccuauguuuuccaaagcagaccucauuuggaagguugcuuaauagaaaugggcacaaauuccuuccauucuuaaaaguauaaccucuuaugaaaagauuucuguaucaacaaggcuagagagauggcugcaguuaagaguacuuucuacucuuccagaggaucagauuuuggguugcagcccccaucuaagcguauauuuaugcguaucuguaacuccaggguuuguguaucugaccccacuggcuuccauuggcaccugcauucgugugccuauguacacaacuacaccuaguuaaauuuuaaaagucuaaaacucuucuuuaaaagauguuucuccguccucuugacucugggacagacgagugauuuacuuugugcuucacaaagcaguguaaaugauauuugugguuuguaucuuucuucauguugucuugggggcauugcucuuaggugacaugaaagauagccauuuuaacucuuggaauaugagaagucccaggugaauggaacugaagcagacaacuuucuuugcuaucugccagaagaacgacugaggauagcuucuuagagcauggcacaacagugcccuaguaagaaauacaacagguucaagguguagcucuauggcagaguauuuguuuagaaugagcaaaaaaccuuggguucaauucccagugcugcccuccccccacaaaaaauacaacuaggauaucaguccacuguguuuuacagaacacaugaccaaaaugugcaacugccucuagaaaaucauuuuuaauucuuaguaaaauuugauaccaucuagauugaacugcaauuccuaaggcauauuuucucacagaaguaaugguaugcauguaauaaauuaaauuucuucaacucgugaauuccuuggaauauagaagugauguagcuaggaauuccuuuaccacgauuacuuauuaucuaaagaagauauucuuuaugggguaaaguagauaugacucccaggugaggaagagcugguuucucaguaguagacugcuauuacuuaaauacuaguugucaccuccuuuucuucauuuaauuggacaccucagacacuccaauuccccuguuuccuauaucauuguaacucauuaugucuccuacagacuauuuauucucucuucccucaagguacaggagaguagcugagauacuucuguugaaauguaauuugucuaugugccugauuuuuccaacaugaauuuaaaucuauauaaaaucaaauuaacuuugaaauuuuucuaauuuuuguuuguuuguuuguuuguuuuuuguuuuuccagacaggguuucucuguguagcccuggcuguccuggaacucacuuuguagacuaggcugaccucgaacucagaaauccaccugccucugccucccaagugcugggauuaaaggcgugcgccaccacacccggccugaaauuuuucuaauuuuuuaaccaaaggaugaacauaccuauaauuauuuagauguuauccaaaaauauuuuacuuaaguauuuuuaauuaaaaaugaagugcccauuaaucauauaaacaaagucuguaaauccaauuaucuuauauuuuagagagaaaaugaaaacauuaaaauaggaauuugagucuauuuucuucuaaacuccuguuugugcuucugaaugauguugcuaacccacccagcuacacccagcuaagcccugaugcugcuaacccacccggcuacaaccagcuaagcccugaaguaucagugaugagccuuagaaacacuacuuuaccaacuugccuuaaagguuuauuaaggaauuuuagugaaugcaaucuuaauuuuaagauuuauuccaauuuuuaaauuuuaugucuacuagaacuguuuuuguuuuuaugacuuggcuuguagauuacauguuaaaacugaugaguaauggaaaaauuauucucaaaucguuucuuagucuuccauaguuuucuuauggcuuuuuacuauuuagguaaguagcuccuugaagugcaaacauaauucuucagaacaacacuguaagugauaaacaagcuuaaagguuauauuuacauagaaacaagggaagacaaagaaacauaaaagaacuagaauagcauaggcaagggggaaccuuccauuuuugaauguaugugaaauauaauauugaaaaacagugaggccaucaaguagagaguggucuugcuggaggaaggauagaggaaagguaaaauaaaauuaaauuuuaauuuaaaauacauuaaauuuaaaaugcauuuuuaaaauguaaaaacauuuuaaaggggauagaacacaaaaaugagauuccagcaaauaaaauuuagguaaaaauacugaccaggccauguuccuuauauuauaguguaauaauuuauaacuugugcugugaauauauagaauuuuuaggaaaagaguaacuaucccuguccucaccccuaauaugaaugaagagacuguaaacagacuacaaaaacuugggccucuccccaacuccuagccauauucucagcuagcuggcuguacuuuggucaaugaaacauaauaucgccucaaaucuacuguuacaauaaguuuccugauuuauugguuccaauacuuauuaaauaaaaucuuuuuuucuauuuuuaggaacuuuucuuuuuuauuaaauauuuucuucauuuacauuucaaaugcuauccccuuuccuaguuuccucucugaaaguccccuuuacccuccccccacccugcucccuaauccagccacuuccacuuccuggcccuggcauuccucaaauaaaaucuuaaaauaauccugauaucuuaucuuuaaauggaacgaguuauacuauuacauaaacuaugaguaugccuaaucaucuacguccuguuuauuuuuagccaacauacaaacagguucucugauggcauuuccauauauccuuaguuuuggaugauuucccagcuuucuuccuuccauguccacaucaaauguucuauuagcuucugacuguguucuugcaaagccugucuuuuuguuugcuuuuuuuuuucuuuucaugaaccuccuuuuaguuuccaugacuaccuacacauacucccacaugcauacacauauauaaacauuuaaagccaguuucauguaugagagaaaauauguaaucauuaguauuugguuguaagcuauauucagaauuuuaccuugaagucuagaacugucuguucuuucccaauguuaagagaacucccuuugccaggaauuagguaggguggcucccugguaccuacggcuguaaugccaacuacaacagaagguuguauggcagcaauaaagaauaccaagaaguaucuaaacaacauuauggucagauaaucauucuuauuuugauuacuaauuguaacgaauauuacuuuaauguuauugacuauauuuauguguuaaaaaucauacauaguauuuuucuggagaauauuuuuacaucuuauccauaccugccaauauaauuuccuagauuuaaagacaucuauacuguagacaugucaauaauuuuuaauuacauuuuaccaaauauaaaaucauagauucucuaggaauaaaccaauguauccccauaagaaauaagcagacaauaaauaauauaaucugccuagagauuucaaaguuucuagauuugaaaacuuuauggaguuuuagcaacuguuaaccuggucugucccucauuagaaaagaacaggcuucuuagagauaacaaaauaaaaugcaacaagauaaaacaaaaaccaacacaguuagacaaaagaagggacuagaaucagccccacuuuucacacacucaaaaguuucuaccucagaauauuaaauagaaagcuaugugcucaggugacuuggugcaauacauuacuucugcauuaaaaaaaaaaguucugucaguuuuugugugugcgcaugugcacaugcaugaauguacagaccacacagacugucagaggacagaggggcuguuucucuccuuucuacggugcguucacuuacacugcaaguacauuuauccauuggcuuguacccgaacccugaguguuuguaggcagagugcucacaguaacuaaugguuucuugaaauaggagauaaaacauuagcaugaagaugagcuagaagccacugacaacacugagucuuuagucucaagaccuccgauauaagagccuuugugggcuugagaaaagcaccuacuaugggacuugagaaaagcaccuacuacauagagcuccucauagccccaggauugucaggcaggcgagaugcgggacuucugcauguucaaaaccaaagaacuacuucacagacucuaaucaacaagccugcaguguaucuacuuguauuucacaacuaaucuaugccauacauuuccccaaauugcaguuucuuuuucugccuagcuucgucuguuggguauuuauagggcaaauaaccaauaacuuuauucacaaaauuaaacuuguuaauagagaggagcgaugcuugaaagcuguacacaccgagaagucauaccuaaagccucaauacagguaccuauacauguuauugauggugucugagaccucaaacuugauuguaacaccuaaaggggggagguuaagugguuuagaaaugucgcuuucugggauccagaggauggagugugguaauuuuaaaugauaaccccaggcaugucuuuuaguauguauucuuguucuauaaauuuuaagugugagauucucaaaguaaaucccacauucacugaguucagucaguaaauucauuauuugcauuuuggaaagccuggacaauauaaguaguuugcacauucuaaaaaauuguccugagugagauuagugccucacucaucccuuaucggguuagcuucuuggugcagguaggaacuaacacacauauccacaacugacaauaauacuuuggggugcucacucccaaguaggauaucuucaucaagguccucccgccaaggcucaagagucaacgcacaaaaggagguaggaagauuuuaagagucagaggugauggaugacuccagggaaauagugucuugcagacucugcaggacuaacacauacaugaauucguguacaagaagaccugaaagggcucaugccagaagguguccaguacuaggaggggaaguagacaccggguuccaccuuuaaccaagaagcuauuuguaaaugauagcugcuggcaaaggaaaaaguuuucuccaaugaacugucaauagguuuaucuaagauaccccagggcagacugcaugcaggaaguaacugaccaacacaagugguuuguuuuggaguuuuuauauggacuucuuuuguuguuuguuuugguauuuuugagucuuaauuuuuuguaugcauugauuuuuuuuuucaaaagaaugagaggaagaacaaagaugaguagguugguggggaagaucugggaggaguugagggaagggaaaaaacaggaucaaaauguauucuaugaagaauguuuuaguuugaaaaaagaaaaauaauuuggaagacugugagaaauggaucgaagguuaagagcacauacagcucuuccagaggaucugaguucaguucccagcaucucuaaagagugacucacuaccaacuaugcuauacaggggaacuguaucccuugauaaaggcaugaaccaccacugccaggcaagggaaucccuugccucuaugggcaccugcacucaugugcacauaucuauacacagacacauagcgacacacacacacacaaaagaaagcaaucaucuggagaacacauggaaaagccccaagacaauauggacaugaaaagaggcauagcaaccaacaauguuuagacuucaugugauuuauucaauuaugacuauacuuaauaucagagagaccuuaggucaguaaguauaagaaucacuacucagguaaugaaaucaggcucagacucaugaaagcuaauaguaaccaccuuaaaucuguacuccugauuaguuuguuaaguaacaguuaacaagaaggauuaagaaggauaaccauucuaaaagugugccaugggauauauauccauaucuauggaaagauaaauaugacauuucaccuguuuauauaccugacuuugauggucaagauaugaaggugugaucauaauaccaaaucaucauagugcucuuuucuagccagccugaccacucccccaaaguuuauuaguacauauacauuuuaccaggaccuuuuuuuggcuuuccaucuguauucauguaugucacaagccaaaucaagcuaaaucucugcauguuucuuugucucuacuucuauuguucuaucuuuuauuccuugcuuuccuacuggucuguuucucuacagagcucacaaccuauaaaaauaccuaagucaccuuguaaacauacauauuuacuacuaauuacguuuaugaguugauggaucucaagaauaaacaugcauagugguguccuuaguuuuaguuguauuucuuuaaugaguaaugaauuuucaacuuuauuggugacuuacuaggcuaugcuauucuuugaaagcuguucaagucucuuacauuuuuacugacaaauguuuuauuugauaaaaauggaacauacuacuagccauuuuaaccaguauaaccuauaauuucuguuuaugccaaauuuucauuaguuuauuucuuggaaaauauauucauaguaaaaauauauacuaaauauauauuccuccuagauuuaaaacuuuuuuuuuguuucuuguuuuaucuuuuuucuuuuuuuuagauuuauuuauuuuguauaucugaguacaccauugcucucuucagacacaccagaagagggcaucagaucccauuacagaugguugugagccaccaugugguugcuggaaauugaacuuuaaaaccuuuugauauagccagaaauggugguacaugccuuuaagcccagcacucaggagaaagaagcacauaggcccgucugguuuauauagcaaguuccaggacaacauagaggcccugugucaaaaacaaacaaacaaaacaaauccuaacaugcauaugugagugugauauggguauaauaaauguuuucccuuaguauacucgcauacaucuugagagagaggagagagaaaagaggagagagagagagagagagagcgagagauauuaccuagucaccuagccaugaagacauuuucccauuuuuuuuuucaagguuauucuuugacauuaaaaccuaucauuucugcugggcaugguggugcacgccuuuaaucccagcacucgggaggcagaggcaggcggauuucugaguuccaggacagccuggucuacaaagugaguuccaggacagccagggcuacacagagaaacccugucucaaaaaaccaaaaaaaaacaaaaacaaaaacaaaaaaaacuaucauuucaccuuucucugacuugaaggauaauucaagauacacaccacaguauuaucagucugaaaauguagucggucuuaaauuuuuuccuaucacaguaucucuguccuuuuuagugugagcugacacaauucuuagaaacaccaagagccucuauauauuuuauagagauccaugucccuagaccaaaaaguucuuugaggauucugaacuguuagcccuaucuuuauacauggcuucugcugagaugauuuuugcuuacagaugacuuacucacaaaucaaaaccacaauauauuugacaaaaauuuuggcuuuggcucacaccauggcauguucuauauaacucuuccccaacugaagaugagaauuucccaguuaaguucuaguuccuuuuuaccuaacagguccucacacaguuaccucuuccucuuguaguuuaccagaagcagcuagaagaaaccagaucggaagucucccuaauuugcuugcaaauuucuuauaguaacuaucuagauccacugcuccugcauccagguuaaagugggccugccagauagccuaggcaagaagaugaggcuccaacauagugagagcccuugucucaaggaaauaagguggguaauaauagagcaucuauuauuguucuggucucuguaagcaugucuacccucacauucaugugcaagcaccuccuccucacccccaccccacaagcaccacacacacacacacacacacacacacacgugcgugcauauuuucuaagaucucagcacuuuacccucugcacagauguuauccucugcacuuucucuacucaaaggaaucuugacuuuuuuccauuauacacuuuacauuuuuuucauucuuauuaaccaacugcaaagcaacaucuacaauuuuauguauuuguuaugguagcaugcacucuuagggcugccauaacaagaugcuauaaauugagaggguugaaagauuccacguucauuuucuuauaauuauagcaucccagcugucagcaaagccauacugcuugcaccauccaggacuuguauugucccugacugaugguaugcuuucccauauuuucauaaugccuucaucucuuuguuuuccaaauucuaaugucuuuucucuuauaagaacauuuaucacuaaauuuaagguucaucuuacguccaaaaucaccuugguauuguuucuuaaauaaauauacaaaauaaauauacuaaauaaaaguauggcauuugcaugucauaguaaagaaagcaacugaguagcuuagcucuagaguauagaugucacaucaauaugucugcaggguuguuuucuuuaaagaccuaaagaaagaauaguuguguguauucuucuuaguuacugauaguuuuuaaugaucuuuggcucuagaucagugguucucaaccuguggguugcuaccccaaaagggguugcauaucagauauuuacaucacaaaucauaacaauaccaaauuacaguuaugaaguacaaaugaaacaauuuuaugauuggggucagcacaauaugaggaauauuaaaaggcugcaguauucuuugaaucacuuuucacaugcaaaugucauuuaccuuagaagcauucuucuguguccaguuuuaccauuuuuaaaaagcacuaguuguuuuggcuuagagccccucauaaucaccucugcaacaaaucuauuuccaaguuaggucacaucuugaaguauugagggauuagaaugucaacauaaguuaaguuguuggucacuauuuagucuauaguucauucucuuagguacugggugucaggacaugggcaucuuuugggaucaaaaucuuaauauuaguuguuuaaauguuuuauucccaucucugcucccacgcauauuuuuuuaaagucaccuauccuugcacuuuuauucuuauacaguaaagaugcuccccccaccccugucccaaccuaaccccuggcguuuugcaagauuugucuuugucuuugaaauuuugaauguguuuuagauauuagguaauggauagauggauggauggauggauggauggauggauggauggauggauggauggauguucagacugauuauuuuccuaccuuuuuacguguuugguuuguugccauuaauuuuggaaauuucucauuauuucaaauauuucuuucuuuuguccuauucuuuuuugauauuccaauacauaucuugacacugaaacuaccucagaguucugacauguuguguuucauuuuuaagauuccguuuucuguuugaauuguuucuaaaguuucacuagccucugucugcuacguguguuggucuuugcuuugccauguccagucugcugaugaacucaccaguagcaaacaagguucaaguuuuuacauuuuuagcauaaaccuuugguuccucuucauuuuucgucucuuugcauuacaagccuauuauguucuuuuuuaacuuauauacuaaagacccuaauauacuaauacucuuaugcuauaccacaauacucuuaauuaagauuuuccauaugacaaaauaugaccauuuuucauacuugagguuaguucuaauaguuguuuugucuauucuucguaauaugccuuggagauuuuugucaaauauugaguaugauuuaccaugucauaggagguaaguagaccuuuuauuauuauguuauagaaacuaaaaguaauaauugcuauugcuaugaguaccaaauacuucagaauaucacuuuauuaauauauauucaucggaaaaaugaguuaauuaugacauuccuauguacauaagauauucuuugaucuuaacuguucucuuuacccuguucccauucuugucucuuaaugauccucuuucucuucccaaauagucauacuuuguuuucaaccuauuuuuaauaaaaaaauuuaaaaaucuagauuccaaauaugagagaaaacaugagacaaacauuuuucugggccuguuuguuucuuuguuugguuugcuuuuacuuaucaugaugauauguaguuccaucuuuuuuuccugcaaaugauauaauuuguuucauuaugacugaauaauucacucugugugugugugcacgcccguuaacaccuguggaaagacaaucgcugggauaggcagagauaaaauugauuuucuuaccaguauguugacuucagauguaugccuaggagcuacgguagagcaugagauuaugcuauuuuuaguuuuuugaagaaucucuauacugauuuucauggagguggcauuaauuuauauuccacuaauuauguauauaagcugcuuauucauuauuugacagaauuuauauuucuggcuauccugaugauugccauucugacuaaggugagaugggaaucuguuuaguugugguuuucauuaucccgauggcugaggaugcugaacauuuuccuacauguuuauuggccauuuauacaucuuguaagaauugaccaauucauuagcccauuuauugcuuagacaguagaagguuugauguucaguuuuauaaguucuuuuuauauauucugaaucauuuguucuugugacagggccuaauuaugugaaucacuuuucucaguaucauuuguugaaguuguauuuucuguaaguuuuguuuugaacaacucuugaaaaucaaacuguaaccauauggguuuguuucuugaucuucucugccuucccagggguggugagucuuuguuagcauggcucuaugaauugcauuggaucuauaagaacuuugggugguauacauauuuucacaauauuaacucugcugauucauuggcuuaagaugucuucccuucucuaaucuuccuugguuucuuucaucaguuuuuuucacuuuucuauuauagaucgccaucauuuuuauaguucgaauuguuucuuauuguauuugaagcuaaugugaaagguuuauuuccuugauuuccuuuucagcauaauuauaacuguauauuaaaaaguagacuauauuuuauauguugauuuuuauaucccacuauguguugggaauguuuagccaaucuaaaagucuuauggaggagucuuuuaaguauaauauccaaacacuugcacauacgguuaauugaauauuucuuuuauguuguaugcauaucauuuucucaugcuuuacucuuacgaucuagauaagaauucccaugauguauuauauaagaauggggacagugaauaccuuugucuugcuuuugauuuuagggaaaaugcuuuuacuuuuccccuuuuuguauacuuuuggcuguacauuuguuaggcuguguguguguauguguauguguguguauguguguguguauguguaguauaccacacacaaguugguuucauuucagagauuuaggaaugauuuaacauaagaaauuaauaacuauaacacauacauauguaaagagacauaaagcacaugauugucucacuguuccaauggauaagggguccuugaccaaguucaacauuuuuuaaauaaaaucccugcaguugggaauagaaagaacauaaucauagauagauagauagauagauagauagauagauagauagauagauagauagauagauagauaacauaaucauagauagauagauuaaauagauagauuagauagaugauagauagauagauagauagauagauagauagauagauagauagauagauagauagauagagaacauaaucauagauagauagauuaaauagauagauagauuagauagauagauagauagauagauagauagauagauagauagauagauagauagauagagaacauaaucauagauagauagauuaaauagauagauagauuagauagauagauagauagauagauagauagauagauagauagauagauagauagauagauagauagaaagaaagaaagaaagaaagaaagaaagaaagaaagaaagaaagaaagaaagaaagaaagaaagaaagaaagaaugaauacguggaugagaucaugccaugcuuuucuacccucucaggcauucagugagaggaggggucuauuguuccugggauggaaaugccuuuauaaguacacggaaugcuguuguguugugcuuggccuucuguuugcacuuuuaaacagucuugcuguguuacccuccauguguucuccauguggacuacaaacucaccaauggcuacuugacaccucauguagcuuccucauguauuuaauauucuuucuuuguucuguuguuuguauuuaacucuaauguggcauggagagcuucuauucuugccauauuauuagggcuucuuagugccuccagugucuguuucucuguaucacuggguuugagaaguuuucuguuucucuguauuuguaaagguuuguuaugcuuuuagccucaaauucaccucuucuauuaaacguacauuuagguuuuucaaagucacaggcauccuguuuuguuuuguuuugauuugauuugauuugauuugauuugauuugauuugauuugauuuguaaacuaaucucuaaauguacucuugacuuuguuuuuaaucccugguuuguuucuucuucuuugaccuacuccauguuugauaguuuccacuggugguuguggcuguuguuguuauuguuguuguuauuguuauuauuaucauuaauuauuauuauuauuauuauuauuauuuuguuucuuguuugauuaaaguuucagcaauuuuaauauagguccugcauugacauccacacuucagucaccugcuuuuucagacuuuccucucugaagucauuggucauaucuacaguaggcuuuugaauuucuugucuuacacuguaaugauuucagcaucuuugguuuuacuuacugaagaguuagcuaaagagccuuaccagcuaaauuuuucauuuucuugggauuuuuauauugugacuuagacaucucuugagauguauauguauuuuucuuuucuuuaucuauucauaacuuuugagaaggucguuuucucuugggcuuauagucugcaauacucuuuaaaggagaggaaguagagauuaauaacaaaacaacuauuuguccagaaaacaauuauuaaaauguauuaaaaugcaaauuacuacuuaaccaacauccuuaguaagauuauaaagggucucagauuguaauuacaaaagaggaaaguuuaaguuauuaauaaugccaaagcuacuacuaaaaauaaguugaaaaauuggugaguuuggaaagggguaagagagagagaaucaguaaagaaaauaguaaaagcaugaaagcuauaacagagggaggaaaaagcaaucacaagagcaggccaagaggaacaaaaccaagaaaaauaaacagcuaaaaaagugaagaaagagaaaagcaaguuaacugccaguauuuccuuccugcuaagauacuuguggguugucuuuuuaauuuacagucugucuuccacuuccuguuucacuucuggaucccuucagauuccuccucagucaaaagccauaccuguucuuguacuggaguuccuuuagcuuggcaauaaagcgugugaaaaggcaguauucuuaaucuucugauuaauuugcaucuaaaguuuaguguauccuuacacuaaaagcuuacauccuuaagcuaugaauuuaaccaauguuuccuauuuacacacaaacacacccacuugucuucagugaaagauuacuaguaauaacaauaggaaagauguucucuuucccuugaagaauccuuguuacagauaaugaggaagccuauuucacauugucuuccuccuuaccugcuagagccauuagccauccccucucaucuugaagcuuuaaaguggcugaguccauugcggaauggagguucacucaagacuguguaccauuauuaguguacauuacuaguguaccauauggcuucugugucugaauuuagcugugacucuuuuugcacaucucuaaauaguucaggguagcaauuagccugauaaucucacaucucugauagaucccugaaaaggaacuagcuuuuaaguuguucacuguuuuauuagucuaaagauagaagugauacuggaaugaaaccauaaauccugaaaaugccuuuuaauauuuagaagucaaacagaagaacugaugauuagcuaaguacuuccuacauccgguugacuaaagaagagcucuuagccucuucauuacauuguuccuucucaaugcauugccuugaaucagccaggauagaaauguucuuacagacuuguacccucuauucuccaaaggaugacacagaacugauaccauccuaggugcacaggaguuaacuuguuagcuacuacccuuugaaauuucaguggaugcuuccuagaguagguugguuucuuauauaacaagaaaauagccaucacauucagaaaauccaauacugacuuucuguuuguuugauguauugcugggaaugaagccagaauguaguguuggguggaaggcagaugcucuaccauugagcuacauccccaaccugaugaguaucuuuauauaaucuaucaaccauauuucaguuuucucauuguucgaagaauauuguccugcugacaauauucuauucuggaucacauauuaauuugucauauuucucaauaucacaaucaagaacaauucuucaugacaugacauuaaaaacuuuuaaguauaccaagccaguuguuucuuaguuugucuaaucaauacucauguuuaaguuagaguuauacaccccugcagcuggcuuugauaacuuggaugaaauauuuucugauugucaaaaauaaaauuauaaaccucugacaacagguaggaaugguuguuguacuuuuaagucuaugcagauauucuauucuacacucucuucaauccugaccccaggauuauuaccacucucuauucuugccagucauucuuuacuuuaucauccauucuguauuuaacacccuguccuaucuaccugccagucuauauuuacuaugugucaucagugggaauucaugaugcauguccuuuuuguuuuguguugucuuguguugucuugcugugagacauugucugaucuaggccaccauagcuuggagcucacuguguggcgcaggaugaccuugaacuuuucaccucuugccucuaccucccaaauguugagauugcagguaugugccaauaugcccaguuuuaugaaauccugagccucaaaccucaggguuuugcaaauuaccaaacacucauauauagcauucauaaaacuuggguucaacucccagcaaagucaugauccaggcacucuagauaugaaaacggggaucaguucaaaaccaugcuugguuuacuaacacacuaaguuaaggccaacauaguauacauaauacccuguuucagaagggaaggaagcugggaagcaaacaaacaggaaagcaggaagaaagaagggaaggagaaauuauggauuuugauacucaaauauuccuauauauggccagaagaaauuuauucagcuagcuccugaauacccuaaaaggacuccguauuuucuucuaaugguucugugauucuaguaauccacgcuaaucuuauaccucuuauucaccugagcaaauauuucuaagacaaacauguagaacauuuuaguauuaccuguauauuuuagaaaucaccuugacauuuaauuuucuuacaaaguuaguuuaauuuacuuacaaaacagcaacauacuguaauuuaaugacaaaacagcaaccuacauuuguuuuuuuuuuucuuuuuguuuuguuuuguuuuuguuuugaaaccaggggugcaguuuauagcucaguauaaagugcagguuuagcaugcagggggccacguuaaaucuccagcaaagaaaacaacaauuauuucuuuaaaaaacaaaauaagagaaauuucagaauacuucuuuguuuaaaaaaugccaauuuuauuaucaguauguuauuaucuaauuuauaaacuguaucucuguauguaauuauucuaaguaucuauguauaacucacauccaguuguacucaaaaaauacuuguagugaaaucuuucuucaugauuucccaaaugcagccuuaccucgggaguccaguaaaaagugggacucaaucuguagaguuuucucuuauggaaacuuugaaggggccuuguucgcgcagcuguacucaugauagccaaggauggagauuucaaucuuguccugucuuuucuccuuuucuuacugugcuucugauuaaguaaccagcuacuggaggaagagagcucaucuaaauucucugaagcacugaaauguaugaaauaauuggagauggggguaaaauaaaaugaacaaaagcacagaaagcuaaauguaaauuuuaugguuuauuaugauacaaaagcauucaguuuuagccaauuuuacuauaacaauaaguaaaauaauugacauuacuggagaauuacauaguaaaaauauagaaauaaucugaauuuucugcugcaaaauauacaucuucaaagcuaaaacuuugcuuaguauaaaauuaauguuccuuauaaaucauuaauucacauccaacacaguuuuaacaauuuaugccaauuucuuuuugcaugacggugaaguacaucaaaaccaaaggcuuaaaaguacaagggcucauccuugcaccuuucauuucucuuaacuaagcaauuuuacugcauaccaaaucuuagugaauucucauacagcuacauccuauuacaguuuagauacagacauaccaacuauaaaauaaugaaagaaacuauacauggaaaauauaguuuuauaguuauacuuuauaugaauuuuaacauauuuaauauuugugaacugagguucuuggaaauuuuaccaacugacugacagguuacaacuucauaauuauguuauaauaauuauguuacagaucaagagagaauuaucguaggguaucuuuagucccuuaauagccauuuguuacccaucucuaaaucugaucugguuuuauuuugaauagcaguaaaaaccucuggaauauauuaguaacuaaguuauugccagaccaauagguuccaccaaugggggaaaaaaaugucaagggacagccccugaaucgcuaccagccgccccuguguugcugugacuggccuaccugagucuccaacacuguauaugggaaaaguuccuugauguuucugaaauuguuucuacaguuucuaucuguuucuggauguuaggaauuuuggagaguuauuuuauguggacacaucugacuucauuuacauuguauacugcauauuauaauaauauauuuaacauaaaauauauaauaaaauauuuacugauauaaaguaagcuuuucacacacaacagguuccaauuccaacuugauuuaugcaggucagcacaaguugacugaauagucuaacaauaacaaguggauuggagaugggcuagguagacucaaagugacaaacugccuacuagcuaaagggugauacaguuguaguggauuauggcagagcauucugugacgacucaaaaacugcuggcacaacuacagacuauccuuugcuucauuauaaugguaucuccauaucauuagccuugcaaguuugcuugcuucuagcauguaucugauaaaaugcuacaucugaagaaucccacaaagggcagagaagcugaguuaacccuaggccaggauggacacacacacacacacacacacacacacacacacacacacacgacgucauucaauuccuuccuuuccucuaccuuaauucaccaauauuccucuauucauuuuaaguuugggcauagaaggagcuacuggggauuuaagauacacuucuuucugagaaaccagcuauuacugcuuuaccauguaacuugugacaaacuugcuccaaauuccuuguuauuucauuaauguugacaagcacuagaaacacugaauacaggucuccaucugguuccauuaucucugauauaucuguaaccuccauuuggaaguaacaauauuacuauaugugaugcucguagucaauauguaaguucuaaauaauacuauuuggcugaagaacuguugguguuuguaaauacaaguuacgguucuucucugaguagagagauagcucagucuguaaaacaccugcuguggaagcacaagaacaugaguuuggaucccuagcaccuuuguaaagcccaagcacagcagugcugugcccuguguuuuaugcauaaccucaauaguggggcuagggacaggcuuagauggaaucuagaacucagcagaauggauucacuucagguucaugaagagugcuugaggaagacacccaacacaacaugcaugaacauaagacaagaacauauaucauaccccaauacauucauacccacacacauacccacacaaaagauacugcuuucuacaauaguauuauuacuuuuaaaucauauuacagcuacuguaaaaauauucuucuagagugaaugaaacaaaacauucaagaaugcugguacaagcaaugggaaaccaaaaagauacaaagaagcuuggagaaucuaugucaaugagaacagaaccaagaauuaaacaggcaagacaguaacuguaaugcauuaaacaaauaucucacugauauuuguagcaauugguaauaacaaaaaagcugucaccuaaagucuuuugccaguccaagugacacagguuaguaaugcuaguuacucaagacaccuuggcagugaaucaaacuaaguucaggccugccugggauauggaauaaggcaaaaucuggccuaggcaacuuaaugagacccuaucuuaaaauguaaaaaguacaaagugccaggaucacagauaaugggguguuuguuuguuuguuuaguuuuguuuuauuuuuuaguauaaagccaaauaacauguggcuuuuaacuaguuaauauaauuagaucaaguuaaaaaaaaaagugguagcggacaucuuuaauuccucacuugggaggcaaaggcacacucuuugaguuugaggccagccugcucucuagaguggguuccaggauagccagggcuacacagagacccugucuugaaaacugaaacgggggaggaggaagagccuagaauauauauauaucaguauuuacagcacuugcuguguaagacacaguacaaaauaaauauuuaaacuauagucuuuuaaugaaaaaucgacuuaggagacuaucuauccugagaaauuaaucacuaaaagauuaucuuauccuguccccuuaccaggacuccucccaguuaugcugcuguugcccaguaucauggagauccugcagcucuggaucuaaaggaccagcccuuucaugugccccacagguuuacagauaauguagauuuuaggguuggccaacacgaagcccuagccugggugguagcugggauggugagcgcuccagcucuuccuuuccuccaguaccagggcagaaggcagacaccuagaacuagagcacugccccauguacacagaacauuugaaagugaagauguguggacagagggagauacugugggacacgcauuaacacuacagcuuccacaagaucuuuucuaugcuuugugguauuuugcuuaauuuuguuuguguguguguguuguugguuuuuuuauuuuggagaggagguuugcaagggcagaggguagauacgaggggagagagaugaacagcacuuggguacauaauaugaaacucacaaauuaucaggaaaaagauuuaaaaaaaaaaccaagauuaucuuaaggaugaaaaguugaaugugauuaggaacuugguaacaauaauauauuaugcuaacuguauauuuaagaaguacaguuaggagguucaaaaacucaaaaccaagguaacaaaauaugauaaagaauaucacaaaaauauacacaacuguuuaguguuaaaauaguggccuccaaaauuuguuuuuaaaauauuucugaagugaacaaucauuucagaaauaacuuagaugaguuagcaaaauauugagauaauuaagccuagaaguaggaagcuuucuauguucaauggagaaaaaaagaaacugauaauuauagaauuauuucccucuggauauuaccuucaaaugagacuuuuuauuucuuuuuauaguuguuuuugagaaaagcuuuuaccauauaacccaaagcuagccucaaacuuacuauccccgaggcuggggaugacaggcauguacugcaucgccugccuaaagaguauaucuuaauuuacuuggacuugagcuuuauacacuggaucgaauaaaagagaaagugggagagagcuuugaacucauuggcacaggguggggcaguuuccuagacagaacuccaacgacucagggucuaagaucaaaauuugauggauggaacuucaugaaacuggaaagcuucuuuacggcaaaggacauaguccauuggacaaaucagcagccuauacauuagaaaaaaaaucuucacuaaccccacaugcaaaagagggcugauauccaaaauauauaaggaacucaagaaguuaaccuuaaaaaaaagccaauaaaaaaugaaguguagaauucacaauagaggacuuucaaauggcugagaagcgcuuaaaagaaauguucaaaucccuaguaaucagggaaaugcaaaucaaaaugacccugagauucgacauuacaccaaggaaaacggcuaagaucaaaaacucacguaacagcagaugcuggugagaacguggagaaaggaacacuccuccauugcugguaggauugcaagcugguacaaccacucuggaaaucaaucuggagguuccucagaaaauuggaaauagaucuaccugaagacccagcuauaccacucuugggcauauacccaagaugccccaccaugcuacagggggacaugucccacuaauuucauagcagccuuaucugugauagccagaagcuagaaacaacccagaugucccacaguggaagaauggauacagaaagugugguccauuuacacaacaaaauaauacucagcuaaucaugaguuuugcaagcaaauggauggaacuagaaaauaucaucuugagugagguaacucagauccaaaaggauaugaaugacaucuacucacgaauaaguggauauuugccaaaaaaguaaagaauaccgaggauacaauccacagaacucaagauuaacacacagaagagcccaaguaaggaugccucaaucccucuugggaggaagaagaaagcaauugugggggagcagagugaggaaagcaccugggugggagagggaagggggaggggaaaagaacaagaucagguauuggggugcggggaacaggagugaagcccugaggaccagcagaaugaaugaaaauaugcaagcaugggagauugggggacccucuagaaugagccagagacuugguaggugagacacacucaguacucuaagggagagaacuuaagugccaaacagugggcagaggaaacuuauaguccaugucuaauaaaaagacaaggcaucagguggauggaugggguugccaucacauagucaaaaacgcugaccuagaacuguuccugucuaaacaaacugcagggaccaaaauggagaagagacugaaggaaaacaugaacccaaauuggcauccaucucaagagauugcuccaaggccugacaauuauuacugaugugcauauaaaugggccuagcauggcugcccuccaagaggcccaacaagcagcugagacagaagcagguauuuaugcccaaccaauggacugaagucagggacccaugugguucaauuagggaaaggcuggaagaaguugaggagggcggccccauaagaagaccaacagucucaacuaaccuggacccccgagaucugucagacacuaagccaccaaccaggcagcauacacuagcugguacaagcuccucccgccccccaaaacauauacagcagagaauugccugcuuuuaccucagugaaagaagaugcaccuaacccuggcgagauuugaggccccagggaguggggaggccuggcagggugggauagagaaggggugaggaggagggcauucucuuggaggugggggaggaggaaugggaugaggaacugucagaggguggaccaggagggggauaacaacugaagguaauuuaaaaaaaaaaaaaacaagacaucuuaaaagcauuacaacaaaacaaaaaccccaaaugcagaaagccagugauugcuagucaaacauuauuccuuaucugugcucagaaaaccuaggguuuucuaucguuugaaacuuuggaaacacacacaaaaagaaaguggggaggagugaaggaaauagggagccagcuccacaagcauuagaacaggauuuuggauugcucagaaaccaugugaggaguaugggacgacuguaucccuguaagcccagcaauagcaugacaguagacgacaggccuguccuugcaagcuaggucuaccugguaaagauuccuuucugaaaaggugagagguaccggaaggccaaccccuaaaguugcccucuggcauuuauaggcauacugggcacauggacacauggguacccacauguaccaccacauaaaaauaaaagagagaucacuucaaacccugccuacuaagaugaaguacuguuuucauuaacauuuuacuguauaucucucaaauauuuuuucuaagaaacgacuguauaauacauuuuauauucucauuuugccaauuaauagugcaaaacaaaacuguucuuauauaacuacauauuuucuagacauaacuuuaauaguauaccaauaacuucccuaagauaaaauuauguuuuacacuuacaucauuagagauuaaaaaggaaaagaagccauuuuacaaaugaaaauaacuccuccuggcacuacucuuuuaagaacacagcgggaaagguuuauuuccccauuggcaucauacaucuagcuaauaugauuacugucauguacagaaagcacugacucagaaaacauugcuaucaaacaacacucuuggaauugggaaaagacuacugaaacauccuuaugguaacauuauuucuuuauguugugauuauuuugacaacagaccuugguuuuuaaauuaugacacccauuuagaaggaaugguuucauuuacaugagauaauuaccauuaaugaaaauaaauaguauggcaaugauucacuagaauuuaauuucauaccccauuauggaacucauuaagacaaaaaauaaaccacaaaauuuagaccuuguuucaaauagaaauuuacuuucucagagauaauacucaaggaugucauuagagcaucguauguucauuucagaauaacaguucuaaaagcguauaaccaccucauugacagaauguaauccucaaucuuuugaaggcuuaauaauacuuauauuugguucuuagugccaugauuaauaagguaaaaaauaauuacaauuauaguacccucagauggugcccuuaaauaauaaaugaguuaggaaucaauaacacauuuacagauaaguuccccccagaauaacagugauuuugaagacaauaugaaaaaaggucaucaaguacauauaaaaaugauuuaaaauauuuaaaauauauauaucauaaauaguaaguuuuagaugacccaccccaaaaguucucucuuaaagaauagcuaaacuuuuaaauuuuaaaauucuuccauaauaugcaaaguuaugauauaauguaauguaaagcuagaaugaggacacuuugagagaacuaaaauauuuuacgugugagaguccuuguauaacauuucagcuacauagaaugcagcuaaaacucacaaaaggcucauugaaccaaagaaggcuucaguguuugcaggccuucuugcuuacucaaauuccuucugagaagcauucucuuccuuuaggaguuuccuuacuacagcacagauauuucuucugcuuugaauuucucguuuucuuugagauuuuucuuuuguaguauauauauguguguauacauaugugugugaaugcuuauggagagaagaaaaggaucucuugaguccgguuucuuugagcuguguuaggaucaggaaaccuaauccccaugauagggcagcaagcucugggaacugcucagcaccucccggcaucacucucuguauguucuaauccggagccaacuuagaugagaagcaaaacugaaggagaugggcaugaaagcaacaggguacugaugugacuauuucagaauuaaaauaagaacaaucucccuuuuauuuuuauuuuuugauacaagaucuacuacaucccagaggagcaucauaacccugauccuccugccccaacuuucucagugcuacaauuagaaauguggaccuccacauccaguuucuaucauaccgggaauggaaccuagagccuuaugcaggcuaacacuauuaucaacugagguacauccccagccuacccccaauauuuuuuuuaagaaugucaguuaucuacaaaaaaagugcaaagcauauuggcaugguguggguccugagucuaccaaauaucuacaugcuaagaguugguaaacaggcuggcauuaagggaggagguagacucguuagcaguaagauagagaaguucuggagucauaagagguaugaccuuaagaaguguucuugagagcccagacucugucuuccuuuuugcucccugguuccugaugcuuuguucuaccaaauaugcuugccaugcugugcuuucucauugccagccgccaacugacugugaacccugaaaacugcaagccaggauaaauggauccuaguucaaaguugauuaucccagguauuuuuucuauacugaaagaugaccaacaaauauuucauacacucaguauucauucccauucauaauaugucauuugcugauccagguguucgaacuaaaacaauaaaccacaauuuaacaagacaaaccaaagaaauccuacuauuuugaagcuuauauaaaauccaaaacagaagacaaaaaaaguacauaugucaaaacauugacaaaacaaaucccaguugucagcugauauucaugaccacucgugaaauaacuugacuguucccauguauuuucuuuuaauaguaacuaaauguagaguuucaaacaugcuaagcaaauguacuauaacugacccacauucuccagcucuugcaaugcugcugcaccagcuuugcaggugagcagaaugaaagaaaugcauucccgugcuuauuuugacuauucucuuccaguaauauagaaaaaauaugcaagguuaugaugcuacuaguuagcuaaacugggauuagcugaacuuucuaaguuuuggguuugguuuuggucuuauuuuuuacuucugaguauauaugugugcauauaucuugugaggguaugugaacacauuaguacaggugccuguggaguccagaagagacuaucauagucuguggaacugcaauuacaggauguugagagccauuuugcuuggaugcugggaaccaacuucagaucguauguaagagcaguuugugcucuugcucacugagccaucucaccagccugcuugucuuaaaacaggguaucacuguaugucauuuggccuuaaacuacaauccucucgacucagccucccaaguacuaggauuguaggcaugagcuaccaugccucuguagcucaaaaaugacauuuuuagcaaucaaauuuuucuuuagaacauuuuaucagccuuuaaaaucauguauuuaucugaaugaucacgauggcaucauugauuuccucaacuggaaucuacacugccacaagaucagcucccagauccggucuuguucaagauuauauaccagugcauaauuaucuacuauugccauguuaucaucaaauaucuguagauuauauauauauauauauacacacacacauacauacauacauacauacaguaauauagucauggcuacaagcauaguuuagauaagcaaaaugacauagaaaauauauuagccugaauacaauauucauucaucauuuuaugagucaacuuguaauugacuuucacugugaauccccaaaccaggauucuuguaaaugagacacuaucacagcugcccaacaaucagcaaguuuuacauuccaauuaagucucaaugauacaaaggaugacacucaaaaauuaaguaaaaccaguggaaaacuauuuuaauaauagaaccaggcauaaaugacagcauaaagaaaacuggagaaauauuuuaaaccaugauuucaauauaaucagaagaauuaaagaaaaauuuuuuacuuaagaccaaugucauuugagaauggaauggcuauuuaauaugauuuucauugggauaugcauauucuacuuugcuauacuggaaauuucuuaauauaacuaauaugauuaugaauauaaaaaucaauguaaaauuaugaugauauaugccaaucuucugugcccaccucuagaucuaaggucuuuuuaaguuacaaugaacuggagaccaagggaaaaacuauaccaaacagaaaucaugguaacaaggcaguaauugcagagcuaaugcuauccauggcgugaaaucaugguaccaaggcaguacuugcagagcuaauacuauccaugguaugagcuucagaagcacuaaaauuccuagaaaugcaccuccucaugggaagcuuuuaugacugcauuaauuccaugaacucuuuugucuaaaacuguaccuaugauccacugauuguaguauuguaguccuuaauguagaagaaaaauaguuguauuagguauuaaucaacaaagucaaaauaaaauaagccaaauucagaaaccaaacuacucaagugacaccuaccuucuggaaaugccauuagccagacauuuguggcuacaggauuuggaagagaggggugaugaaguuggagacaaguugagaggggcaaucaaacuguuaaugaucucagucaacugugcacucuacaaagaaacaguuaacacuuuaguguagcuaagcaucaugaagauccugaauucuguccugagaauucuuauauuguauuuauugauuuacacauacugaagaauucuuacaucacuaaaaugacgccuauuuagucacaguguuuuuuaaaaauguguucccauuggccuacuaucaagaccucaccuuaugaccaaauuacacaucuauggguuaaucucucaggaucuaaaugacccaaucaccccucaagagcugggauuaugaccuagggacuaaugcugaauacaugugacuuuuggagaaacauuugauaucuaaaucuugccaagcaguuuaagaagcaaaaauguaucuaaaguuauuucguaaagcaagaacucuacauaccuguuucucuauguuucgaagaaguaguguagggcugcuuggugacaucucaaaaucguguucugguaaaggcucuucacuccucuggggaaccugagaauucacugaaguguuuaaugaaacugcuugguuugaaaacuguauuuguuuuuucaaaaugucuuuuggaagcugacauucuucuaagaucacuauccccuaggggguaaaaaacaguaaagugaucacauccuacuauccucauaggaaacauaagaugaagaauugaaaauauaguuuauaugucuaaaacagcuggcugauuaggcugggagagauggcucagcaauaaaaguauguacuauuuauucuuucagaggaacuaguuugcucccagcaccugucggucagucuccagccaugggcagucuccaacuccacaccuccagcuccagggcauccaaccgacuguuauggccucugugugugguaugcacacgcacacacacacauggagaaauuucaaaacaguauauuuuaugcccugugugauuauaccucuaaggaaagauaguagacuagaaacugccucuaugugucuaugccauaguuacagaaaagugccaagauuuuaaaaaaauaaauguaaguaaguaaauaaauaaaaggccuuaauccaaagagaaaagagggaaaagagcuuuggaaauccaccaaaaaagugauagagcaucugaaaauaacagcagagaaacaagugauagacugaaaaaaaggaagacgagccacacacaguuucaccuacccaccugcagagggaaggaaaaaaggggggccacaucaaaaaguagagcugggaacuaaaugcacaggaguauucaaauaacaaaaaugauacccccaaacuagaaaagauccaaaccaacagugacuaucaaaagacacaaaaccaaaacccuaauauaacaacuccaaaacaacaguaacuacuaaaucuacuaaauucaaaaccuaaaaaagauaaaacuuuaagaccuaaaaaugaucaaugaccucaaagaggacucaaaaauauaaaaguaaggaaaucaauauugccuacagagagaaaagauaacaacauaaaaaaaggccaggagaaaaucaacagaguagaggagaaaaucagcacaauaauugauauuuuugagaaaagaaauauuggaaauaaaaagcacguaagaacaaauacaugagaacuauaauauaaaagcaagcaguacuacacacagcaaugauuugugagcccaccauugucuucuauugcuauuuaagaacuauucaacagcaccauauacauuguacauuuccagaccauauacugagccacaugaauuaaauaucaaaauaagaauaaaaaaauuuaaauuuuccauacaaaaauguaaaaaaguaaaaccaucccuuuugcagaugauauaugauauuagagaucccaaaaagucuaucauaaaauuucuagaaaugauaaaauucagcaucauagaucaacuugcacaaaauacaugaacagacagaaaagaaaagaugauggacacacucccauucacaauggccucagaauaagccaagccaaggaaaugaagaaccucuauaaugaaaaccacuggaaaaaaagagauagacauuacaaaauggaaagacacccuugcucauggguuguuaguacuaacauugugaaaaugucauuucuggaaaaauauauuuacagauucagugcaauccaaaucaaaauuccaaucucauuccucacagaaacagaaggcauucuaaacuucauauggaaucacaaagaucccagcuauccagagcaauucugaacaaaaaaagaaacaaugcagggaguuuaauuccagauuugagauaaauuacagagccacaguaguaaacacaacauauagacacaaaaacagacauggggcuaauggaacaaaaugcaaagacccaaauaugaccacaucucacuuagccacuuaauauuugacaaagagaccaaaaacacacacuggaagaaaaaaagaaaucaucuucucaaauaguucugaggaaauuggaugaccacaugcagaagaaugaaauuagacccauuuuuuaucaccuugcuugaaaacuauaaguggaucaacgaccaaaccugagauccaaaacuacuggaagaaaacacagggagugcccuacaugguugaggguaggaaaggucaccguuuuccccaagaagcaaggcuucgauuguuuagugagauuucacagaaguaacaagccucugcauagcuaaagaaagagccaggugaagaggaggaccacagaaugggagagacucuucaccagcuagacaucugacagagguuuaauauccacaacauagaacuaaaaaauacaaagaggagucugggacaugaauggagaguuucaaaagaaggaaaaaauuacuaagaaauaucucaaaaucuguucaccauccauagcaauuagcaaaaucuaaaucaaaacuuugugauuucauuugauccuagugagaauggcuggaaucaacaaacaaccuacaucaaacgcugaguacucguuuacugcuguggguauugcaaauagguacagguacuguugaaaucaguggagagaacucucaaaagguuaaacaauauauauauuguaugacucagcuauaccgccccuuggcauaugcccaaaggguucaacauucuacuccacagaaauuuguucagcuguguucauugcuguucuacucacuauagcuaggaaauagaaacaaaacauaaaccaaaaacuggaagaccuacuccuugauucuaaaaugacuagaauaaccaaaauaauauaacagcaguauaaacauaggcagauguauagaacaguagaacaaagaacagagaaaguauuugcauauauggucaaaugaguuuugagaaauagugucaaaaccauucaacagaaaaagcaaaguaugaucuuucaacuaaugccccugggaaaacuggagaucuacaugcaaaagaacuaacuccacauaccaaaauuaacucaaaauggaccaaauaccucacuagaagauccuugaagaaaauauaagaacaccaaaggcacagauaaaaauacaauagauaaaauagacuucauaaaaauaauaaaguaaaaagacaacaaacaaaagaauaaagauaugaaaauuaaauacuauguaagcaauuauuaucaagauaaagacucccuaaaauacagcaacaacaaagccacucagaaauaggcaaaaggccugauuuauagauauuucuccagagaacauauacaaauaaccaauaaacauaaaaauaucuaaacaccauuaauacuaggaaauuguaaacugaaauugaaaagagauaccaccugacauucaguauuauuaucaguuaaaaaauaagcaaaaaaccaaacuguuggccacaacuuagagaaauggaaacuauuauauacuauaguucauuaaaaauuaaaaacagaauuaucauacaauccucuaacuccauuucuggauguauagccaaaagauuuuuuuuuuuugguuucuuuguuucucagaaaggaucacaccauugagcccuggcuggcuuggaaaucacuaucuaggcagggagaccuguacucaaagaaauccacuugccucccuuucccaugugcugugguuaaaggcauacauccuuguuccacugaaaagagugcuuugaaaagagaauuucuuucacucuauucacagcacacagacaacagcuaaaaugugaaacaauuuacauaucuaucauugguaaacaaaaugugaugaauauacagcuauucagcuuucaaaaaggaaauucaaguauauacuacaauguccauaaaugaaaggaccacgggcuauauaauaagccagccacaaaaaaccuagguauuauuauguuuccacuauaaacagacaugguuauuaauguuauggagacugaaaacuagauagucacuguuuaauagguauaguuuucagucuuaaaagaggccaggcagggagugaugcaugccuuuaaccguagcacucugaaggcagaggcaggcaaaucucuaugaauucaggccagccugaucuacaacaugaguuccaggauugccaaggcuacaaaaagaaaaaaaagguggaaaaaaggaaaagaaauagaaagaaaauggaugccugauauuauuaaauuacuuaauacuauuauguuguacacauaaaaaugaauacauuaacaaauuguguuauacacacauuugacaauaaaaagguuuuaaaauguauaauauuucuauuaacuuaagcucaauguuuuuaauuguuuaaacauacugucaaauuauauauacauauauguauauauauacaggcuugagaaaagcaacauuaauauuaagaaauuaauauuugaaaaccugaaacuagcuccuuucaugaaauuuaauaaaaauuaauuuaugugaaaaauuauacagguaacaauuuuaacaaaaaacuaacaauaccuuagaggcacgaaucugccuguggauaucuguuagcugcuggauuuuguauuccagcucugaaaucugagcuugaagccaaguccaucggcugccaacuugugcucugucuacaagccacuuccauucaguacuagaguugcugggaacaaaacaaacacuguuagucaaagcacaaagucagauugucagagugcuaauaacuuccuugacuaguuucauaaaauguaauuucuuuuagaagacauguacacuacaucaagggaaaauagcagacugauuucuuaucaaaggaaauuugauuccuuaccuuucuaccacaugaauacuuggcuuucgucaauauuauguaccuaacaguaggauaaucccucuguaauuuaauaugcuacugaugcuaagggcuugcauggggaaugaaccaguaaggaaaaggaaacaagaauaacaacuccaacaucccguaacaucuguucugugaggauuuuacaaguaaaaguggaagucaaguacuagauaacccaucugaacuauaccuaaauucacuuacuaaacucuaguguaccugauuuaacuguaauuucuacuuaguagacuauagcaucauuauauuacuaauacuuaaaauuaaaggcauugacaauaauuuacaaaaaugaauccucugcuguauuuccuucucauuuucccucuccucccuuucccuucccucccucccuccauuccucucucccucugccccuugcuuccucucuuucuuucuuuuaauaguaucucacugaauacguuggauggccugaaccaagcucuguagcccaggcuggccucaaacucagaaaucuaccugccucugacucccaaaugccugugccacuaugaccagacuuuacauuucaaaucacuauuuugaauacauaggucuuccauuguuuuuuuaagauaaauaucuaguuaaaaauuuaaugacuauguugcacaauacgaggaacaaaaagaauuuauaaagaccucuacuuucauuuauguuuugaaauaaauguugaaaccucuuaguuccucuaucuuuuagcaggggcacucuuagaagcuauaguuuuggggacuacaaaugaauuauuucaugaaaauaguguaagugcaugagcuagaaaaauaaauaauuguaauaacacaugguauggcaggagguagugggaaauaagggaaggaggaaggaaauuuaauagacugccaaggagaaaauaucaccaaaaauuaaaaguauaauuccaaacuaauaacuguaauagaaaaauauaugaauauuuuuaaaauuaucuaaaauguauauauuuccaugaucauagaaugagcuauaaugauaauuacaggugauaauaacagaucaauaucagaugguaauugauauggaaguugugagugaacuuguggggacagagaggacacaggaauucugauauuuacuguuuuacuuugaagccaaaacuacucuaaaagugaagaaaauguauaauggaaacaaaacaaaucaaaugaaauaggucauacaaaauggcacaugccuuuuaucccagcacucagaagacacaggcaggcugauugcucugcauucaaggacagccuggucuacauagugaguuccaggacagccagagcauaggaagacucuguuuugaaaacaacaacaauaauaauaacuuuaugauggaaugugcauauaaacucagccagaggagauagugaagaaaauuuucugucagauaaaaaaaagucaauuauuguaacuuugcuacauacaauuuaguaaguauaagauuuuauaucaguauuucuaugauaccauaugcaguagaguuucucuagacauauuuacauuuucaguuuacaaucaaaauuuuaauuuuucaaauuuugaacauuuuuaaaucaaagugagagaguacauguuuuaaauucauuuuauagagauaguauuuaguaguacuaaaugccuaucaugaaguuuggagaguaaagcaagagucauaccaacacaacuugaacaggugagaauaaugauuuaguguaaagugggagcuacuuagaaaguacuaacaaaauuauuuccccaagcaguguugcuacuaaagccaugagacaugaaaagaaacaaggaagauaucacugguguauaaacuguagucuccaaauacccugugugcuacuaguauuuuauauauagccuucuuuguacugaaguuggagucaugugacuacuaccaaucaacaggcucugagcaaaauagacuauuauuuuguauacccaagaaucuugaaauccacuggugcagauagaauagcuauaaaaccauacuagauaguagaggauaucccaaagcuauguaugguagaucucuauuauguuaaagcugugagauuaugagcuuaacuuauuacugaauauaaccuauucugacuggaacaaucugaaaauagguuggacugacaagaggagaagauaaauaagauaaguggguaaagucauuuaaaauuuacagcagaucauuauggaagagaccauaaggaaagcaaaggucauuucucaaguucuuucauuacauuuugcuucaguuagaaaauuuccuuauuaacauucaguuggacuugaauauguaguugaugacaaauaauaaaauauaaaaaacuuaauuucuuaauacaauacuuaugggaaagauacucucaccaaaguuaauaccaaaacucauuuuuacuuuuacaaauuguaucaaauuauaguaagagacauuacaauacuagauuaaauguaaaugaagcaaaucaugcugaagcuuugugaugcguggaaugaguuuguuauaaugauucauuuuucccauacuuuacuaggaauaauuaaaagccuguuugcugaauguaaaggggguaaacaagcuuuuucauccaaagagcuuccuugcuuagaaacauguuuuucaccuaagacagaugcagauacagccaaccauuggacugagcccggggaacccaauggaagaguuaggggaagggcaggaggagcugaagaggauugcaaccccauaggaagaacaacaauaccaacuaagcagaccucucagagcucccagggacuaaaccgucaauaaagaguauacaugggcuugcuacauauguaguagaggucugggcaucagugugaggggaggugcucaguccuguggaggcuugaugccccagcaaagaggcaugcuagaggggugacgcaagaguagguggguggguggaggaacacauucuuagagggaaagggguggggcaugggugaggaguucguggaagggagaccaggaaagagaguaacauuugaaauguaaacaaauugauuaauaaacauguuuuucuuuaaaauacuguugcaaacauaacagauaacagguaaguuuauagucgacuuuuuuugaagacagauuuaaagucaaaauaugucuuauauaaacaacauauauguuguaacuguagaguagaccaaugauguaacuauagaguagaccaaucagaauauagguuagguauauuagagaaccuauacgauuuaaucuguauguaauugguguauaaguuugggcugcuaaaucucuaagaacaauggcucucugcauuucagagguacacaaaacugagcucaaacuaccagcugcugaccacuggugguauuccuaucuucaacaaagaaaaaggcaaggacaucuguacauggacaccacuugggcugcguaaaaacaguacaucuuccaaaugguggccuaugccuuacaauucuaugcuugcuugcuuguagucaaugcuuaacuugucggaaauacuacaagguucuuuucuuaaaauguuaguauggagguguuugccugcauguaugcauguauagcacauccacacucaguaccaugggaacccaggucaccggccccagcacuguacuuacagagcugggugcugagggaaaaacccgggcccucuauaaaagcagcaugugcucuuaacccacugugccaccucguaaguuccagccuaaauacuugaaccuagagucuagauucuugucuuugaaguauaguuacugaaauaagaacuuuccagaaugacaucuuagauuuccaaggcuuaaagagagacauguuuaauguaaucuuuccuuuaacacagguuuuguuaguucaccauacagcaaauugaugacuaaucaagacacaaggucuaguuguaagaaaugaauguuaaaaaaaaaaaaaaaagaaagauugguccuagaaaaauaaacugaucaaccuucucaacugguauuugcucaccuaggacaaccuuucuacccuagaauuggguuccuuuagaucagagguuagcaaacuuuaucucugcagacacauauaacaaaugcuuuagguuuuguggucagaggaucucuguaacuauucaacucugccuuugaaauaugagaguggcuauaggccauacacaccacgggguggcuguguuccaauguaacuauuuucaagacaggaacuaaaucccauuugguucaugagucugcuugccaacaccugcugaagauuauuuucucauaugcaccuucugcuuugcaaaggauuaugcagaguuccguuaauaacaugccugugcaaauagcauguccacauuuaacugggcuauagcuuccugguguaacuucuuuaucaacucuaacuuacuggaaauauuucauuuccaauuuacacaugauucgacagacaaaugauaaacagccuaaaguaugugucuauguaacauugcauucugaguagguuuuguuuuaucuugaaacacugccuauguaacucaggcugauauguugucaguuauaaguggguuugaaauuugucaaauuacuuuugauguuaauuuauuuaaaguuugaauguuaaugaugugugugcucaugauuaaauuauuaugcccaauucuaugugacauuuguuaugaaugcucugauggcuagugugaaaggagcugcguuucuccugcuuucuucuauguuuguccagugucagacucacgcuaaugcuggccucagaguaaacuagcaagaauuuuuucucuuuuacucuaucaaagaguuuuuaauauaauuggaauuauuuacacacguuucaaaaauaaucagugaaaauagcuaggcuggaaauuacaucuggaaagauuaucaauuuaauguuucuaaaugauauaacaucuaucaugucuuuuauuucuuuagcaauauuugauaaauuuuguuauaaaucauaagacuauuugguucaaauauuuucauugauaagcacauaaucacucauaauauuccauuauuguuuuaguaauaugacaucuuuaguucuauuuuuggucauuuucuucuaaucauccuagauauguuuaucaacucugucagaacaaagacuuguggcuuguuauuccuugauuucuacgguuuucucccuuuuuauuucauauuuuauuugcuacaggucuuagugaacacagaccaaagauuuuauaccauucuuuccuacauauacauucagagccaaacaaauuccuaucagcaucacuucaguaauuuacuaaauggaauuaaaauaacagcauaaauauacaagguaugcaauuuguaauauacauaucuaaaauauuucguaucucgauuuuuuaucaccuauauuauuuggaaauguaugcuuuacauauuuuagaucuagaauguuuaccauuuccuaccaguccuucuuuuucugcagauaugaguauaagucgaauaugauuuuccuuagccugaacaucuuguauaaauguagucuggccacgcugcugacacauagcugaccaucugccuccccaccgacucucccaccaacacccugcagaaaugcuucacuccccacaauucuuagacagugaccagugucccacacacuggcuccuccacucacucaagcuuaugacaaagacagaaugccuuaauguccaggcagccaagcacaccucuuagccaaugcuguggcuauuacaauggaucugagaugaauaauaauaauuuggggacaucccaaaguaacaaaagauaguagaauuauugcaaagacaauugauuuaaaggauaaauauaagaauauuaaauuuguucaagauguaccaguaacacaaaugaagaggguguggaaggucccagcauugcuguuugggcaugcucuaguacuaaaggcggcuuucagaagaucagggaaggggcuaauccuaugaaaaucaaagaugucaugcugccuauugauguuauuaauugcugaucuuuaaaagcaauauaaaccuauaacaaccagggaagagaugucuuacauugcuacaauuucuacaaauagaagcaaaaaaguuggaaacuucauuuggauucagugacaaaggucuagaagaaaguauuaucacaguaaaggauggaaaacaagccgaccguggugguacacgucuuuaaucccagcaauugggagacagaggcaggcggguuucugaguucgaggccagccuggucuacaaagugaguuccaggacagccaggguuaucuagagaaacccuaucuugaaaaaaaccccaaaaaagagaggagaaaaaauauggaaaacauugaacagggaacuguauugaagacagaacauuugauugagauauauuuuccaauguguuauuacuacguccaaaggaugaaaauguaauuuccaagaugcagauguuuuuauugagugagaaaaaaauucuaguguccagucuguuguaccuacuuuugaaauuucuuugguuguaaucacugaaaauguuggagaaauuguaaauauacuauuuuugaaugggauaaaaguugauuuucaaguuguaacaaucaaaacuccaggauuacagagaauaggaacagcuuaaaaaauguauacuagucuaaagauuuuuccauucuucugggaacuagcucuuguuguaccagaaggcaacauacaagccuccaaaggauagaggcaacaaacaacccuacauagcuaugacaccuaugauucacaaugacgcgcauaacauaauaucccuaaagguguuaauaguuauacacaaacuuuagcauugaccaacagcucuauaauuguacuuaggacccacuaaacaagagagaaauccuccauucccuggccuagugaaacauggaucuuagagaagagccuacagccacuuuacuaaaccagcaucaucuguaacuacauucuaaaucuuuguccucguacagauaaauguacuccucgccccucagcaaggaaacuucuccuuaaaaccacaacauaucaaacuguauagcgggauccaguuccaauaaauacaucuacaaaacgacuccugucccuaaggcucgggaauauuacagaaaaaguugaaaaaauugucagagacauacaaucaaggagucuguugugaggugucgccuaguaauuucagaaaguaaacccauaaacucucaccaacagacagccuuauaugagcugaacaaggacaacaacagacaugccaaaauggauagggcucaaccacauacaaagaacugcagacaagggaugcugagagcaacagaaauacuauuucucagggaaaaacaaaacaaaacaaaacaccaauugguuauucaaugccaaauggucagcaaaaacauacaaggaacauuauacaaacuaaguggguuauauuuaagaauauauauguauagacauacauucaugugaccaauuaacuauugaaaaaagagacugaauuagaagaaaagaggagaggggucuauguuugggcuucaguggaagaaagggaagaggaaaauuauuucauuauaaucucaaaaaauaaaauaauuuaaaaagaaaaaaguuguaaauauugcuauugguaauucaguguuuagagaagaggggcugaaacuaaaucuugaacauaugacaaaguucaaauugaaaagcuaaaugaaugagcugcuaaacuagcugauggaguagcugugccgagucuuggaggacaagugauguuggaguaaaugacaaguuacagaugcucacagucuuacaagagcagcuguagaagguggcccuguuuaaggcuucaggagagcucuguuuggacuccuuaaaguauccuaguauagauuagaacauugguagaaauuaaaagaacacuuaaaauuccuguaaugacuaucucuaagaacauagguauugaaggaucugugaaauuugagaaaauuuugugacacugcuuagaagucaguuaugauguuaugcuuggagauuugugaacaugguagaaaaagcaaucacugcucuaacaaacguugagagaacugcuuuacuaaaucccgcugaggcaguuucucuguuaacuacagcagaugcuguagacagaaauuccuaaagcaggaacgaacacaauggaugaaauggguuaaauuucauuaacaggugggaugcaacgggcauagucuuaacaccuggaauaggauuuggcccucauaacugaacugugacaugaagcucacggcagagcucaacaauaacuuuagagauguggguugaagaaaaggaugucugauguuuaagauaaacuaucuaaucgucaauuacugguuuuagucagccauacauaauagcuuacuaucauuguccaugccuacagauuauucauuuuuuauuuuucaagaaaggacauucauaauccugggugcaaagaaaacauguuuuagugcacucauacugacuuuugucaguuuuuacuuacuuggaauugccauucacguuuguuaaaacucacugcauugaauagauaacucauaugguuuuuuucaacauuucuauuaucauuccauugacuucugaaaucauacuucuaauaaaagcuaucaauguuuuauuuaguguauucuaaauagccauucucuugcuaagaugaaaaauagguuacuauuuuggauacugagaguucagcgguuauuuuaucuucaauucucaugauuuaugacuucauuaaguuuguucaaaacaaauauuuuacucacaucaucucugucauuucaagguccaugucuauugcuacuuauucuucuguguauauguacauauacaucuaucuaguaacugaccauacaaacacacaaacauacaaauagaagauuguugagugugguccuccucuagaaaauaauuuucuuuuacuugguuauuaaauuacuugcuuauuuaacugcauaaacuucaucuuucuuuaaagcuuuguucaagccaaguauauaguaaccuugacacuaagacaacucacuaaauuaaugaagaaaaagaaauuaacaaaacuuaauuaccagcaaaggaagaaauuugacuugguuauuuucauaugucacucauaagauggaaaaaaaaaaagugaaacacugagaacucuguuagcaaaagcuaccacaagacuaacagaaacuaaaccuuggagccaggguuaauaacagaguacaacauccaauaaugguuuacuaugacggcauauaaucauaaaagauaugaguacauucccaugcagcaaagugauauucuauagaaaacaaaggaaaagacuuuuaacuuggcaaagcaaaacugggguuccucuaagaccuuacucuacugcuacagcagguuuugguacuguaaaaaccaggaacuauugugcauauccacauuuuucuuuuaaccaguuagaguacuuuuguguaugauguuggacaaaccuguggaagccagagguagacaucaggugucuucuuaaagugcuguccuuauuuugggagacagggcuucuuacuagaugagcuggaguucacccaugaaauacacucagugccccacuaucccagacuucccucucuccguaccccaggacugguauugcaguuacacacagauccaugcagcuuuccacucgugagcugggcaucuaaauucugauccuugugcuuccauagcaaauacuuuaacccacuggcuuuuaccuagcagcucuccuaugaacuuuauuggagcuuuccuguccuuucugcaucauauaagaaacagaaagucaaaguacguuugccaguuuguagcucaucacacugaugaaccacaucuuaacacaauggagggauacuguacuucauuguaugauucuagcuugucaucuuugagaaauugguacauuuuauauaagagaaagguguauaugggcauguggaaggccaaagauaaccaaacagacugcaucucugcagucccucucccaaugucuagucauuuuucucucuuuucuguaguuuuugcaagagaacauacuauauuauaggcuaguauuacaucagaaucacuuuauagcccagauuacccucagguuuauaauccuccugccucauuauccagaaugcugggauuauaacagaacucagcucugagcccuaagcagaacaacuguagacuucauuucccagucuagaauucuaguaagucuaaguuucaaagucugacucuaagagguaagccaaaauaaucugcguaucugcaggagcuugccuuuccaucuaauugaauggcuccuuaaaaauagcuggguguggaaaggaagggagugcuagugagucagugcagggagacaacagagcuaacaggccguagcaugccuaauuguuaacuguuaaaugagaagaaaaaaaucaguccuucaucugugauauguggcggucccccugcuaugacagcuuagucuaucuuaaugaagcucuccuucaaagauauuuccugccauuaggaugaguuaacaaguucucaauuaaaauguuuacugucagcuagacaugcuagcucaugacccaauccuaaaacuuaaugauuuguaggcacgauagugugucaaaggacagcauggacaaggcaagauucugccccaauaaccacaaaaacaacauacaauauaaaaguaagaaaggugaagcuuagaaaugcuggcauaaugacaaaaaaauuaaggagugaagguauuaaaggguuucaaauaacaaagaguggcacaaaguaagauauuauuuacauuugacuagaacccugguagaacucagugcauaaaccaucuaaacaaagcuucuagcauaccuuaaaaagaagucaugcauuaaccagaaaaguuagcucuacccucccucuucugcucucaaguccuaucaagucaaaggaagagagaaaaaugagguauauauucauguacagugucgcuaccacacuuuuccucucuguuaaauacucaacuauccuuauacaauucuugugugauacggaacauugacaacuguggacauaaagcaugaauuuuuaaagcagacuaaagcauacuaacaaaggaaaauauaauucaauaaauauccugugcauauacauccaugcauacauauuucuuauguucaaaaaguagacaauuauauagauugaacccuaccuaaaggucuaguugagcggacaguggaguuaaaauuucaacaaaaaguucugaguuucaaauuuaaaacagcucagaggaaaccuaucuuuugcuauggcaccacauauguagauuuauuuguaguccuuccaaacacuacaauggcucuggaaaaaggguaaaagacuauuaaaaccguaucaccagcaacaaaaacaaucagaagccaaaauaaaacuacuuuuguuccucaaaaaggagaacuacacauuaaccaaaaauaaguagagacauuucuguaauaccaccauauaauauacauuuccaaauaaccuuauauucugcaaaauagaagaauuuacauugaaaauacuuaguaccaggccacaaaaaacccauggaacuuuaaaaucugauccuuaacaauaacucuuagaagauaguuucacugauguucauaccuaaaaucaagcaggccauccuuuaaaggcagucuucucccucugcugccaguacuaauagagcuaauauaacuaaugauauuuaaaaugucaucuagaaauagacuucauuacugcauugauuuuguagcaaggaaaauagaagaguguauucaacugaaucugcagccugagaucuuuuaauguagcaagagggaauuucuacagaauuuucaauauuuuguuuagacaguuauauguuguuaaggcuuucucuuuacuugugacaaaacuugacccuaaauauuuaaaaauauuaacaugguugaagugguuuggaaauagggcaaauugaauguugcauuauagucauaauaauucuauauaacacaugugcauaaagccacacuuuaaauguaagaaaaugacauaguuuuuacaguaacaaaugucaguaguguaaaccgucuuuaaagaguuuacaaauucaacuacugcacuuuaaagagucuacauguacaaauucaacuacugcacuuucuugaugcgaagacaacaccaauucaagauagacaaauaaaauaacaaaaaccugcuuuggagaaauaugugaauuuuacucaugaaugcaucucaauguuagaaucacugauguggagccagugguagcacaugccuuaaucccagcacucaggaggcagagaaggcugcccaucucugugaguuguucaacaccagucuggucuacauagcuaguuccaggccagccagaacuacauaauaagaccuugucuccgacaagccaacaaaaauguugacuguuuucaaaaauauacauuaggaaucugagaaauauuacauugaaaguacauauaaauuuccauuagcccuguuuucuaagaauaaaacuuuaauuuaaaaaaguuuuaaugauaucacuuuuauuaaaauuucauuuaucaaaauaguaucuguagggcuuagauuuuucuaagacaacuuaaaacuauuauggauauuuuuuaaaaauuuuaauuuacugagggaaaaaauaacaaaaaauguacaugauuauuguagugugauguuuuccuguauaaaucaaugugaagugauuuaaaugaaguuaauuauauaucaaucauuugacauacauuuuacuugugagaacacuuuagaucuacucuuagcaacuuccaggcacacaacauauucuaugaaauagucagcauauugacaaaagagcucuagaacuuaguuuucuacguggaaacagucacuguugccagcauccuccuccucuccccaccucacccagagcaauccgguaagcacuagucuacuaugcuucuguguuauggcuguuuuagauuuuccuccuaagugagaucagacauucauuuuucaauuauugacaucuaugcucaauuacuugacaagugauguauuucacuuuuuucccaaaggcugaauaauauuucauuccauauuugauuguggaugaagauuacaaugguaaugcagaaaugauuccauuuguugauuucauuuccuuuggauauaucuagaguaggauugcuggaguauacaagauagaucugggguuuuuagcuuaaguuucuuuuccuauaaaggcuguacuaauuuauauuaucaacaauaugcaaaguuccuuuguauucucuccagcacuuaggauaaccauacucacacauguaagacuuuaucucacuguaguuuuacuuugggaucuucugaugauuaguaauguugaguugcauuuuuuuuuuaugucuucuuuagagaaaagucuagucuuuguuuucuuguuacuguuugucuggcuugaguauaucccuugaucauuaacuuguuaaauguaggacuagcaauuuuccauucuauagguuguuuguucacauuguuucuuuuguugggcaucaguuuucaauucaaugcaaugccauuugucuauucuugcauuuguugacgcuuuuaaggccaaauccagaaaaucuuugccagaacuauaugccaagcucuuucucuccacuuucucccaggaguuuuacaucuucauguuuaggucuuuaauccaucuugaacuaaauauggacugguacaagaauucaguucaauucugcauguagauaugcaaucuccccagcauuuaagaaauugucccuuuccauguguaugcucuugacauuuuucuccaggaugaauugaacacaaauaaguuaaacucguucugcaaugaguccuuuccuuaguuauaucuauuuauauugcuagcacugaacuguugagacuuuaacauauucugaaaucgaauagauacuccaacuccucccacuuugaucuccagagagagagaacugaagaauaggauuacaggcauuuggcacagugccuauaauuaauguugaguauuuccacuuacucgggucuacuuugacauuuucaucaaugguuuauagcuuuuaguaugcauguuuuccacugucuuuaucaagucaaucauaaauuguuuucaugcuacuguaaaaagaaucuuuauucuugauuacauuuucaguuuagggguuucuauacauugauuuuguuuuuagcaaguuuacugauuucguauuucagccaauuuucaggauaccuguuuuucucauaagauucuaacauuuuuaaacagccuauuuaacaucuuccuuuuccauuuguguauccuuuccccugacuuggcugagaauuccagagcugccuggaaggaagcagauuaaauguccaggucuacuuaaaauuccuugaagccuacuagcaauguugugaccuuuaagagguaucacugggaagucuggaagugacuaguucuguuccauccuagguuugauguccuuacaaaagaggcuguggacuuguugacucccaggaccaugugagaaacuagauagaagauaaugucaaguuugaagacauuuccaagaauugaaucugcaaguucgcccugaaaacgcccuaccuuccagaacuacaaaucauguuucuaugauucauaauuuccuggucuguuuucuugaaccagucugaacaauaaguauccuugucuuguuucuuaucuuaaaaggaaggcuuucaaguuugcuauuacuaagagauuaucugggaaucuuuuaagguacauuccuuuuauaacuguugguaauuucaacaacaaaaaaaaggauauugauuuuuuccuuguauugaugaucauguaaagaacagguuagacuucaccacagagauccaccugccuugccucucaagugcucagauuaaagguguacuccaccaucaccugguugguucuugcuuuuugauaagauauuuguugucaucuccuugcucaacauuggcagguuuaauuuuuaacuauuuuauuaucuugguauuguguguauauauuauauuuuucuagguuaucaaguuuguuggaguacaaauauuccuaauagaacacuauaaucuauauuuguuuggccacuucuauuuucuuacuuccgauaagucuaugauucuuagucuaauugaagauuuguuuaucuuggcaaaaauuuggucucauugauauuuucaguagcuuucuuguucucuacugaauucuuuucuaugccaaucuuucuuuacacuuaggacuucauucuuuucuauuuuccuuacucguaacacuauuucacauaguucuuauuauguagguuuuccuauacacuuccuuauuaauaacagcuuuugcuacauuguguuuugauaauguuguuuuccacuugaacuucucuugagauuauuuuauacuuucucuuuauucauugauccauuggcuuuucugaaaaacucuuuaauuucuauuuguuaauuuucccaaacuuuuuacucauuuuuaguuucauuuuuaaauguaaaaguuuccugaugcaaauuuguuguuugguugguuuuuauuauucuuuuguacuacaaaagugugacuucgggcauaugcaugccauguacagaaguggagacccaagacaaugugcagaaggcaggaaucuguucucuuccucacugugaguucgagagacugaacucaugugaggcuugcauggcaagcacucuuacccaguaaagccaucucacuggcccuacagauauaauuucaaucuuuaauuuguuaagauuuauucuguguccuaccuauaauguguucuaacaaauguuauaugaguaccucaaaauaaucuauauucuacugcuauuggauagaugcccuauauguuaggcccauuugauccaaagaguagcccaaguccaguguuggguuuuagauagccuauugagugguuuaccuauugcugaaugugacuuacgaaaaccuauuuguuacugaguuaguaugucuugucagauauauucaaaucuguuucauaagcacagguauggaagugcacaccagcaaucccagcacuuaggagauaaaugcagggggauacugaauaugaugucagcuguacacuaaguuccacaccagcuugggcuacauagggagcuccagucucauuuuuucuccuucuaaauuacuuaccacaauguuggguauauguauauuuauaaucuuagaucucuugauaaacuauuuaccaauuauaauaaccuacuuuguuuuacaguguuucauuuaucuggauuuuccugcucuaaguauaccuaacuccuguucucuuuuuguuucuauaugcauggaauaucuuuuuauuuuuaauucccuguacuuugucuccuguuaaagcagaaauauccuacuggagaacauauaauugggccuuuguuuuuccccaauccacucagcaauucuuaagaauuuuaucuuuucauucaagauacugaauuaacuauuaauagguacagauuucuuagugcuacuuuuauuauugcuauuuuuaaaauguagucuauuuguuccuucuucaagaccuagugauuuuguuaugcuuugauuacuuacuccuuucugcaguuaacaugauauuauauauugguauaauaaauaauaugugguaacuaugagacaugaaaacaauucagcuaugagucuacuuuaaacuggcagcaaauauacuguagugaaguagcugacacuugguacccuguaaagaaaagagaucuauuuagcugaugguuuggaugaaagucaaagacugacagcccagucagugcaaccccuuucugucugccuucuggugaagaauuccuggcuauauuaugccaaauggcaucauuauggaagugaugaagucagguaucauuuggugagauucaaagccagagaaaaaaauggggggccacucuuaccauuuuacagcaaccuacauaagaaccaccuuagggcaucaucacaguggccuccuuguaagaucccucucaaagcucgcacauucucucagcugcuacacucggaacacacauucuuuggggaacauagucaaauucuaccuaacccauagaaauaaccucaaauugcauacaaaaacucucuacuuucacuccucucccauuucaugacuugcuaucacuauuacacuuuuucauucgguaaccacuaaaaacucauauuaaaaucacuucuuuuagccuucacaguaaagacuuaaguuauuuauacaucacuauuacagagcacucaagucuaucagucuucugacuugacuacuuaccuauaccaccaacuuuauuuucauguuugguuauuaacuuucagcuugaaaauuccauuugugauuauauaugugugugugugugcgcgcuacauaugucuauauauacauauauguguauauauacauuauguguguauauauacauauacauauguguguguguauauauauauguauguauguaugcauauauauugaaggauagcuuugcugggguauucuuggcuacaagcuuauuuuucuucgaacacuuugucauuucauacuuuucugaccuugaaagcuuuccgggcucugaugacagccacucucuucuauaugcacucucuucuuuugccacacucaagccccugccagugauucacugcuuuucauuuaguauguauguaucauggguggguguucacaugccacaagacaagugugguggucagaaugcugacuguuggaguccgcucgcucgcucacucgcucgcucucuuucucucacaaagacuccaggaaucacugagguccuucuucccugcaaagccaucucacuagccugccgguagugucugagcuugucuuuguguagugcuuuuacaauuggaaacucuugauucuccuguacuugauagacgcuuucuaagauacaauuaguuuucagucauuauuuccuuaaaaacuuuccccaccucuucuguaauuacugacuacagacuagcacuacugggaaaacccauuacguuuucuagguuuucuucuuuaaaguuucuucucuaacuggauuuuuccaagucaccuuucauuucaagaucucuucuguuugagcacaucaccugaugcccucuggugcacuuuucauuccuuucacuguauugcucaguucauuauuucagucucucucuuaucacucuccugauuuuauuguccauacucucucauaguuugcuaagguucccuaaaacgauucuuucccaggcacuuaauccauagaaauucuuauucuuugaggucaguuacuggaaaacuauuuugccucccucuuugauaauguguguguuuauuucuauuucuacaauuguuuucaugcuucuuguuuugcauaacauauucaguggcuguguucuccucuuuaggaaucgguaucaguggggacaacacugucugccagcaaggcuaagugcacugcugagacauucagcuguguugccugaggcagauuggcagaguacacagcuucucaacaucucagguuaggugucccugaaguagcaagagcugcugugcucuucaauaggaugacugacagggggucuuuauggucucucaucuacaugaaaguccuaguugaacucuugcuuggaacuggaucuggcacacagaugcccuuucaggaauggugucaggaugugugaagcaugacaugugcaaaguagccacagaucggauacaugagcauggccauguguuggaguaaugguuuaagggaaacaggauagcaacaacuaucucccaugauuauugacagaacuaaaauaaccagcaaaauggcagccuggaagauaaauugugcuuagugacuauccuaguucccacauccaagcaaauuucaguuauagugacaucauaacaccaagagacuggaaugcuugcuuuguuucacauuuuacucauuauaaaaacaaauguacuaguucuauauuaaguaauaaaaacaacuuuguuucuaauucuauaauaaugauccauuuugggaaauuuaaaaaaaacagcagacuauuuucaacuuaaugucacaguuauauucaggcaaguguaucaauuaacgaacauuauuagaccccaagaaauuucaaacuauguuccaugugacuauuaaauugaaaacucaguucuucuuagcaguucaucagguccugcagaugaaauaaauguuuucuauuuauuuuguuacaguuccagguagaauagagacuaugcauugaaacacaaaacccaagugggucagaggcacaagcaagaccauaaagaguucaagagcacccuugggcccacagugagucuaaguccggccugggcuaucuaaaagcaaucucuaccuucuaucaagcagcauaaccuguacuaccaaauccacaaagccagugaggagaucccaugugauuuccuaaggguccaggcuuauuugcauagcauuuacauuguuuuaaguauaauccuagauggucuaaguacacgagaauagugucauagguucacguacuaugcaaucuuauaaaacagaaucaaacaaaccuugugaaaugaaguauguacagaagauccugaggcuaacgcuuggcauaucugaaaagucacacauaagacuuaagaaauaaaacauuuuaagguaccauuaucucagauuucaaguccuuuuauagagccauugcaauaaaaacauuauaggacugucauaaaacagauacauugagccaacuggguaaugcacaccuuuaaugccagcacucgagaggcagaggaagguagaucucugugaauuggagggcagccuggucuacauaaggagcuguaggcaagauaaacuuaagacaacuagacacacauacacauaugaacaguacagaacagaacugaaaagucagacauaacuugacauacauacagacaccugauuuuuaacaaagaaaccaaaaauauacacugaagaaaagacaacaucuucaagaaaugguguugaucaaacuagauagcugcauuuagaagaauaaaaauggaucacacugucuaucaaccugcauaaagcucaacucuaacuggaucuaauacuucgaaguaaaaccagauacccuaaaccugacagaagagaaaccugacagaagaggaaguggggaaaagucucggacccauugguacagauuuucugaacaggcugccaauagcaccggccuuaagaacaacaaugggaucucaugaagcuaaaaaguuucaguaacaagcaaaggacaccaucauucaagaaaaguagcacccugcagaagggaaaaagaaucuuuaauuaauuacgaucugcuaaaugauuaguuucaauacuauauaaagaacagaaaaaugaacaucagacaaauaaccccauuaaaaacugggguauauaauagaguucucacaagaggaaaugcaaaugacuggaaaaaaaaaacacuuuuuaaaaauguucaacauccuuagccaucaaggaaauacaacuuaaaacuacuuugggauuucaucuuaccccagucaggauggccaugaucaauacaacaacaaacggcagcaugugcuggcaagaaugcaggaaagagggaacacuuaauccuugcugauggaggugcaaauugcuauggccacuacaaacaucagaaugguagcucugccagaagguagcaauagaucuuccacaagaucuagccacaccacucuugggaacuugcucauccauguucauuguuuuucuauccauuacagcagaaacuggaaauagcuuagauggccagcaagugaugagugggcaauaaaaaugugguguauuuacacaaaaauacaucacuauucaauuuuaaagaaaaaaauugcgaaauuuucagacaaauuaaugcagcuagcaaccaccauucugacugaaguaaucuaggccaaaaagacaaauaucacauuuucucuuauaucuggauguuaacuuuguguuuuagcuauguguuucaauaugaauaaccauugagguuaaauagcgagugagggaccaggggaggggagacaaucuucacacuaagaaccaaauagaaucuaguguuguaaagggacaaaagggaagccaagauaggaggacuaagaugaggggaagaauguaaggcaggggaaaggugggacuauggagagagacaacacugaaggccuuuugaaaagccacauagaaacauuguagaggcuugcuaauauacauauaugaaaggaauuuaaacagcgucagcauauaauggaagagaaugucccaacaagacauaccagcaaguaaaaccucuaguguuaggaauggguuacaucuuuuaaaucacuggccaaaauagcucucuagcuaggccuccuccccauaaaccauuacaggcuuuugccaaaccuauugguuacucuucacuaacaugaugguaaggcauuauugcugaagacacaacuuaucucaucaagcuugcagaacucaagcugcuguaugagaagcuucacucccacuuacugauucaugguacuacaagguacuuugucagcuacuagaggagaaaaguuaugaccaauuucaccuggcuacaaaccuugcuacauacaacaaaccugaaagacauacugguguggugguggcauaauguggaaccuaaacaugauacugcuaaagugcccaguaaccugacacuggauugguggcaggucuagaugaaaaccgauuguucuguuaaaggaacauagcaaucaaaugacuccuaaugaccugcuauacccauagagcauuguucaacccuccauagaaaagcugcuucuugcagucgaugguaaccaauaaguagaugcacaacugggcaaacagugagagacuuaugagcacuuaagcccuaagugggaugucuuugucagagcccuccccuuaaggcucagagaucuauguagaagcagaggcagaaagaaucuggugaaugguucuaaagaaaacagcuucuuacagacacaacucauagacuguggcaguacacacaagacuccauagauucaaccaaagucccagcaacgaggacaagauacaaagucccaacccuaaccaaggaccuauuugcaacugauugauaguuucugggaagcagaaaagcaguuuucuccaaaggaguguuacuggaucuaucuaccacacucccagggaagguuccauucgcaggagugcuuggccaacaugaaagggacuccaugguguuggcauuuuguuugugagugugugugcccaugcuuugugaguuguuuaaugaauuuuuguccuuucuuuuuucuuuuucucagguuuuuuguuugguuuugguuuuuuuguuguuucuucuguuuuauuuuuugaaagaaagaaagaauacaaaauugggugauaaggaggggggaagaucugcgaaaguauugagggaaaaaauguucaaaauauauuguaugaaaaaaagaaacaaaacauuuuuaaaauucaccaguguuuuauaacuuaaagaucauggcaguaagauuuuagaaaaccuacuuucuuauuauguaucuugaaaccaauauaauugcuacucucugcagaauaggaaaaaaaaaacuaguaauuuacacuuacacugccacauuuuuucuaaugguauauucauccaacucgucaucugagcugcuaucgguggcgucagaguccagacccucuucaacaugagacaacagcccuguagcagacagugcaaaucuuuggauuucugcagcuguacacugagaaaagccauuguuuguaucaucccaaaacuuauucucugaagccaauauguugacuucuggcuuaauuucaguguguucaaguaaacuauuacucagaacuguuguggguucaugaaagaucuucauugugggcagcugauguuucauagaaaauuucaucuguugaccauagugcuuaacaacaugcuuugccaggagcaucugcaaguguuucugaguucuucuagccuggcuaaguaaaauuuucuguuuacucacacaaugaaguaaacgagcauucacuuccugcucuuuuucagcagcugaggaacuaguaggcacaucugaguggcuagguccaauuuucuuuugaguacauugcaauaaacccuuuuuaaucuuaguaucagugaauuuauccaaaagugcauucuuuugguaccauuuacaguuuugcagauguagucugucuacauuagcgucuuuggugagauuugaauccagaacgauuuguauaucuuucaugcacuggcuugugguauccgagaguuccuuuuugaugaacucguuuucggagugagaagggcagaucuuacugagcugaaugcugcugccauugcacaguacauuuuucaguuuacugcaguuggacuccauuacuuucuuuugguuauaauucucauuauacuuauuuaguguugaauuagaacucauuaaaagaacugucugaaaauguuuugaagccugaggggaggcaaaauguuuuaaauucacaaaauuaguauuuagaguagguucaggagucggaaaucccagcaucugagagaaagugucuccucccuuaagcuuuucaucuacaguucucggacuuuccaugcacagcaucuugucagauuccaugguauuuggcaaagaugaaaagcagauacccuuuguuguugccuccuucagagcuggggucauggcgaauccuggagauaauuacuggaagccuaaaauuacauaaaaaauacaugaucaaacgucuaggaaccaaaggcuugaugcuuacacuuuugccgagggcaacuuuuauguuugauguuucugauuaaaaugagcaaggcaccaaagauuuccuuuaucucucaacaucccacauuaucucaauaauaagcuguuauucuccacucugaugaugaaccuaauauucacaauuccaacuaaaguugcauauuacuaguccggagagauccucagugguauagcucuuguauagcacaugugagauccuggguguuaucuacacagcaccaaaaauaaaaugcucuugcacacucucacacuaaggguuuaauaaaaaauacgugugggugcaaguacaucucacaaucacaucauugaugguguuuagugacaggagaaaaacuuacaauuuugaaucucuuaaucaaacuugaaaaugugauucaaucucacaacugcaagaauaucucuuuaugaaacaauagcauuuucuaaaauaaauuuccaucuggaauuuuucucaacuugaacaguaauaacuacagguaaaauauguucaauagucugauauaaguacagcuaaguaaaugcaaaacauaugaguucauaguugcuaaaaauaacagcagugagaaauuaccuaaucugagguaugguuuuuuuuucuaaaaauguaucuacaauguuuuuccauucucacaaauauguuuauuaauuaucacuguagaauguacuccuccaaguaaauagugaaagccacgucagaugaccagcaaagaucaauucaaacuucaaaagaaaagaaugaagucccauguccugacaacacagaaaaaggcaaucuaguuccaaguguuuccaacagcacacuuagcaaaaaacuguacagaacuauuuuagguuuguagugauaauacacuggaacuauuacacuccauaacuuuucaacacacauggcacauucuaauauuaagugcacccaaaugcuagcuauaacuguauauacaguaguaagaaaugucuaucagcaaagcaaaaguccauguuuccauacacgaaaccgacaaaaaugauucaaguccgaaauaucacuuaugaugaggaaauaagcaagcaaaauuucucacaucuacugaggccacauacugguugaguaauuuguacauaaaguagaaaacauccuugucauagcuauaugagcaaugguucuaauagcaaaacacuaauccaaaacaacucagcuauaaaauaaaaccaaagcagaaagaacaauaaaacauauuggaauaaacuaguaaagaguaucaauauagaaaggcuuuaaaacuaacaguaagaagaaaaaggaacaguguaggcaugcacacacacauauuaguuuuacaucguauaaauauaacacaaacauaaaagacaucauauauauggauguccaugcuuauacuuaauaaaaaguggacuagaaaaauaccuaccauaccccuaacaguugcaucaaguuccaugaaagagaaggaagaguaaugguuuaagaggauuuucauuuucauuacaaauuuuaugacuugggacaaaaggagcaaaugccaaaugaacaaauguuaaugaauaacuaggugauaaaaugcagcuguuuguauauacacacauugugugugcagacacacacauuuaucucucaauguaaaauguguuuauagucugccuucaaauuugaauuaccccaaauucuguguaacuaagccauaauuucuaguguaauagacucaugaucauccuaaauauuaaggaaaaaauuaaaauaauauuuuuguuugaaauucacucugcuuugaauggaaauagaaaaaucauuauagaacgucugggaagugauggagagauggcucagugguuacgagcacuugcucuugagagggacuguauucuguuuccagcaccuacacuguacaacucacaacugccuauaacuccagcuccagggaagaagcccuucuucugggcucagacagugcccucacaugugacacacacacacacacacacacacacacacacacacacacacacacacacacagauuuuaaaaaaaucauuagggcaaaauauccaaaucucccaggauuuaaguaaaaauuugaucaaguaauugucauaucccuuaccauguaguaaucaagaaagagccacaauaacauuucuaucucuuaccccacucacaaacauuuaaacaagauguuauggauaugaucaaaguggcuugcagcagacacuguaagguaaaauaucaugaggcagagaguccugggugaacaugagggagaacuacaacuaauuagaguaaggacaguuaaggaauagaauaaaaauagaaggaaauaaaugcaaagguuaaaguggcuaagaacuaucuaugguggaaaaugaaaauguauagacaaccuugugacagcuguuuuaucacucuacauacaaaaugguccuaauaaucaucuacugcuauucuuaucugcauaaucucgccucuugaguacgacugagugguauacucaagaugacuaaauccagcagaaauacuagaguaugacuucugagauuaagauaauggcgagucugaauccuuuguccuauugucuuuccccuuaguaaagaagcuaacugcuagucuuugagcuggaagcuaacugcuagucugugaccggauggccacagguggcuugugaguaaucugagaagcagagucuuccgcagucaagccuggagagggccgcaguaccugcuaaccugauuagagcugaugagagacucagagagagccaaaaugaagaagcuggaaaacaagguuuagauaauaagagggcuuuuguuacccaugaacagauaaccacccuuuuaagucauuuuuuaguauuugaaauuauaacauaacugcauuugagaugaagacuuuuagauuauagucuucuagcuauaacacaaccccuauuuaaaauuuccaugaaguucuuaugugcacuauucccaaauguauccuuauuugaaaaaaacaaacaaacaaacaaacccuaagcagaaguaagucucuguaauguauaacuaaagagacucaugaaaauauuuguaucuuguaugcauuaugguuucaguauaacauguaagugauucauuucaaucauuucaauuuuauacacauacaucauauauaauuguauauuuuccaauugaaaaaauucuaaaauacuuuugccuacuugcauauuuauguaaaguauuauauuacuacucuccacacaccacuagcacucucagacacucuuauacucugaaaaggaagacaguuagggcagguuuuugguuuuuucaaauuuauuuuauguuauguguaugggugcuuugccugcauguacaucugugugccauguguguguagugccugagggagccagaagaggguguuugaucccaucagcugccauguaauuauaacuaguagaaauaccuauuuaauuacuauuuuaacaaugauuguacaauuacagcacuguacaaacgggauaaugugacccaaucaaguaugguauauuucaugaacucaaggcaaguucaacauuuuuuaaccaaucacugaaauuccccauagcaaaguuuaaaaaaacaaaagcaaacaaacaaacaaaaaaaacaaaccagggucucauauaguaaaagcauuucccagauuguaaaaauccacuuauaaggaaauaaagaacuccugaaauuuaggacaaaggaaagaaauuccuuaacccagcaaaaaucaugaaagucuauaguuuauaucuuuuuuuuuaaugcugcccugaauuuauuauuuuuuuuaauuuuuaauuauuauauauaaguacacuguagccccaagaugcaccagaagagggcaucagaucucauuacgggugguugugagccaccaugugguugcugggauuugaacucaggaccuucggaagagcagucagugcucuuagcugcugagccauuucaccagccccuauaguuuauaucuugauagugcauaaagaauucucuugcccuaugacuggaaaugaagcaaaauauucucaucauccauuuguaguguccugcuagaagaacuacuaaguguguuauggacagaagagaagggcaagcagcuuagaaaauaaaccucuccauuaacacaucacuauuucuacauagaaaaaucccaaggaaucuacaaaaaaaaaaaaaagucuagaacauucauccucgcaagcauuuagucagguuacagacagucaaaauacuaaaccauuuguacuuuauaaucacagaugugaaaagccagaucagacauagaaaauuugaaaacaguaauaacuccaauguuuccuggauggcuaaucuuaguugucaccuuaacuacaucuggagucaauuaaaaccagagguggggacaccugggaaggagaagacccacccuaaaucaggaccaugcuucugguugcaaccuacauagaaggacauggaaggagcuuuggcuuucugcuugcuuugcucacauucuagcugaaaaguucaugcuuccugcaggugccgagccauccuucugcuggcuuuagaagcuacuucauuccugacuccgacacagccagaacaccagcugagacuuacaaccuuagggauugaacaacuacagcauucuuggccuuuccaguggaagacaguuguucaaauagcuagagcacaaccuguaaggcacucuaaguuccuuuagucuauugguccuguucaucuagagaacucugacuaauacacccuucaaaggcacacagcaguacuggcacagcugcauggucaaggcuguauuacucagggagcuggcucccacuucuagucacaacaaaauaaaguugacaaaauguguaugaucuauacacugagaaauauaaaacacaaagaauacccagauggcuuccauaaauacauugcacucaugagagagacuacuuagcacugguaagaucuuacucuccucaaaaugacuugugaaauuaaacauaguuucaaccaaauuuuggaagaauaucuguugacacugacaagcugacuaaaaugauuuagucaaaagaacugaaauagccaaaaauaauucugaaaaagaacaaacuugaaggacucacacuauguacugacauuugguuaaggacagugcuguaccagcuaaggauaagcauacagaaaacuggaaagaaaacaggucagaaauacaccgcuacacacaugcaguauuuugggaagcugacaauucacuguagaggaaaaaugaaucuccacacauaccucauaccauguaugaaaauggucagguccaucaaaaugaaugaugggcuacauguaaaagcuuaaacucuuaaaaacaucuaggagggaaaagagggagaaaauuuuugaagauuuuuaagaugugacaccaaaauauucauaagaaaaaaauuaauugcacuuucccaauacuaaguaccaacuacaacaaccuuuugauuaccuaucuaucuaccuaccuaccuaccuaccuauucauuuuguuuuuuauuuaguuuggagauacagucucauuauguagcuaugguuagccagcaacucuguaaguagaccaagcuagacucgaauuuacaaaaaaaugucugucucucugccuucuaaguucuaagauuaaaagcauaugagaccaaacccagccaacuaaauauuuaaaagaguagucuuaaaucacuaaguuuuaagucauucaucuuaacucugaaugauggcuccaaccauuauacaaauuuuaauuaacuuauucuuaguugaauauacuucauuaacauacaaaguagauaauuggauaaaggcaaaauauacuaaaccuuauaauuuuaaaagcacacaauaaugaacaaauaagaauaaaugaauaaguuuacuguuuaguucaagacaaucacaauuauuucauagaacuuaaauguguauccugugcuuaguaaaucaaccuuagaaaggcaguaagacacuuuaauuacaaauacagccaucugcuuuucauugagaauuuaacaaucaacuacgccacauaccuuuuucauauuggaugcuuaugaaagauagcuagaaaacuaucauuuaaaaaaugaaauuaaauugcacaaauuauagacauuaaucaguuugguuuuuuaaaggcaaaaaacaagaaaacaguuacaaagucauaaaauaauugucugccuuggguagaagcuugagucuuuuaucuccauuuaauauauauucauucuaaaaaucaacuauucauuuaaaaguuucauagauaaaaaugucugauacuauccuaaauacuagaaagaggucuacucucacaaaguguacagaggagcaugcuagagagagaagggaggggaggugaauuuaacuauaaagaacuuuaaaaaaaaaacuacuacauucaugugaaaaguggcuuuaaaguguguugauuugaaucuaucugaauaacuggucacucauuaguggaacuauuugggaaggauuaggagguguguucuuguuggaggaggugugucacuaagaacaagcuuugagguuucaaaaaccugugcuaucccaagugucuggaucucucugccuugugcuuauggauagaguugugagcuccuagcuacggccccagggucuacuaccugaugccaagcucccaccaugaagcaccaugaaggccagagacucaaauacucuaggaacaugagccucaaauuaaacuuuucauuuuauaaguugccuaugucauacugucuuaucacagcaauagaaaaguaacuaagacaaugaguagaucaaauaucuaguaaauaaagauuuuguaaguguuuaucacaacuaaagucgagagcauguuuauacuggcaccuggcuaaauuuggaugugugguugaagauaggccucucaagguuucuugguguuaccugcucuaagaccucaaacaaugacaagcuaagaagcaucuagaauguaugcccuccccugaaagaaagaaagaaagaaagaaagaaagaaagaaagaaagaaagaaagaaagaaagaaagaaaggaaggaaggaaggaagaaagagaaagaaagaaagaaagaaagaaagaaagaaagaaagaaagaaagaaagaaagaaagaaagaaagaaggaaagaaagaaagcaagcaagcaagcuuuggacaagaauaaguuuggcaugcuuacaagaaaaaaaaaaaaguagcuaugccuagaacauaaugacugcggaaaaaaaauagaaaaaagaaaaccaaaguaguagauauagccagaccacugaauuaaggugaagcagaaucauuagacauuuauguggggaaaucuguccuauggaaaaaagacuuugaaugcagaggaaccagagacaguuacugaaucaaugcaagccaaauggguugcuuggagguguuaauaaaaaugaggaaaagucaacucaaauguuucagaguagagccaacaaaacuuuugaugaccaacauuucacugggcuuaaaaaggaaaaaaagaaaagaaacuaaaaauaauccuugguuuuccagcuucagcaaauguacggucaguggugauaguuuugaaacaggacagacuugggagccuucuuuuuuucuaagugcugcuugggguauauuauguuugaaguaugcauuagccacccaaguggagucagacaaacaaguguagaguucaagugagaggucauaauuagagacaggacuuggagaagucaugcauauaaauaguauguaaagccaaggacaggcguuuaccuaggcagaggguagaaacaugggaaaggagccagaaccaagacuagggagugcaguaguguuuaugugaaagggagaaagcuacacgagaggacaggccccaaaggacaaugaaaaugucuuuaguaagaaacaacaaaauguaggagucaguacaaucaagacaaccaaauauucaaacguguacaauacacguuuaaaagucuguuuaaaagucuccugggucuuguuucuggucauguauaguuaacuauaaaguaaagacacaccaaguuccagucugcucuagcuuucagccuucacaugcuuuucauagcuugugugcaagcacaugugugcacacaagcacacacucacacacuacacaaguaaauaaaaauggacuaauuaauaaacuuaaugugucugaacaaagcucugaauauaaaagauauaucaagagaaaaauuacaaauugaaaaaacaaaaggagacuaaagaaaaaauuaaaaagcaaaaaugaucaaaaaucugaguguggagcauuaugggauagcuacagaaagagaaaacauacauaauggcaacaagaaaggaaaagaaacaacagaagugauaaaucugacuaauaauuuccccaacuuauguaagauaucaaaccccauauuccaagaaaacccaggagaacaaaugucaaaucaauucauauaauuuaugucccuuaauaaauuaaaguguucaaguauuacaugaaauuguuacuuacuacauaauaguuuguucacaaguaauauauuuaaaacuauguacuaaaauuucuuaucacauuugcauguauuuauggugcagauuaucaaauccaaucucacaaguacuaggaaacuucucuaugacuuagagcuauaccaccagcccuuauuucuagagagguucuuacauauagcacugaauggccucaaauucauagucuuccugcaucaaccugcauagugugccuagcuggccucgaacucacacagauaucccugucucugccuccuuaguuuaaaggauuaaaggcaugcaccaccaccugacauuuuuuaauagaauuuucuuaauaagacuauauguaaucuuuauauggagaaaaucuucaaaaauccaguuucuuuaccacagucuuaauguagcaaaagccucauuucaaaugcucacaucugugcagugagggauuacuguacuagauaguauaagguaaaacauauuguuccuuaaauaaucaggaaucaagcacuaacuacaaaauuucaauucauaaauuuaucuuaccaaauauaugugggcaccuacagccauggcaacagagaaaacaaauuccaacaauuuucuaaaaagcaugcugaucaguuuuuaacuacauacauaaugggguggugagauuuaauccuagguaaaucuaaaaaaugucuaaaugcaaaaauauugugugcuaugauucuagauaccacuacuacuggcaaggauuauuuauuugaguauacccuaaauguuugaguauaauguagcacuuugcuaaaaagcuuagucuaaugaccuccaaggggaaaaauuauuuuggaaaaauuaacuuuuucuugucaaagacacacacuaagguaucaagcuaauaggauuuuuuuuuuaaguaaauacuacaagcuuaaaaacuaucaguagucuuugaaagacagcagcuacacaguuuugauucucuguuagggaaaguguucuugauaaucuaaaaaaacaauucuauuucauuucacagaggauuuuucagcuucuauuucagccuaaaucuuuuauaaaaaauucauuaguaucuuagcagucagaaauuuuaugguucuaugaauagcauuacaaaaacuuaucauaaaaccauuauaaacaaucugucaaguaaauagccuuucaacaaaccacccagaucuaaauaucuauagaugagaaaaaaaaaacccuuauaacuuaaaaauaaacacuuuacagccaccuuuuuccuucuuuugguguauauuaauuucacuauuauaaaaccaaauuaauccaucaaaacaaugaacuggguuauucuguuaaucuacaucauaaauucuaaaauuuuagucuacaauguaauccaaagagcauucacugagaacugaguuuccugauucugaaauuauacuauuacaaaugcaaaguuuugccuugucccuggaauguuuucauuaguugcuuacacuguacauuuaagauucaaagcacauucauacuuaugagucuagcaugaacuaaauguaaucuaaccucuggagaucaugaaacauagaaaaagcagucaucuuucaaaaucugcacuuacauagugagauaacugucaaggcaauuacuauugaguugguucagacacaguaaucaaaucuuuacaagcuaauaaauaacuuacauaucucaaaagauugacaugcccucaaagaaaauuacuuaaauucuaucucggccuuuaaauacuaucuaguccuaguaccuucacacuugaauuugauaauccagauaagaaccacuguuacuccugaaaaguuaauauuaaaauuugauucccuaccccuuauauugcuucagauuuuuguuaugcucuauauucuagaaugcacaugaacaucccauauugucuuuggaaaguauucucuccagcuuuaccccugaacauuaaauuuacuuuuaauuguaacuuugauaaacucuauucucugaaauacagaguauaaggcacacauucaccgauuuaaaaaaacaaaaacaaaacaaaaccaaaaaccuaccaauugaauuugaaaggaccaaaacuuacuuccacauauaugacuuaaguauuacaugaaguggacucaugcuaaaaaggaaaaguagcuaacuaaaugugagaugcuuucuuuuugucuuuacauuuauuaagcaugugguggggugcuaugacggaaagcagagacauuuaauggaugugggaaguccucucccuucacuacucauguugcagggauccaguucagguuaucagauuaguggcaaacacccauacaaaaugagccaucucacuggccuaaguugggcuuguaaaugcuaaaaauauaagagaauucaauuuuucuaacuuguucauauaaaagcaaaaaugcaauauaaaaacaagaaugaguucauauuggcugaauuuuuaucucacagaacuagaacuaggcugaagaguuggcucaggaguuaauaacacauacugcucuugccgaggaccuaaacucaaccccaacacccagguaggucagcucccagucacuguacuuccaucuccaggagacccaacacccucuucuggcucccacagacacugcacucucacaaacccacacacucagauagucacaccaucuuuuaaaauguuuuaaaguauuaaaaaauaggaauuaaugaaagccauaaguacaaaauauagcauauuuccagauaucuuuauguauucuuuuaggagaagucccuguucccuacagaaaacccugcaauaacuggcaugagcagaauauaguuagcucagcacuuuguagucuaugauguuuauaagcuucuuccacuuugaaaacuaugccuaaaaaggaauucucuuugaagacuaaaggaauuuaauuaaagauaaagccacuuggguggccacauaacagaucaaacagcucauacuugaagcagaauuauuacucuucuucuguaagugcaugacucauaagaauaaaaaugagguuuuuccuauggacagaaauuugauugcagaaauuuacacuuaaaaguacauugucauaaauuuguucagcccauucauuuuggcaauuuuacguaccacaguuuccaguuuucuuuuuuuaaacuacuaaagacauaccuaugaacucuggguccuauagagcucaaaaagaaccugaaacauuacaaaguucaugaaugauuuaaaauauucacaaauuuucaaugcuauaaauaagcugaccuuuuguaucaauauagaaauaaguguuuuugaaaauaugaaauaacauuuaguauucaaauuuuccuuuguggccaagcaaaaccccaacaugaaagacaaacuaaaagauaaguuacaggguggcugugacuacagugugacuucuaagcugacccaggucucauagcaacauccugucuuuaaagaaaaagaaaaaaaaaauccacuaugaauuauccucaauuuucacuauacauuaucaacuggaaaguaugguaucauucuuaauaacauguuuuuguuuuuaucuuucaugacuaggcaagaaaaaaaucugugucugugaaauguuccuuuaguacagcacuuaagagaaaacaggaagaaauuuagaaaguuauucagcuucuuucucuuucuaaauauaacauacugaauaaaauaugaaagauaauacuuaugaguuauuuugugugauuuuucuauuauaguacuauaauaaaggcuuuaagaacagauagaagacauaacacacauuagucauaaacugcuaauaucccacugucauuuugcacuacacaacagccucacucuuugcuguaacaauuugauaagccagaucaacaccaaccuuaaagacagcccuaaaccuaaaggaaacaacuuucuacuucuucaccugacaccucauauagcaaacacagacuuauaugggaaggaacaagauauguguaaacccaagaagacaucaugacagcaugaauggcuugcugcauguaagguuuacaugaaagaauaggcgaccagcagcaggaaugccaugggcaguaacucuugggcugugaacagucgggaacaaagcacagaaccguagacacugccuuccuguuuguguagcacagagucuaugggagaaauaacgaugaucaggaugaaauguucacaguagcaccuuggaagcguggugagugagucaaggauauccacguguaaggauacacgcaggaaaagcagaccaacauuuuggauaugccaugcuuaucaauggcaaguuacuggaacauuuaauagaaaacuauaaagacuagugaggccuagccguauggaacaaguacucaaacagcucaaucaguuacuacauuagcaacucuguacucuuaagacaaaaaaggaaaagacaauuuccugacggcucaccgguuuaaaaaaaaaaguuuaaauauuugcagccaaucggcaagucuuuacuagacauccacuauuugcuauacucaugugaauaugaaguuuucucucaaauaccuaacaguaaguuaggaaaugcaccagauaccacauacaggucagugugggagugggaguggacaacaagguuuuccccauauagccaauccugggugaugaacuaggcuauggcaggagacacauuuauaccucuaugaguaaauuaauacaugcucaaaauuggggugucacaagagcauaaaaacuuuaaaaaccggcucagacuccuauaaaucuaauggggaaaggggaguauacuauuucaaagacuuguguaauaauuuacacaaaauauuagaaaaaccccaaacaucugccaauaggaaaaacuaaaaauauacucaaaugaugaaaauguuaagcaguuauuaaaaucguuuuucagagaauauuuaauauuucuacuuuuaaauuaacugaaaacgcaugcucuccaguuuuagggaaaauuauacauagauaagaagugauagcagaccuugacagugaucuuucaaaccgugaagagaaacuuaaaguuacagcaguuaggcacacguuccuaggucagcucuaaaggggaccuggauuacacagcaaguccggaggccagccugguuacauggccagaaacaacacaaaaagugcaacagaucuggcgaaaaucaaauaucuuacuucacggcuuauucuuaaaauuccaaaaauaugcuagcuuuguuaaaaacugacguuauguuacaccaccacauuacguggugauuuaugcucacuaacacaaggcacgugaucuucauuacacucuuuuaaggcaggaacuguauuacgaaacgguuuuccagaggaaacagauguaucagcaaggcugugacuugcccaaggaaacggcuaguuagcucucuggaaaccgcagaaaucaacccccggcauuacuaaacagucugcguuccacaccugcgcuuuucccccuccacugucgaauuauuuuuagaacuacuucuacccucaaauccugccuguuuugccagcugugcucaggaacaguuucggggaaguuauguugcuaucaaacuugcccuauccaaucaggauuuaaaaaccuuucuacaaacacaaaguuaaacuauuaaaggcggcggcggcggccaaucuuucuuagucucuccggcacauucugcguccaagcugggggaaucaaagccagaaggugacucccacaacuccagucucccgggaacccgcgaugggaacagcgaggacagggaaccgccaccgcgccuucugcggggguaccgaggacgcccacgcagcgcccgcuccucgcaaggcagaucccaacagcuccuuccccgauuugggaccacacaacaccguccugcauuuauuucuccuuaccaaacgcuguuucuuuuuuuaaagcuagcccucuccccucuugggcacaagcagcaacaccaacucggaccgguuaccuuucaauaaaccacaacacucccuuccaccccaaacaauucuaaaggccaaauccauaacggccccaaauaagaagaaauuaaugucgccgcuggccagccaagcucagcguuacggaaagcuucccacagagcgccccacacccccaggacaggcgccgcugcuccagccuugcggggggcggggggggggggagggagagggcgugcccaagaaaaaccacguguuccgccuucugcgcacgcgccagccaaaacaaaagggaggccugccaagccccgccccauccccacgugacucgaauccaggcccgcccccugccccgcccuccccuccccgccgugucugccaaggcuguuagguuuagccguuuaaauuuggcugcgguccgaccccugccccaaagcacggucuugugccggggcccgcaguccaacggcaagcaggguucggggugcaaagggggcugcccggcggacgccgagcccgcgaguccacccggcggucuucuccgcucuuucccgccccgcgccgccgccgucccccgccgaggagacccaccccccucagcccgccgcugcgacgccggccacucgccugcuggggcgcccuggcugcccuccgccgccgcaccuucgguccggccguggugggggccgccgaggcgaucucuagcuguccgcccgccuccccccacccggggcgccgccgacucgucuccagagcgcgccccgcucccgccccggcugacgccgccgccgcgguuuaacaguccgcccgcugcccgcagcuccgggcgcucgggggacggaacccuacg

SEQ ID NO: 200 - RNA, 2181 nt, Mus musculus
uuaucuuucauauuuuauucaguauguuauauuuagaaagagaaagaagcugaauaacuuucuaaauuucuuccuguuuucucuuaagugcuguacuaaaggaacauuucacagacacagauuuuuuucuugccuagucaugaaagauaaaaacaaaaacauguuauuaagaaugauaccauacuuuccaguugauaauguauagugaaaauugaggauaauucauaguggauuuuuuuuuucuuuuucuuuaaagacaggauguugcuaugagaccugggucagcuuagaagucacacuguagucacagccacccuguaacuuaucuuuuaguuugucuuucauguugggguuuugcuuggccacaaaggaaaauuugaauacuaaauguuauuucauauuuucaaaaacacuuauuucuauauugauacaaaaggucagcuuauuuauagcauugaaaauuugugaauauuuuaaaucauucaugaacuuuguaauguuucagguucuuuuugagcucuauaggacccagaguucauagguaugucuuuaguaguuuaaaaaaagaaaacuggaaacugugguacguaaaauugccaaaaugaaugggcugaacaaauuuaugacaauguacuuuuaaguguaaauuucugcaaucaaauuucuguccauaggaaaaaccucauuuuuauucuuaugagucaugcacuuacagaagaagaguaauaauucugcuucaaguaugagcuguuugaucuguuauguggccacccaaguggcuuuaucuuuaauuaaauuccuuuagucuucaaagagaauuccuuuuuaggcauaguuuucaaaguggaagaagcuuauaaacaucauagacuacaaagugcugagcuaacuauauucugcucaugccaguuauugcaggguuuucuguagggaacagggacuucuccuaaaagaauacauaaagauaucuggaaauaugcuauauuuuguacuuauggcuuucauuaauuccuauuuuuuaauacuuuaaaacauuuuaaaagauggugugacuaucugaguguguggguuugugagagugcagugucugugggagccagaagaggguguugggucuccuggagauggaaguacagugacugggagcugaccuaccuggguguugggguugaguuuagguccucggcaagagcaguauguguuauuaacuccugagccaacucuucagccuaguucuaguucugugagauaaaaauucagccaauaugaacucauucuuguuuuuauauugcauuuuugcuuuuauaugaacaaguuagaaaaauugaauucucuuauauuuuuagcauuuacaagcccaacuuaggccagugagauggcucauuuuguauggguguuugccacuaaucugauaaccugaacuggaucccugcaacaugaguagugaagggagaggacuucccacauccauuaaaugucucugcuuuccgucauagcaccccaccacaugcuuaauaaauguaaagacaaaaagaaagcaucucacauuuaguuagcuacuuuuccuuuuuagcaugaguccacuucauguaauacuuaagucauauauguggaaguaaguuuugguccuuucaaauucaauugguagguuuuugguuuuguuuuguuuuuguuuuuuuaaaucggugaaugugugccuuauacucuguauuucagagaauagaguuuaucaaaguuacaauuaaaaguaaauuuaauguucagggguaaagcuggagagaauacuuuccaaagacaauaugggauguucaugugcauucuagaauauagagcauaacaaaaaucugaagcaauauaagggguagggaaucaaauuuuaauauuaacuuuucaggaguaacagugguucuuaucuggauuaucaaauucaagugugaagguacuaggacuagauaguauuuaaaggccgagauagaauuuaaguaauuuucuuugagggcaugucaaucuuuugagauauguaaguuauuuauuagcuuguaaagauuugauuacugugucugaaccaacucaauaguaauugccuugacaguuaucucacuauguaagugcagauuuugaaagaugacugcuuuuucuauguuucaugaucuccagagguuagauuacauuuaguucaug

SEQ ID NO: 201 - RNA, 514 nt, Mus musculus
gcggugguucaguuucuuuuuuuuuuuuuuuuuuuuuuggcaguucugcaacuuuauuugacaugagcagguuaguucucauccacauugaccgucuguagauuuuugaaugugauaacaggcacguaaguuaccagcguguagagcuuguuuggggaauccucauccucauugcguuuucuggacaagcguacucggaugcgauauggaacguuccuuauucccuuggcccagacggcuuuauugagccuggugucaaugcgcacaucugguguccccauuuccuucauggcaaacuuccgaauuucuuugagugcccgaggagcacgcuucuugaagcccaccccaugguugcgcuugugaauguugaugguguauucucgggucaccaccucguugauggcagaacggccauucuucuucucgccacccuucuuugcgggagccauucugccgggcccaaguaggaaaggaagggcgcgaggguuugugggagggacggugguucaguuuc

SEQ ID NO: 202 - RNA, 1211 nt, Mus musculus
cuuagcugugccgaugauggcugugccuucuaugcgaucuguguggcucacuguggugccugcuaggguaaggggaaggcucccugguuucauggugggaauagacucugcggauggggccgggucuaugcucacgaucaguagaguugguuuccccggaguauccaugccugcgccucggggaaucucuguggaacggcugcugaugggaagauggagaugagggaauacgguccucucugcggcuggacuggcuucgagagugggaagaagaucucugagggcuguggugauggugguaccugggagcgggagaaugccuggccccaggagguucacgcugcucauggcggugguggucucgaggaugccuucggucugcccggucuggcugucuuccuacaggaccaucccugauccaccuucccacgggguugugggcugggaggaucacaccccaggcgucugccacaugggcgagcagcagcugcgagagguagcggugcgcucgcucaucccagugcacgccaucgcucagccgaugcugcccugcauggcggaaguggaaguggagauccagcacaucgaagccacgccucgccgccucccuggagcuguaaaaguuggccuccaucacaucuucacgcaggcgugaggggcacccuggggcaucccgcaggaugaagcccccggacacgaccucggccacaggcauggugguacuccauaccaugaggcagugggugggcagcaccugauccaggcguuggaaaagccucuccaaguccucucgguaguuucugaggaaauugcuucuguaccuggacaggucccagaggcaugaguucaugaucaccaagucgggggcauacucgccccaucgcagcugcugcaggauguccucaacauagggcgaguaggcccgcgugaggaaauagaagcguaucaaguggcgcccggagcagaacuggcgcaccucgcgguagugggcgccauugugcaugcguccccaucugccgcccuccagcaguacgucgcguucgaagcucagcucgcccuugcucuucagcuggcuggaagacagcaggcaguccuucuggagcaggagcaccaaguccuuguagacggcucucuggaucgagucccccaggacgacgacgaacuuguugugcaacagcugcuggacuucgugagcucggagauggggcaug

SEQ ID NO: 203 - RNA, 1849 nt, Mus musculus
ugcuugauuuacuacauuuuuaccauauccgacacaaacccuguagcaggaaaucaggcagugggagugagaagagcuucuucuuguuacagaagcagccccagcagggguguggggggcacuccugagccugcgcacacugcagcuuacucugccuguucuguagguccucauugugaguggacagggucuauacuuguaaauggucuuaaagaagaggauucuuccaugcaucaucccagaagguaaagaguuggcagcauuaugguuugcagaaggaaguccuaagacaaccaucagcucuguuuuuaggagaagagggcagcuugacaagcccuggguggaguugccccagcucagaacaccaggaagcugggaugccagucauuucaagauccacuuacuaggaaaguuugagauucuguugaucauuugaaagugcaccuugcauaaauccuucuuugacauacuauuuuuucaugccaauaggcauguugacgugaacacaauguuuccccaugcuggcuucccaggaucaauaguuaggacagucuaauaagguuuugucuguguuugacacacaguuccuucugcaucuagggguggguagaagggugccauguggauuaagccauuuaggccugggguugggguguagggauaguuuucccuuuacuucacacacacauguugagcuccuuccuguugcguguggcgucucaccccugcccagggucacagccucguugcugugaagccuuugagguuccuguuccuauuuuuuuuuuuauuuuuaauuuauuacguauuuuccucaauuacauuuccaaugcuaucccaaaagucucccauacccuccccccccccccacuucccuccccacccauucccauuuuuuuggcccuggcguuccccuguacuggggcauauaaaguuuacguuuuaaucucuugccucaccuccucucgguuucccuucuuuccuacuaguauuauuuuugaaugcucugaaugcugguuuuuaaaaaaaauugucugaaacagaaauguauuuucagaauaauucacaaaagcgcaggucucacacugaaacuucaacuccuucuuccccuuucuccuccuccucuucucugaaugccagggagaaugcaguugaaggagaugcgcagucacaaugaccaacucuaaagacaaaagcccucagcauuacguauccgguuaugugaacagcuugacugaguaggguuaagauguugcagauguccugcuucuuuaagguggcuuuucagggcugcucagggagguaaggauggagugcaagugggagacaucuuuggcccacucccugagcuuaaggcuaaagucacacaguugugcauccauuuuagggacagcucaucaguguccucauaguggcagugcugccaggcuguuugccuuuguuuucuucagcugcucgcugucucacgcacuacccuucagcuccauuacugcuuucuucccacacugcugcuugcugccgagacuuggcaucaagggcuuccaagugcucuguuugcucuucucuccauuuagggauacuccagucucugaucgcaguagaccugcuucugagauagccgaauaacuguuuguuggcccauuacuuuccugguaguauucgccauuuuccuuccaucagcagcaucagcaguugguuuauguuagcuuuuaacacuugaggcuguacuuucuuuuauagaaauguguguaauuuuuauuuuuuccuaauggauuuaaacuuauaaaucauuaaaacuauuugugcuuguauguguaucuucuguaaaaaugacuuauuucgauauuga

SEQ ID NO: 204 - RNA, 917 nt, Mus musculus
cggggagugaccaacgagcugcgcuuugagccacgccccgaaggcaguucucccgcgaaaauucgaaaagugccguuugagucaucuucguugcagguggcugggaagccacucagaaaacucaggagugggacacggagggacagacgacacuaggucgccaggccgguccuuaccagcgggagcagcgcagcagcuucuccaggcgggcaagcgccgcgcggcugugggcccaaagcccgucgguagccggcuccauggcgggcacgggagcaggcugguucccagagcagacccucggcggccggcguggcauucccacagaggaggggaggucagguuugcucuagcgccgcaccccgcuggucaccgccggauccugcugcgugcggagucucugaauuggucggacgccuccggcucggaggcugaaacgcgguaaaacucagagauggaaggacccggcuuuaggccacgcccucaaggccugagggcggggcuuuaguaaugcgguccaaguuccggaaauggagaggcgaggcuugagaggccacgcccucaggagguguagggcggaccgcggaaaccaaagugccaaggcgcgggguugaggaggcguggggagaagucaccuaggccuguggcccuaggaggcgggguauagcgcgcucaaacuuccugagcgggaaacugagcggcggggccucaggccacgccuucaaagaggcggggcuccccauggguuucauucccacccccucucaguuuacugaaacugugcuuaccuagaaguuggauucuaacccucccauagccucaggagcuugccgcugaagccaucuacaaagaguggcauucaagcuacuguugaacuuggacaagcuuuucccaugacaauaaaaguacuacccuuuaua

SEQ ID NO: 205 - RNA, 750 nt, Mus musculus
uacgcgguuucugggcgccagggucugcaccgaaacauggcagaggucggcuccaagucagugcuguucgugugucucgguaacauuugccggucacccauugcagaagcaggauucaggaaacugguaacugaugaaaagguuucagguaauugggccauugacagcagcgccguuuccgacuggaacgugggccggcccccagacccaagagcugucagcugccuaagaaaucguggcauuagcacagcccauaaggcaagacagauuacaaaagaagacuuugaaaacaaucugagagaucucaauagaaaaaguaaucaaguuaaaaacugcaaagcuaaaauugagcuauuugggagcuaugauccacagaaacagcucaucauugaagauccccauauggcaaugacucugacuucgaggugguguaccagcaaugccuuaggugcugcaaggccuuccuggagaagccuuacuagcugguccuaaccaccaccacugagcagcucacucaucagugcugugcccaagggugguggcaguccuuagccccauaccccaccucucuuuucagcugacuuacuguauaucuuuaaaaauaauuguagguggaaauuaggcauauguucagaaggauaaaaacauuugagucagauaguucgagguguggcuaagcauucuuagacuaacuaaaccucugaccuugccgcaauuacaaaacaguggaacaagcaaauauggaacaaa

SEQ ID NO: 206 - RNA, 67764 nt, Mus musculus
ucucuccaaacacaugauguuaaaaaaaaaaagaaaugacguccacaucauggaauguaaaucuuuuuauuaaaacacuugucuuuccacaguaguaaagcguuggcaugugcuuauaaaaauaaucaccaaccauaauuauacugaauuccucuuaucaacugcauacaaagugucuucaauacaauuuuuuccguauaaaaauacugggaaaaauugauaaauaacaaacagguaagagaaagguauuucuaggcaaucugaauuguugggacaaagugaguccugugggagggguguuugaacacacagccacaggccauguccugacagugcugcaggucagauggcaaaagaaagcagaggugucugggugacuuuccugcucaaggucuuggguacuagcauucaguacauuuccuccuaguuggcuaccuguguuucccuauugaucccagaccaaaccauaagaacuuuugauucucuuaaacaacacugagcaguacugaaacccugaagcagaacagggugaccaacugucaccauugaggagagaagucucaaaacaucccacggggcgaugcuuggagaagcuguaaauugugcugaagcugagaacauggcuccagagcaaaaggcuuaagggugaaaggaccacucaaagauggagggucugcuaacaucacugggguguggauugaccuugguagagagacacuuguaggguggggcuggaaagauuacucucgagaaucgucucugucagcuugcacaucuagcggcaugaagcacucaauggggcaauuuacguucugucaaaauagaagacaaacauuaguagcaaauacucggaaaaccaaaaguguguguguuucggggaggguugaguggagauuugugucacagguguuuuauaggaaggauaaauaguuucaaaagacuagcaauguacugagcaauagacaaugcuuagggauuuaguaaauuauaacgaguuauaauuaauucaugacuuuguguguauaaggagccaagaguuaacuuuaaucaagcaaaugcugucugcuuuguucaugagccugaaguucauuaacaaggcuacaguggcuggccagacagccccagggacaccacccacacccuauuucuaccuccucagugaggagauuauaagcacuugcuguagcgccuagcucuuuuacauggauggguccugaggacuggacucaugagcaaaagacuuaucuccaaauaaaacucauuugguucauucaagaaaagcaucuauccaccugccccuggcugcaugcagggagagucacggugguggggguggguggggauauguguacacuuacaguguuuguucucugauuguaucucuguguauacugguuguagguguggccgguggugccaucgggacuggguucagcagccccaggucuacggcaguugucacagcgccagcccugagaggaaagacacgaaguuaaaugggguuuaggauaaccugaggguaucaugacugaguuucagcucuugcccaucagcaguacaagcaguuaaucaggagacugcaaugaugccuguguacagucguaacucuuacaauagaucuuggcuuauucaucugucuacauaugcuuuccuuuccgcugaaauauccuccucacuucuuuugcucuucucaucuuugguccuaccuuccuccuugguaggcuuucugcucuagguggaagauuucucacagaccccuagggcugcgaaaucagucacagugacuugagaguguggggacaaaugccaucacuuucuggugaaggagaggaaugacuuggaaggaaccagaaaggacgccgugggucccagguagaacuggguaccuggccacauucucuuuccagucccuucuaaaaccucccuaaccuauacuauauagccuuagcucuggccagagguggggcuggguacaggaagacaccacagcgggccugugcuucuuccugaguuuugcuggcacacauuugcuuucucaucacuccugagcugggaggaggaagaucuggagcugauguggugaacgauggcaccauuagcagaagccccaggggacacagaaauggacacuagggggacacagagagaggcgcacucuuggggcaaaguaguccuugaaguucacagaaugggggaguucauguugguagccaucuuuugccuaacuagcaagacuuuacauuuaggguugaaaacaacaacaacaacaacaacaaaaugaagaaauaaggccaggcuggagagugguggcacacacccagaggcagguagaucucugugagcugaaggccagccugcucuacauagcaaguuccaggauagucagggcuacuagacucugucucaaaaauaaauaaauccuacaaucacuuucuuauagaaucauuuaaacaucuuugacguauuucuccauuuaggagccuauuucccagagggccugcuugcagaaucaauaacgauucucaaagaccauagcaaccgccaccauguuucagaacuuuagagacaggcauuacccaaagagauucccguucauagggaacaagaauggagugaagaaagacuaaaaucugccucccaacaaagccacucauucagaccaugaugacugagucauaugaucugcuucugugugucugagaaagagacagagagacagagggacagacaguccacuccaugaauaacagauaaaacgagauugucaauccugccggcugcccagaccuaagaagguugugaugauacauagagucuuucuuguggccacauuaacugcccuucuucuuuuaaaaaggauuuaucauauguuuuuauuuuaugugauaagugcuugccuguguguaugucugugcaccaugugugcaugaugcucaaggaagccagaugaggacgucaguucuucugggaauggugguuauggaccaugugaggagagaaaccaaguccagguccccaggagaacagugagucccauuaagcacugagccauuucuccagcucccagauucauuuuuuuaaaagguuauuguccauuaugcuacuuuuaaucauugaugaaugccaauagcauuaaugggugaacuucacugugggggugaggggcauuauuccuugugccccagauuucugggacccuuuaaggucaagcccuuuacauaacaauuuaauuccuaaaaaauuaagcacauuuauuuacauauguguauguauacacaugugcccaaaauguguggaggucaaagggaaacuugugggaccugcccgaucauuuucuuuuuuuguuuguuucguuuuuaugaaucaggguuucucuguguagcccuggcuguccuggaacuugcuuuguggaccaggcugcccucguacucaagagaucuaccugccucugacuacucugagugcugggauuaaagggaugugccaccaucuccagcccccuauuacauuuaaguuaaaagucauuuugauauuucacuuauuaaaagauggaguggaaguuguuguuauauugaagaagggcccacguuagacaugacugagaauuacugucuuaaaugauggcuuucccagcuuuccaugagucuccuccucaaaucuaauuucuuaccaaaagauuccagcggaaggacugccucgcugggccagcucucccuaggccaggaaguauguagucucugcuuccuucccuccccacuuaaugauagcuauccuaaaccccaggcggcugguuuauguuucucuuuucuaggaagccuucuugcugauugcaggccauccagaacuguauucgucaaaaucuccugugauuagcuuggcuuggcaggguaugcuaauuugcugccuccaaguauauccucaagagcaacggccacccuucccugugugucuauuguuacuuagcucaguauuagagugauaauaauuuuuagauugaacaaaggcucaaaaauaguuaaauuuucuuagaucacaguauuauuaaaaaugugaacaauacucagaugcuaguccaucagcucagagcuggggccuuagugcuacacuccaggcgaggacaaacagggcagccugagaauuuuagucaugggagaaggugcugaagcuauuaucaacugggagggacagacccauuguggugguuugaauaugcuugguccaugggaaguggcacucuuuguuagaggaagugagucacugugggggugggcuuugagguccuauguucaagcucuacccaaugaagaagaaagcuuucuucuagcugucuuugucaguucaagaugcagaacacucagcucuuucuagaguaccaugucugccugcacacugccaagcuuccugccaugaugauaauggacugaaccucugaaacuguaagccagccccaauuaaauauugucccuuauaaaaguuaccuuggucauggugucucuucaaagcaacgcaaacccuaacugagacacccaucuuagagacucuuccuaaaaggcaaggcuccugugcacaaagcauauccaugcugcaaccuccuaagugcuuuaucuaaacgccaaccaggcuuacccgcuggccuccgaaacacgugcaggagcaaauggcuccgagauauucuuucugccacuguucuccuacaugguaggucuucccaucgucauagcacguugcuucaucugcacgugggcacagagcagaaaggaacaguuguaagaccaaggacaaucagguacacucaaguugaugcaucugcccucgaccugaaugagcacgggccaaaucucaucaacuuaggugaaucacaaggagauguuccaaagccuugguagacuaggccagauggaacgauugaagucuuuuuuuuuuuuugguuuuuugagacagguucucucuguguagaccaagcuguccuccaacucagaaauccuccugccucugccucccaagugcugggauuaaagacaugugccaccacugcuuggcuuugaaguuauguuuuaaaaacugagucuacauagcacuucacugcagaugaccaaagugcucaaguugugaaagugcuaaagugcuuagacgugccauucagucaugauucacuuucugaagcaagcuacugacuuaccaaccacagacugacaagcccaccacguccagcccagccuguaaauggguguuucggcucaguuaggaacaugggaguacuuaaaaagucuagaaagcauuuuuaggaugacguacggggaucacacuugaauucucccuuuccauucccgaggcaugugcagcucauccgcuggccauuuucucccugccgaucccacuucucuccgaucuuguaguugacaccguugucauggcaccauucuggaagguagggacaucgcaggcagagaguuacucuguguucugacucacaggaugggcagaacacuggaacaggacgaaaauccauacagagcaggaaguccaagaucacauuucuaaugaugaagcauuucuucaucauaacauuuaauaucuuccaggccaguguuaagacuuaacacuaccaccaagaucauuucagaggaccaaccagugauucauucagcuccuuuuaaauuuuacaaauauggaaaauuaaaaugggauuggagaauuaaaaaauauauauuuuagguucgcagagauccuagauacaaaauaguuuaauuaaacauuaaagagagggcaggcgucgucgugcacgaauuugcucccagcauuagggaggcagaggcaggcagaucucugaguuugaggacagcccugucuacagacugaguguaccacauccagggacacacagagaaacccugucucaugaaacaacgacaaaagcaaacaaacaaaaacaaacaagaagauuaaagagaaaaacagcuggugucaccugauucauauaagugaagaacgaacgaauauaacagccaacaaaauaaagacaaaugaaaugaaucaggcuuguuguacaaauagacaaguccuaagaagucaccacgagcugugucuaauggcagauguaaaaaugcccuuuaaccucuaagauuuauacuaaacagaguucacuuacgacccucauccagggcagugauucuuccacuuuaacaauucagccuuccuuaaacgaugagcaaauguauaaggcaguuaugacauauccagcaaagacuggugagucagaggcucacggauaaaaaucauuguauacguccacauuuguacugaguuaugaaaaacaugcaaacuucagugcaguucacucucugaaaaagcaccuggucaaggccaaauggugucccuccuguccccagcaugguauauugcccacugggcucuacccaacaacacacauugaaaccagucuggauuuugcuauuucauguaaaggaaaggaaaauguuacacaaaaaacuuuagagaucuauuaaaugucauuccauggaauaugggaccuauaauuguccauaggccuguggauaucuaugauauaugaugaacacauaaaaaaagcacauuaaaaagcuaauaauaauuauagcucuaaaaacaaagaaugaaugguuauauacuccaauacuaaaucucuagaaacauagauaacucauaggaucauuuucacuaauaauuugaaauuuuaaccucuuuaagauuugaaaaucaaauuauuuuucagucaaaguugaucuuaacauuuauuagauuuauugauuugcauguguguguacauauguauguacauaugggccuuaguguccccccaggaauaugugaaggucaagggacaauuuguggggacuggcaccaccuggguuccagggaugggaugccuagccuagcucaccagcccugaacuugauccuuaaauguagaaugcaaacuaggcgugguggcacacgccuuuaaucccagcacucagaaggcagaggcaggcagauuucugaguuugaggccgaccuggucuacaaagugacuuccaggacagccagggcuauacagagagacauuuuccuuuauacgagcaauguuugggauaucuggguugugagauguguguguguguaugugugugugugaugugugcauguauaucugguuaugcugaaaaagugguguuugugaguauaaauguucaccucuguccuuacucaauacuaaagacugaaaagaauuuggagucucugccugccugucucaauuaaaccaaacucuaaugagauauuuuuuaacuucaauuuacauagagcuaaacacuacaaggagcauaucaacacuacagauauauuuguaaggaauaguuagauuaguacacaacucuugaaaugcagucauauugcacaaguaaaauuucccaucauccuucuaugaugcaaaauguuacuuggagucaaacagucuacuucuguuugcaucauguuuggaagagcccgagucugccaaacauguuuccguggccaccuagugcgaacgcaugagaccagaagagauggaggagugagaggguggggaacgcaagcuacucacuagaugaaucgcaucugaaaugaccacugccaaagcccaagcacuggcaugugagcuuaaagccagcgucagacaaccgcucccacuccucuccaauggcguaaugggaaaccguguaagggucaaagcaugagucaucuguaggcugguucaggccuucgcugacuaugaagaaaagaaggagaaaggaaaaaaaggagaagacauuuuauugacgguuauugauggggaaacggccauacuguauauugugaccuaaucagcacuaacaacacagacguucucaucggcaacacuuugaugcagucaguaggcacuugucacagcagggucaaaggacgucuuccuucauucccgucuucuguuucucaugacaugaagcagaucgucaggcauuuuaacuagcugagaauaugggcaguggugcuuccccaagacaccugaguacauggagccaauuaacauuugucugucucucuucucucaucuauuacgggauaauaauauaacuagccccacuuuuuuggaucuuguaaaggcuacaugaaacugaggaaucaaagcucuggaccaguaucacuaugcagagaugacuuacuaacuacuguuacucaauaauuaacaauuauuguuagauacgucuuugcuguagucaaugucuuagcaucuuuauauagcauuauaacacaaucuuuacuuacauuguagcuuuucuuuugcuaaauaguuugaaaaccuagaugcuuaugguuacuguaaaacuagauaagaccugauuuucaaguaagagaaaucaccaccgugcaguuaggaauaaguagaaaagcugcaguggguuucccaagauuucauccccguacuugggaggcagaggcaggcggauuucugaguucgaagccagccuagucuacagagugaguuccaggacagccagggcuauauacagagaaacccugucucaggaaaaaaaaaauccuacuuguggauagcuucuuuuaauaguguaaaaaucaaaagugcaaaugaaaucaauauuugaaaugccuaauauuucaaaagccaucauucuggaagaacuaaaaagucuauccaaaauguuuugaaaccaagaggaccugguaaagacaggagucggaaagaaaacaaaggggcuaaaacucucauggggguucacuauuuuaaaauaucuaggaggucugcccuaacauuaggagccugggcuacauagcaguucagucuagcacacuauauacaaacagcauacaauacaguaggacugucugaaacacaccacacacacaccuucaagaaaaugauguggaaaaccacaaaaccccuaugcuuuugaaaaaaaucccuuucaaguggcauuuuacuagugaaaccacaaaaggcaaaugcuaauuacuguggauggaacacagaagaucugcccacuucugcauugccagacaugcaacugcuuaacugaagagucaaauaauagcagucuucgcuaagaggaagaaggcugaaaagaaggcagugguccuacccagaaguccugcucccuggaaaaagugggaguuagcccuuccaggguaagaggacucgggauccagucucaguuagcccuuaacucaugcuccuuggugaaucuuuagcuauugcaacuuaagccaaaugacacaucacuggcuucaaaaggcuucucagagucagggucauucaaccuuuaucaaaaauuuucaggauuaaauuuauuuaaccuuuauuaagauguugcaugcuggucauuuaaccuuuauuaaaaggcugcaugggggucguuucaucuuuauuacguuuguaugauggccauuuaaccuuuaagagcuugcauguauauaacaugacauauauaauuuauguauuaagacacauauaaaggggcuggagagauggcucaggaguuaugucacuggcuccucuuccacaggacauuacauagguucuagcacccacauagucacuaacaacccucuauaaguccaguuccagaggacccgguguccucuucuggccuccaugggugcugaaugcauguugcacacauacaugcaggcaaaacacccguacacauaacauuaaaauacguaaaucuaaagaagaagaaaacaaagaaguauauaaaguugaaauuuggaaugggaagcucuuaggaaagcaaagggcaauauugguaacauuuuacauuagguacaaaaccuaagucaucacuuaagauugccaaggaggacuguuuauagguguucgguucggguuaggaacgcuuaaguggaccacaguaugggaugagagaauaguaaaagguacaaaaaaccauugccucugucaacuggauccucaacaggaggggaaaaauguauuagaguaaauaauauucaugucccucccaggccuggcauccugucaauauguguuggugaacauauggguuacauaaggggacaucucugacuguugugcaaucucauuuuccuaaguuuaaagccaacaaagaacgacagaccaagucuucucugggcugauccagcaagaagcgugugccucaacaggccagcaguguaccuaccagcguugcccacagucacaaccucuucccgaaccuugugccuccucugguucugcagugccuccacuaugauguuguaggugaccccucugguaaggccagucagagucgcacugguagaaguuccaggaacuuggaacuauacauccaaagcagggagaaagcauuucaaugaugaaucggcaugagcuuccuuagucuaugagcaaucccccacucccauuuaaaaacagacgaagggagagaacagggcuguauaggacucccaccuagucaagaugagauauuaaaugagugcaaaaaaccaucguuuuaagauuggggagauggcucagugguuaagagcacuaaaugcucuuccagaggaccuggguucaauucccagcagccacaugguggcucacaaccaucuguaacuccaguuccagagcuucugacauccucacccugacauacaugcagacaaaacaccaagguacauaaaaaauuauuaaaagaguaacuuaaaaaaaaaucauuucugcuagauuuuucuaccuagguguuccacaauucccagaaacccucagcuauaccagcuuccucugaauccuguggccacuagaacuccuggaaaaaaagccccuucauaaacaugagugccacagacagacaacaugugccauguaaggugccaacacaguagaacuuggguuuuccuaaaauaccggcacauccccagacuaaaguuucuaagcuaauaaauguccuaggguacagucaauuuuaaaauuucugccacuuucuaaaaauaacacaauaaaaauugauucuagcaccugugggacaaauuaaagaagagaguuuuggagaaucgaucucucauaacagcugguccccaacgguucaccucgucuuccuagacacguaacagcgugccucuucaaggacagacgccaaagguggcauuucaaacuucauauaaauuacuuuuccucuacuuccuaagauaauuguuucauccaucucacuaaguagucuccaguguaugagaauaauaaaaagaauuucguuuucucuacugcgugacgcucagugaugcucucugagucaaacaaccuccagucagagucguagccucugcccugggaggguggguauacuggcugguguuaugugucaacuugacacaggcugggguuaucacaaagaaaggagcuuuaguugggggaaaugccuccaugagauccagcuaugggguauuuucucaauuagugaucaaggggcaaaggccccuugugggugggaccaucucugggcugguagacuuggguucuauaagagagcaggcugagcaagccaggggaagcaagccaguaaggaacaucccuccauggcuucugcaucagcuccugcuuccugaccugcuugaauugcaguccugacuuccuuuggugaugaacagcaguauggaaguguaagccgaauaaacccuuuccuccccaacuugcuucuuggucaugauauuugugcaggaauagaaacccugacuaagacagugggcaucagacaugaagcugugguuguuucugaagacacaguuacauagagagacacuuugcaagggcugucauguaccuguaagggcucuucgucggugccaacugguuggcaugaaaugauguacucagaacucuccuggaacggcguccaagagaugguugucugagagagagcuuccuguccuguagaggcauuuggauugaggcccggaacaugaggauagaggugguagucuacgucuccccugggaacaugaccgauuuggaccuccucaucuacauucggcagguauggucuuggccuaagccugacggggguggccgcaguggguggcguuguccgccuaaagccauguuccucaaagaucauuuguugcccaacacuggguugcugguggguugugccaggaagcugaauaccauuuucggugucauacccaggguuggugaugaagggggucuuuugaacuguggagggaacauccaagaucucugguccaugaagauugggguguggaaggguaaccaguuggggaagcucaucuagccaagagagguuagagccaaaaaagcaaagcgcaaaaguuaagcucgaagaagaagcaaccaaucacugucaacccaggcaacaacuguuuaucaacccgaucagagcucccacacaaccagcgguucucagaucacaaaacacucuuagagaaagaaaucgugauuuuuuuuuucucacagauuucuuuauaguucagacagaaaaaaaaaaaaguuaguaugaauucucauacagacaaagcuuugaaccgcugagccccacagaaagccaucucugcuccaauuaaggcuuugcaacgaacugaaguguuugaaguucagaaaucaaauaauaaauaaaucgacccaaaucagaaagguuuuacucccaccauuauaaagcuuccccccccuuccaauucaaacuaucuaguuugaaucucugcaagguaaacgaagcuuaagguuguagaaaaagaaauaaaucagacauuuuuagagcauguuaggugauuccugucaaagaguaaaauauauaagccacucugcuagggaaauaaaaaaaauccgugagagaugugugauguguggaaauguagagacuucacccugcaaagcaaccacugguuaugagucuuuaccugucuucuuccucccaaucaggggcucacucuucugauuguucuucagggcaaugacguagaugguguacucgguuccuggcuccagaccugaugggaaacgcggccguuucacucacguuggcgggcacggccagugauuggcucagcagaggcgacuggggagcaggcauuccugccagcugccugugaagucuuucagcuucacuccuuguuuaucuacucugcgaaccccaaagccccuuggcuaguuagucauuucacaaccacagcugauacuugaaugagcaguuucauggcaaccuuccuagaggauucuuucagccuguagauaaacuaucuauacugugggccgacaaugaaauauguauuugggagaggccaucagagacuucagacuucuauuuaggucuaaucucagacagcugucagugacagagcaaaaauuaggaugucuucugcuuaagucuucccauaucagacucuuauuuucuucuucaauaaaugcaacaaagaagcugugaucuccuuauaucuguguguuuuagagacuucaacauccaggagaaucuauacacacaauuuauccuaugggggaggggggaauaaugaagaauuuacaccagaguguaauacaucacagcugugucauaggacggcacugaaauugcaugcucaguugcucauaucucuugagaaaacuacugucccuaaacagaacaucuagagugcugggcaccucauucucaugaaauagcaucaaagacacaauuggggaguauuauggacuuggggcaucuaugauuaaggggggaaaaaaaucacaguguggaagcaauaccaguaaugguggccuccgugacaccagggcggggccgagggaccacuucucugggaggggauccaggcuucucauacuugauaauguagccaguaauccuggcacggggcgccugccaugacaccagcaaggaguugggugugguggucaggaaccgcagguuggauggugcgucgauggcugaaaggcaagcaaagugacaccuuagaaaaaugaauguccauucucacaguugagcccagcccuagcgaacagaggaggagagagagaaucagagagucccgggagccagaacauggaaauuccagcucccuaacuguuucuaaacuugacgcggcugauuacaauaugcagcagcugacauuuccuccauagaaagcauaguuaccgguggaggcaucgaugaucacgggcgagcuccgggcauugucguucagaguguacagguggaucuuguagucagugccuggcuguaaaccuggaaguuaaaaagacgccuguuuaauccacuccuacuuuacuaggcgaguucucaugcuugccuacaguuuccuugacuccuauacuggcagaagcaguuacagggaagaguaaagggcuucacgggguggacaggucacuacuaaugaaaaacucaucucaaaagcaccucacuuaugucccaauacugaaucgucucugauuacaguuuccgguuuuauuauacauaaugcuguuuguaaucauaaauuucauuaugccuuuuaaaaucuaggcaugcuaauuuuacuauuuuguaucuuuauguucucuauauuaacuuuaaaaaaaguaggguuucacuaugucuagucucaaacucacauccuccugccucagacuccugccuaugacuacagugugcagauuuucauuagacaauaaugaaugagcauuuauaaaacaacaaauucaaugaaugagauuuauaggucaagcaaacaucaggaagccaacagaucguggaauggugcccacauucucaauaccagaccagacuaucuaccgagccagggucuccugcgggcgcacacaggcagaccacgaguacacugaccuguaaugguguagcuucuaacauccgggcugaugcuccucugaacuggggucuggccauuggcugggauggcaucgacuuggaagccagugauugucucugucuuuguucuccagcuaauagugaugguggucucuguagcguccgucacacgggcccuucuuggagggcuaacaucuguguaggagcagagccagagauuaaagcacgcuuggcucauacauguaagguuuggauauuuuaaaaagaguccucauuaugcaaauacauccacuucaggaaauacacuaaaaaguaauguggagguuacagaaagauggguuaacgguauugaggaaauauggaaauguucacuaaacagaaaagcuuucuaaauacuaucaguggugcccaggguugacucucuagugucuagagcuaugucaaacaagugugacaaugauuacuuuacuaauauguaaggauguaugguaggaauuauaacacagacaauuaguaauaacgucugucuggguggcgaaucuucggucauuucuauaaggcuucacguguuaaucauuccauaggugaugaaacaucaacagacuagaccacagaucuaauuuagccccacauucccuaugguggaagccaguucaucuuccccacauugaacccuacgaauacagacccucaccaguaccgcauaagccagcugugaguuuuaacccaccagcaccaacacaacacagugaagugauuccauuuuguuucggcaggucauuuccuggauggauucccgaaacgacaagcuguucuaucaacuuccaaauucuauugcuaagucaguggcuuaaauguaaagaucuuuucuuuugacuuccacucagggugugucaggauuaaaacaugucacucaucggauuacucacucuccagaguagugaugacucccugggcuggucugcuugucaguguguccuugagagcauagacacugacuucguauuuaguggccaccuggaagcagagguaccagaaacuuuggcaaugguguugcaugaugcccggaguucuuaccaaagcauuagagaaaugcggugauuauaaaagaccaucugcauagcccagcaaaccccaaacccccagguucccagagcaacuucacuguuaccuaugagugacaauacauuuacauuuaaauuaagugaauuuuaaaauguucucagggguuaaguccacaauccacaaggagcagcaaaaaaagaauaagaaagaaaucagucuuagccuuuuuuuuuuuuugccuuuaugauaugacagauauaaaucagguuuugcuuuuuuccugaucacaaaaaaagcaagagaaagcuucuauucuacugcuacuucucuaagaauuggccuuguguuaagaugugcauuaagcccuuauaggauccuagcuaauuucugcauggcuagaaaaaguuuuaaauacuacuugcuugcuuguuugcggcagggucucuuuguguaucucuggcuguccuggaacucauucuuguagaccaagcugggcucgaacucagaaauccaccugcuuauucugccucccaagauuaaagcacagcuggcugauugucaaauguuuuaauggggguagugucaaguuaggcugguacuaacuggagaaugcgucuugccagggaaacaucacucauaaaagccauaaacucagccagaguguguguguguguguguguguguguguguauauaaauugcucccuaccgaauaccacuucuuuuaaauaaguggaauacuucugucaaagaccugcacgaaauccaaagcuauuuacaccauucuaauccaauagucaucuuaggguaucuagaaaauccuaggucuacauaaaagaauucuauuguacacauuugugacaacccuauuugaugguagaagcaaagaacacuagguuuauuaugagauugcaccuaugaacucuaugaaaugaccuccugccuuacucugcagagggaagcucacuucuuaccaugaguccugacacaaucaccgaugagcugucuggagaaagguugauuucuuucauugguccugucuucucuuucggguucacccgcacccgguagccagugagcugaacacugggugcuauccacugggcaguaaagcuggugggugucaccugacugaacuucagauuggugggcgcaggaauggcugucaggauggucauugguuaaaagguuaucuuauagggaacgaggaacggggaaagaaagcaaacuugaagaaggagaauggaugguccucguagggacugguggacucccuggagacucccaggagagucugcacaaacagauaauaaaaacgagaggaguauuuauaccagcaacucucagaaccacugcaaacaucugcauaaacaccaggguuccgagagacuuugggucuuaucucccuacccuacgccuuuagaagccaagaguugaauucccuuauuagucauuagaauugauuuuuuuuccauuuguaugaaaaagaugagcaauggccccuuuuucuauauaaauuaucuuuguacaggaaacaauuucacagacuauuccauccuagagauagaauuguuuuuauuugucucuuuuauuuggaccccacggcagauagcacugcuaaauuugaaguauucucugcggcguagcauaagaagaaaauugguuuacaauagaggcaggagagagaagcagagagcaguuccacagacugucaccucuguaugcuuugagcauuccaaucuugcuccagcgguaaaagcauaagaggcugguaagaagcacugguccuaaugacgcuguccugugcaucugcaucaucauccuuuaagcaaaugaaggcccagcacaggagagcuagccaggggaggucuuacccauguauucuuugaucauguugcaagaaaaugccuggcuuaagagggucaauucucagaguaagcucuaugauucuagacuucuuuccuccauguguggagagggagggucaccaccgaggugucucacuuaggaaacaauccguaauuuaguaccuucaaaugucuugcuucauaaucuuuaaauauuuauauauuucauauguuugcacgucugugcuuagcuacuuuaaauuucucuuuccuagacuuaguuaccuaaacaucaccugacuuucauuguucacaaccauuccucauuaaagagggccuuucuuuacuaagaguuugaaggcauuuuucuacucucccuuacaugggacucaauagcccaguaaaguauaacgccagcaaggcauaaagccacuguucccagaagcacccggguggugggugcgguuaacgauauaccuguggacuggauuccaaucaggggcuggcucuccauaucaucgugcaaggcaaccacacugacuguguacucagaccccggccugaggcccugcagcucugcagugucgucuucaccaucaggugcagggaaaagcucccggauuccauccucagggcucgaguaggucacccuguaccuggaaacuugccccugugggcuuucccaagcaauuuugauggaaucgacauccacaucagugaaugccaguccuuuagggcgaucaaugucuguuaggcaaauuaaugguaagagguuaugugaaaagcaaguugugaaacaagcauauuuccauaccaugcaaagcaguucugcagauaacucuugucuuugaugaauuaaguuccaauuaucacacuauuaaaacagaaaguugcuugacaucugcuuaaaaggcuuuuuuuuuuuuuuugagauuuagcauaugcagugucacguugcuuauuaagacacaaguguguguaagguauguagacacccugaagaaaaaaaucuccaccaaggaaauuuauuuauaucaauuuaaagauauucuagauuugauucugcaaugugauguuagucucaaggaccuggauuuucuauaucuuggaaaugguaaaguugauuuuuuuuuuccucaagucauaauuugucuuagguucuucuuuuuuccccucucuuaagucuuuauauuuaaaaaggcugacccugggcuggagagauggcucagagguuaggagcacugacugcucuuccagagguccugaguucaauuccuagcaaccacaugguggcucacaaccaucuguaaugggauccgaugcccucuucuggugugucugaagacagugacaguguacucauauagaugaaaaaaauaaaaucuuuaaaaaggaaaaaaaaacaaggcugacccagccacaguccuucaaccauaaccacuucuuggggcacacuacagucaacauuaccauccagucauagaaaaaguagguccuggagagaucuuucauagauuugcuaaaagcaaauaagauuuugcugaggcuguuuaagcaaaggagauucaaagcacagcagccauugauggcaacacuacagugauuuuuccugcaagcucgcuuuggcgccaagaaauguaggccaagggcucaucucaagauaugaaccagcugacacauugccuuucccuguguguauacaauggcacaagaugugcggugggcaucgagagacaccugaggacaauaugacuuuggaaguaggaaaccgagcauugguuacguacuggucacugcaguuugaaccaggggcuggcuuucuccguuccgguucugagcauaaacacuaaccacguacuccacaguggguugcaaaccuucaauggucauuucuguuugaucugaaaaggagggagaagcaauuaauugcaggucuauagagccacccaagccacuccuaaggacucaaugagaagcagaugcugagccuauaauuuucauuugcagaauaaccaugaaacacccauuccacuugggaaagucagaugccuguuuccucucaggacaacuuguucacugguaccaaaacuggggcuggggagcucggcuuaguugguagaaugcuguucccaugaacaaacccaggcuuagauaaccaagcggcacaguaaacugugugcguaucuauaguucuagcacucaggagauacugacaacaagaucagaaguuuaacgccauccuugccuacguagugcagugaaggccagcacagacuucaugagacccccaucucaaaacaaaaucuagcauacugaaguaaaaucauauucaagaauaagcuuuacaacuaacuuaacaugaugccccaucccccaaaauuaaugaggcuauucuugaaaaauuucaagaaagaaaugaaaauugaucuuaagaaacuggcuugagaccuugcaagccauuucauauaagaacaucagaucuagaaggaucuauaacaucaguauauccuucucuuccuacuacacaagacaguauuaaaaaaaaauaaaacccgagauacacggauaccaauacugagcuggugccaagccuaugaaugggaguagcauacacacaccacauaggacacucacuucaaauggcaacuucugagcuccuacaguguuucucuugcuagguguggccuugugguuauccuuaccuggacuggcaguuuuaguuuuugaugguccuaggccauuuuugggagugguggucacucuguagccugucacaggagaaguugaaggcagccaccugacacugaugcuguuguccuggacaucugucaccugcaucugggacggcuugucaauuucuguaaguacaaaagaaagcagugaugucccaguguggggggagggcuggacaagcccuggccuuuaguuccaguguguaugcgaauguucucuugcuucuauuaauguauugcaaauguuucuuuugacaagaauaaaggguguuagcuugaagaaggaaagccaugcauccagucacuauuacaacuauuuacaaccugauucuuucauuccacaaacaaagcauuacaucucagguaggccuuugucuccuaauagucaacccauccagucauuuucuacagguauuuauaaacacucucuggcuugugucuaauguagauacauagcgguagcaguuaaaaacacagacaaaaaugucugcucuuggggucuucuuuguacauuugucucaagacucuauuacuugaagguguuguuagcuacaggcuuuuguacacagagaaacccugucucggaaaaaaaaaaagaaaaauaaaucagggucaaggguguaguucagugguacagcauauauauauuuaugagaugcuggguuugguccccagcaccacacaaaacuaaaggaaaaucaacuguguagugaagacaauaccuuggacgaauacagggauaaccaucuucauaaauaaccccguguuaccccaagagaaauuuguaccuguuuuauaauugauggaaacuggcuugcugcuugcuggacuguccccacggccagugacagcauacagggugaugguguagucugcuccugguuuaauguuguugaugguggcuguggacuugcuuccgggcacagugaacuccuggacagggcuauuuccuccuguacgaaaggaguuagcauagaauuugaggagcuaggaguuacuccaauauuauuaacacaucgaaagcgguauguaagucacugcagcuugcugguuccaucauaaggaguggcugcuuuaacccaaccugacagacaaguguauuuauguguguaguaagcccugagaaguauauaaaaaccaggagaacucucaagcuaaugccauauuaacaucccuggguuaaaaugucacugaguugcagauuaacaggcaaaaggugaagaaauccccagaaaugagcucccugguugauaauaaauaccaagcagucagcccugaaaccauguccauauaagcaacaguaagcagacucgguggguuguauuuauacuuauuuguuggaugcacaugcacucuguguguguguguguguguguguguguguguguguguguguguaacaguaagacaaagaagccaagaaacugagaggaaguggagcgagaggggugugggauaguuuggaagaggaaagggaaggaggaaaucauguaauuauauuuaauuaauuguuuaaauuaaauagaaaaaggggacaagaauguggcucacucaaccuaaaauggaaugaagucuuuacaaaaggguuaacagaauauuuguuaaauuuagagaacacugaaaagaaagaauaguaagaauuaccaaugguaauauuuguaaauauauaaacuuuuuuuucucagcucugcuucccacccuugcuguaguguauaaaccaccuuugaacuucauuacaaucaauuaaauguagcucccaugcauuuuuggacagaaaaagaaagaaagaaagaaagaaagaaagaaagaaagaaagaaagaaagaaagaaagaaagagggggaggggaggggaggggagggagggagggagggagggggguuuucuaaaugggccuguuugcauuuaauccuguucccacugucagauuuccaaguuacccacccgaacccugauccucuaagggugaaauggcccaaaaugaacagaccugucucuccguaggugauucuguaauagcgcacagagacggcaggggguucccaacugaugagcaggcugguggggguggaggcaaugaccuccagaucucucggaauaucagaaacuagaaaaaaaaaaaucacaggaaaacuucacauguauaacuuccaaagaaagcucagguucacuuuguccuuucccagauaacgauuacacacauccucuucaaacaaaaaucuaaaugcaacacugaauuagcagaguuaaauucuauggcgaggucaagggaaggggcuauggagaccaucccaauugugaauuccuuuuuuccucaacagucucuuugggaaauaauuuaaaucacagaaguuauaaaaacuacagcagcacucaccaugcacuuuucuuuuuucuuuugguuuuugaagacaggguuucucuguguguuauaacagcccugucuguccuggaacucgcuuuguagaccaggcuggccuggaacucacagagaucccaccccaugcacccuuaacuauguguuauuuggaaauaguggucacacacgccccuauucacagcuaagcuacagauuguucugauaacaggucucccagucauugucacugaaaauauaucuaucugugcuuaaagccaaaaucuagggcuugacucacgccacacagagcacuccaccacuacacuacauccacugcaccccuuuaaaaaacuuuuauuuacuuugagaugagccucacugaauugcacaggcuaacuuugaacucacaguagcccaggauggccuucuugcuccagccucccaaguaccugggauuacacaucugugcuaccaagcccagcuaacgaaacaaaaaucauagguuuacaguaacuuugguaccauauuaugguuuuguaugaaaccuucuuaaaaaccaguaaauauccaugaguaguaguagcucaugccuguaacuccagcacucacaagucaaggcgaaguaucuuagauaagcuugggcuacagagccagcuucugagucagucugggcuaugacgcucucucaaaccaucauaaauaaagacugaccagcaaaaacaccagaacauagcugaaccaggugacaaucucucagagaaauaaauauguuuuuagagggagaaauguuuaccacacagucuaucacuguccucuuucccuuuuuauugagauaagaucuuguuguguagcucuggcuagucuggaacucacucuguagaccaagcugaccuccaauccagaaauccaccugccuccaagcgcugggaucaaaggcgugcgugcgugugugugcguacgcgugcgugugugugugugugcgcgugugugcgcgcgugccugcgugcaugagcgcgcacagcugcgccuggcuccaccacugcucuuugugucuaacaugaagcuuuuucacagucuacaccaaaccuauacaaaguccacaccaagggauuucuuugcggauuaaaaaaacaaaauuaccuguggcuugcuggccaaucaguggcgggcucuccucucugccauuaacagcaaugaugcugacaacguacucggugcccggauuaagguuggugagggugauggaauuccgcgagggcggcacucgauccugccugggucuuccgacagaaugcucggcgugauggcggaugauguagccggugaugggggcccgaggagccacccaguggacagugaaugaguuggcggugauaucagaagaaucaaaaccaguuggggaaucgagaccuguuuuucccacccaaggaggggagcaaaagacaacaaccacgagcuuagacaucgaggauggaggauguggggaacgcaacugacacuguuauacgggacugauagcugaccgcaaucagcuuacacaagcauuucuuucuuuuuuuccuuuuaaaaguaauugaaacaauauguaaaauuauagccgauuucuacauuauaccgaaacacugauacuucugagggcuucagcguuguucuggguagcuuuauaucauaaacuugaccaagcuaaaguuaucuaagaggaaggagucguuaauuaagaaaaugccucuguaagaucuaggcaagcuuguagggcuuucucuuuaucagugauugacagggcagggcccugcccacugugggcgggacagugccuucucugggcucaugguccuggauucuauaagaaaccaggcugagcaggucaugguagaagccagucaguaagcagcacuccuccauggccccggguaucagcuccugccuccaaguuccugcccugcuugaguuccuguccugguuucccugcagugauggacuacaguguggaaguguaagucgaauaaacccuucccuccccaguuugcuauugaucaugguguuuccucacaaauaucacaacaaccuuaacuaagacaagaaaccagugaaauucacaaggaaaccagggaacucuauuguuauguuaaacaaaguaacauuauuauguuaaacaaagcaauccagucucagaaagacaaguggaguuuucugguaccuggauccuagcuuuaauuuuucauauguguguauagagcaucuacauguaugugcagagcaaagguccugaaacuagaaaaaggaauguggggagaagagaaggugcuuuaaggcggagaggguagaaagugaaaagggucauaggauagaggugacaagaugacgagagugaaaacggggcuguacauuacuacagggagaaaggggaccaggaaggaugacagggggcaaggagaggaacggaagaggaacaucaacagagcaugugaaaauaccauggcaaaaccacuacucuacaauaacuaaaauuaauuauuaauuaguuguaauuaauuauugucaucauaaauuaauuaauaaauuaaaaguaauguaucaaugccacaaaagguggagaugcaacuauagacucaaccuaucauuuuguugcuuaacguugguagcuaacguggcucaccuguuuucugccuuccccggagagggaugcucucauguuguucguagacacuggagacacugacuaaguauucugucccaggcaggagaucugaagaggcaaagugggauuugcuuuaaacuugauugagacuuugagaaagcauaacgcuccccgggacuccgucaucugauaaaacauccaagcguucagucccauagccuaccuguggcuaagugaguaugucugucuggacauaaucuguaaauaagggccgcucuguccugucuguaagccccagcuccacagguauaaauggaacucagucaaguguaaacacgggauguuacuaucucucccguccauuugaaagggcaucugugagggccacugauguaacuuuugugggagucuacauuaccaucuacccaucacaacaaccacaugagguggucagcagcuuccaugcuaugcaaugucaagauguacaguuggacaaaauuugacauguguccuuguuggggccaugaauguauucaagacaaugaacauaccuagugccccuggacucacuccacugcccucaaacugcuuaauuuuuaaaauaggguaauaaugacuucucuaagggggaguuucuucuagcauuaggacucuuuaagauacauaauuaacaugugacacgguuuggcuaaaccggugccaacagguggcgaugggucuaguauauuggacaaugugguuccuacugacuggacagacauuuccacacucggguuaaguaucuggguccucuggucuuuagccaccaagugagagcugcugcugcugccucuuuguaguuagcuuucugagccguaucugaagagcagaggauguuuucugacccuauuuggaaaugggccugaauguaacuacuuuccucuccuguagaaccccuguacuuauacaauuuccuacaauguugcaagcucuuguucucuuuaauucaaaguauccucuuccaguaggacucgggaagaaacaauuucuauaacuugucuaauacaugucaguugcuuucuaaacucucccagcuucagggaaauggugcaaacacgugcuuucugaaauaugaacuaaacgucugccugucuccacgcaaaagccauucuaaguuuucuagugcuaaauagauccccugguggugguagaucucacacaagaaaggacaauaaaccagaugcgcugaucuccauguuucucacucuugccuuaguuacagaauucacuugggagucacguaucuuuugugcacugauuagagaaugucugacaccuuggugcuucacagaccgugccuucgacuacgauuuguagcgaucaaaggucugccacuccggcagaaucauuacaucuuucacaguuuacagagccgccuacugaacuuggagagcgugucucucggucacaguucuccuuucucuuaggugguccuccaggaaaacucaggauccaugccuugugcuccagaucuacggaucugcguaucuacgggacaagcuauguuugagggcuuacuuguuaggaccacggcauugucugaaggugaaauggauagcucugcaacguccucuucauucuucacgggugaguagcgcaccaagagguuggucagcucgauggacggaggcggggcccaagugacccgcaucgugucuggaccgauauuggugaaucgcagauccgugggaggagggacagcugauaucaaauaaggaggauugaguuaaugcgauuuuaaagucaaagcuaaaaaaaaaaaauagcugaaaagguaaaaaccaguauuucaugcagaaaagaaacaguuacaaccaugcaaacagucuaaucuaaucuaaucuaaaucaugacacgcuacuguuaaaaaaauaaacaaaacacuauagagaacacuguuaggccccuuuaaccuuucugccaugaucaaugcauuuuaaaagaauuuuagucuacuuuucaaauagguaggcuuuuuuuuugguggcugcuauugccguuuuaguacaucgauaccacggaagauguuucucccaggcugaagaggcuuaaguugccacacagcaaagacacauagcaguacuuuccgaagaaacacaugcacgaagacaaaaaagacaagggguccucaguuuccccggagugagauaucuacacacuacugcauugccauaauuccauucagugaacucuacuuacaagugagggauucaugcacagugguucucagcaauguuucuuaccaugcagggcagagaaccuuuaagauguugcaugcucgucucuagacugugguuaaagaggaguuucuuuacccuguagagcagcacuauccagaaagcccuacggcucgucgucauccuacccugagaucuccccuucuguuccacacucauuuuugguagguguuuuauuagcuacaaaaggagcuuaucaagguaagaggaagcacgcaguggcacacuuuggaggccugucuuaguguaaaugagugcucauuguucaguuugauagucauacuuuaaaaaaaaacaaacacccucaagaucugcaaauguaaucuccuuugcauuucauaaaucagagaucuagagcucuuccccuucacaucuguuugugcuuugacugaaagugcuugagacuauuuacgcauacuuucaugcaaccagacuaauguaucccuuaucucugagcgggccccgucuucaucuccguagccaaucacuggcuuggaaacauccagauuuaaccacagcgacugagcagcaugcaacaccauccaugucucaaacacagaagacuucaagauucacccguuugcugugucaguguaguaggggcacucucuccgccauuaaugagagugauaacgcugaugucauagucaaugccaggcuccagcccuguaacuguguaguauccuacugaggaguccacaaaaucuucaaaaauagggaucccuucuccugccgcaacuacugugauucgguacccgauaaugguggaagaguuuagcgggguccaccucaggccgaugcuugaaucaguuauaucaacaaagcuuaggucagugagcuggggcaccucuauugaguuacgaagcaaagaggaggcaaaagaaaaguagaggcaaaaaacaaaggaaaaaauaaagcaguguacaucaggugaccgguagugaaauugacggaaugcucaagcaaugaugguauaugcaauguaucccaaauuaucugaaaagacgucccaagcaucaugaguaauuugcuccccugggagacuaaugcagguuaccacauucuuucaggggcuuccucccauuuagaaaaugucccugaaugguacaguuuuaacuucucaaguguuaaaaaaaauuaaucauaaacccauuuacaaugucaaaaucauucucagagccugaacugaucuauaaaagacacuagcaauguuggcggggugggggguugggaguggggagaacacaaaaccuuuaguaagaaaauaaaaucuuccaaagguuuuuuaaaaaaaaauuggcuggcuaauugacuuauuuuccauguucaaaagccaugauggcaucaugaccaugguauuaaucuauguugugaaugugccacucaaaugcacagucaggccaaggccagccagcacagagcccugagcccacuccacugccaacauuuuaauucauguaauuuaauuaguauucauaaaugcauagcaaaauacugcagaggguaagagagucugaccagggcuuucaaucuacagaagacuggggacaaacaaugaaccuaucccuagacaggccuuugugacgcugucuuucaauucagaagaaagcaagccauggggggccuggccuuuacuucuuuccuuucugugguuuuucaccccacuugcaauuuuaaaaaggauuugaagcugcaagauaaagauuuggauugucaaccaaguguguuucagugcucacauauggagacaaaggcuguuuucuagauaacaguuggagguggagauggacuguaaaacccgggcacaaaagccccaaagggaugcauuuaccacauuacuuuuagccugucagcacuggguacagacacgcgacacuguuuaguaaucuuuccgugugagcaaacaguacagaguuaaugccguggccgcacucaucagguacccauggcaacaaacagcaucccagggaagcacagauagugaagcagaggaaacaggaaagccuucauccaaacaguugcuuuuuggcuuugugguuuuggagagcgcccugggagguuggcauuaaaucccaacuguaucugacacacucagcuaucucggauuaagaugcuuauccccaucgcuacucaaaacugccacucuaaggauaacagcuuauuuuucuauuaccugggacaacgguaucagagauaggggcacuuuccuugucaucuuugacaguguaaacacugacguuguacuccaggccaggauucagguucucaaaagugcaggaacucugaucagcauggaccacuucuuccagagagguccccugcugcccguucguggggguaguaguuauucuguagccagugauaucuggaguaaaugcagagaggaaguuaccauacagaaccaaugugacucaggguauauuaaacuguacaccaaugauggaccuagagaggaaaaggugggaccaaggggcagggcuguaauguaccaacagucagaaaguaggaauuacucugccgggugacuaguccacagcaacuuaugauaauuucauaauaacuagagucugagaguguccagcacuuagacaugaauguuuuagauggaaaugcuaacucgaucauucuacauugcauccauugggcgaucuuacaacccauauaaauguguuaacuacaaaguaaaaucaugggaccuuuaacaaagauaaggaaaucuuagagaagaccugagaguuuccugucuacaaauuccagccucuuuuuacuauuuuauccuguuuuuccuuaaugggcgaccugugggagagcuaggaaaucuacauuuuuuuuuuugaaugcucugagguugcuuuccacuuaaacauucuccgaagaguguaaaaguuugaacuaugggaacggggggggggggggguaggggcuggagggcacagaacacagaaguguagaugcucauucucgaaaacaaauauuaaucauagaagacuucagaaucaugaaaauugggcagugaaggcauuaaaggaaaggagauaucaauaaaucuaguaguggccagagcucugcagggccaggcuggaagaagacagaacaagacugacccacugagaacagggaaugaggguauauccugucaguggggagaaggugaacauuaacguguuaugugcuaggaaacccagugggaugggaagucaauaacauuucggucauuugcuuuacgccugaccauugaaugggcaggccacugaaaccaaagauugaugauccagcugcccagaagcaagaacuugucagcuucaaguuucaaacccagagaaacuuaucuggaaacacuguagcugucacauuauacaauacauugccacagagaaggaaacaucacucagucugucuauuucaaaaggagauuaaaaggaguauuuuaaacuaguuuuauuuugugugacuauaaucacacacauuuauagauaacugcuugacaccuacgcccgagcaaggguaagaacaguguaagagauuauagcuacaaauuauagacuaaagauuuggcucgguggauaagcuguuggccacguacucaugaggaccugacugaguuccuaucuccagaauccacauaaagccagacacgagagcgugucugaaauccccaauguugcuagagagcauugggaagugaagacaggagaguucccagaagcuauuggucucacugucuuaaagaagauggaaggcagucacguauacugaagguuauccucugaccuccauacacacacuguaccaccugaacuuagacacaugaaaaugcauguaggcaugcauccaucauacaaagguacuuuaagaugauauuauauauguguauguauauaauauauagagauagaugcagauauaguuuauauaguuuugucaagacauagcccacacuaugacuccaggcuagcauuaagacuugcuguauauaccaggcuaauccuccugccucagccuuaguguuggggugacguuacuuuuagaaaaccauuaucaccgggcgaugguggcucacgccuuuaaucccagcacuugggaggcagaggaagguggauuucugaguuugaggccagccuggucuauagagugaguuccaggacagccagggcuauacagagaaacccugucucaaaaaaaaaaaugaucaaugaguaaaauuagcaacaaucaaauaaugaacuaaaaauauugcuccaacuaguuggcucccauugaccauguucucaaguagcaagguguggcagcgggucucccaggggaaucauagcugcucguguagccacgcccagcuuuuugccuaguggcuggggaugaacuauguccuucugcaugcacaucaaauguucuuccccaugugagccucugcccaucccugucucucauacaucuuaugguucaauucauuacauauucauagguuacagaugugcauacugaaccaacauggauuaaaagaaaauacugguugaagauaauuuggaucuaugcuaugcaugcacucuuucuuguuacuguccccaaaacaauccagugggacaaugacuuccacagcauuugcaaucuauuaggcuacaaguaaccuacagauaguugaaguaugcaagcaauguauagguuauacgcaagcacaacaccauuuuaugcaauuggcugagcagcuacagaguuuggaaucaaugggaacccugaagccagccccacccagauaccaagcgaucugucaaacuucaguaaacagucaacuuaagauuuauggacuauagacuaugauuucagccuuuaaaauugggcuuuaaauuuauuuauuuauuugucauuuauuuacuuguuauuuauuuguuauuugcuuguuuguuuauuuauuaugugcaugcguguugugccuacaugugugaggguuucagauccccuggaaacuggaguuacagacaguugugagcugccaugugggugcugggaauugaaccaggguucucugaaaaaggcagcuggggcucugaacugcugagccaucccuccagccccaguuugggcauuuuuaacgagcugaacaaaaucuucuuuccaucuaauccucucaaaauucccuguaguauaaacguuagucucccccgcccccacagccuagcauuugauuguucucuuuccugcgaguuaagaaaagaugcagccguguuuacacguaguucaugaacucucucauucuccucugucacucauggagagcagagcacuugcuuucucucuuucucugaauggaauccaaaucugucuugggaaagccuuauguguacgcggcucucagauccgccccacgcuucccuaggguggugcuccccuuuguuaccugggguagugcuccucucccaggagacaguaagcacuccagugucaggguuugccuccagaugcaaguuggucgguggagacagcgcuacacaacagaaaagaaaacuuaaaaguuaaacugaacacagaacacguggccugugaaauguuuccucuacgcccucucuccacccuucuuuccucgcaccucccuccuuuuuugccuuucuuuaucccuucccucuaggacugggaaaauaaaguauucuauaaaaauacaggcgacaguaaccccgauagguggucucuaggauuaacgcuauuguaauucacuacugaaauuguuucaucuugccaguuuggaagacuuuugacauggaaggaacacuucuaauucuguggccugcaugacaccagcuaaacuacauccaguucugaagacucugcugauauaaauaagagagagguucuucccuuguucugucucaaaagaaagcugggacgcuaacauucaaauaauuagaggaauauguuucuuuuuuggggggacaggcucucacuguugguuggccuagaacuuacuauguagaccaggcuagccauaaauucuccaauaucugccucucucugcuuccuaaguacugggacuagagguguguauuauaaaacccagcuccgccuccaguuuuuggcuggucuugaacucccaucaucauucuuaacuuucccaagcacuaggauuaaaggcacacccuaccacaccuggcuuuggcaaucuuuuaaaauaguuuacaaguuaaaagaagaaggaaggcucuccucacgugucacuacucuguugacaaucggugcaucucucuccuggccaucucgcaggacuuggaugguguaaguguauuccacgccuggagucaagccagacacaacaaugcucccagagucugaagucacuucucggggugccucaccucccuggcucggucguacacccagcuggaaggaagacagcaaaaucagcaugaaggaugaauauuccagagaucccgagagguuguagauuuacacagggggaaguccguuacaacuccacacugcauuuacuggguggauaacacauugagggcucacuuuagugaucuugcaauuagcuggagguaucuuccuuugguacuaggguccuuuauaauagaaagguucuagagaaaugucaguauaacuguuugacacaaacccuucuggugcauaccagcaguacacagggaagaaaugcucuaggcucucucuuuaauaaguuaucugcagccacuuugacacacggaaaugaaaaacacauucccacgaagacguccguguguuccuaacuacaaaagcuuaggugacauuaucaaacaguacucagcuccagagaaacccuucagauucucuguggcuucuaaaacucugaacgacauuauuaagggaaacuaaaaaggugccguggcggucuucauaaagguccccucuguaccugagcagcccacucaucaagauggcuauuugcauacuaaaaagcagagugacccucggucuauuucuuuuuucucucuuuuaaacaaucaggcuuugauuccagacauaauaagugucucuuuuuuuuuuauccucuggaugccuaaggaugggauucuuuuuaaaaaacauauucauuuguauccaucacgucccugguaucacugcuuuaaagaacaugacucuggauaucuaaagcgaagaccucaauuuuaacuucuauuaagaaauucacccacagggcuuugaacaaguugagaugaaacugauuggauaaaaaugugauuuuuaagugacucucaguuuaauuggucuucccaaauugguuuucauaagcuucucgacacccauuuagagcaacacaucaaaugagguuuggcuauacuuuuauuuuaaaauggaguucccuggggagaaggacagaaaacagaacaacacuacaguuccauggcucaugguuuucuucccuugcaacacagagaagccucaaugcaggcuuugcucucagaagguccuggaguaugagcauagaacuuuaaaaacccaggucuguaaaguguagugggaauggaaagacaccccugggcuggaucaugagaggugcaucugaaacucaccuugaagccaauccuuggagcggggguccaggugaucacaauuguggucucugucaccucgguguuguaagguggaauggagcgcagaggcugcacugcaaauuaaccaacaugagguucaacguuaggcgcauagguguaggccaggacugcagauuaacgagcauuguaaacagagcuuuggucuaaccaguaaguacacagagaauguagcuaaggugcauucaucggcuaagaaguugaacugcuucaaggcacccaggaccuggugagacccgggaagggggccgaggguggugauucugcagguccagcuuuguuugggcuggggcuugaauuucuggcagagaccugucacucacagguaguagaaagaggggcucgcucaccucaauggaagcuccuuuuaauuucuugggccuuaugaucuguaucuuuucaugauuuggggaucuuaucaucaacaucaaagauccauuccuccaacaugugguugaucauucaaacaaaaaugcuacagacacuuaauaccugaccacuagacauagaaauuauaacuaguaugcuugguauucuaguauccugacaccaccaucauuucuucuacugaaaauucuaacuuuuuuuguuuuguuuuguuuuuguuuuuucgagacagaguuucucuguguagccccuggcuguccuggaacucacucuauagaccaggcuggccucgaacucagaaauccgccugccucugccucccgagugcugggauuaaaggcgugcgccaccaaugcccggcugaaaauucuaacuuuuuaacagccuggagagaauguucagcaauuaggaccaaauacugcuccugcaauucagaacuguccauuuucacaccuaggcauuuucuauugcgucagccaagcagcuaaaucuugccccauguuugagacaauauucucuugccuagacaagaccauuacaggaaaaucaccaagccacaaacccacaaaguguugucaaacaaaggaugugccuguaaguaugaauuaugggcucuggcagggcuuguuagguaaggaacaaccuggcuguugagaaaugacauacgcccccaaacagaaggaggcuggauuccuccucuauaaauaacuuauuccccccacuuuucucacaguugcucuuaagaauuuagcaugagauauaaaagucagaaaacugguuguuuccaaaacuuaauuuugguaaagcaucagaaaccaaaguuccuaggcccugcucauguuuauaccaagacuaucugagguccaaauggauuugcuuaacuccuugguuccacugguuuauuuaaaucugagccacggugagcugcucauuugucuuucagucaccuacccuaccguguuggaaaggauacuccacgcaauucgguauguuaauuaauggucagcaaauacaguuuuacuguuacacccagaagccucggguacgaggccaaguaagaggcugugugcacagaaacuccaugcucauuaauuuaagggacagcuccaagaaauggguuuugcaagaaaaacaaggauacuaguucuguaagaguggaucuuagacuuucucaaaacugggcaaugucaaauaccaaacauuuaaaaagaagucugcaaacuagaaagcagacuucauuugcuggugaacaguuucguaggaaaaaacaggccuucgguguucaaccucacauuaccaaaugugcaugcaaagaaguuugugguaaacaauagauuccuguggggaacaguugacaguuuuucuaaauuguugcuuauuuauuuauuuguuuguuuuugagacagggccucuuugcuuagcccuagcuguucuagaccucacuaaugaccagaguggccuugaacucagagagauccaccugagucuaccuaccaagugauagcacuaaaggcagguaugugcuaccaugcagggcuuagauuacuuuuuaaugcaaacaagacuugcugaaagcuccuggaaagcugggaaccagagguagacggccauaaaugcccaaagcaugcuuauuguuagguccuccuauaauucaaacccgcaagucaaaaaaauaacaaguacucagcaagaaauaagucucagagcucucugucauguaaauggaguguacguaggaggaaagcagcuugugaagacaggaguuuaugggaauguggauaaauaagagaguuaaggccauuuccucuaaaauauugagucaaaggcuagucauacccaaaacccuugucuuuuuccucuguguggaagauguggaagagaaaguuaaggaagaggaaaccaggcucugcugugaaggacgguagccuucggcgggcgguccaggcucucaaggaagucacauacuuaaccucucuuuccauuugcugaugucuguucaguccauggguggauuuuuuuuaaacauauaugacucucaguugaugucuagagagugaugugauggagcuaugcauauggguuagauucugucuacuaguauuuacucagccuuuucuacuuuguauucagucuaugcgcccauggauucgugugacuuccuuaaccagucuccaccauauuuccuuuuccuucuuucuuucuuuuuuguuucuuguuuguguauuuuuguuuguuuguuuguuuguuugagauagggucuuucuauauaguccugacuguucuggaacucgcuauguagaccaggcuggucucaaacucagagauccgccugcuuuugccucccacuugcugggaugaaugaauaaaagcguacgccgccacaccagccucggcgguggauuuuuggagaaccuggagcuacugaucagcaacacuggcugugagccuccagauccucuugucucugucucucagugcuaggauuacaauuauccaccaaagcaccuggccuuuuauguccaugccagggauccgaacucuggcccucauguguuagccgcacuuguuuuauccacugagcuaccucccaaguccuccugacucauaguguuagcccagaaagauagaaagaaccuggaaauaccugcaaauuaacacacuguuaucuucaucaagcacuuaucagcccgggcaaaggccacgaacugugcugcccacgcuggcaaagcuguguauguuacagcagaccagcaagaaauacucagagaacaccagccuguccauggggcacaccuucaauggggcggcuuuaaauggugcaccagggcuuuuuagguucacuuuugaaaagcaaaaggacagaaaaagccaagaguuaauugagaacucuagcuucacgaaagcaaggcauuugaauuuuagcuuacggguaguaaagacuccgguggcuuugggacucugcugguucccuuucacagccaccaaggucacgguguacucagacccaggcugcagauuucucaggggauacuuggaggccaagggucccacauuguacugcuugggcuggccuccucgggucaggcccgcggucagucgguagccugcuauacgggcucgagguggaguccacguuaccagaacuguucugucaguuucauugacaaacuggagguuagugggagcgucgaguucuggggaaaaaauaagaugaaaugugucaagaaacguuuagaucaguaacagccaugcggaaauccucccgcuugauuaagcaucccaagcucccuuacucaagguuggaacuaaagucagagccacagcccuggauaccguggggcucugggagacucaggauaguguagaauuuugccgaaacuuuaucaguuaugaaaauucguugacccuuuucacuugucuaucauccuuuggaaaggcuacuuuucccaguaaagauuuacccaccacccuuggaaauuauagucacauuauaauaacaguauuacuuuuuuuuuucuaaagcaaaacaaacauuuugcaaaccccacaauuuguuuugggccagaaagguuaagggagggggcuaaguccaacagaguuagggcaagaaaagcuccauggguccugcaggcaauaugcuaacguguauguucauuggcugaccuaaccucugcuggagaaauaaaagcugccucacauggaucuaauuacaauaacuaaaacagaugggcagaaccccagucccauggaguaucagaaagaaucacauagaucaccauuuuucuucuuucuaaggaugauaacugggccucccauaggaaguuagaacaucuuugauagaaagaaccuuccagagguggucgaguguaauugagaacauacaugagcuuuggaauccaaaccacugucacuuccucagggaagaccuuaggucucuucccacauccaacagaaguagcauuucccuuugcacaugucagcuaaagacuuaagagccagccagguucugcugauaaagagcuaaauagaugauaccucgcugcccagggccacuaaauguuuaggaugaauuacuuaagguaucaacucguuguguggugcuagagagagaacccagggccucacacaucccagacauacauuuacacacccugcugccuggcaacugcuagccucaaaugaauucuacuauaucuaacuacauauauuuuuuuuucccuuugguuuuucgagacaggguuucucuguguagcccuggcuguccuggaacucacuuuguagaccaggcuggccuccaacucagaaauccgccugccucugccucccgagugcugggauuaaaggcgugcaccaccacgcccggccauauauuuuuuaaaaaugcacuuaagggcuggggauguuguauagugguagagcauuuuuugauucacagcuuaaagaaaggaagguuaagggaagggaagggagggagaaagggagggagggaaggaagaaaaaagagggaaggaggagggaagaagggaggggaaacagagagacaaaagcacugaaauugcaucuccauuagcaaagaaaacucuaacuccagcagugagcauguuggacaugacaugcguguuggaagcauguauguuggagucagcauucucagaacgcuaguuucauuccaccuucaacauuccuuucaacucgauguucccuaacugcugagcugugaaccugggagugagcagcaugcuauggaguuaucccagguagagcugaggguucagagcuggaaggagggggccacaagacaggcaggcaggccuggaacguacugguggucuguugugccgucagaggauugcuuucccugcccuggugcacagcaaagacuuugaagagguacgugaccccaggggacagcccagugauuucagcaaagguauuucuguugacaggcagccucugcccauguuccccgggcaggcugacaggcaggaccuccacacgguauccagacaccacacuaucaggagggguccacaugauggugacuuucacaucagucaguuccacaaacuguagguccgucggaggggggacguuaucuagcagacaagagcgaugagucagucagucacaauucccacugaagguugaugcuagaaguuagcucccugaacaauuccgccaucucuuagacccacucauucuaggccaauacugggcuuugccucuuaaucaaaaaauaaauguguguguguguguguguguguguguguguguguguguguguguauacucaugguuagucaaacugauauuggaaucucuauuuaguaucuauagauaggcauguuauaacauaaaaccaaguuaaaauaauauacaaaaauaaauguuuucacuuuacaagacagcugguguguuuguuuaacugacucauuuuaugguaguuaagagaacagauuuucuuaagaaaaugguaguuaagagaacaguaauucuuaagccucccaggaaaagaaagaggagaugcugugaguuuuuaaccagaaaacccaauaguugccuuggauaaauaaauuccuuccaagugcugacauuuuagcauuuaacucgguaguucucaaccugugaguugagaccccuuugguggcagaugacccuuucacaggggucaccuaagaccaucagaauucuacacagauacuuacauuaugauucacgacaguguggcuauagagcagcaugacacuaauuuuauaguugggggucaccacagcauuaggaagggugagagccauugauuugggugaugggggacauagaaagagcuggcaaagacaaaaacagcucccucucagggaucugucacccacgugaccugcaccucaguccucccugaaggcuaaagaaugagucuaauccacgugggcuuuaucuuccccuggaagguuagagcggcucucuggucuaguccuaagagaucagacaucagggaaugggcuguuuuuaaguuaccagaucuuggggugccaguggucucuuguuggaugaaaacgggugugcucuccugguucuccuccacagcauagauagugauguuguacugaacaccgggcugcaggucgcugagggugacggaguuggccguuucagggagguugagcucugugcuacugccuucuacugaaggugaauagacaauucuauacccugcagguuuaggagaacagcguuuagacacauggucuucagaagcggaggcuagacaaauuauaacucuccuuucucauggcuaagaaucagcaagauucuuuccgggucuuucaauguuaccacuuccucugauaaugccugacgggcacagaaauaagaauaaguugauaggaagcuuuuaauaaucaaauagcauccuugaacccagagauccuuaaugaaugucaguaagugaugccaugacgugagacauucauaguacuagcggcuuucccuucucggagcagaggaauggaaucagccugagcaguguuugcaccuuugggaacuucacuggugaagcuagagcggcgacucagcucccucuucagcagugagcagcagcucugcaggaaucacccaccuguacagcccgggaacugcccacugcagugaacagcggggcuggccuuauagguugcagaugcagguauuaggaaugggggcgugugaacagacuugaaggaaaacgaaucaaaaacgaagaaucccuggaagauuugaaguggacacacccacgcacgcacucacacaugcacacacaugcacacacaccuccaaccacuuaaaauggaagauuuaaggugguaccagugugaucagaauuuuccccuuccacaucuauacaucaaaagaaacacagaagccaaggaugaccugugauaggugccuggggucuacuccaccgaacaacaauggaaguaucaucaaccugguccacgguagggucuggaggagcgucaggugcugaaagaagaagaaaggaaaucagucaguguugcuacaagcccacgcguuacagaaaaacaaaaagagucuucaaaaauuuguuuuuuaaaacagugguucuuacugcaggcuagccuggaucucuacccucagcaucccaaagcuguauguaugaguguaaguaugugugauuaugauguauguauguaucguaucacccaccauaccaccauaccccauaccuaaaguugcuuuuaucauggcugggugcccacauaccuguagucugugagguagacaggaucaagcucuguuuucccuccucagauaucugauagacauugacaauguacuuucugcccgggagcaggucaggaauguucacggaaguggccgugcuugggagaucuuuaaaauacagggcaaagguuaguggccugagcaaaccaaucuuccacggcuucuaagagcgcuauacucagagggugaaagcccacgagaaauguucuagugaauagccugcaauuuccaauguaaguaaguucuuucauuuuccacuuucccccacccccgaagauguauaauuuuuaauaacaucucucuguuuuuuuguuuuuuaaaacagagcugucauuagauaucagaguaguagccaugguggaaggaaggaugacagggcagggguuggaaggagauucauuuuuaugaucuggguccuauucacauguauguucaguaucuucucauuauuacauugguggggggggggcguacacacgugauggaggucagacuggagggugaacuuggguuauaaggcuuaggggugagggccuuuacucacugagccgccucacuggcaccagcaaauauuuuuaaagacccccucaucacugggcuauuuuaaaaguaaacaagaagguaacuccgcaccccuaaaggauaacauugucagccauaggccucauccuggucccccuuccauggcuaugagaaauacacagcaccagaggccacaaaggugcccagggaaucccagccuggccagagaggagucaccucucuccuggcucugaugaaagggaccgucuuccguuugaacuguggaggcguuccggaaucaaaacuccugcgagccaaguaaguaucuagaaacacgagccgaggaagccagacauucuacuuaccaagguacugugguucaucucccuccucgcucagcucauacuccacccggaagccugacacggugucggaggcugagacccaugagaccacaaagcugcuggcugugauuucaguuacagauucagaaguggccacaacaggagaguagggcgcagucucuccggucaccguguugccuagaggaaugggagcaggggacaagagccuuugauuaucuggaauacccacgcucucuguguucagaggauguucaccauccgagcaaagaagcagcuaaggacagaaccuucucuggggaacccacgucugagcagugcaggcacagccccaacagaugcuggcuacguacuggucacaggggugcuggcgcugguggugaagucgaagcgugucacuucucuguggccauacugcuggaugcugaugagcugucccucauagaucacaccuggggucaggccuuugaugguauaggaguuaagguggccaggaaugguagcuuccuuccagcgacccguagagguuuucugaauauguaaaaggaaaaaaaacguggugguuagucaucuucaaagaagaauggaggauagauaggauucucgaggcucuguuuuggaagaaagaugguggaaaaccugacugggaacagggccucuacaguuugucgauguuaauuaauuauucguccaagugguugaccaagcacucagggcuguuuugcuuguuuguuucucccccugaucuucaccuuccugccggaagugaagugccucacugcacuuuacagguggagaaaugagguuuucaaaguuacacacuugaggccucgaaucauuuaagaccagcgccaucaauucagccucuagacuuuugugguaaacagaggcacgucucucuucugaagugagaaaaggccucacgcucuaucuuucaacuuggugggauacauuucaagcuucuugccucgcgagacacugaaaaguauaauaacauugccuggacucagauccuggggccaucacaaacaagguucaacgugucugguggcgugacucauccuuggaaaugaacgacccaucaagagucguuagccaacucugggaaagacugcagaagaauaggguucgguuuguuuaaucuucccccuccaguuuacauuuuuauauccuguccagcuucauuaauaugucauggaccacagaacucauugcaauagauuguguggaaaagaaacacccagacuucaaacaagaaauccuuuuaaguguaaauauucuaaagcgguuuaaauaucaaauacaugguuaaugcccagugauuuuuuuuuuuaauguuaucuaaucaaguuuguacauacuucaaauguucuaaugcccgguuuuuuauuuuggagauaaauaaaagugauccaagcaaguucucuuuaaucuuuaguuuuagcucaaauaugcugaaagaaauugaaguuagccauuuuguuagcuuaaaaauuagcaauuggccaucagaagaaaauaugagaauauaaacucucagauggccuacauuuaaaaaaacgaaacaacagaaauucuuuuuaaauuuucagagccauggaugcggcucgguuggcagagcacuugccuaaagguggccaaaguccugaguucagucccuagcaucacauaccaagggggagcugaaccuauaaucaagcacucagcagggagaucaacgugagcuacguaagaauaugaagucagucuuggccuaauggggucaucaucucaaaacgaaacacaacaaaaccgaagcuaaaauguuugcugagaguuuaaucaaaugugaagacgccucaacucaauguguauuucgaaaccuauuuauaaaugccucauuuguagugacaacaugggacggcugaaggaaaagagugagcucagcagaauggaauuccccaagaguuuaaauucgaccgagugaguugacguccuaagucagacagguuguuguagucuaggauuaauaauaguucaauugaguagauuugauuuuuaaaagugcauuucuccuuucugaaguagugguuuuaaauucugucauaaacuuuggagauggaagagggcaagucugagaagggacgagacaucaaggguuaauagacuaauaugagagacuccuugcuaugguuuuggcaucuggaugguuagaaaacgcuaggguuuggggguccuuuuagaaaccaaauauaaacccuuccccgcuccuccuucucucaauaccucauucccuucugucuacacaacucaagaggacuacaggacaacugaguugagucaaaagaacgauguucauuuagcugguuuuaaacucuggaaauaacuugaaaaugugauuuuaauuuuaaugacauugcaaauggauaccaaaauuucaaauuuucuuuccacauuggaugagaauaguuguuagcauuauggcuucuaagauuuuccuaagccaaaggccuaauuuaauuucuucuacauaucaaaacaaaaaaaccaaaaacaaucaaaaaacccugaaucuacauguugauucgacuaacuacauauuggcuagacacuaagaaaauaaaugucagcacuguucgacauggcaucagaucugucgacucaaaagcaguaacaaacccagagggcaacacauccuagucccaucaggucaggggucagaguccaaggcugcggagcuauuacucacaggucuccaucugagaauguacuuggugaugugugaaggcuccggggcauuccacuggauggggugggaauugggcuggcugggggucuccgugauaauuacuuggacagguccaguugugccugaaaaugaaaacaugccaucucuuuagcuuguguggucuuaaaguuuuacaaaacauggauguccauccuuaaagacuuuucgcuucucgggaaaugugggcaaagagucuaguuaaaccuucuacauugugacauuagcugaagaaaaagcacagucugauuugaccugguaaucauugccuuucccauaagaaaagcaauuagaauucuuuuucuaauaaauacgagagaaaccacuccagugucucauagcuugccuucuucucuggcuuucaaaguaagacgugggacaacugugaaauuuccuuaacacgaagaauguagcucagaauacagaccucaugugcuaauuacaugaaggcucuuguaagacaaauuccgaaucauggaggcuuucgggacagaggacucugcucagaagcaaugaucccaaggccuuacggcgugacacaaaacaaacauuucuaaauggggcugaauccggacaaacagacagagguaauaauuaaagcccaagguuuauuuccccaucagucuaagccuucucuccuuuaguguuuuuguuuguuuguucguuuuacauuuacuuaaguacacucuuaaagccacugugagcgaauuguucaaaaaaaaaaucuuuuuaagcaaucaucaauugaaaugacauuugaaagcauauauuuaaaauucaguauuuucagaucuugauaugacuguuauuaacaaaauuuaagauagauucagguuuuuuccuuggggggaaaaaaaaggcaaaauaagagaagggaaucaauuuuuuaauauaguagauuccauuuaggauaauaaugaaauuuuaucaaaaacucuguuuacagaauggaaauuuaucuucucucuaauucuuugucagucaaaauccauuuguacaaaguccuuacaaaaaccuaagacacaaaguucucacugaugcucugugagacagaagaaaauucugcaugcugauaaaggaguucucuacacuaccugcgauuucugagugcucuuggaaaaaauauauugacuuucagauuuaauuauggucuuaagcuucuaaauucuuuaaaagcaaaaucuucuuuagcagaauaaauauguaacuuacauauuuaugugaccucaaaagauuuugaacucaacuucuucauugggaauaacucagcuuguugaagacuaacacauauucauugagucuugauuucacuuaaugcuacaagcugaaaugucaaaauucucaucuuugcauccuaaggggcauaggacccacgcgccacacagguugguugucccauuaaucaacucaaguccauugcacagcccucuggaauagcuccuuccauagaugaagagccucacaaauacaaauacauuaaaaacauuucuuucaaacacuauuuaaagagguuucauaugaaucaguaaaaacagaccuuauguuauuagugacaaucugcauaaggcuguuaaauauugcuguuuuagaaaaauccuaguauaaucucucagguagauagacaugucucaugcaucuuauuuacugaauuugaggcuggaaaacuugugauaacuaaaucuccuugauaaaucuauuauuaagagaauauaaaugacauuuacugucuguccagucaucaaacccuguguucacaagggugacagaagacgcgggaaagggagggagggaaagaugcucgcaaugguuaacccaagugacucagaacuucauuuccuuucucagccuuucagcgcagaucugaaaucccauuauuuuuaauuuuaauuuuuaaaaugccuacauaugagagaguacgggugccggcaggagacagaggcauggguccccugagcugaagguucagcaauugugcugucuaaugggagggaugggaauuaaacugcguagggacuacaaccucugagcucucagcucuccaggccccuaagaugaugacaggguccaccuucaagugacugcccugaauggcaaaggggauuuaaagcauuucugugcaggaaugggaaggaaggaaggaaggaaggaaggaaggaaggaaggaaggaaggaaggaaggaaggaaggaagaaggaaaaccccucaucuguuuucuaggucaauuaaauuccagcucuccacuauacucuacacuacaacacaugauuuaaagaugggaaaguuaaaaaaaaggcuagcuaucauuuacacuacuuaaauugaaguguuuuuauauccccuuugaugcuggcuaguugugugaucccgaccauccaccucccuggaccuuuuacacuucuaauagcaaugcccacugugagaucuucacuuguagggugccacauuauacacuuucaaaaucaguugacaguaaggucagaaagagugauuuccgauaauagugacccuggagaaguuaaacauucaugauuuuuuuugacccgaaagguucuuucucuaccuaauuugcugagagcugugcuuuccugguugcuuauugacaaaccaaauuccugcuaccuuuuguuaguuugaacaucucuaccaaccuaguaggaagaacaaacagggcaaggcucagacacggucuuucagccaucggagccucaaaggcuaggcaugagcccuugagcaaagccuccauugagauaaacacugagccugcuaucuagggucaaacacucauccgcuugcccugaaaucucuucuguguucaauggguuuuugacauugcccuuuuuagaaacagggaacaaagucaacagguaaaacucccgcuaggugacucuuccuguccaucagcagaucuacccucaaugcuugcagcaagauauaugugaauagacuuauuuuuaaaagaaaaggucuuaaaagaaaauaaauuucaaaaauugcccugcaaaaacugacugugaacacaaaaauaaacuucuauucuuggcuuguaucauuggaaaauccaauccuccuaaauauguguuuucugaauuuauggcucauuuguaaucagauuuuuaaacuauauuaaguugaccagguguaaugugcacaccugugaccccagccuuuuggaaacaagagacaggaggcauggucagaaguucaaggucaucauuggcuacauaguaaguuugaggccacccagggcuagaugagacucaaaaagcaaaacaaagcaacuggauucaauuuuuaaaaauguuaaguaacucacucuugguuuuguuuuguuuuguuuuguuuuguuuuguuuuucgagacaggguuccuuuguuauagcccuggcuguccuggaacucacuuuguagacuaggcuggccuugaacucagaaauccgccugccucugccuccuaagugcuggaauuaaaggcaugcgccaccacgcccggcaaguaacucacucuuaaaccaaaguccagcaaaaaugcaggcugcucugagcuacauaguugcggaagcaaucaccuauccuacccugacaaugucuaagggcugagcggaggaggauguccccagcacauaaaaacaaugagcguauucuggauaugggaggcaugcaacucuaaucccagcacuugggaggaagaggcagguggaucucuaugagucugaggccagccugguccacaaaguagccagaguuacacagugaaacccugucauugaaaaacaaacaaaacaugauugcaugagugguggacgggugcucugggucucugacuguuagugaaggacuggaagcaauuuuaaaggugguuagcaagucucccuuuguccacaggagaaguuaacuaguaucucucucacagcacagucagagcgaggacucacacugccuugggcucucaucguucacuuugggacacucuuaggaagauuaguuuaaucuuaguauuuaaucuuaauacuuauggaguuaauuuauuauuauaauauuuuguauucuuguggauuaucuccccccaccccaaaucuuuuuguuucugaauacaggugguauuucaugucuuaaauuugggccagcaagauggcucaggguaaggugcucgccucccacaagccuguagaccugagucugauccccacauaaagaaucgugugugaagaaagaacuucaaaguccacucugaccuucacguaugugcugugacccagugcccucuccacacacauacagauaaauaaauaaaucauuaacggaaaucuaggagucugcugaaauggcacucauaaucaacgugugaauuuuaaauguuuuccccaaaaugaauuaaugccuauggcuaggcaugaugucucuaugggagaacaaacaacaaccaaacaaaacaaugagaaccuagcaauaaauaucaacaacaaaaccacaauaaauauuuuaagguauucgaacgguguggguggaguugaccaaguuucuuggcuccagauuuuguuccacauuacaucucacuaaacaaaugaaaucugacacaaagaagggcuuaagauggcaggaaacaaauuuaugccucauacuguacuucuugccuucugucgaugugacuucucuuuaagaaacagaauguaaaacucuuucacuuccagucugaguuacuuuauggcucuacuugaacacacacacauacacaugcacgaaugcaagcaugcaugcccauguaugcgcaugugcacacacauguacacucacaaacacaggcacacacacucacucacacauguacacacaugcacacgcaugcaugugcacauacauacacacauccacacauguguuugcacaagcacagauacacacacacacacacacaggacugagauaaaaugaacugaaauguuuucaccuaauggaguccucaacuguguaaaaugcaaaauuguagcaugcacuuuuucauagucuuuggugauuuuucccugaugaagggugaaauaaaacaauuuaagacaaaaaugcaauuaacuauuagacaguaauaugaaaagggaugggacagagcaaggcccccacugggauuccaaauaguagcauagacuggcauccaugggucugcuucugucucagagcuacuuaccuggguaggucugcagagguugacagugccacuccccgaugccacggccguagcaguaacacugguaucggacaccaugcacaaacuucucccaggagucaccaaucugguaaaauguccgggucucugaaucuuggcacuggucuaaaacaaacacaaagaaaagauuaaaacagccucaaacacaucacuguagugugaugaaguguauucuuaaaguaugaauauaaaaauuccaguucuuacaaauauaguuaaaguaaguuauaaguguauguguuugugugugugauaugugcuugugugugagauacgugcauauguugugugaaaccauuuccccaguccuaaaguaauauuuuauucaagucauuuaccuuaugggaaaauuagucguuaaaauuaaaauguaccuuuugggaaggauauuugguguccuacaggggaaacauugcuaaauuuaaaaaaaauguaaagauuaaaauuucagcauauagccaaaaucugaaaauuaauuuuaggaaacuagauaccaauuaaaaguuuuaaaacuugccaucuguaaaauaagaaaagaacuuugcaaugauuucauuuuguguacuucuucggaauucaguagguagcuuuacauuaaugagcuaaauuuaaagcaugaacagcuuucuaagcaagccucccgggaccucucggcuuuacaaucgcaggccgaacaaacugcugggaucaauuugcugucucaguaagcagucugccuccuucaguaaaggaguaagaacugauuaucuuaaacuuuggauuuggggaauaggcuccuuuuaauguugaucgcucagugauggcccagcccuaucuauuuaucuacuuauuguacagagaggcaaaagcugaaguguuuuggccggaggcaggcaucuacuggcugaguccuauacccauguuucuuuucugcagucaguaacgaaacuuccuuugucaugacucagaaccaacaaagcuaaccccacucacucacugcaguaaagccacccuuguuaccaacacauuugcaaggcucucugcagacugauggaugaggcagguuuggagagaaggaagucuggcgauaccaaauagcuuuccuuaucugcaaguggccaaccaaccaaccaaccaaccagccaacguccucggugaaaaccaaccaagcagaggcggccacuuaccaauggggucacacuuccaucugccccggcccugaccaaagcagguacaguucagcauaugucccuccucgugacgcuuguggaacgugucguucacauuguaaguaaugucaucaacgaugcacuggucuguccagggaacaguugggugagugauaagcuuugacuaaugaaaucaaaagaaacugcauuuuuucaaggcagucaguucuacugcuggauuuaacaccugcuaaaauacauuuucuacuggcacagaauaaucuuuuuuucaaagcuuaauaauauuaauuuuuacuccccucuuauucugacuaauagacuuguaauugucagggauuacaguccauuaaacuaaaagccaugguaaaauauaguuuccuguggagaaacuaauuucucaacaaaggcaugccuuaguuccucuaacauccucauuuaguugaugauuuuaguuaaauuuuugguuguuacccuaagacgaagagagaaauuuacauagcauacaccaccaugugguagucuccuuucugggauggagagcagugugcgcugguuggguuuuaccaacuugacauaaucuacacagaucugagaugagagaaucucgauugagaaaacugucugcacaacacuggccugcaggccagucugggaggaacugauuugaugagugguuaacuggaggaggacccaguccauggcaggcagguaguguuaccccugggcagguaguccugagcuauauaacaaaggagguugaacaagucaggggagagcaagccuguaagcugggcuccucggucuguggggccucugcugcuucaguuccuaccuccagaugccugccuugacuuccugcccugacucuccccagugauggacuguggccugaaagguguaagcuaaaauuaaccuuuuccuccccaagaugguuugguuugguuggguuugguuugguuuugcucaugguguuccacagcaauagaagccuaagacagaagguaauuggaucugggaaauacaaugacaucugugauguucagaaaguuuuagaauguaaaucaaugcuguuccucacucaaugagaaaucccgaauaaguuacauucuaucuuugggaccccauuuucucaucugucaaacuaagggcuguuuugcaugucuuauuaguuuuccuccugcucuggaauguucuaaguaacaaagaggacucccagauaucucuagccauuggacaccauuaaaggaaucaauguagggcgcacuguuuauggacuggcuaugggaacuguuuacccacugaguuccaccuaaauguuacuuuuccaaucaaagaagcugaaauugcuuuaauacauuaacagcuccuccuaucacacaucugaguccaaaggggaaaaaaagcugauuugaaaaaaagaaauuagucugaggaugugauguauucaucaccuuaaauuugacaaauagaaaauauccauccauucccgccccucccaccccccccaccccccccacccccggcuuggagaaaugauaccaucuucucuagacauaaacacgggcagaaccuugagcuaaaaggauuucaaauauugaucucucuuugggaaagccauccuuuuggcucaaccuaaaugcuuacauccugagaauauuuccagagcccuagaacuauucaacucacucgccagcuuuucucagcgggcuccuggaaucaagagaccucuucagcacagcgggugaguggauagcuacacacugcaugcuucccucucugcuuuugcaacuacaggcuuucacacaaacucucuggucaacacaccagcauaccucggagcugggaguaggggaugcaggcccauucuccacgaccguuccccacacacgugcaccucaucauguggcccaggucaugcugcuuaucccacugauccccaaugcgauacaugaccccuucauugguugugcagaucuccucgugggcugguuggaaauggaggagaaacacuugguaaacagccauggaauacaaauggauaguuaugugaagauagcagucuuguuugauaauccugacaauucucucuccuuugggaagaagacuugcaugcauguagcuggaugaagguggaguuuugaacucuccaggaaagaaccgguccagaggagauuggagagaaauaccaaaagggcugaagaagauuagacuaggaaaaucucauauacucauugauucucguugucuagaggacuggauuuaacuauagccuugugacuucaccugguucacucaaguucaaagggaaacugugagcauaaaaucccagguaaaagugacugucccucuuaaacccaaugucaucuucuguugaaaugagaaaaacaaaaaguguaguuuccuugcgucugagcacaugacucuccaugacccucaggcuauugguucuacaacuggaaaagaugucuucuaccggacucucgaaacuuaaaaacaauaagcaaucccugauuccucuuucuguauccagguaaaaugaggacagcucuguauuugccagaauacauugccauugacaguuuucucaauuugcaaauguaagauauaauacauagaugcacaucguacucucccagaccaucaacaggcugcuagcggguccacacccauaacucacagggcuuccucuuaccagccauugggcagaauccaaacuucugaucggcaucguaguucuggguggugccgcaccauuucauguugucccugcgacccucagaaguacagucgguguaauuccgguuguuguacaggaaggggaaguggcacagagcaccauuggaauuuccgccucgagucugaaccaaaacugcccaagacaacacacaaacccgaagauuacagcugagcuguguuguguacgacaaggagagacuaccgcaggcuuagacagagccagguuccggcuguuaagucccagagggccuauccacaaauaaaaagauaucugauaauacagcccuaagcuucuuaguggauuuucaucuucacuuucaaaauagauuuaaaucucauguuuucucauuuucccagccaaggggggaaaaaaaagauuaaaugauagcuuuguguaaaauucgacucuacacagaagauaaguaccggcacccuugacauuuauccuguguguucaucggcucugugggaucauccacugauuucaauacuugagugucuuuaaucacaucauaauccccaugugucgaaauaaucaaaccauagggcuuuucccucagugacauuuccccaguggcgcuaagggacauggaaacugccugccucugcuaagggauuagcuguggguucaaauagaucaaagcuauaguucccgugcagccucggaaugacugacugacugcuggcacacagaagggugugcacggcaaggacagacagacgaccgcccucucugguuccucccaggacacucacccgcauggucugugcagaaggaauacuucuggucuuguucguaauuggaaguugugcuacaccacagauguccgucuugccgcccuucgguggugcaggaauagaagguccuaccguuguaggugaacgggaggacacagggcuccccguuugaauugccaccauaagucugggucacggcuacaagcauaaccaagagucucagucaguacaguuguuucccacccucaccucugaccccaguggugacaaauuucuaauuuaaauggaaacugugcuacuaaagggccaagaugaaaagucuagucagcugguuaagggugagccagaguucuccuuuuaaugucuuugggagacacuucugcuaccgugacucaguuuccccacuuguaaagcuuuauuaauacaaauuauuaugauuugaagacggcacagagcgauacaugcuugcuuacauucucagaagaaacaguauauauggcugcucuagaaaaacaauuauaaaagagagcauguuugacccagaagaggccaugugcugcuaaaagacaucuauaauuccaaauugaacucagaguacagauuauuggcuaguugagaaaaaacaaaaacaaacaggaaaaaaaugguguucuugcagcaucccuuucggcaaauacagauacuacaaagcaguuugauccucaugauaggaagaaaauauacaaguuauaauacuagagaagagccgggcgugguggcacacgccuuuaaucccagcauucaggaagcagaggcagggggauuucugaguucaaggccacagccagggauacacagagaaacccugucucaaaaaaccaaaaaaaaaaaaaaagaccagagaagaaaaugucagcuacuaugauuuuuaucacaggauuauaaacuuuucuggauuuaugguuuuacauuuuuuuuuacgaacagcuaagauacugcagacacugaauguagguccucuggcauccgugggcagauggugccuaccugucuccuggcagcugacgccauugcccaggcacgugcacagcauuugcuuguuuccuugcgacuucagccacugcauucccacagaguagaccacaccacugucggugacacaguggccguagggagcgggcugggggugagucugcgguugguaaauagcuguucggacaucagugaaggagccagauccuaagggcaggagaaugaaaaaguuauaaaacuggaagggagaagucaaugaguccagagucuucuuggcuugacccggaacuuccgcacucagcccaagaagugguucacaagacuccucauauaauccucaucggagccacaccugaacagcacaucuaagcgacaacauuauccugccgcacaacacaacagguuaucuuucacaaaccuucagucacgcuaggaagcgauccaucugugagcuccacaccccucuaccacucuccccucccgccuggcugcuagccuucccugcccuguucuaagcuucaacccacugagcugcucaucauuccuggguaccaugcuccugccuucucccuauggcuccccacucaucugaaauggucugccuugccugucuucccucauagcucucauaugcucuguguguggccuuuccucuuccugagagaccccugaagacccacaggggauauccugccuucucuaaaacuuggcucucaggaggacacccuggagagcuacggauuuccuaaguuaucccucuuccugggugucggugcucagcagaauuccuuaggaugucuguuuguuuuccuagaagcaaccaauccucacaaguuuccucggauaguuaacacaacagauugugcuagcuucucuuuuagaaaucuggcuuuugaaggucagaguccguauggcagcggaagagcuucuagaaugaaucuagccucuucccccagcgcugacgagcacaaauacccaaagagaacucagacagaggacgccaauggugucaaggcccaccauacagaaggacggcaaggcccuccuagaagagguuguuucguuuaacaguguuucucaaacccuuuaauagugaaacaccucgguauauuagugaugccauaaaaauaguuaacacguauuguuuaaucccaguuagcucaguuaauccuucauguaguucagucgacugacauucguaacuguucuuccucugccuuauggccaauagcuguuuuuaucgaugauaauuggauaauguagagaucaucaaauguaaccuuguuugcuuucacaaggauuaauuagguccagauaaacucgucaaaaggggaaaaaaaucuaauuacuauugccugaaugacugacugcuaagaggcuaaguaacaaggcuggacuaucacacaguaaaagcuagauggaaacccagagcgcaauagcgggaagguaccacccacaagagcugcacuuccuucuuccgaugugugugugcaugagagacagcaucuuuuuuuuuuuuuauuuuuuuuuaaagauuuauuuauuuauuacauguaaguacaccauagcugucuucagacacaccagaagagggcgucagaucucguuacgggugguugugagccaccaugugguugcugggauuugaacucuggaccuucggaagagcaguugggugcucuuacccacugagccacauugagcagguuugacuagaacucacuacguagccaaggcugacucuggacuucugauccuccgucccucuacuuccugaucccuggaaucgcaggcacaacacacccuccuuuuauuuagugauggggaaccagaaccagggcuuugcgcaugguuggcaagugcuccgaccccuuccucagacucugaccaagcauccaagauacauacaaauaccuuucuuuguuuuaguuauucuuuuaaauuuauauaauaauuauugggguguuuugggagggugcugggaacugaacccagggcuugaggauuccaaguacauaccacacauucacucacuauugcuuguccaugugagggagggugcaugcacauuaucuaugugcgcaugcguguggagagcuugugcauguagaaggcagggauuaugcccagagccaucuuguuuucuaugacaccaucuuucacaaaccuagaacacaacuucccccaacucccccaagaaaagugggcuggccagccacaccaucucacuaaccuggaaccacccccacacuuccaaaguaguguaagcuggcuggucuguaauccccagguauccuccugccuccaccuucuuggugcugggauaacaccaucacacuuggauauuuacuuugguucuagacugaacucugagucucaugcucauaagccaaagccuauacuaauagagccaugaccagaguacacuaugcuuuccaacccagcccucugugcuaaaggcacgucucaacuucauuccacucaacuuuguucacaauauagaaugaauauuuuuaaacaguuaugugaacgauuccagcuucuuagcugaaacgcuauaaaucacccuggcguggagcuguccccggucccagcgccucaccggcugaagcacuuuguagagcaugucgcucacacuuccacuccccucugccauugccugugcagacacacugaagcagguuuccucgguuguccuucuugcuccacgugucuccaauccuauaggauguccggguguccugaucguugcaucugucuguuucaggagagaagcauugaauauagaaguuaucuaguaaccgacacgcagccauccacacuaagaugggaaugcugcaguugaaugcuucugaguggcuguuguugguguuaguacauccuacccagugcuggugaugcauauauuaaaauucagauacccgguucguuacaguacagcccuaccucuccauuugccaaaggaaaaaaagaaaaaauacuauucagugucuuuuauugauuaaaaaaaauuaagauuuucuacauugguucuuugacucaauuaauuaucuggcaaucuacucuuuacuccucagugucuuccagaccuuuuucuguaauuacagcccauggcccuccuuucaauaaacaauaaggaggcaggucucuuccgacugccccagggaagcuaaaaaguuaaccacaccaaucucuccacuuguuauguaaaaguauuccuguggaaaaacaacuucucuggcuagaagguucucuuuucuugccccacccaaaaccaccuguuuuacaauuacaaagucacccacgugguuaaccccagcgucugggagguaggagcaggaguguuaagagcccaaggucucucucagcaacacaguaaguucuaggccagccugggcuuaugagaauccucccuguauaauaguaauuguaauaauaacagugacaauaaccaauagcaacgacaaaauggcuuaucccacgguuaaaaggucucuucuggaguuaaggaugcugucucuuauuauccuuguaaaaagcuggccccaggcauccuucuucccucccgcuucuaagauugucuugaagucuuaauugcugcuucugccuucaaaguuccauuuagaauuucaaacuaacaacagccuuggaauuugcugaagcaugaauuuuaaaacgcaugcaaaaaaaaaaaaagucaaaucuagauaucuugaauguguuuuguuuauccagcuuaaacuaguaauuaaaaauaccacccaaguucaaauucuuugccacacaaaaauaagucauggaaaaagaucaaauguuucccccaaacuuauaggauccuuagaucuuuugauuuaaaacugugaugagcuucagucuuccaagucguuuguggcaguauuuucauugaagacaaauuagacaucuaauucugagccacugagcuggcuuagugaguaaagaaccuugccaccaaaccugacaaccugaggucacugcacccugcgcgguccaaacuguccuuugcccuccacaugcacacuguggcgugugugccucccaccuccacacacaaaauaaacacauguagaaagaaaucuaauucagacucuuaccuaucauuuaaaacccuucugacagcaugcaaaguuucucaaacaaauagcaugugaucaacaaaauuuuauaaguacuuacuuuguauguggcaauauggggagggaaauacgaacugggcaucagccuucagagaacacuuaguaggucaaagaugaggaaggcucauguauuaaucacuuacaaagcucagcauuaggaguuucaagagauacugauucaaagauacugaaaacagguucagguuugacaacacuguuagcuggggucuuggaccucuguucuugugugucuaugcauuugccugaaucaaugguugauuuuuuuuuccugacacugcaaaugcagcaauauuuaagucacaaaguuagacccuuacugcccacauuguagcguaagagcaaggauggguuauaauuuaacagucucucugcccaaucgaugaacaaacaacacacagaaauucauuccacuuuccuauuugaaggauaauacugggcacggacucauuuccacuagguucuuguuuagagucaguaaaccuuauuuaaacuucaaacauagaaggaaauccgaacaugggguagagccuuuuauuuccaaucgcucccccaggucaaaggauucauuuacaugcuacuuuagggauuuaauuguccucgguaccagaaagguaucucugagauaauucccagaucaaggaagacccauccagcaagcgaauaccacuaaggcucuuuucauuuuuacuagcugacugccuaaggcaggguugaacugagaacugccuuuccuaguuauugaguguccucugaagaagcagaaggugaugguuauacaguuuuucuggacaucuuaugauaccacagagucaccaaggcaucacaacucucucuagggauccagaagcaacagugggcugcauugucaacagaaaagagcuaaaccuacuucuggagguacaggugaugcguccauugccuucgccuagacaaguacaguccaccaucauccagccuugguagggcuuuucccaggucucccccacgacguaggacgucccagcagcaugaucaaaacacuucucagcuggagaagaaaugggaaagcaaaaagaaaggaggaagagcgauuuaaaaugauagcgucucccuauaauuuacaguguagcauggaaucaaaaccccagccacauuucuuaaaguggcacucuguucagaugagcaggcacgcccugcagcuaagcacggagcaagaagccggagcaagaggaagccccagccuugcugcaaguaaauucuguuguccuaaugaguacacagaccggauuuuucugccugucccaagcuucccacuaacauuucaaguggaaagaaaugcaagucuuuacccugugggagacgacccuaugcaaaaucccaaccuuucucuuuuaacucauuaauucaguccugggaauugaacccagaaccuuauguuagccucagcaagugcucucuaccacugaucugugugucccuaaacuaaaccacuauaaaauaugaacgacuuacaaagaaugagaggagcgcucuuuaaauuuuagacuaauguaaaaaacaaaaacaaaacaaauuugaaaaaacacacgucugacuuggagaucuaagaaagagaacccaaaacuuugggcuucagaguacaaccaaggcuaagacaaaaaaacagaaaaaauaaauaaaacaaaccaacaaaaaucccccacaaccuuuaauguuuguuuuuaaggaaauugccaaggugugaccggagccacguggcauuuugugcuuuaacaaacuguguuccaacaagaaaugugucaauaguguaauuuuuccuccuuuaaauaacaugucuucuucaccaaggggacagcauaguauauaaacaaaagaaaucacuucuuccuaaagauuuuaacuccaccuugugcuuuucaaacaaaauuaagauuccuuuauguuccauaguucaggaucugauuuccuuaaggcuggugacucgcagcacauuucacugguuuuuaugcugugauucagcuaucccggccacugguuugcuuaggcuaucugcuuguggcuccguuccccucgaucacacacacgagccacuuaccuauagguuugcagguccauuccccuuuuccauuucccagacacagacacucuaacauguagccaccagucucauguggccuccuccacuugucgccaaucuuguaggacugacccccuucauggcagcgaucuguuacagaucaaaggcaaacguuaggggauugagagaauucagggggugcucaucucauguucugccugagauaaauaaguauguauguuggccaaaaugcaaucccuaauccugagggauuuuuuuggcaggcagcucuccugccaaaaaaaaaaaaaaaagcagaaagaaggcuaacaccauaucagcccacuuugggucaaucguuaaagcacaaaaaggaaagccauggagaacucugaauggcaagaagucauaaauugugguuccccggagacaucacaggcaaucuguucccuagacagagaagagcugggggaacuguccuccuagacagcaaggugagcuacuugggcauagcauuccgaucuccuggaggacggagagccugcauucuacuccaggguggaaauagcacucuggcagaaagcaagcagacacacucaugaggguuggaaacccugauacuuucuuaggcugugaaauccaauggcugaauuguacgcagggucacaaguguaccaucgacucuugggcuuugccaggaaacuuggaaaaaacccucauguuaaauguuggaaauauugauuuggucuauucagaagggacuaauugguucuuuuggacagaggacuuauauuuaaaaguugguuuuuagagagaaagucuuauuaauagaacguacuggcaacccaaugagucacacgagaaagacugccgcagcuguagacuuccugagagaaagcccaggaccuaaaguuccuuggagaugcacugugcucaucagccuguguugaauuugagaaccgcaagguuuucuccccaaaucuaaucuacucaucacaaagaaccagacuccaugacaaagagcaaaaacccuucuggcucauagcugcagaggauaaaaugaucaaucuggcuuaaagaggcccagauaauuuaaaauagguaggucccuugggcauaucuuauugaaaagaaccaagagaucuuccacuguccacacacacacacacacacacacacacauacagagagagagacagagagauuccaucucugcuuagauccaucuuccagauguagaggagcuaggugggugacgacaugggguuuggucauugaaguaaaaaguauucacuauucagucagggauaacaggaaaaggcaaggacaggccagagggaaguguguauaugugaccucaauaacuccacagaaggccucucuuacuugcaaugguacagcugauccugccucucccagccccgaugcagguacagucccagaucauggaaucuuuagggcgcucauaagugucacccacuuuguaaguguucccaguguauuugucaaagcaagucucuucagcuguggaaaggggaaaaaaaaaaaguccaugugagucucacacacauacauggcgacucugaaacuuaagagagacaaguuuuuaaguuaggcuuuaauaaaaccagagcucuugaccuuuggccagcucucagcgguucccuuauuuauaauguaaagaguucccaggaaaaagccacacccugugaccagcugaguugcagaggaaagauuccaaauuccagucucaaaccagggaaaucaauucaagggucacaagggacacaaacaguuugaagguugccggccucccagcaguggcuggccuuugucagccccacugaaacauuuguccuguacccucccucagcagccucucugaagggacugcuguagcucaccggaagcguaucaaggggcuucaggagucuccgaagugguaguggguuguuguuuuuguuuuuuucacggaacugcagcuaacaaaucacuuuacaacccagugccucaaagcaacuucuggcccauaauugggagccaaaagauccgagaucacuuucuaauaaauuaaacuuuuauaagcaaacuuuuauaaguuuucuuuuugaagggagacacgcaaaaccucucauuuucuaaucaaaagcuccaagagaauaaaaaggcggcuuuggagacucguguggauuacauuuguuuuagagguaagagcaugugaaaagccagugcaagaagucuaauaagagggaauuacaagcgacuggagcagggaggaggagaaggcaaaugugguuuuacuuagagcaucaucucugccagggcccagacugccuuccacuuacgcucaggcuugcucucgcaguuaaaaccccggcuuccuccauagcagguacaaaccagggcguugccuagguagguccguucccacugcugauuuaucugauagugcuucccauugucaaaacagccagcugcgaagaauugauggggaaaguuauuaacaguuccaucccucccucucuuuuuuccccuacaaaacuacugaauuuugccaacugacuuggugagccugcacaaacaaaaaaacucuuaaaagcaauauuccacuaaaguucagauguggaaacuagcuaaucaaagauuuaagcauuguuuauguagauggauguuuagggguuuuuuccuucuuaucuuuuaacuuggguaaaaguuauacaaugacgucauguccuuaugggcaggggaacuaccucagcagacuugaaacacucugagaggccagaaauagaaauuacuuuuaaauccugagggcuucaauacucuuaacaacaacaacaaaaagacaagaaagaaaacuuaaguugggugucuugaugacuaugccaauaaccccagcucuguagaaacugaggcagaagaauugcucccaaguugaacacacaagccuggacaacacaggagaaugccaggcuagcuuaggcuacagugugagaucauggcaaaaaaaaaaaaaaaaaaaaaaaaagaaaaaaaaaagaaaagaaaagaaaagaaaagaaaaagaaaaaaaggagggagaacuuuuaaauuuuccucuagcccaagauaaaggaagagugugucucugaaaaacuggaagagaaauggcuauccuugcucuuggggaaagaauccuaggcuacccccccccccccaaagcacugagccaacuaacaucucuuucaaguugguaagaaacuaccuauuuagauagucucaccuccuccccguguuaaauauuuaaccagcuauuugcugauaaagaaaauaaggaucaggggaaccacaauaaucucugauguaaaauuuguaaguucgugucucuuuucucuuucacacguuuugguuccuggaagggcgaacugaagguguagaauuuguuagcgcacuugaggggaagaacagacggucccuaccuccacuucaccagcaaccagccuguucagaccuaagccuuuuguguccacagcugguuucccucgauaaagcgcgcacucacacacguucgcacagccacgcacgcgcgcaaaaacuuuagccacaacuugagcgggcgcuugaggaccaacccaucccugccgccggccgguuugaaccagacugucgguacucacgcuugcucugacugacagccaccggggauugaggcugcacgauuugcugagccugccucuugcucuucccggcuucggugcagcgcaccgagguccccaggcacaggacugccagcagcagcagccgcccgggucccggaccccugagcaucuugaguggaugggaggagagucgcccuccccaggaggcaaguggccacgaacuguggguccccucgcagccugcgggaaaaguccugagguggggacgccgguaaggagauggaaggagaggaccagaaguuguccggcucacacccugggcuccuuuucucccccugugcagcgcagcgggugcgagcgguugagccccaagagcagaggcuuauaugggacaguaccuucccgccccccacgaggcccug

SEQ ID NO: 207 - RNA, 67764 nt, Mus musculus
cagggccucguggggggcgggaagguacugucccauauaagccucugcucuuggggcucaaccgcucgcacccgcugcgcugcacagggggagaaaaggagcccagggugugagccggacaacuucugguccucuccuuccaucuccuuaccggcguccccaccucaggacuuuucccgcaggcugcgaggggacccacaguucguggccacuugccuccuggggagggcgacucuccucccauccacucaagaugcucagggguccgggacccgggcggcugcugcugcuggcaguccugugccuggggaccucggugcgcugcaccgaagccgggaagagcaagaggcaggcucagcaaaucgugcagccucaauccccgguggcugucagucagagcaagcgugaguaccgacagucugguucaaaccggccggcggcagggauggguugguccucaagcgcccgcucaaguuguggcuaaaguuuuugcgcgcgugcguggcugugcgaacgugugugagugcgcgcuuuaucgagggaaaccagcuguggacacaaaaggcuuaggucugaacaggcugguugcuggugaaguggagguagggaccgucuguucuuccccucaagugcgcuaacaaauucuacaccuucaguucgcccuuccaggaaccaaaacgugugaaagagaaaagagacacgaacuuacaaauuuuacaucagagauuauugugguuccccugauccuuauuuucuuuaucagcaaauagcugguuaaauauuuaacacggggaggaggugagacuaucuaaauagguaguuucuuaccaacuugaaagagauguuaguuggcucagugcuuuggggggggggggguagccuaggauucuuuccccaagagcaaggauagccauuucucuuccaguuuuucagagacacacucuuccuuuaucuugggcuagaggaaaauuuaaaaguucucccuccuuuuuuucuuuuucuuuucuuuucuuuucuuuucuuuuuuuuuucuuuuuuuuuuuuuuuuuuuuuuuuugccaugaucucacacuguagccuaagcuagccuggcauucuccuguguuguccaggcuuguguguucaacuugggagcaauucuucugccucaguuucuacagagcugggguuauuggcauagucaucaagacacccaacuuaaguuuucuuucuugucuuuuuguuguuguuguuaagaguauugaagcccucaggauuuaaaaguaauuucuauuucuggccucucagaguguuucaagucugcugagguaguuccccugcccauaaggacaugacgucauuguauaacuuuuacccaaguuaaaagauaagaaggaaaaaaccccuaaacauccaucuacauaaacaaugcuuaaaucuuugauuagcuaguuuccacaucugaacuuuaguggaauauugcuuuuaagaguuuuuuuguuugugcaggcucaccaagucaguuggcaaaauucaguaguuuuguaggggaaaaaagagagggagggauggaacuguuaauaacuuuccccaucaauucuucgcagcuggcuguuuugacaaugggaagcacuaucagauaaaucagcagugggaacggaccuaccuaggcaacgcccugguuuguaccugcuauggaggaagccgggguuuuaacugcgagagcaagccugagcguaaguggaaggcagucugggcccuggcagagaugaugcucuaaguaaaaccacauuugccuucuccuccucccugcuccagucgcuuguaauucccucuuauuagacuucuugcacuggcuuuucacaugcucuuaccucuaaaacaaauguaauccacacgagucuccaaagccgccuuuuuauucucuuggagcuuuugauuagaaaaugagagguuuugcgugucucccuucaaaaagaaaacuuauaaaaguuugcuuauaaaaguuuaauuuauuagaaagugaucucggaucuuuuggcucccaauuaugggccagaaguugcuuugaggcacuggguuguaaagugauuuguuagcugcaguuccgugaaaaaaacaaaaacaacaacccacuaccacuucggagacuccugaagccccuugauacgcuuccggugagcuacagcagucccuucagagaggcugcugagggaggguacaggacaaauguuucaguggggcugacaaaggccagccacugcugggaggccggcaaccuucaaacuguuugugucccuugugacccuugaauugauuucccugguuugagacuggaauuuggaaucuuuccucugcaacucagcuggucacaggguguggcuuuuuccugggaacucuuuacauuauaaauaagggaaccgcugagagcuggccaaaggucaagagcucugguuuuauuaaagccuaacuuaaaaacuugucucucuuaaguuucagagucgccauguaugugugugagacucacauggacuuuuuuuuuuuccccuuuccacagcugaagagacuugcuuugacaaauacacugggaacacuuacaaagugggugacacuuaugagcgcccuaaagauuccaugaucugggacuguaccugcaucggggcugggagaggcaggaucagcuguaccauugcaaguaagagaggccuucuguggaguuauugaggucacauauacacacuucccucuggccuguccuugccuuuuccuguuaucccugacugaauagugaauacuuuuuacuucaaugaccaaaccccaugucgucacccaccuagcuccucuacaucuggaagauggaucuaagcagagauggaaucucucugucucucucucuguauguguguguguguguguguguguguguggacaguggaagaucucuugguucuuuucaauaagauaugcccaagggaccuaccuauuuuaaauuaucugggccucuuuaagccagauugaucauuuuauccucugcagcuaugagccagaaggguuuuugcucuuugucauggagucugguucuuugugaugaguagauuagauuuggggagaaaaccuugcgguucucaaauucaacacaggcugaugagcacagugcaucuccaaggaacuuuagguccugggcuuucucucaggaagucuacagcugcggcagucuuucucgugugacucauuggguugccaguacguucuauuaauaagacuuucucucuaaaaaccaacuuuuaaauauaaguccucuguccaaaagaaccaauuagucccuucugaauagaccaaaucaauauuuccaacauuuaacaugaggguuuuuuccaaguuuccuggcaaagcccaagagucgaugguacacuugugacccugcguacaauucagccauuggauuucacagccuaagaaaguaucaggguuuccaacccucaugagugugucugcuugcuuucugccagagugcuauuuccacccuggaguagaaugcaggcucuccguccuccaggagaucggaaugcuaugcccaaguagcucaccuugcugucuaggaggacaguucccccagcucuucucugucuagggaacagauugccugugaugucuccggggaaccacaauuuaugacuucuugccauucagaguucuccauggcuuuccuuuuugugcuuuaacgauugacccaaagugggcugauaugguguuagccuucuuucugcuuuuuuuuuuuuuuuuggcaggagagcugccugccaaaaaaaucccucaggauuagggauugcauuuuggccaacauacauacuuauuuaucucaggcagaacaugagaugagcacccccugaauucucucaauccccuaacguuugccuuugaucuguaacagaucgcugccaugaagggggucaguccuacaagauuggcgacaaguggaggaggccacaugagacugguggcuacauguuagagugucugugucugggaaauggaaaaggggaauggaccugcaaaccuauagguaaguggcucgugugugugaucgaggggaacggagccacaagcagauagccuaagcaaaccaguggccgggauagcugaaucacagcauaaaaaccagugaaaugugcugcgagucaccagccuuaaggaaaucagauccugaacuauggaacauaaaggaaucuuaauuuuguuugaaaagcacaagguggaguuaaaaucuuuaggaagaagugauuucuuuuguuuauauacuaugcuguccccuuggugaagaagacauguuauuuaaaggaggaaaaauuacacuauugacacauuucuuguuggaacacaguuuguuaaagcacaaaaugccacguggcuccggucacaccuuggcaauuuccuuaaaaacaaacauuaaagguugugggggauuuuuguugguuuguuuuauuuauuuuuucuguuuuuuugucuuagccuugguuguacucugaagcccaaaguuuuggguucucuuucuuagaucuccaagucagacguguguuuuuucaaauuuguuuuguuuuuguuuuuuacauuagucuaaaauuuaaagagcgcuccucucauucuuuguaagucguucauauuuuauagugguuuaguuuagggacacacagaucagugguagagagcacuugcugaggcuaacauaagguucuggguucaauucccaggacugaauuaaugaguuaaaagagaaagguugggauuuugcauagggucgucucccacaggguaaagacuugcauuucuuuccacuugaaauguuagugggaagcuugggacaggcagaaaaauccggucuguguacucauuaggacaacagaauuuacuugcagcaaggcuggggcuuccucuugcuccggcuucuugcuccgugcuuagcugcagggcgugccugcucaucugaacagagugccacuuuaagaaauguggcugggguuuugauuccaugcuacacuguaaauuauagggagacgcuaucauuuuaaaucgcucuuccuccuuucuuuuugcuuucccauuucuucuccagcugagaaguguuuugaucaugcugcugggacguccuacgucgugggggagaccugggaaaagcccuaccaaggcuggaugaugguggacuguacuugucuaggcgaaggcaauggacgcaucaccuguaccuccagaaguagguuuagcucuuuucuguugacaaugcagcccacuguugcuucuggaucccuagagagaguugugaugccuuggugacucugugguaucauaagauguccagaaaaacuguauaaccaucaccuucugcuucuucagaggacacucaauaacuaggaaaggcaguucucaguucaacccugccuuaggcagucagcuaguaaaaaugaaaagagccuuagugguauucgcuugcuggaugggucuuccuugaucugggaauuaucucagagauaccuuucugguaccgaggacaauuaaaucccuaaaguagcauguaaaugaauccuuugaccugggggagcgauuggaaauaaaaggcucuaccccauguucggauuuccuucuauguuugaaguuuaaauaagguuuacugacucuaaacaagaaccuaguggaaaugaguccgugcccaguauuauccuucaaauaggaaaguggaaugaauuucuguguguuguuuguucaucgauugggcagagagacuguuaaauuauaacccauccuugcucuuacgcuacaaugugggcaguaagggucuaacuuugugacuuaaauauugcugcauuugcagugucaggaaaaaaaaaucaaccauugauucaggcaaaugcauagacacacaagaacagagguccaagaccccagcuaacaguguugucaaaccugaaccuguuuucaguaucuuugaaucaguaucucuugaaacuccuaaugcugagcuuuguaagugauuaauacaugagccuuccucaucuuugaccuacuaaguguucucugaaggcugaugcccaguucguauuucccuccccauauugccacauacaaaguaaguacuuauaaaauuuuguugaucacaugcuauuuguuugagaaacuuugcaugcugucagaaggguuuuaaaugauagguaagagucugaauuagauuucuuucuacauguguuuauuuuguguguggaggugggaggcacacacgccacagugugcauguggagggcaaaggacaguuuggaccgcgcagggugcagugaccucagguugucagguuugguggcaagguucuuuacucacuaagccagcucaguggcucagaauuagaugucuaauuugucuucaaugaaaauacugccacaaacgacuuggaagacugaagcucaucacaguuuuaaaucaaaagaucuaaggauccuauaaguuugggggaaacauuugaucuuuuuccaugacuuauuuuuguguggcaaagaauuugaacuugggugguauuuuuaauuacuaguuuaagcuggauaaacaaaacacauucaagauaucuagauuugacuuuuuuuuuuuuugcaugcguuuuaaaauucaugcuucagcaaauuccaaggcuguuguuaguuugaaauucuaaauggaacuuugaaggcagaagcagcaauuaagacuucaagacaaucuuagaagcgggagggaagaaggaugccuggggccagcuuuuuacaaggauaauaagagacagcauccuuaacuccagaagagaccuuuuaaccgugggauaagccauuuugucguugcuauugguuauugucacuguuauuauuacaauuacuauuauacagggaggauucucauaagcccaggcuggccuagaacuuacuguguugcugagagagaccuugggcucuuaacacuccugcuccuaccucccagacgcugggguuaaccacgugggugacuuuguaauuguaaaacaggugguuuuggguggggcaagaaaagagaaccuucuagccagagaaguuguuuuuccacaggaauacuuuuacauaacaaguggagagauuggugugguuaacuuuuuagcuucccuggggcagucggaagagaccugccuccuuauuguuuauugaaaggagggccaugggcuguaauuacagaaaaaggucuggaagacacugaggaguaaagaguagauugccagauaauuaauugagucaaagaaccaauguagaaaaucuuaauuuuuuuuaaucaauaaaagacacugaauaguauuuuuucuuuuuuuccuuuggcaaauggagagguagggcuguacuguaacgaaccggguaucugaauuuuaauauaugcaucaccagcacuggguaggauguacuaacaccaacaacagccacucagaagcauucaacugcagcauucccaucuuaguguggauggcugcgugucgguuacuagauaacuucuauauucaaugcuucucuccugaaacagacagaugcaacgaucaggacacccggacauccuauaggauuggagacacguggagcaagaaggacaaccgaggaaaccugcuucagugugucugcacaggcaauggcagaggggaguggaagugugagcgacaugcucuacaaagugcuucagccggugaggcgcugggaccggggacagcuccacgccagggugauuuauagcguuucagcuaagaagcuggaaucguucacauaacuguuuaaaaauauucauucuauauugugaacaaaguugaguggaaugaaguugagacgugccuuuagcacagagggcuggguuggaaagcauaguguacucuggucauggcucuauuaguauaggcuuuggcuuaugagcaugagacucagaguucagucuagaaccaaaguaaauauccaagugugaugguguuaucccagcaccaagaagguggaggcaggaggauaccuggggauuacagaccagccagcuuacacuacuuuggaagugugggggugguuccagguuagugagaugguguggcuggccagcccacuuuucuugggggaguugggggaaguuguguucuagguuugugaaagauggugucauagaaaacaagauggcucugggcauaaucccugccuucuacaugcacaagcucuccacacgcaugcgcacauagauaaugugcaugcacccucccucacauggacaagcaauagugagugaaugugugguauguacuuggaauccucaagcccuggguucaguucccagcacccucccaaaacaccccaauaauuauuauauaaauuuaaaagaauaacuaaaacaaagaaagguauuuguauguaucuuggaugcuuggucagagucugaggaaggggucggagcacuugccaaccaugcgcaaagcccugguucugguuccccaucacuaaauaaaaggaggguguguugugccugcgauuccagggaucaggaaguagagggacggaggaucagaaguccagagucagccuuggcuacguagugaguucuagucaaaccugcucaauguggcucaguggguaagagcacccaacugcucuuccgaagguccagaguucaaaucccagcaaccacaugguggcucacaaccacccguaacgagaucugacgcccucuucuggugugucugaagacagcuaugguguacuuacauguaauaaauaaauaaaucuuuaaaaaaaaauaaaaaaaaaaaaagaugcugucucucaugcacacacacaucggaagaaggaagugcagcucuugugggugguaccuucccgcuauugcgcucuggguuuccaucuagcuuuuacugugugauaguccagccuuguuacuuagccucuuagcagucagucauucaggcaauaguaauuagauuuuuuuccccuuuugacgaguuuaucuggaccuaauuaauccuugugaaagcaaacaagguuacauuugaugaucucuacauuauccaauuaucaucgauaaaaacagcuauuggccauaaggcagaggaagaacaguuacgaaugucagucgacugaacuacaugaaggauuaacugagcuaacugggauuaaacaauacguguuaacuauuuuuauggcaucacuaauauaccgagguguuucacuauuaaaggguuugagaaacacuguuaaacgaaacaaccucuucuaggagggccuugccguccuucuguauggugggccuugacaccauuggcguccucugucugaguucucuuuggguauuugugcucgucagcgcugggggaagaggcuagauucauucuagaagcucuuccgcugccauacggacucugaccuucaaaagccagauuucuaaaagagaagcuagcacaaucuguuguguuaacuauccgaggaaacuugugaggauugguugcuucuaggaaaacaaacagacauccuaaggaauucugcugagcaccgacacccaggaagagggauaacuuaggaaauccguagcucuccaggguguccuccugagagccaaguuuuagagaaggcaggauauccccugugggucuucaggggucucucaggaagaggaaaggccacacacagagcauaugagagcuaugagggaagacaggcaaggcagaccauuucagaugaguggggagccauagggagaaggcaggagcaugguacccaggaaugaugagcagcucaguggguugaagcuuagaacagggcagggaaggcuagcagccaggcgggaggggagagugguagagggguguggagcucacagauggaucgcuuccuagcgugacugaagguuugugaaagauaaccuguuguguugugcggcaggauaauguugucgcuuagaugugcuguucagguguggcuccgaugaggauuauaugaggagucuugugaaccacuucuugggcugagugcggaaguuccgggucaagccaagaagacucuggacucauugacuucucccuuccaguuuuauaacuuuuucauucuccugcccuuaggaucuggcuccuucacugauguccgaacagcuauuuaccaaccgcagacucacccccagcccgcucccuacggccacugugucaccgacagugguguggucuacucugugggaaugcaguggcugaagucgcaaggaaacaagcaaaugcugugcacgugccugggcaauggcgucagcugccaggagacagguaggcaccaucugcccacggaugccagaggaccuacauucagugucugcaguaucuuagcuguucguaaaaaaaaauguaaaaccauaaauccagaaaaguuuauaauccugugauaaaaaucauaguagcugacauuuucuucucuggucuuuuuuuuuuuuuuugguuuuuugagacaggguuucucuguguaucccuggcuguggccuugaacucagaaaucccccugccucugcuuccugaaugcugggauuaaaggcgugugccaccacgcccggcucuucucuaguauuauaacuuguauauuuucuuccuaucaugaggaucaaacugcuuuguaguaucuguauuugccgaaagggaugcugcaagaacaccauuuuuuuccuguuuguuuuuguuuuuucucaacuagccaauaaucuguacucugaguucaauuuggaauuauagaugucuuuuagcagcacauggccucuucugggucaaacaugcucucuuuuauaauuguuuuucuagagcagccauauauacuguuucuucugagaauguaagcaagcauguaucgcucugugccgucuucaaaucauaauaauuuguauuaauaaagcuuuacaaguggggaaacugagucacgguagcagaagugucucccaaagacauuaaaaggagaacucuggcucacccuuaaccagcugacuagacuuuucaucuuggcccuuuaguagcacaguuuccauuuaaauuagaaauuugucaccacuggggucagaggugagggugggaaacaacuguacugacugagacucuugguuaugcuuguagccgugacccagacuuaugguggcaauucaaacggggagcccuguguccucccguucaccuacaacgguaggaccuucuauuccugcaccaccgaagggcggcaagacggacaucugugguguagcacaacuuccaauuacgaacaagaccagaaguauuccuucugcacagaccaugcgggugaguguccugggaggaaccagagagggcggucgucugucuguccuugccgugcacacccuucugugugccagcagucagucagucauuccgaggcugcacgggaacuauagcuuugaucuauuugaacccacagcuaaucccuuagcagaggcaggcaguuuccaugucccuuagcgccacuggggaaaugucacugagggaaaagcccuaugguuugauuauuucgacacauggggauuaugaugugauuaaagacacucaaguauugaaaucaguggaugaucccacagagccgaugaacacacaggauaaaugucaagggugccgguacuuaucuucuguguagagucgaauuuuacacaaagcuaucauuuaaucuuuuuuuuccccccuuggcugggaaaaugagaaaacaugagauuuaaaucuauuuugaaagugaagaugaaaauccacuaagaagcuuagggcuguauuaucagauaucuuuuuauuuguggauaggcccucugggacuuaacagccggaaccuggcucugucuaagccugcgguagucucuccuugucguacacaacacagcucagcuguaaucuucggguuuguguguugucuugggcaguuuugguucagacucgaggcggaaauuccaauggugcucugugccacuuccccuuccuguacaacaaccggaauuacaccgacuguacuucugagggucgcagggacaacaugaaauggugcggcaccacccagaacuacgaugccgaucagaaguuuggauucugcccaauggcugguaagaggaagcccugugaguuauggguguggacccgcuagcagccuguugauggucugggagaguacgaugugcaucuauguauuauaucuuacauuugcaaauugagaaaacugucaauggcaauguauucuggcaaauacagagcuguccucauuuuaccuggauacagaaagaggaaucagggauugcuuauuguuuuuaaguuucgagaguccgguagaagacaucuuuuccaguuguagaaccaauagccugagggucauggagagucaugugcucagacgcaaggaaacuacacuuuuuguuuuucucauuucaacagaagaugacauuggguuuaagagggacagucacuuuuaccugggauuuuaugcucacaguuucccuuugaacuugagugaaccaggugaagucacaaggcuauaguuaaauccaguccucuagacaacgagaaucaaugaguauaugagauuuuccuagucuaaucuucuucagcccuuuugguauuucucuccaaucuccucuggaccgguucuuuccuggagaguucaaaacuccaccuucauccagcuacaugcaugcaagucuucuucccaaaggagagagaauugucaggauuaucaaacaagacugcuaucuucacauaacuauccauuuguauuccauggcuguuuaccaaguguuucuccuccauuuccaaccagcccacgaggagaucugcacaaccaaugaaggggucauguaucgcauuggggaucagugggauaagcagcaugaccugggccacaugaugaggugcacguguguggggaacggucguggagaaugggccugcauccccuacucccagcuccgagguaugcugguguguugaccagagaguuugugugaaagccuguaguugcaaaagcagagagggaagcaugcaguguguagcuauccacucacccgcugugcugaagaggucucuugauuccaggagcccgcugagaaaagcuggcgagugaguugaauaguucuagggcucuggaaauauucucaggauguaagcauuuagguugagccaaaaggauggcuuucccaaagagagaucaauauuugaaauccuuuuagcucaagguucugcccguguuuaugucuagagaagaugguaucauuucuccaagccgggggugggggggguggggggggugggaggggcgggaauggauggauauuuucuauuugucaaauuuaaggugaugaauacaucacauccucagacuaauuucuuuuuuucaaaucagcuuuuuuuccccuuuggacucagaugugugauaggaggagcuguuaauguauuaaagcaauuucagcuucuuugauuggaaaaguaacauuuagguggaacucaguggguaaacaguucccauagccaguccauaaacagugcgcccuacauugauuccuuuaaugguguccaauggcuagagauaucugggaguccucuuuguuacuuagaacauuccagagcaggaggaaaacuaauaagacaugcaaaacagcccuuaguuugacagaugagaaaauggggucccaaagauagaauguaacuuauucgggauuucucauugagugaggaacagcauugauuuacauucuaaaacuuucugaacaucacagaugucauuguauuucccagauccaauuaccuucugucuuaggcuucuauugcuguggaacaccaugagcaaaaccaaaccaaacccaaccaaaccaaaccaucuuggggaggaaaagguuaauuuuagcuuacaccuuucaggccacaguccaucacuggggagagucagggcaggaagucaaggcaggcaucuggagguaggaacugaagcagcagaggccccacagaccgaggagcccagcuuacaggcuugcucuccccugacuuguucaaccuccuuuguuauauagcucaggacuaccugcccagggguaacacuaccugccugccauggacuggguccuccuccaguuaaccacucaucaaaucaguuccucccagacuggccugcaggccaguguugugcagacaguuuucucaaucgagauucucucaucucagaucuguguagauuaugucaaguugguaaaacccaaccagcgcacacugcucuccaucccagaaaggagacuaccacauggugguguaugcuauguaaauuucucucuucgucuuaggguaacaaccaaaaauuuaacuaaaaucaucaacuaaaugaggauguuagaggaacuaaggcaugccuuuguugagaaauuaguuucuccacaggaaacuauauuuuaccauggcuuuuaguuuaauggacuguaaucccugacaauuacaagucuauuagucagaauaagaggggaguaaaaauuaauauuauuaagcuuugaaaaaaagauuauucugugccaguagaaaauguauuuuagcagguguuaaauccagcaguagaacugacugccuugaaaaaaugcaguuucuuuugauuucauuagucaaagcuuaucacucacccaacuguucccuggacagaccagugcaucguugaugacauuacuuacaaugugaacgacacguuccacaagcgucacgaggagggacauaugcugaacuguaccugcuuuggucagggccggggcagauggaagugugaccccauugguaaguggccgccucugcuugguugguuuucaccgaggacguuggcugguugguugguugguugguuggccacuugcagauaaggaaagcuauuugguaucgccagacuuccuucucuccaaaccugccucauccaucagucugcagagagccuugcaaauguguugguaacaaggguggcuuuacugcagugagugagugggguuagcuuuguugguucugagucaugacaaaggaaguuucguuacugacugcagaaaagaaacauggguauaggacucagccaguagaugccugccuccggccaaaacacuucagcuuuugccucucuguacaauaaguagauaaauagauagggcugggccaucacugagcgaucaacauuaaaaggagccuauuccccaaauccaaaguuuaagauaaucaguucuuacuccuuuacugaaggaggcagacugcuuacugagacagcaaauugaucccagcaguuuguucggccugcgauuguaaagccgagaggucccgggaggcuugcuuagaaagcuguucaugcuuuaaauuuagcucauuaauguaaagcuaccuacugaauuccgaagaaguacacaaaaugaaaucauugcaaaguucuuuucuuauuuuacagauggcaaguuuuaaaacuuuuaauugguaucuaguuuccuaaaauuaauuuucagauuuuggcuauaugcugaaauuuuaaucuuuacauuuuuuuuaaauuuagcaauguuuccccuguaggacaccaaauauccuucccaaaagguacauuuuaauuuuaacgacuaauuuucccauaagguaaaugacuugaauaaaauauuacuuuaggacuggggaaaugguuucacacaacauaugcacguaucucacacacaagcacauaucacacacacaaacacauacacuuauaacuuacuuuaacuauauuuguaagaacuggaauuuuuauauucauacuuuaagaauacacuucaucacacuacagugauguguuugaggcuguuuuaaucuuuucuuuguguuuguuuuagaccagugccaagauucagagacccggacauuuuaccagauuggugacuccugggagaaguuugugcaugguguccgauaccaguguuacugcuacggccguggcaucggggaguggcacugucaaccucugcagaccuacccagguaaguagcucugagacagaagcagacccauggaugccagucuaugcuacuauuuggaaucccagugggggccuugcucugucccaucccuuuucauauuacugucuaauaguuaauugcauuuuugucuuaaauuguuuuauuucacccuucaucagggaaaaaucaccaaagacuaugaaaaagugcaugcuacaauuuugcauuuuacacaguugaggacuccauuaggugaaaacauuucaguucauuuuaucucaguccuguguguguguguguguguaucugugcuugugcaaacacauguguggauguguguauguaugugcacaugcaugcgugugcauguguguacaugugugagugagugugugugccuguguuugugaguguacaugugugugcacaugcgcauacaugggcaugcaugcuugcauucgugcauguguauguguguguguucaaguagagccauaaaguaacucagacuggaagugaaagaguuuuacauucuguuucuuaaagagaagucacaucgacagaaggcaagaaguacaguaugaggcauaaauuuguuuccugccaucuuaagcccuucuuugugucagauuucauuuguuuagugagauguaauguggaacaaaaucuggagccaagaaacuuggucaacuccacccacaccguucgaauaccuuaaaauauuuauugugguuuuguuguugauauuuauugcuagguucucauuguuuuguuugguuguuguuuguucucccauagagacaucaugccuagccauaggcauuaauucauuuuggggaaaacauuuaaaauucacacguugauuaugagugccauuucagcagacuccuagauuuccguuaaugauuuauuuauuuaucuguauguguguggagagggcacugggucacagcacauacgugaaggucagaguggacuuugaaguucuuucuucacacacgauucuuuauguggggaucagacucaggucuacaggcuugugggaggcgagcaccuuacccugagccaucuugcuggcccaaauuuaagacaugaaauaccaccuguauucagaaacaaaaagauuugggguggggggagauaauccacaagaauacaaaauauuauaauaauaaauuaacuccauaaguauuaagauuaaauacuaagauuaaacuaaucuuccuaagagugucccaaagugaacgaugagagcccaaggcagugugaguccucgcucugacugugcugugagagagauacuaguuaacuucuccuguggacaaagggagacuugcuaaccaccuuuaaaauugcuuccaguccuucacuaacagucagagacccagagcacccguccaccacucaugcaaucauguuuuguuuguuuuucaaugacaggguuucacuguguaacucuggcuacuuuguggaccaggcuggccucagacucauagagauccaccugccucuuccucccaagugcugggauuagaguugcaugccucccauauccagaauacgcucauuguuuuuaugugcuggggacauccuccuccgcucagcccuuagacauugucaggguaggauaggugauugcuuccgcaacuauguagcucagagcagccugcauuuuugcuggacuuugguuuaagagugaguuacuugccgggcgugguggcgcaugccuuuaauuccagcacuuaggaggcagaggcaggcggauuucugaguucaaggccagccuagucuacaaagugaguuccaggacagccagggcuauaacaaaggaacccugucucgaaaaacaaaacaaaacaaaacaaaacaaaacaaaaccaagagugaguuacuuaacauuuuuaaaaauugaauccaguugcuuuguuuugcuuuuugagucucaucuagcccuggguggccucaaacuuacuauguagccaaugaugaccuugaacuucugaccaugccuccugucucuuguuuccaaaaggcuggggucacaggugugcacauuacaccuggucaacuuaauauaguuuaaaaaucugauuacaaaugagccauaaauucagaaaacacauauuuaggaggauuggauuuuccaaugauacaagccaagaauagaaguuuauuuuuguguucacagucaguuuuugcagggcaauuuuugaaauuuauuuucuuuuaagaccuuuucuuuuaaaaauaagucuauucacauauaucuugcugcaagcauugaggguagaucugcugauggacaggaagagucaccuagcgggaguuuuaccuguugacuuuguucccuguuucuaaaaagggcaaugucaaaaacccauugaacacagaagagauuucagggcaagcggaugaguguuugacccuagauagcaggcucaguguuuaucucaauggaggcuuugcucaagggcucaugccuagccuuugaggcuccgauggcugaaagaccgugucugagccuugcccuguuuguucuuccuacuagguugguagagauguucaaacuaacaaaagguagcaggaauuugguuugucaauaagcaaccaggaaagcacagcucucagcaaauuagguagagaaagaaccuuucgggucaaaaaaaaucaugaauguuuaacuucuccagggucacuauuaucggaaaucacucuuucugaccuuacugucaacugauuuugaaaguguauaauguggcacccuacaagugaagaucucacagugggcauugcuauuagaaguguaaaagguccagggagguggauggucgggaucacacaacuagccagcaucaaaggggauauaaaaacacuucaauuuaaguaguguaaaugauagcuagccuuuuuuuuaacuuucccaucuuuaaaucauguguuguaguguagaguauaguggagagcuggaauuuaauugaccuagaaaacagaugagggguuuuccuucuuccuuccuuccuuccuuccuuccuuccuuccuuccuuccuuccuuccuuccuuccuuccuucccauuccugcacagaaaugcuuuaaauccccuuugccauucagggcagucacuugaagguggacccugucaucaucuuaggggccuggagagcugagagcucagagguuguagucccuacgcaguuuaauucccaucccucccauuagacagcacaauugcugaaccuucagcucaggggacccaugccucugucuccugccggcacccguacucucucauauguaggcauuuuaaaaauuaaaauuaaaaauaaugggauuucagaucugcgcugaaaggcugagaaaggaaaugaaguucugagucacuuggguuaaccauugcgagcaucuuucccucccucccuuucccgcgucuucugucacccuugugaacacaggguuugaugacuggacagacaguaaaugucauuuauauucucuuaauaauagauuuaucaaggagauuuaguuaucacaaguuuuccagccucaaauucaguaaauaagaugcaugagacaugucuaucuaccugagagauuauacuaggauuuuucuaaaacagcaauauuuaacagccuuaugcagauugucacuaauaacauaaggucuguuuuuacugauucauaugaaaccucuuuaaauaguguuugaaagaaauguuuuuaauguauuuguauuugugaggcucuucaucuauggaaggagcuauuccagagggcugugcaauggacuugaguugauuaaugggacaaccaaccuguguggcgcguggguccuaugccccuuaggaugcaaagaugagaauuuugacauuucagcuuguagcauuaagugaaaucaagacucaaugaauauguguuagucuucaacaagcugaguuauucccaaugaagaaguugaguucaaaaucuuuugaggucacauaaauauguaaguuacauauuuauucugcuaaagaagauuuugcuuuuaaagaauuuagaagcuuaagaccauaauuaaaucugaaagucaauauauuuuuuccaagagcacucagaaaucgcagguaguguagagaacuccuuuaucagcaugcagaauuuucuucugucucacagagcaucagugagaacuuugugucuuagguuuuuguaaggacuuuguacaaauggauuuugacugacaaagaauuagagagaagauaaauuuccauucuguaaacagaguuuuugauaaaauuucauuauuauccuaaauggaaucuacuauauuaaaaaauugauucccuucucuuauuuugccuuuuuuuuccccccaaggaaaaaaccugaaucuaucuuaaauuuuguuaauaacagucauaucaagaucugaaaauacugaauuuuaaauauaugcuuucaaaugucauuucaauugaugauugcuuaaaaagauuuuuuuuuugaacaauucgcucacaguggcuuuaagaguguacuuaaguaaauguaaaacgaacaaacaaacaaaaacacuaaaggagagaaggcuuagacugauggggaaauaaaccuugggcuuuaauuauuaccucugucuguuuguccggauucagccccauuuagaaauguuuguuuugugucacgccguaaggccuugggaucauugcuucugagcagaguccucugucccgaaagccuccaugauucggaauuugucuuacaagagccuucauguaauuagcacaugaggucuguauucugagcuacauucuucguguuaaggaaauuucacaguugucccacgucuuacuuugaaagccagagaagaaggcaagcuaugagacacuggagugguuucucucguauuuauuagaaaaagaauucuaauugcuuuucuuaugggaaaggcaaugauuaccaggucaaaucagacugugcuuuuucuucagcuaaugucacaauguagaagguuuaacuagacucuuugcccacauuucccgagaagcgaaaagucuuuaaggauggacauccauguuuuguaaaacuuuaagaccacacaagcuaaagagauggcauguuuucauuuucaggcacaacuggaccuguccaaguaauuaucacggagacccccagccagcccaauucccaccccauccaguggaaugccccggagccuucacacaucaccaaguacauucucagauggagaccugugaguaauagcuccgcagccuuggacucugaccccugaccugaugggacuaggauguguugcccucuggguuuguuacugcuuuugagucgacagaucugaugccaugucgaacagugcugacauuuauuuucuuagugucuagccaauauguaguuagucgaaucaacauguagauucaggguuuuuugauuguuuuugguuuuuuuguuuugauauguagaagaaauuaaauuaggccuuuggcuuaggaaaaucuuagaagccauaaugcuaacaacuauucucauccaauguggaaagaaaauuugaaauuuugguauccauuugcaaugucauuaaaauuaaaaucacauuuucaaguuauuuccagaguuuaaaaccagcuaaaugaacaucguucuuuugacucaacucaguuguccuguaguccucuugaguuguguagacagaagggaaugagguauugagagaaggaggagcggggaaggguuuauauuugguuucuaaaaggacccccaaacccuagcguuuucuaaccauccagaugccaaaaccauagcaaggagucucucauauuagucuauuaacccuugaugucucgucccuucucagacuugcccucuuccaucuccaaaguuuaugacagaauuuaaaaccacuacuucagaaaggagaaaugcacuuuuaaaaaucaaaucuacucaauugaacuauuauuaauccuagacuacaacaaccugucugacuuaggacgucaacucacucggucgaauuuaaacucuuggggaauuccauucugcugagcucacucuuuuccuucagccgucccauguugucacuacaaaugaggcauuuauaaauagguuucgaaauacacauugaguugaggcgucuucacauuugauuaaacucucagcaaacauuuuagcuucgguuuuguuguguuucguuuugagaugaugaccccauuaggccaagacugacuucauauucuuacguagcucacguugaucucccugcugagugcuugauuauagguucagcucccccuugguaugugaugcuagggacugaacucaggacuuuggccaccuuuaggcaagugcucugccaaccgagccgcauccauggcucugaaaauuuaaaaagaauuucuguuguuucguuuuuuuaaauguaggccaucugagaguuuauauucucauauuuucuucugauggccaauugcuaauuuuuaagcuaacaaaauggcuaacuucaauuucuuucagcauauuugagcuaaaacuaaagauuaaagagaacuugcuuggaucacuuuuauuuaucuccaaaauaaaaaaccgggcauuagaacauuugaaguauguacaaacuugauuagauaacauuaaaaaaaaaaaucacugggcauuaaccauguauuugauauuuaaaccgcuuuagaauauuuacacuuaaaaggauuucuuguuugaagucuggguguuucuuuuccacacaaucuauugcaaugaguucugugguccaugacauauuaaugaagcuggacaggauauaaaaauguaaacuggagggggaagauuaaacaaaccgaacccuauucuucugcagucuuucccagaguuggcuaacgacucuugaugggucguucauuuccaaggaugagucacgccaccagacacguugaaccuuguuugugauggccccaggaucugaguccaggcaauguuauuauacuuuucagugucucgcgaggcaagaagcuugaaauguaucccaccaaguugaaagauagagcgugaggccuuuucucacuucagaagagagacgugccucuguuuaccacaaaagucuagaggcugaauugauggcgcuggucuuaaaugauucgaggccucaaguguguaacuuugaaaaccucauuucuccaccuguaaagugcagugaggcacuucacuuccggcaggaaggugaagaucagggggagaaacaaacaagcaaaacagcccugagugcuuggucaaccacuuggacgaauaauuaauuaacaucgacaaacuguagaggcccuguucccagucagguuuuccaccaucuuucuuccaaaacagagccucgagaauccuaucuauccuccauucuucuuugaagaugacuaaccaccacguuuuuuuuccuuuuacauauucagaaaaccucuacgggucgcuggaaggaagcuaccauuccuggccaccuuaacuccuauaccaucaaaggccugaccccaggugugaucuaugagggacagcucaucagcauccagcaguauggccacagagaagugacacgcuucgacuucaccaccagcgccagcaccccugugaccaguacguagccagcaucuguuggggcugugccugcacugcucagacguggguuccccagagaagguucuguccuuagcugcuucuuugcucggauggugaacauccucugaacacagagagcguggguauuccagauaaucaaaggcucuuguccccugcucccauuccucuaggcaacacggugaccggagagacugcgcccuacucuccuguuguggccacuucugaaucuguaacugaaaucacagccagcagcuuuguggucucaugggucucagccuccgacaccgugucaggcuuccggguggaguaugagcugagcgaggagggagaugaaccacaguaccuugguaaguagaaugucuggcuuccucggcucguguuucuagauacuuacuuggcucgcaggaguuuugauuccggaacgccuccacaguucaaacggaagacggucccuuucaucagagccaggagagaggugacuccucucuggccaggcugggauucccugggcaccuuuguggccucuggugcuguguauuucucauagccauggaagggggaccaggaugaggccuauggcugacaauguuauccuuuaggggugcggaguuaccuucuuguuuacuuuuaaaauagcccagugaugagggggucuuuaaaaauauuugcuggugccagugaggcggcucagugaguaaaggcccucaccccuaagccuuauaacccaaguucacccuccagucugaccuccaucacguguguacgccccccccccaccaauguaauaaugagaagauacugaacauacaugugaauaggacccagaucauaaaaaugaaucuccuuccaaccccugcccugucauccuuccuuccaccauggcuacuacucugauaucuaaugacagcucuguuuuaaaaaacaaaaaaacagagagauguuauuaaaaauuauacaucuucgggggugggggaaaguggaaaaugaaagaacuuacuuacauuggaaauugcaggcuauucacuagaacauuucucgugggcuuucacccucugaguauagcgcucuuagaagccguggaagauugguuugcucaggccacuaaccuuugcccuguauuuuaaagaucucccaagcacggccacuuccgugaacauuccugaccugcucccgggcagaaaguacauugucaaugucuaucagauaucugaggagggaaaacagagcuugauccugucuaccucacagacuacagguaugugggcacccagccaugauaaaagcaacuuuagguaugggguauggugguauggugggugauacgauacauacauacaucauaaucacacauacuuacacucauacauacagcuuugggaugcugaggguagagauccaggcuagccugcaguaagaaccacuguuuuaaaaaacaaauuuuugaagacucuuuuuguuuuucuguaacgcgugggcuuguagcaacacugacugauuuccuuucuucuucuuucagcaccugacgcuccuccagacccuaccguggaccagguugaugauacuuccauuguuguucgguggaguagaccccaggcaccuaucacaggucauccuuggcuucuguguuucuuuugauguauagauguggaaggggaaaauucugaucacacugguaccaccuuaaaucuuccauuuuaagugguuggaggugugugugcaugugugugcaugugugagugcgugcguggguguguccacuucaaaucuuccagggauucuucguuuuugauucguuuuccuucaagucuguucacacgcccccauuccuaauaccugcaucugcaaccuauaaggccagccccgcuguucacugcagugggcaguucccgggcuguacaggugggugauuccugcagagcugcugcucacugcugaagagggagcugagucgccgcucuagcuucaccagugaaguucccaaaggugcaaacacugcucaggcugauuccauuccucugcuccgagaagggaaagccgcuaguacuaugaaugucucacgucauggcaucacuuacugacauucauuaaggaucucuggguucaaggaugcuauuugauuauuaaaagcuuccuaucaacuuauucuuauuucugugcccgucaggcauuaucagaggaagugguaacauugaaagacccggaaagaaucuugcugauucuuagccaugagaaaggagaguuauaauuugucuagccuccgcuucugaagaccaugugucuaaacgcuguucuccuaaaccugcaggguauagaauugucuauucaccuucaguagaaggcaguagcacagagcucaaccucccugaaacggccaacuccgucacccucagcgaccugcagcccgguguucaguacaacaucacuaucuaugcuguggaggagaaccaggagagcacacccguuuucauccaacaagagaccacuggcaccccaagaucugguaacuuaaaaacagcccauucccugaugucugaucucuuaggacuagaccagagagccgcucuaaccuuccaggggaagauaaagcccacguggauuagacucauucuuuagccuucagggaggacugaggugcaggucacgugggugacagaucccugagagggagcuguuuuugucuuugccagcucuuucuaugucccccaucacccaaaucaauggcucucacccuuccuaaugcuguggugacccccaacuauaaaauuagugucaugcugcucuauagccacacugucgugaaucauaauguaaguaucuguguagaauucugauggucuuaggugaccccugugaaagggucaucugccaccaaaggggucucaacucacagguugagaacuaccgaguuaaaugcuaaaaugucagcacuuggaaggaauuuauuuauccaaggcaacuauuggguuuucugguuaaaaacucacagcaucuccucuuucuuuuccugggaggcuuaagaauuacuguucucuuaacuaccauuuucuuaagaaaaucuguucucuuaacuaccauaaaaugagucaguuaaacaaacacaccagcugucuuguaaagugaaaacauuuauuuuuguauauuauuuuaacuugguuuuauguuauaacaugccuaucuauagauacuaaauagagauuccaauaucaguuugacuaaccaugaguauacacacacacacacacacacacacacacacacacacacacacacauuuauuuuuugauuaagaggcaaagcccaguauuggccuagaaugagugggucuaagagauggcggaauuguucagggagcuaacuucuagcaucaaccuucagugggaauugugacugacugacucaucgcucuugucugcuagauaacguccccccuccgacggaccuacaguuuguggaacugacugaugugaaagucaccaucauguggaccccuccugauaguguggugucuggauaccguguggagguccugccugucagccugcccggggaacaugggcagaggcugccugucaacagaaauaccuuugcugaaaucacugggcuguccccuggggucacguaccucuucaaagucuuugcugugcaccagggcagggaaagcaauccucugacggcacaacagaccaccaguacguuccaggccugccugccugucuuguggcccccuccuuccagcucugaacccucagcucuaccugggauaacuccauagcaugcugcucacucccagguucacagcucagcaguuagggaacaucgaguugaaaggaauguugaagguggaaugaaacuagcguucugagaaugcugacuccaacauacaugcuuccaacacgcaugucauguccaacaugcucacugcuggaguuagaguuuucuuugcuaauggagaugcaauuucagugcuuuugucucucuguuuccccucccuucuucccuccuccuucccucuuuuuucuuccuucccucccucccuuucucccucccuucccuucccuuaaccuuccuuucuuuaagcugugaaucaaaaaaugcucuaccacuauacaacauccccagcccuuaagugcauuuuuaaaaaauauauggccgggcgugguggugcacgccuuuaaucccagcacucgggaggcagaggcaggcggauuucugaguuggaggccagccuggucuacaaagugaguuccaggacagccagggcuacacagagaaacccugucucgaaaaaccaaagggaaaaaaaaauauauguaguuagauauaguagaauucauuugaggcuagcaguugccaggcagcaggguguguaaauguaugucugggaugugugaggcccuggguucucucucuagcaccacacaacgaguugauaccuuaaguaauucauccuaaacauuuaguggcccugggcagcgagguaucaucuauuuagcucuuuaucagcagaaccuggcuggcucuuaagucuuuagcugacaugugcaaagggaaaugcuacuucuguuggaugugggaagagaccuaaggucuucccugaggaagugacagugguuuggauuccaaagcucauguauguucucaauuacacucgaccaccucuggaagguucuuucuaucaaagauguucuaacuuccuaugggaggcccaguuaucauccuuagaaagaagaaaaauggugaucuaugugauucuuucugauacuccaugggacugggguucugcccaucuguuuuaguuauuguaauuagauccaugugaggcagcuuuuauuucuccagcagagguuaggucagccaaugaacauacacguuagcauauugccugcaggacccauggagcuuuucuugcccuaacucuguuggacuuagcccccucccuuaaccuuucuggcccaaaacaaauugugggguuugcaaaauguuuguuuugcuuuagaaaaaaaaaaguaauacuguuauuauaaugugacuauaauuuccaagggugguggguaaaucuuuacugggaaaaguagccuuuccaaaggaugauagacaagugaaaagggucaacgaauuuucauaacugauaaaguuucggcaaaauucuacacuauccugagucucccagagccccacgguauccagggcuguggcucugacuuuaguuccaaccuugaguaagggagcuugggaugcuuaaucaagcgggaggauuuccgcauggcuguuacugaucuaaacguuucuugacacauuucaucuuauuuuuuccccagaacucgacgcucccacuaaccuccaguuugucaaugaaacugacagaacaguucugguaacguggacuccaccucgagcccguauagcaggcuaccgacugaccgcgggccugacccgaggaggccagcccaagcaguacaaugugggacccuuggccuccaaguauccccugagaaaucugcagccugggucugaguacaccgugaccuugguggcugugaaagggaaccagcagagucccaaagccaccggagucuuuacuacccguaagcuaaaauucaaaugccuugcuuucgugaagcuagaguucucaauuaacucuuggcuuuuucuguccuuuugcuuuucaaaagugaaccuaaaaagcccuggugcaccauuuaaagccgccccauugaaggugugccccauggacaggcugguguucucugaguauuucuugcuggucugcuguaacauacacagcuuugccagcgugggcagcacaguucguggccuuugcccgggcugauaagugcuugaugaagauaacaguguguuaauuugcagguauuuccagguucuuucuaucuuucugggcuaacacuaugagucaggaggacuugggagguagcucaguggauaaaacaagugcggcuaacacaugagggccagaguucggaucccuggcauggacauaaaaggccaggugcuuugguggauaauuguaauccuagcacugagagacagagacaagaggaucuggaggcucacagccaguguugcugaucaguagcuccagguucuccaaaaauccaccgccgaggcugguguggcggcguacgcuuuuauucauucaucccagcaagugggaggcaaaagcaggcggaucucugaguuugagaccagccuggucuacauagcgaguuccagaacagucaggacuauauagaaagacccuaucucaaacaaacaaacaaacaaacaaaaauacacaaacaagaaacaaaaaagaaagaaagaaggaaaaggaaauaugguggagacugguuaaggaagucacacgaauccaugggcgcauagacugaauacaaaguagaaaaggcugaguaaauacuaguagacagaaucuaacccauaugcauagcuccaucacaucacucucuagacaucaacugagagucauauauguuuaaaaaaaauccacccauggacugaacagacaucagcaaauggaaagagagguuaaguaugugacuuccuugagagccuggaccgcccgccgaaggcuaccguccuucacagcagagccugguuuccucuuccuuaacuuucucuuccacaucuuccacacagaggaaaaagacaaggguuuuggguaugacuagccuuugacucaauauuuuagaggaaauggccuuaacucucuuauuuauccacauucccauaaacuccugucuucacaagcugcuuuccuccuacguacacuccauuuacaugacagagagcucugagacuuauuucuugcugaguacuuguuauuuuuuugacuugcggguuugaauuauaggaggaccuaacaauaagcaugcuuugggcauuuauggccgucuaccucugguucccagcuuuccaggagcuuucagcaagucuuguuugcauuaaaaaguaaucuaagcccugcaugguagcacauaccugccuuuagugcuaucacuugguagguagacucagguggaucucucugaguucaaggccacucuggucauuagugaggucuagaacagcuagggcuaagcaaagaggcccugucucaaaaacaaacaaauaaauaaauaagcaacaauuuagaaaaacugucaacuguuccccacaggaaucuauuguuuaccacaaacuucuuugcaugcacauuugguaaugugagguugaacaccgaaggccuguuuuuuccuacgaaacuguucaccagcaaaugaagucugcuuucuaguuugcagacuucuuuuuaaauguuugguauuugacauugcccaguuuugagaaagucuaagauccacucuuacagaacuaguauccuuguuuuucuugcaaaacccauuucuuggagcugucccuuaaauuaaugagcauggaguuucugugcacacagccucuuacuuggccucguacccgaggcuucuggguguaacaguaaaacuguauuugcugaccauuaauuaacauaccgaauugcguggaguauccuuuccaacacgguaggguaggugacugaaagacaaaugagcagcucaccguggcucagauuuaaauaaaccaguggaaccaaggaguuaagcaaauccauuuggaccucagauagucuugguauaaacaugagcagggccuaggaacuuugguuucugaugcuuuaccaaaauuaaguuuuggaaacaaccaguuuucugacuuuuauaucucaugcuaaauucuuaagagcaacugugagaaaaguggggggaauaaguuauuuauagaggaggaauccagccuccuucuguuugggggcguaugucauuucucaacagccagguuguuccuuaccuaacaagcccugccagagcccauaauucauacuuacaggcacauccuuuguuugacaacacuuuguggguuuguggcuuggugauuuuccuguaauggucuugucuaggcaagagaauauugucucaaacauggggcaagauuuagcugcuuggcugacgcaauagaaaaugccuaggugugaaaauggacaguucugaauugcaggagcaguauuugguccuaauugcugaacauucucuccaggcuguuaaaaaguuagaauuuucagccgggcauugguggcgcacgccuuuaaucccagcacucgggaggcagaggcaggcggauuucugaguucgaggccagccuggucuauagagugaguuccaggacagccaggggcuacacagagaaacucugucucgaaaaaacaaaaacaaaacaaaacaaaaaaaguuagaauuuucaguagaagaaaugaugguggugucaggauacuagaauaccaagcauacuaguuauaauuucuaugucuaguggucagguauuaagugucuguagcauuuuuguuugaaugaucaaccacauguuggaggaauggaucuuugauguugaugauaagauccccaaaucaugaaaagauacagaucauaaggcccaagaaauuaaaaggagcuuccauugaggugagcgagccccucuuucuacuaccugugagugacaggucucugccagaaauucaagccccagcccaaacaaagcuggaccugcagaaucaccacccucggcccccuucccgggucucaccagguccugggugccuugaagcaguucaacuucuuagccgaugaaugcaccuuagcuacauucucuguguacuuacugguuagaccaaagcucuguuuacaaugcucguuaaucugcaguccuggccuacaccuaugcgccuaacguugaaccucauguugguuaauuugcagugcagccucugcgcuccauuccaccuuacaacaccgaggugacagagaccacaauugugaucaccuggacccccgcuccaaggauuggcuucaaggugaguuucagaugcaccucucaugauccagcccaggggugucuuuccauucccacuacacuuuacagaccuggguuuuuaaaguucuaugcucauacuccaggaccuucugagagcaaagccugcauugaggcuucucuguguugcaagggaagaaaaccaugagccauggaacuguaguguuguucuguuuucuguccuucuccccagggaacuccauuuuaaaauaaaaguauagccaaaccucauuugauguguugcucuaaaugggugucgagaagcuuaugaaaaccaauuugggaagaccaauuaaacugagagucacuuaaaaaucacauuuuuauccaaucaguuucaucucaacuuguucaaagcccugugggugaauuucuuaauagaaguuaaaauugaggucuucgcuuuagauauccagagucauguucuuuaaagcagugauaccagggacgugauggauacaaaugaauauguuuuuuaaaaagaaucccauccuuaggcauccagaggauaaaaaaaaaagagacacuuauuaugucuggaaucaaagccugauuguuuaaaagagagaaaaaagaaauagaccgagggucacucugcuuuuuaguaugcaaauagccaucuugaugagugggcugcucagguacagaggggaccuuuaugaagaccgccacggcaccuuuuuaguuucccuuaauaaugucguucagaguuuuagaagccacagagaaucugaaggguuucucuggagcugaguacuguuugauaaugucaccuaagcuuuuguaguuaggaacacacggacgucuucgugggaauguguuuuucauuuccgugugucaaaguggcugcagauaacuuauuaaagagagagccuagagcauuucuucccuguguacugcugguaugcaccagaaggguuugugucaaacaguuauacugacauuucucuagaaccuuucuauuauaaaggacccuaguaccaaaggaagauaccuccagcuaauugcaagaucacuaaagugagcccucaauguguuauccacccaguaaaugcaguguggaguuguaacggacuucccccuguguaaaucuacaaccucucgggaucucuggaauauucauccuucaugcugauuuugcugucuuccuuccagcuggguguacgaccgagccagggaggugaggcaccccgagaagugacuucagacucugggagcauuguugugucuggcuugacuccaggcguggaauacacuuacaccauccaaguccugcgagauggccaggagagagaugcaccgauugucaacagaguagugacacgugaggagagccuuccuucuucuuuuaacuuguaaacuauuuuaaaagauugccaaagccaggugugguagggugugccuuuaauccuagugcuugggaaaguuaagaaugaugaugggaguucaagaccagccaaaaacuggaggcggagcuggguuuuauaauacacaccucuagucccaguacuuaggaagcagagagaggcagauauuggagaauuuauggcuagccuggucuacauaguaaguucuaggccaaccaacagugagagccuguccccccaaaaaagaaacauauuccucuaauuauuugaauguuagcgucccagcuuucuuuugagacagaacaagggaagaaccucucucuuauuuauaucagcagagucuucagaacuggauguaguuuagcuggugucaugcaggccacagaauuagaaguguuccuuccaugucaaaagucuuccaaacuggcaagaugaaacaauuucaguagugaauuacaauagcguuaauccuagagaccaccuaucgggguuacugucgccuguauuuuuauagaauacuuuauuuucccaguccuagagggaagggauaaagaaaggcaaaaaaggagggaggugcgaggaaagaaggguggagagagggcguagaggaaacauuucacaggccacguguucuguguucaguuuaacuuuuaaguuuucuuuucuguuguguagcgcugucuccaccgaccaacuugcaucuggaggcaaacccugacacuggagugcuuacugucuccugggagaggagcacuaccccagguaacaaaggggagcaccacccuagggaagcguggggcggaucugagagccgcguacacauaaggcuuucccaagacagauuuggauuccauucagagaaagagagaaagcaagugcucugcucuccaugagugacagaggagaaugagagaguucaugaacuacguguaaacacggcugcaucuuuucuuaacucgcaggaaagagaacaaucaaaugcuaggcugugggggcgggggagacuaacguuuauacuacagggaauuuugagaggauuagauggaaagaagauuuuguucagcucguuaaaaaugcccaaacuggggcuggagggauggcucagcaguucagagccccagcugccuuuuucagagaacccugguucaauucccagcacccacauggcagcucacaacugucuguaacuccaguuuccaggggaucugaaacccucacacauguaggcacaacacgcaugcacauaauaaauaaacaaacaagcaaauaacaaauaaauaacaaguaaauaaaugacaaauaaauaaauaaauuuaaagcccaauuuuaaaggcugaaaucauagucuauaguccauaaaucuuaaguugacuguuuacugaaguuugacagaucgcuugguaucuggguggggcuggcuucaggguucccauugauuccaaacucuguagcugcucagccaauugcauaaaaugguguugugcuugcguauaaccuauacauugcuugcauacuucaacuaucuguagguuacuuguagccuaauagauugcaaaugcuguggaagucauugucccacuggauuguuuuggggacaguaacaagaaagagugcaugcauagcauagauccaaauuaucuucaaccaguauuuucuuuuaauccauguugguucaguaugcacaucuguaaccuaugaauauguaaugaauugaaccauaagauguaugagagacagggaugggcagaggcucacauggggaagaacauuugaugugcaugcagaaggacauaguucauccccagccacuaggcaaaaagcugggcguggcuacacgagcagcuaugauuccccugggagacccgcugccacaccuugcuacuugagaacauggucaaugggagccaacuaguuggagcaauauuuuuaguucauuauuugauuguugcuaauuuuacucauugaucauuuuuuuuuuugagacaggguuucucuguauagcccuggcuguccuggaacucacucuauagaccaggcuggccucaaacucagaaauccaccuuccucugccucccaagugcugggauuaaaggcgugagccaccaucgcccggugauaaugguuuucuaaaaguaacgucaccccaacacuaaggcugaggcaggaggauuagccugguauauacagcaagucuuaaugcuagccuggagucauagugugggcuaugucuugacaaaacuauauaaacuauaucugcaucuaucucuauauauuauauacauacacauauauaauaucaucuuaaaguaccuuuguaugauggaugcaugccuacaugcauuuucaugugucuaaguucaggugguacaguguguguauggaggucagaggauaaccuucaguauacgugacugccuuccaucuucuuuaagacagugagaccaauagcuucugggaacucuccugucuucacuucccaaugcucucuagcaacauuggggauuucagacacgcucucgugucuggcuuuauguggauucuggagauaggaacucagucagguccucaugaguacguggccaacagcuuauccaccgagccaaaucuuuagucuauaauuuguagcuauaaucucuuacacuguucuuacccuugcucgggcguaggugucaagcaguuaucuauaaaugugugugauuauagucacacaaaauaaaacuaguuuaaaauacuccuuuuaaucuccuuuugaaauagacagacugagugauguuuccuucucuguggcaauguauuguauaaugugacagcuacaguguuuccagauaaguuucucuggguuugaaacuugaagcugacaaguucuugcuucugggcagcuggaucaucaaucuuugguuucaguggccugcccauucaauggucaggcguaaagcaaaugaccgaaauguuauugacuucccaucccacuggguuuccuagcacauaacacguuaauguucaccuucuccccacugacaggauauacccucauucccuguucucagugggucagucuuguucugucuucuuccagccuggcccugcagagcucuggccacuacuagauuuauugauaucuccuuuccuuuaaugccuucacugcccaauuuucaugauucugaagucuucuaugauuaauauuuguuuucgagaaugagcaucuacacuucuguguucugugcccuccagccccuacccccccccccccccguucccauaguucaaacuuuuacacucuucggagaauguuuaaguggaaagcaaccucagagcauucaaaaaaaaaaauguagauuuccuagcucucccacaggucgcccauuaaggaaaaacaggauaaaauaguaaaaagaggcuggaauuuguagacaggaaacucucaggucuucucuaagauuuccuuaucuuuguuaaaggucccaugauuuuacuuuguaguuaacacauuuauauggguuguaagaucgcccaauggaugcaauguagaaugaucgaguuagcauuuccaucuaaaacauucaugucuaagugcuggacacucucagacucuaguuauuaugaaauuaucauaaguugcuguggacuagucacccggcagaguaauuccuacuuucugacuguugguacauuacagcccugccccuuggucccaccuuuuccucucuagguccaucauugguguacaguuuaauauacccugagucacauugguucuguaugguaacuuccucucugcauuuacuccagauaucacuggcuacagaauaacuacuacccccacgaacgggcagcaggggaccucucuggaagaagugguccaugcugaucagaguuccugcacuuuugagaaccugaauccuggccuggaguacaacgucaguguuuacacugucaaagaugacaaggaaagugccccuaucucugauaccguugucccagguaauagaaaaauaagcuguuauccuuagaguggcaguuuugaguagcgauggggauaagcaucuuaauccgagauagcugagugugucagauacaguugggauuuaaugccaaccucccagggcgcucuccaaaaccacaaagccaaaaagcaacuguuuggaugaaggcuuuccuguuuccucugcuucacuaucugugcuucccugggaugcuguuuguugccauggguaccugaugagugcggccacggcauuaacucuguacuguuugcucacacggaaagauuacuaaacagugucgcgugucuguacccagugcugacaggcuaaaaguaaugugguaaaugcaucccuuuggggcuuuugugcccggguuuuacaguccaucuccaccuccaacuguuaucuagaaaacagccuuugucuccauaugugagcacugaaacacacuugguugacaauccaaaucuuuaucuugcagcuucaaauccuuuuuaaaauugcaaguggggugaaaaaccacagaaaggaaagaaguaaaggccaggccccccauggcuugcuuucuucugaauugaaagacagcgucacaaaggccugucuagggauagguucauuguuuguccccagucuucuguagauugaaagcccuggucagacucucuuacccucugcaguauuuugcuaugcauuuaugaauacuaauuaaauuacaugaauuaaaauguuggcaguggagugggcucagggcucugugcuggcuggccuuggccugacugugcauuugaguggcacauucacaacauagauuaauaccauggucaugaugccaucauggcuuuugaacauggaaaauaagucaauuagccagccaauuuuuuuuuaaaaaaccuuuggaagauuuuauuuucuuacuaaagguuuuguguucuccccacucccaaccccccaccccgccaacauugcuagugucuuuuauagaucaguucaggcucugagaaugauuuugacauuguaaauggguuuaugauuaauuuuuuuuaacacuugagaaguuaaaacuguaccauucagggacauuuucuaaaugggaggaagccccugaaagaaugugguaaccugcauuagucucccaggggagcaaauuacucaugaugcuugggacgucuuuucagauaauuugggauacauugcauauaccaucauugcuugagcauuccgucaauuucacuaccggucaccugauguacacugcuuuauuuuuuccuuuguuuuuugccucuacuuuucuuuugccuccucuuugcuucguaacucaauagaggugccccagcucacugaccuaagcuuuguugauauaacugauucaagcaucggccugagguggaccccgcuaaacucuuccaccauuaucggguaccgaaucacaguaguugcggcaggagaagggaucccuauuuuugaagauuuuguggacuccucaguaggauacuacacaguuacagggcuggagccuggcauugacuaugacaucagcguuaucacucucauuaauggcggagagagugccccuacuacacugacacagcaaacgggugaaucuugaagucuucuguguuugagacauggaugguguugcaugcugcucagucgcugugguuaaaucuggauguuuccaagccagugauuggcuacggagaugaagacggggcccgcucagagauaagggauacauuagucugguugcaugaaaguaugcguaaauagucucaagcacuuucagucaaagcacaaacagaugugaaggggaagagcucuagaucucugauuuaugaaaugcaaaggagauuacauuugcagaucuugaggguguuuguuuuuuuuuaaaguaugacuaucaaacugaacaaugagcacucauuuacacuaagacaggccuccaaagugugccacugcgugcuuccucuuaccuugauaagcuccuuuuguagcuaauaaaacaccuaccaaaaaugaguguggaacagaaggggagaucucaggguaggaugacgacgagccguagggcuuucuggauagugcugcucuacaggguaaagaaacuccucuuuaaccacagucuagagacgagcaugcaacaucuuaaagguucucugcccugcaugguaagaaacauugcugagaaccacugugcaugaaucccucacuuguaaguagaguucacugaauggaauuauggcaaugcaguaguguguagauaucucacuccggggaaacugaggaccccuugucuuuuuugucuucgugcauguguuucuucggaaaguacugcuaugugucuuugcuguguggcaacuuaagccucuucagccugggagaaacaucuuccgugguaucgauguacuaaaacggcaauagcagccaccaaaaaaaaagccuaccuauuugaaaaguagacuaaaauucuuuuaaaaugcauugaucauggcagaaagguuaaaggggccuaacaguguucucuauaguguuuuguuuauuuuuuuaacaguagcgugucaugauuuagauuagauuagauuagacuguuugcaugguuguaacuguuucuuuucugcaugaaauacugguuuuuaccuuuucagcuauuuuuuuuuuuuagcuuugacuuuaaaaucgcauuaacucaauccuccuuauuugauaucagcugucccuccucccacggaucugcgauucaccaauaucgguccagacacgaugcgggucacuugggccccgccuccguccaucgagcugaccaaccucuuggugcgcuacucacccgugaagaaugaagaggacguugcagagcuauccauuucaccuucagacaaugccgugguccuaacaaguaagcccucaaacauagcuugucccguagauacgcagauccguagaucuggagcacaaggcauggauccugaguuuuccuggaggaccaccuaagagaaaggagaacugugaccgagagacacgcucuccaaguucaguaggcggcucuguaaacugugaaagauguaaugauucugccggaguggcagaccuuugaucgcuacaaaucguagucgaaggcacggucugugaagcaccaaggugucagacauucucuaaucagugcacaaaagauacgugacucccaagugaauucuguaacuaaggcaagagugagaaacauggagaucagcgcaucugguuuauuguccuuucuugugugagaucuaccaccaccaggggaucuauuuagcacuagaaaacuuagaauggcuuuugcguggagacaggcagacguuuaguucauauuucagaaagcacguguuugcaccauuucccugaagcugggagaguuuagaaagcaacugacauguauuagacaaguuauagaaauuguuucuucccgaguccuacuggaagaggauacuuugaauuaaagagaacaagagcuugcaacauuguaggaaauuguauaaguacagggguucuacaggagaggaaaguaguuacauucaggcccauuuccaaauagggucagaaaacauccucugcucuucagauacggcucagaaagcuaacuacaaagaggcagcagcagcagcucucacuugguggcuaaagaccagaggacccagauacuuaacccgaguguggaaaugucuguccagucaguaggaaccacauuguccaauauacuagacccaucgccaccuguuggcaccgguuuagccaaaccgugucacauguuaauuauguaucuuaaagaguccuaaugcuagaagaaacucccccuuagagaagucauuauuacccuauuuuaaaaauuaagcaguuugagggcaguggagugaguccaggggcacuagguauguucauugucuugaauacauucauggccccaacaaggacacaugucaaauuuuguccaacuguacaucuugacauugcauagcauggaagcugcugaccaccucaugugguuguugugauggguagaugguaauguagacucccacaaaaguuacaucaguggcccucacagaugcccuuucaaauggacgggagagauaguaacaucccguguuuacacuugacugaguuccauuuauaccuguggagcuggggcuuacagacaggacagagcggcccuuauuuacagauuauguccagacagacauacucacuuagccacagguaggcuaugggacugaacgcuuggauguuuuaucagaugacggagucccggggagcguuaugcuuucucaaagucucaaucaaguuuaaagcaaaucccacuuugccucuucagaucuccugccugggacagaauacuuagucagugucuccagugucuacgaacaacaugagagcaucccucuccggggaaggcagaaaacaggugagccacguuagcuaccaacguuaagcaacaaaaugauagguugagucuauaguugcaucuccaccuuuuguggcauugauacauuacuuuuaauuuauuaauuaauuuaugaugacaauaauuaauuacaacuaauuaauaauuaauuuuaguuauuguagaguagugguuuugccaugguauuuucacaugcucuguugauguuccucuuccguuccucuccuugcccccugucauccuuccugguccccuuucucccuguaguaauguacagccccguuuucacucucgucaucuugucaccucuauccuaugacccuuuucacuuucuacccucuccgccuuaaagcaccuucucuucuccccacauuccuuuuucuaguuucaggaccuuugcucugcacauacauguagaugcucuauacacacauaugaaaaauuaaagcuaggauccagguaccagaaaacuccacuugucuuucugagacuggauugcuuuguuuaacauaauaauguuacuuuguuuaacauaacaauagaguucccugguuuccuugugaauuucacugguuucuugucuuaguuaagguuguugugauauuugugaggaaacaccaugaucaauagcaaacuggggagggaaggguuuauucgacuuacacuuccacacuguaguccaucacugcagggaaaccaggacaggaacucaagcagggcaggaacuuggaggcaggagcugauacccggggccauggaggagugcugcuuacugacuggcuucuaccaugaccugcucagccugguuucuuauagaauccaggaccaugagcccagagaaggcacugucccgcccacagugggcagggcccugcccugucaaucacugauaaagagaaagcccuacaagcuugccuagaucuuacagaggcauuuucuuaauuaacgacuccuuccucuuagauaacuuuagcuuggucaaguuuaugauauaaagcuacccagaacaacgcugaagcccucagaaguaucaguguuucgguauaauguagaaaucggcuauaauuuuacauauuguuucaauuacuuuuaaaaggaaaaaaagaaagaaaugcuuguguaagcugauugcggucagcuaucagucccguauaacagugucaguugcguuccccacauccuccauccucgaugucuaagcucgugguuguugucuuuugcuccccuccuugggugggaaaaacaggucucgauuccccaacugguuuugauucuucugauaucaccgccaacucauucacuguccacuggguggcuccucgggcccccaucaccggcuacaucauccgccaucacgccgagcauucugucggaagacccaggcaggaucgagugccgcccucgcggaauuccaucacccucaccaaccuuaauccgggcaccgaguacguugucagcaucauugcuguuaauggcagagaggagagcccgccacugauuggccagcaagccacagguaauuuuguuuuuuuaauccgcaaagaaaucccuugguguggacuuuguauagguuugguguagacugugaaaaagcuucauguuagacacaaagagcagugguggagccaggcgcagcugugcgcgcucaugcacgcaggcacgcgcgcacacacgcgcacacacacacacacgcacgcguacgcacacacacgcacgcacgccuuugaucccagcgcuuggaggcagguggauuucuggauuggaggucagcuuggucuacagagugaguuccagacuagccagagcuacacaacaagaucuuaucucaauaaaaagggaaagaggacagugauagacugugugguaaacauuucucccucuaaaaacauauuuauuucucugagagauugucaccugguucagcuauguucugguguuuuugcuggucagucuuuauuuaugaugguuugagagagcgucauagcccagacugacucagaagcuggcucuguagcccaagcuuaucuaagauacuucgccuugacuugugagugcuggaguuacaggcaugagcuacuacuacucauggauauuuacugguuuuuaagaagguuucauacaaaaccauaauaugguaccaaaguuacuguaaaccuaugauuuuuguuucguuagcugggcuugguagcacagauguguaaucccagguacuugggaggcuggagcaagaaggccauccugggcuacugugaguucaaaguuagccugugcaauucagugaggcucaucucaaaguaaauaaaaguuuuuuaaaggggugcaguggauguaguguagugguggagugcucuguguggcgugagucaagcccuagauuuuggcuuuaagcacagauagauauauuuucagugacaaugacugggagaccuguuaucagaacaaucuguagcuuagcugugaauaggggcgugugugaccacuauuuccaaauaacacauaguuaagggugcauggggugggaucucugugaguuccaggccagccuggucuacaaagcgaguuccaggacagacagggcuguuauaacacacagagaaacccugucuucaaaaaccaaaagaaaaaagaaaagugcauggugagugcugcuguaguuuuuauaacuucugugauuuaaauuauuucccaaagagacuguugaggaaaaaaggaauucacaauugggauggucuccauagccccuucccuugaccucgccauagaauuuaacucugcuaauucaguguugcauuuagauuuuuguuugaagaggauguguguaaucguuaucugggaaaggacaaagugaaccugagcuuucuuuggaaguuauacaugugaaguuuuccugugauuuuuuuuuuucuaguuucugauauuccgagagaucuggaggucauugccuccacccccaccagccugcucaucaguugggaacccccugccgucucugugcgcuauuacagaaucaccuacggagagacaggucuguucauuuugggccauuucacccuuagaggaucaggguucggguggguaacuuggaaaucugacagugggaacaggauuaaaugcaaacaggcccauuuagaaaaccccccucccucccucccucccuccccuccccuccccucccccucuuucuuucuuucuuucuuucuuucuuucuuucuuucuuucuuucuuucuuucuuucuuuuucuguccaaaaaugcaugggagcuacauuuaauugauuguaaugaaguucaaaggugguuuauacacuacagcaagggugggaagcagagcugagaaaaaaaaguuuauauauuuacaaauauuaccauugguaauucuuacuauucuuucuuuucaguguucucuaaauuuaacaaauauucuguuaacccuuuuguaaagacuucauuccauuuuagguugagugagccacauucuuguccccuuuuucuauuuaauuuaaacaauuaauuaaauauaauuacaugauuuccuccuucccuuuccucuuccaaacuaucccacaccccucucgcuccacuuccucucaguuucuuggcuucuuugucuuacuguuacacacacacacacacacacacacacacacacacacacacacagagugcaugugcauccaacaaauaaguauaaauacaacccaccgagucugcuuacuguugcuuauauggacaugguuucagggcugacugcuugguauuuauuaucaaccagggagcucauuucuggggauuucuucaccuuuugccuguuaaucugcaacucagugacauuuuaacccagggauguuaauauggcauuagcuugagaguucuccugguuuuuauauacuucucagggcuuacuacacacauaaauacacuugucugucagguuggguuaaagcagccacuccuuaugauggaaccagcaagcugcagugacuuacauaccgcuuucgauguguuaauaauauuggaguaacuccuagcuccucaaauucuaugcuaacuccuuucguacaggaggaaauagcccuguccaggaguucacugugcccggaagcaaguccacagccaccaucaacaacauuaaaccaggagcagacuacaccaucacccuguaugcugucacuggccguggggacaguccagcaagcagcaagccaguuuccaucaauuauaaaacagguacaaauuucucuugggguaacacgggguuauuuaugaagaugguuaucccuguauucguccaagguauugucuucacuacacaguugauuuuccuuuaguuuuguguggugcuggggaccaaacccagcaucucauaaauauauauaugcuguaccacugaacuacacccuugacccugauuuauuuuucuuuuuuuuuuuccgagacaggguuucucuguguacaaaagccuguagcuaacaacaccuucaaguaauagagucuugagacaaauguacaaagaagaccccaagagcagacauuuuugucuguguuuuuaacugcuaccgcuauguaucuacauuagacacaagccagagaguguuuauaaauaccuguagaaaaugacuggauggguugacuauuaggagacaaaggccuaccugagauguaaugcuuuguuuguggaaugaaagaaucagguuguaaauaguuguaauagugacuggaugcauggcuuuccuucuucaagcuaacacccuuuauucuugucaaaagaaacauuugcaauacauuaauagaagcaagagaacauucgcauacacacuggaacuaaaggccagggcuuguccagcccuccccccacacugggacaucacugcuuucuuuuguacuuacagaaauugacaagccgucccagaugcaggugacagauguccaggacaacagcaucagugucagguggcugccuucaacuucuccugugacaggcuacagagugaccaccacucccaaaaauggccuaggaccaucaaaaacuaaaacugccaguccagguaaggauaaccacaaggccacaccuagcaagagaaacacuguaggagcucagaaguugccauuugaagugaguguccuaugugguguguguaugcuacucccauucauaggcuuggcaccagcucaguauugguauccguguaucucggguuuuauuuuuuuuuaauacugucuuguguaguaggaagagaaggauauacugauguuauagauccuucuagaucugauguucuuauaugaaauggcuugcaaggucucaagccaguuucuuaagaucaauuuucauuucuuucuugaaauuuuucaagaauagccucauuaauuuugggggauggggcaucauguuaaguuaguuguaaagcuuauucuugaauaugauuuuacuucaguaugcuagauuuuguuuugagaugggggucucaugaagucugugcuggccuucacugcacuacguaggcaaggauggcguuaaacuucugaucuuguugucaguaucuccugagugcuagaacuauagauacgcacacaguuuacugugccgcuugguuaucuaagccuggguuuguucaugggaacagcauucuaccaacuaagccgagcuccccagccccaguuuugguaccagugaacaaguuguccugagaggaaacaggcaucugacuuucccaaguggaauggguguuucaugguuauucugcaaaugaaaauuauaggcucagcaucugcuucucauugaguccuuaggaguggcuuggguggcucuauagaccugcaauuaauugcuucucccuccuuuucagaucaaacagaaaugaccauugaagguuugcaacccacuguggaguacgugguuaguguuuaugcucagaaccggaacggagaaagccagccccugguucaaacugcagugaccaguacguaaccaaugcucgguuuccuacuuccaaagucauauuguccucaggugucucucgaugcccaccgcacaucuugugccauuguauacacacagggaaaggcaaugugucagcugguucauaucuugagaugagcccuuggccuacauuucuuggcgccaaagcgagcuugcaggaaaaaucacuguaguguugccaucaauggcugcugugcuuugaaucuccuuugcuuaaacagccucagcaaaaucuuauuugcuuuuagcaaaucuaugaaagaucucuccaggaccuacuuuuucuaugacuggaugguaauguugacuguagugugccccaagaagugguuaugguugaaggacuguggcugggucagccuuguuuuuuuuuccuuuuuaaagauuuuauuuuuuucaucuauaugaguacacugucacugucuucagacacaccagaagagggcaucggaucccauuacagaugguugugagccaccaugugguugcuaggaauugaacucaggaccucuggaagagcagucagugcuccuaaccucugagccaucucuccagcccagggucagccuuuuuaaauauaaagacuuaagagaggggaaaaaagaagaaccuaagacaaauuaugacuugaggaaaaaaaaaaucaacuuuaccauuuccaagauauagaaaauccagguccuugagacuaacaucacauugcagaaucaaaucuagaauaucuuuaaauugauauaaauaaauuuccuugguggagauuuuuuucuucagggugucuacauaccuuacacacacuugugucuuaauaagcaacgugacacugcauaugcuaaaucucaaaaaaaaaaaaaaagccuuuuaagcagaugucaagcaacuuucuguuuuaauagugugauaauuggaacuuaauucaucaaagacaagaguuaucugcagaacugcuuugcaugguauggaaauaugcuuguuucacaacuugcuuuucacauaaccucuuaccauuaauuugccuaacagacauugaucgcccuaaaggacuggcauucacugauguggaugucgauuccaucaaaauugcuugggaaagcccacaggggcaaguuuccagguacagggugaccuacucgagcccugaggauggaauccgggagcuuuucccugcaccugauggugaagacgacacugcagagcugcagggccucaggccggggucugaguacacagucagugugguugccuugcacgaugauauggagagccagccccugauuggaauccaguccacagguauaucguuaaccgcacccaccacccgggugcuucugggaacaguggcuuuaugccuugcuggcguuauacuuuacugggcuauugagucccauguaagggagaguagaaaaaugccuucaaacucuuaguaaagaaaggcccucuuuaaugaggaaugguugugaacaaugaaagucaggugauguuuagguaacuaagucuaggaaagagaaauuuaaaguagcuaagcacagacgugcaaacauaugaaauauauaaauauuuaaagauuaugaagcaagacauuugaagguacuaaauuacggauuguuuccuaagugagacaccucgguggugacccucccucuccacacauggaggaaagaagucuagaaucauagagcuuacucugagaauugacccucuuaagccaggcauuuucuugcaacaugaucaaagaauacauggguaagaccuccccuggcuagcucuccugugcugggccuucauuugcuuaaaggaugaugaugcagaugcacaggacagcgucauuaggaccagugcuucuuaccagccucuuaugcuuuuaccgcuggagcaagauuggaaugcucaaagcauacagaggugacagucuguggaacugcucucugcuucucucuccugccucuauuguaaaccaauuuucuucuuaugcuacgccgcagagaauacuucaaauuuagcagugcuaucugccgugggguccaaauaaaagagacaaauaaaaacaauucuaucucuaggauggaauagucugugaaauuguuuccuguacaaagauaauuuauauagaaaaaggggccauugcucaucuuuuucauacaaauggaaaaaaaaucaauucuaaugacuaauaagggaauucaacucuuggcuucuaaaggcguaggguagggagauaagacccaaagucucucggaacccugguguuuaugcagauguuugcagugguucugagaguugcugguauaaauacuccucucguuuuuauuaucuguuugugcagacucuccugggagucuccagggaguccaccagucccuacgaggaccauccauucuccuucuucaaguuugcuuucuuuccccguuccucguucccuauaagauaaccuuuuaaccaaugaccauccugacagccauuccugcgcccaccaaucugaaguucagucaggugacacccaccagcuuuacugcccaguggauagcacccaguguucagcucacuggcuaccgggugcgggugaacccgaaagagaagacaggaccaaugaaagaaaucaaccuuucuccagacagcucaucggugauugugucaggacucaugguaagaagugagcuucccucugcagaguaaggcaggaggucauuucauagaguucauaggugcaaucucauaauaaaccuaguguucuuugcuucuaccaucaaauaggguugucacaaauguguacaauagaauucuuuuauguagaccuaggauuuucuagauacccuaagaugacuauuggauuagaaugguguaaauagcuuuggauuucgugcaggucuuugacagaaguauuccacuuauuuaaaagaagugguauucgguagggagcaauuuauauacacacacacacacacacacacacacacacucuggcugaguuuauggcuuuuaugagugauguuucccuggcaagacgcauucuccaguuaguaccagccuaacuugacacuacccccauuaaaacauuugacaaucagccagcugugcuuuaaucuugggaggcagaauaagcagguggauuucugaguucgagcccagcuuggucuacaagaaugaguuccaggacagccagagauacacaaagagacccugccgcaaacaagcaagcaaguaguauuuaaaacuuuuucuagccaugcagaaauuagcuaggauccuauaagggcuuaaugcacaucuuaacacaaggccaauucuuagagaaguagcaguagaauagaagcuuucucuugcuuuuuuugugaucaggaaaaaagcaaaaccugauuuauaucugucauaucauaaaggcaaaaaaaaaaaaaggcuaagacugauuucuuucuuauucuuuuuuugcugcuccuuguggauuguggacuuaaccccugagaacauuuuaaaauucacuuaauuuaaauguaaauguauugucacucauagguaacagugaaguugcucugggaaccuggggguuugggguuugcugggcuaugcagauggucuuuuauaaucaccgcauuucucuaaugcuuugguaagaacuccgggcaucaugcaacaccauugccaaaguuucugguaccucugcuuccagguggccacuaaauacgaagucagugucuaugcucucaaggacacacugacaagcagaccagcccagggagucaucacuacucuggagagugaguaauccgaugagugacauguuuuaauccugacacacccugaguggaagucaaaagaaaagaucuuuacauuuaagccacugacuuagcaauagaauuuggaaguugauagaacagcuugucguuucgggaauccauccaggaaaugaccugccgaaacaaaauggaaucacuucacuguguuguguuggugcugguggguuaaaacucacagcuggcuuaugcgguacuggugagggucuguauucguaggguucaauguggggaagaugaacuggcuuccaccauagggaauguggggcuaaauuagaucuguggucuagucuguugauguuucaucaccuauggaaugauuaacacgugaagccuuauagaaaugaccgaagauucgccacccagacagacguuauuacuaauugucuguguuauaauuccuaccauacauccuuacauauuaguaaaguaaucauugucacacuuguuugacauagcucuagacacuagagagucaacccugggcaccacugauaguauuuagaaagcuuuucuguuuagugaacauuuccauauuuccucaauaccguuaacccaucuuucuguaaccuccacauuacuuuuuaguguauuuccugaaguggauguauuugcauaaugaggacucuuuuuaaaauauccaaaccuuacauguaugagccaagcgugcuuuaaucucuggcucugcuccuacacagauguuagcccuccaagaagggcccgugugacggacgcuacagagaccaccaucacuauuagcuggagaacaaagacagagacaaucacuggcuuccaagucgaugccaucccagccaauggccagaccccaguucagaggagcaucagcccggauguuagaagcuacaccauuacaggucaguguacucguggucugccugugugcgcccgcaggagacccuggcucgguagauagucuggucugguauugagaaugugggcaccauuccacgaucuguuggcuuccugauguuugcuugaccuauaaaucucauucauugaauuuguuguuuuauaaaugcucauucauuauugucuaaugaaaaucugcacacuguagucauaggcaggagucugaggcaggaggaugugaguuugagacuagacauagugaaacccuacuuuuuuuaaaguuaauauagagaacauaaagauacaaaauaguaaaauuagcaugccuagauuuuaaaaggcauaaugaaauuuaugauuacaaacagcauuauguauaauaaaaccggaaacuguaaucagagacgauucaguauugggacauaagugaggugcuuuugagaugaguuuuucauuaguagugaccuguccaccccgugaagcccuuuacucuucccuguaacugcuucugccaguauaggagucaaggaaacuguaggcaagcaugagaacucgccuaguaaaguaggaguggauuaaacaggcgucuuuuuaacuuccagguuuacagccaggcacugacuacaagauccaccuguacacucugaacgacaaugcccggagcucgcccgugaucaucgaugccuccaccgguaacuaugcuuucuauggaggaaaugucagcugcugcauauuguaaucagccgcgucaaguuuagaaacaguuagggagcuggaauuuccauguucuggcucccgggacucucugauucucucucuccuccucuguucgcuagggcugggcucaacugugagaauggacauucauuuuucuaaggugucacuuugcuugccuuucagccaucgacgcaccauccaaccugcgguuccugaccaccacacccaacuccuugcuggugucauggcaggcgccccgugccaggauuacuggcuacauuaucaaguaugagaagccuggauccccucccagagaaguggucccucggccccgcccuggugucacggaggccaccauuacugguauugcuuccacacugugauuuuuuuccccccuuaaucauagaugccccaaguccauaauacuccccaauugugucuuugaugcuauuucaugagaaugaggugcccagcacucuagauguucuguuuagggacaguaguuuucucaagagauaugagcaacugagcaugcaauuucagugccguccuaugacacagcugugauguauuacacucugguguaaauucuucauuauuccccccucccccauaggauaaauuguguguauagauucuccuggauguugaagucucuaaaacacacagauauaaggagaucacagcuucuuuguugcauuuauugaagaagaaaauaagagucugauaugggaagacuuaagcagaagacauccuaauuuuugcucugucacugacagcugucugagauuagaccuaaauagaagucugaagucucugauggccucucccaaauacauauuucauugucggcccacaguauagauaguuuaucuacaggcugaaagaauccucuaggaagguugccaugaaacugcucauucaaguaucagcugugguugugaaaugacuaacuagccaaggggcuuugggguucgcagaguagauaaacaaggagugaagcugaaagacuucacaggcagcuggcaggaaugccugcuccccagucgccucugcugagccaaucacuggccgugcccgccaacgugagugaaacggccgcguuucccaucaggucuggagccaggaaccgaguacaccaucuacgucauugcccugaagaacaaucagaagagugagccccugauugggaggaagaagacagguaaagacucauaaccagugguugcuuugcagggugaagucucuacauuuccacacaucacacaucucucacggauuuuuuuuauuucccuagcagaguggcuuauauauuuuacucuuugacaggaaucaccuaacaugcucuaaaaaugucugauuuauuucuuuuucuacaaccuuaagcuucguuuaccuugcagagauucaaacuagauaguuugaauuggaaggggggggaagcuuuauaauggugggaguaaaaccuuucugauuugggucgauuuauuuauuauuugauuucugaacuucaaacacuucaguucguugcaaagccuuaauuggagcagagauggcuuucuguggggcucagcgguucaaagcuuugucuguaugagaauucauacuaacuuuuuuuuuuuucugucugaacuauaaagaaaucugugagaaaaaaaaaaucacgauuucuuucucuaagaguguuuugugaucugagaaccgcugguugugugggagcucugaucggguugauaaacaguuguugccuggguugacagugauugguugcuucuucuucgagcuuaacuuuugcgcuuugcuuuuuuggcucuaaccucucuuggcuagaugagcuuccccaacugguuacccuuccacaccccaaucuucauggaccagagaucuuggauguucccuccacaguucaaaagacccccuucaucaccaacccuggguaugacaccgaaaaugguauucagcuuccuggcacaacccaccagcaacccaguguugggcaacaaaugaucuuugaggaacauggcuuuaggcggacaacgccacccacugcggccacccccgucaggcuuaggccaagaccauaccugccgaauguagaugaggagguccaaaucggucauguucccaggggagacguagacuaccaccucuauccucauguuccgggccucaauccaaaugccucuacaggacaggaagcucucucucagacaaccaucucuuggacgccguuccaggagaguucugaguacaucauuucaugccaaccaguuggcaccgacgaagagcccuuacagguacaugacagcccuugcaaagugucucucuauguaacugugucuucagaaacaaccacagcuucaugucugaugcccacugucuuagucaggguuucuauuccugcacaaauaucaugaccaagaagcaaguuggggaggaaaggguuuauucggcuuacacuuccauacugcuguucaucaccaaaggaagucaggacugcaauucaagcaggucaggaagcaggagcugaugcagaagccauggagggauguuccuuacuggcuugcuuccccuggcuugcucagccugcucucuuauagaacccaagucuaccagcccagagauggucccacccacaaggggccuuugccccuugaucacuaauugagaaaauaccccauagcuggaucucauggaggcauuucccccaacuaaagcuccuuucuuugugauaaccccagccugugucaaguugacacauaacaccagccaguauacccacccucccagggcagaggcuacgacucugacuggagguuguuugacucagagagcaucacugagcgucacgcaguagagaaaacgaaauucuuuuuauuauucucauacacuggagacuacuuagugagauggaugaaacaauuaucuuaggaaguagaggaaaaguaauuuauaugaaguuugaaaugccaccuuuggcgucuguccuugaagaggcacgcuguuacgugucuaggaagacgaggugaaccguuggggaccagcuguuaugagagaucgauucuccaaaacucucuucuuuaauuugucccacaggugcuagaaucaauuuuuauuguguuauuuuuagaaaguggcagaaauuuuaaaauugacuguacccuaggacauuuauuagcuuagaaacuuuagucuggggaugugccgguauuuuaggaaaacccaaguucuacuguguuggcaccuuacauggcacauguugucugucuguggcacucauguuuaugaaggggcuuuuuuuccaggaguucuaguggccacaggauucagaggaagcugguauagcugaggguuucugggaauuguggaacaccuagguagaaaaaucuagcagaaaugauuuuuuuuuaaguuacucuuuuaauaauuuuuuauguaccuugguguuuugucugcauguaugucagggugaggaugucagaagcucuggaacuggaguuacagaugguugugagccaccauguggcugcugggaauugaacccagguccucuggaagagcauuuagugcucuuaaccacugagccaucuccccaaucuuaaaacgaugguuuuuugcacucauuuaauaucucaucuugacuaggugggaguccuauacagcccuguucucucccuucgucuguuuuuaaaugggagugggggauugcucauagacuaaggaagcucaugccgauucaucauugaaaugcuuucucccugcuuuggauguauaguuccaaguuccuggaacuucuaccagugcgacucugacuggccuuaccagaggggucaccuacaacaucauaguggaggcacugcagaaccagaggaggcacaagguucgggaagagguugugacugugggcaacgcugguagguacacugcuggccuguugaggcacacgcuucuugcuggaucagcccagagaagacuuggucugucguucuuuguuggcuuuaaacuuaggaaaaugagauugcacaacagucagagauguccccuuauguaacccauauguucaccaacacauauugacaggaugccaggccugggagggacaugaauauuauuuacucuaauacauuuuuccccuccuguugaggauccaguugacagaggcaaugguuuuuuguaccuuuuacuauucucucaucccauacugugguccacuuaagcguuccuaacccgaaccgaacaccuauaaacaguccuccuuggcaaucuuaagugaugacuuagguuuuguaccuaauguaaaauguuaccaauauugcccuuugcuuuccuaagagcuucccauuccaaauuucaacuuuauauacuucuuuguuuucuucuucuuuagauuuacguauuuuaauguuauguguacggguguuuugccugcauguaugugugcaacaugcauucagcacccauggaggccagaagaggacaccggguccucuggaacuggacuuauagaggguuguuagugacuaugugggugcuagaaccuauguaauguccuguggaagaggagccagugacauaacuccugagccaucucuccagccccuuuauaugugucuuaauacauaaauuauauaugucauguuauauacaugcaagcucuuaaagguuaaauggccaucauacaaacguaauaaagaugaaacgacccccaugcagccuuuuaauaaagguuaaaugaccagcaugcaacaucuuaauaaagguuaaauaaauuuaauccugaaaauuuuugauaaagguugaaugacccugacucugagaagccuuuugaagccagugaugugucauuuggcuuaaguugcaauagcuaaagauucaccaaggagcaugaguuaagggcuaacugagacuggaucccgaguccucuuacccuggaagggcuaacucccacuuuuuccagggagcaggacuucuggguaggaccacugccuucuuuucagccuucuuccucuuagcgaagacugcuauuauuugacucuucaguuaagcaguugcaugucuggcaaugcagaagugggcagaucuucuguguuccauccacaguaauuagcauuugccuuuugugguuucacuaguaaaaugccacuugaaagggauuuuuuucaaaagcauagggguuuugugguuuuccacaucauuuucuugaaggugugugugugguguguuucagacaguccuacuguauuguaugcuguuuguauauagugugcuagacugaacugcuauguagcccaggcuccuaauguuagggcagaccuccuagauauuuuaaaauagugaacccccaugagaguuuuagccccuuuguuuucuuuccgacuccugucuuuaccagguccucuugguuucaaaacauuuuggauagacuuuuuaguucuuccagaaugauggcuuuugaaauauuaggcauuucaaauauugauuucauuugcacuuuugauuuuuacacuauuaaaagaagcuauccacaaguaggauuuuuuuuuuccugagacaggguuucucuguauauagcccuggcuguccuggaacucacucuguagacuaggcuggcuucgaacucagaaauccgccugccucugccucccaaguacggggaugaaaucuugggaaacccacugcagcuuuucuacuuauuccuaacugcacgguggugauuucucuuacuugaaaaucaggucuuaucuaguuuuacaguaaccauaagcaucuagguuuucaaacuauuuagcaaaagaaaagcuacaauguaaguaaagauuguguuauaaugcuauauaaagaugcuaagacauugacuacagcaaagacguaucuaacaauaauuguuaauuauugaguaacaguaguuaguaagucaucucugcauagugauacugguccagagcuuugauuccucaguuucauguagccuuuacaagauccaaaaaaguggggcuaguuauauuauuaucccguaauagaugagagaagagagacagacaaauguuaauuggcuccauguacucaggugucuuggggaagcaccacugcccauauucucagcuaguuaaaaugccugacgaucugcuucaugucaugagaaacagaagacgggaaugaaggaagacguccuuugacccugcugugacaagugccuacugacugcaucaaaguguugccgaugagaacgucuguguuguuagugcugauuaggucacaauauacaguauggccguuuccccaucaauaaccgucaauaaaaugucuucuccuuuuuuuccuuucuccuucuuuucuucauagucagcgaaggccugaaccagccuacagaugacucaugcuuugacccuuacacgguuucccauuacgccauuggagaggagugggagcgguugucugacgcuggcuuuaagcucacaugccagugcuugggcuuuggcaguggucauuucagaugcgauucaucuagugaguagcuugcguuccccacccucucacuccuccaucucuucuggucucaugcguucgcacuagguggccacggaaacauguuuggcagacucgggcucuuccaaacaugaugcaaacagaaguagacuguuugacuccaaguaacauuuugcaucauagaaggaugaugggaaauuuuacuugugcaauaugacugcauuucaagaguuguguacuaaucuaacuauuccuuacaaauauaucuguaguguugauaugcuccuuguaguguuuagcucuauguaaauugaaguuaaaaaauaucucauuagaguuugguuuaauugagacaggcaggcagagacuccaaauucuuuucagucuuuaguauugaguaaggacagaggugaacauuuauacucacaaacaccacuuuuucagcauaaccagauauacaugcacacaucacacacacacauacacacacacacaucucacaacccagauaucccaaacauugcucguauaaaggaaaaugucucucuguauagcccuggcuguccuggaagucacuuuguagaccaggucggccucaaacucagaaaucugccugccucugccuucugagugcugggauuaaaggcgugugccaccacgccuaguuugcauucuacauuuaaggaucaaguucagggcuggugagcuaggcuaggcaucccaucccuggaacccagguggugccaguccccacaaauugucccuugaccuucacauauuccuggggggacacuaaggcccauauguacauacauauguacacacacaugcaaaucaauaaaucuaauaaauguuaagaucaacuuugacugaaaaauaauuugauuuucaaaucuuaaagagguuaaaauuucaaauuauuagugaaaaugauccuaugaguuaucuauguuucuagagauuuaguauuggaguauauaaccauucauucuuuguuuuuagagcuauaauuauuauuagcuuuuuaaugugcuuuuuuuauguguucaucauauaucauagauauccacaggccuauggacaauuauaggucccauauuccauggaaugacauuuaauagaucucuaaaguuuuuuguguaacauuuuccuuuccuuuacaugaaauagcaaaauccagacugguuucaauguguguuguuggguagagcccagugggcaauauaccaugcuggggacaggagggacaccauuuggccuugaccaggugcuuuuucagagagugaacugcacugaaguuugcauguuuuucauaacucaguacaaauguggacguauacaaugauuuuuauccgugagccucugacucaccagucuuugcuggauaugucauaacugccuuauacauuugcucaucguuuaaggaaggcugaauuguuaaaguggaagaaucacugcccuggaugagggucguaagugaacucuguuuaguauaaaucuuagagguuaaagggcauuuuuacaucugccauuagacacagcucguggugacuucuuaggacuugucuauuuguacaacaagccugauucauuucauuugucuuuauuuuguuggcuguuauauucguucguucuucacuuauaugaaucaggugacaccagcuguuuuucucuuuaaucuucuuguuuguuuuuguuuguuugcuuuugucguuguuucaugagacaggguuucucugugugucccuggaugugguacacucagucuguagacagggcuguccucaaacucagagaucugccugccucugccucccuaaugcugggagcaaauucgugcacgacgacgccugcccucucuuuaauguuuaauuaaacuauuuuguaucuaggaucucugcgaaccuaaaauauauauuuuuuaauucuccaaucccauuuuaauuuuccauauuuguaaaauuuaaaaggagcugaaugaaucacugguugguccucugaaaugaucuuggugguaguguuaagucuuaacacuggccuggaagauauuaaauguuaugaugaagaaaugcuucaucauuagaaaugugaucuuggacuuccugcucuguauggauuuucguccuguuccaguguucugcccauccugugagucagaacacagaguaacucucugccugcgaugucccuaccuuccagaauggugccaugacaacggugucaacuacaagaucggagagaagugggaucggcagggagaaaauggccagcggaugagcugcacaugccucgggaauggaaagggagaauucaagugugauccccguacgucauccuaaaaaugcuuucuagacuuuuuaaguacucccauguuccuaacugagccgaaacacccauuuacaggcugggcuggacguggugggcuugucagucugugguugguaagucaguagcuugcuucagaaagugaaucaugacugaauggcacgucuaagcacuuuagcacuuucacaacuugagcacuuuggucaucugcagugaagugcuauguagacucaguuuuuaaaacauaacuucaaagccaagcagugguggcacaugucuuuaaucccagcacuugggaggcagaggcaggaggauuucugaguuggaggacagcuuggucuacacagagagaaccugucucaaaaaaccaaaaaaaaaaaaagacuucaaucguuccaucuggccuagucuaccaaggcuuuggaacaucuccuugugauucaccuaaguugaugagauuuggcccgugcucauucaggucgagggcagaugcaucaacuugaguguaccugauuguccuuggucuuacaacuguuccuuucugcucugugcccacgugcagaugaagcaacgugcuaugacgaugggaagaccuaccauguaggagaacaguggcagaaagaauaucucggagccauuugcuccugcacguguuucggaggccagcggguaagccugguuggcguuuagauaaagcacuuaggagguugcagcauggauaugcuuugugcacaggagccuugccuuuuaggaagagucucuaagaugggugucucaguuaggguuugcguugcuuugaagagacaccaugaccaagguaacuuuuauaagggacaauauuuaauuggggcuggcuuacaguuucagagguucaguccauuaucaucauggcaggaagcuuggcagugugcaggcagacaugguacucuagaaagagcugaguguucugcaucuugaacugacaaagacagcuagaagaaagcuuucuucuucauuggguagagcuugaacauaggaccucaaagcccacccccacagugacucacuuccucuaacaaagagugccacuucccauggaccaagcauauucaaaccaccacaaugggucugucccucccaguugauaauagcuucagcaccuucucccaugacuaaaauucucaggcugcccuguuuguccucgccuggaguguagcacuaaggccccagcucugagcugauggacuagcaucugaguauuguucacauuuuuaauaauacugugaucuaagaaaauuuaacuauuuuugagccuuuguucaaucuaaaaauuauuaucacucuaauacugagcuaaguaacaauagacacacagggaaggguggccguugcucuugaggauauacuuggaggcagcaaauuagcauacccugccaagccaagcuaaucacaggagauuuugacgaauacaguucuggauggccugcaaucagcaagaaggcuuccuagaaaagagaaacauaaaccagccgccugggguuuaggauagcuaucauuaaguggggagggaaggaagcagagacuacauacuuccuggccuagggagagcuggcccagcgaggcaguccuuccgcuggaaucuuuugguaagaaauuagauuugaggaggagacucauggaaagcugggaaagccaucauuuaagacaguaauucucagucaugucuaacgugggcccuucuucaauauaacaacaacuuccacuccaucuuuuaauaagugaaauaucaaaaugacuuuuaacuuaaauguaauagggggcuggagaugguggcacaucccuuuaaucccagcacucagaguagucagaggcagguagaucucuugaguacgagggcagccugguccacaaagcaaguuccaggacagccagggcuacacagagaaacccugauucauaaaaacgaaacaaacaaaaaaagaaaaugaucgggcaggucccacaaguuucccuuugaccuccacacauuuugggcacauguguauacauacacauauguaaauaaaugugcuuaauuuuuuaggaauuaaauuguuauguaaagggcuugaccuuaaagggucccagaaaucuggggcacaaggaauaaugccccucacccccacagugaaguucacccauuaaugcuauuggcauucaucaaugauuaaaaguagcauaauggacaauaaccuuuuaaaaaaaugaaucugggagcuggagaaauggcucagugcuuaaugggacucacuguucuccuggggaccuggacuugguuucucuccucacaugguccauaaccaccauucccagaagaacugacguccucaucuggcuuccuugagcaucaugcacacauggugcacagacauacacacaggcaagcacuuaucacauaaaauaaaaacauaugauaaauccuuuuuaaaagaagaagggcaguuaauguggccacaagaaagacucuauguaucaucacaaccuucuuaggucugggcagccggcaggauugacaaucucguuuuaucuguuauucauggaguggacugucugucccucugucucucugucucuuucucagacacacagaagcagaucauaugacucagucaucauggucugaaugaguggcuuuguugggaggcagauuuuagucuuucuucacuccauucuuguucccuaugaacgggaaucucuuuggguaaugccugucucuaaaguucugaaacaugguggcgguugcuauggucuuugagaaucguuauugauucugcaagcaggcccucugggaaauaggcuccuaaauggagaaauacgucaaagauguuuaaaugauucuauaagaaagugauuguaggauuuauuuauuuuugagacagagucuaguagcccugacuauccuggaacuugcuauguagagcaggcuggccuucagcucacagagaucuaccugccucugggugugugccaccacucuccagccuggccuuauuucuucauuuuguuguuguuguuguuguuguuuucaacccuaaauguaaagucuugcuaguuaggcaaaagauggcuaccaacaugaacucccccauucugugaacuucaaggacuacuuugccccaagagugcgccucucucugugucccccuaguguccauuucuguguccccuggggcuucugcuaauggugccaucguucaccacaucagcuccagaucuuccuccucccagcucaggagugaugagaaagcaaaugugugccagcaaaacucaggaagaagcacaggcccgcuguggugucuuccuguacccagccccaccucuggccagagcuaaggcuauauaguauagguuagggagguuuuagaagggacuggaaagagaauguggccagguacccaguucuaccugggacccacggcguccuuucugguuccuuccaagucauuccucuccuucaccagaaagugauggcauuuguccccacacucucaagucacugugacugauuucgcagcccuaggggucugugagaaaucuuccaccuagagcagaaagccuaccaaggaggaagguaggaccaaagaugagaagagcaaaagaagugaggaggauauuucagcggaaaggaaagcauauguagacagaugaauaagccaagaucuauuguaagaguuacgacuguacacaggcaucauugcagucuccugauuaacugcuuguacugcugaugggcaagagcugaaacucagucaugauacccucagguuauccuaaaccccauuuaacuucgugucuuuccucucagggcuggcgcugugacaacugccguagaccuggggcugcugaacccagucccgauggcaccaccggccacaccuacaaccaguauacacagagauacaaucagagaacaaacacuguaaguguacacauauccccacccacccccaccaccgugacucucccugcaugcagccaggggcagguggauagaugcuuuucuugaaugaaccaaaugaguuuuauuuggagauaagucuuuugcucaugaguccaguccucaggacccauccauguaaaagagcuaggcgcuacagcaagugcuuauaaucuccucacugaggagguagaaauaggguguggguggugucccuggggcugucuggccagccacuguagccuuguuaaugaacuucaggcucaugaacaaagcagacagcauuugcuugauuaaaguuaacucuuggcuccuuauacacacaaagucaugaauuaauuauaacucguuauaauuuacuaaaucccuaagcauugucuauugcucaguacauugcuagucuuuugaaacuauuuauccuuccuauaaaacaccugugacacaaaucuccacucaacccuccccgaaacacacacacuuuugguuuuccgaguauuugcuacuaauguuugucuucuauuuugacagaacguaaauugccccauugagugcuucaugccgcuagaugugcaagcugacagagacgauucucgagaguaaucuuuccagccccacccuacaagugucucucuaccaaggucaauccacaccccagugauguuagcagacccuccaucuuugagugguccuuucacccuuaagccuuuugcucuggagccauguucucagcuucagcacaauuuacagcuucuccaagcaucgccccgugggauguuuugagacuucucuccucaauggugacaguuggucacccuguucugcuucaggguuucaguacugcucaguguuguuuaagagaaucaaaaguucuuaugguuuggucugggaucaauagggaaacacagguagccaacuaggaggaaauguacugaaugcuaguacccaagaccuugagcaggaaagucacccagacaccucugcuuucuuuugccaucugaccugcagcacugucaggacauggccuguggcuguguguucaaacaccccucccacaggacucacuuugucccaacaauucagauugccuagaaauaccuuucucuuaccuguuuguuauuuaucaauuuuucccaguauuuuuauacggaaaaaauuguauugaagacacuuuguaugcaguugauaagaggaauucaguauaauuaugguuggugauuauuuuuauaagcacaugccaacgcuuuacuacuguggaaagacaaguguuuuaauaaaaagauuuacauuccaugauguggacgucauuucuuuuuuuuuuuaacaucauguguuuggagaga

SEQ ID NO: 208 - RNA, 568 nt, Mus musculus
auuaucucggccgcagccaucguccaguaacucgccaaaaugacgaacacaaagggaaagaggagaggcacccaauauauguucucuaggucuuuuaggaaacauggcguuguuccuuuggccacauacaugcgaaucuacaagaagggugauauuguagacaucaagggaauaggcacuguucaaaaaggaaugccccauaacugcuaccacggcaaaacuggaagagucuacaaugucacccagcaugccgugggcaucauuguaaacaagcagguuaagggcaaaauucuggccaagaggaucaaugugcggacugaguacaucaagcacucaaagagcagagacagcuuccugaagcgggugaaggagaaugaucagaagaaaaaggaagccaaagagaagggcaccugggugcagcugaagcgccagccugcuccauacagagaagcacacuuugugaggacuaauggaaaagaaccugagcuguuggagcccauugcaugugaauucauggccuaaaguacaaaagaaauuaaguaccaguaccaagaaaaaaaaaaauaag

SEQ ID NO: 209 - RNA, 38407 nt, Mus musculus
uccuuucugugucuuuggauuuuguucucugaauuggggggggggacuaaaucaaugauucacccuuuuaauaaauuauaacccuaauaauuuccuuucuaaguaaugaucuuauuaauucuuguaaauuuucaugcaguguguguagugguuugaauggguuuggcacccauagacucaugcguuugaaugcuuggcccacaggaagugucacuuuuaggagguguggccuuuuuagacuagguguggccuugcuggaguaaaugucacugcagggguagguagguugagcuuugcaguccuaugcucaagcucugcccagugcggaagagagaggcuugaucuuuaggucaagauguagaacucucggcaccaugucugcccggaugcugccacacuuccugucaugaugauaauggacuaaaccucugaaccuguaagcaggccgcaauuaaauguuguccuuauaugaguugccuuggucauggugucuguucaaagcaaugacucccuaagacacuguauauuuugaucauauucaucccccaccccauuuccuuuuauuugaacuuuaaaaacaaauuguguaugcuagaggccagaggucaacaccaggugucuucaccaaucccucuccaccauauuucuuugagaaaagaguuacucacugaaccauggcuuucugauuugccuggaauggcuggccaguggaucccagggauccuccugucucugucucccccuuguuggaauuacaagcaugcacucccauacaugacuucuguguaagugugagcauccaagcucacguccucaagcuccugcagcaagcacugcaccuacugagccuucucccuaguugcuaauagugcccaugcagguggagguggccgaauacagugguuugaaugagaauggcucccacagacacauauguuugcaugcuuagucccaguuaguggaaccauuugagaagaauucagagguguggccucuuuggagugggcguggccuugggagauggugugucaccggcagugggcuugagguuuccuggagguguacacuuuugucauuuaucugaaauucauauuaccuggaggcccuguaucuuuucugccaaguaacugagauauuacaaaucuagcugucacugugggaaauagcuucuuuguuaaauuagaaaauuaaauagaucuggacucauuuagauaucagaaacucugaguuucugaaacacacacagaauuccugaggaauuguaguucuaacuaguaacaaguugacuuccucuauggaaauuuuaauaacauucuagcuucauguauuaucuaggauuccuucagcuguggagaguaucgguuacucuuugucucucuaaccacaauuccuggcagagaaggcuuagugggggaaggguuuguuugggcuccugguuucagaggacuugcauccaucacagugagccaggaagcagagaucagaagaugcugguacucagccagcugcuccuuuguccuuuauccucaccucuugggaugacacugcccaccuucaaggcagauaggucuccccaccccccuccccuucucacagugaacccuagugaauucucucaggaaacaucuucacagacacacucaagagguaugccuuaagaaauguggcacucuccaucucuugcaaagcucuacguaguccuguggcauucacaccauguguggugcagacggcagagugcagcucuucacgcaggcacugggagaugcccauguggaggucaugaaggaaggguuacauugaaaguccuuugugcugggccuugggguagggagcagagcugcuguggcuaagggccugagcgccugagacugucccagcucacccugacaggcaacuuagcacaccacgagaaugaaaucuggggagaccaagcuagaacuuacagaggcugugugaccuggguaccaugugccgugauguuugauugccaguuuuuaacugccaguaugucaguugcgcauuugacacauuuucagggguuccgcacgccugcuuguaugcgcggaccagucuuguaugcuucuggguuuuuucauauugcugagaacuuuuuuuuuaauguauuuuuuucuaggauauuuaaauuagcuauccaauaauaugcuccagauaagguaaggaucagguuaugaacaaaccuauuuaaagcgaucagguauacuaaccacuuaguaccaagacucucagauucucuggcuacauaauuuauacagcuuuccuuuaugcucccgcucccuuuagagggacuuccggcgugggaggcuagguauucauacugaugaccuuuuuuguguuugaguaauagcauuauuagcaugaaauucacuguguguguguguguguguguguguguguguguguguauguguguguguugcuagcgaucaaacccgaaaccuugugcaugcugaccacauacucugccaguacacuaugaccucagccccaaauuuaucccuuggaagaauacaacuuacugauuuucauauucaaaguuaccaacuaucaccacuguccaauuucugauuauucugucauuccccaagaagcucucucagcagcgugcagucccccuccucugacccaaccccaguaaccaggaacacucuccaucucugugcgagugccuaauggacguucauaaaguugguagcuucacccuguuuagagagagaaagagagagagagagagagagagagagaggucuuacucauuccuaaugaaucaaaucaagcuggcaaucuaaauuaacuguuauauacuagcuuuuaacugcugagccaucccaaguucucuacccagugggauauauguugucggaacagaggggaaggggaaucuuucaaugaacuaggaaagaguugaucagcaaacaugcagagcuaaaaguugaaggaaauccuucuuuccuuacuaccuggucugucuuuccccgcugguuucagaugcucaugaauggauuuuuccacauuaaaccauauggcagcuggggauauuauuaugcugcacauagaaauuccgaaucacauuacccuguaccuucuuuuuuuauauacuuucuaaaaaaaagauuuauuuauuuauuauauaugaguacacuguagcugucuucugacacaccaaaagagggcauuagaucccauuauagaugguuguaagccacuauguaguugcuggauauugaacucaggaccucuugaagagcagucagcgcucuuaacugcuaagccaucuuuccagcccugauaccuuuuuuuuuuuuuuaaagugcaugguuucauuguuguugagccacgguuaccuggcuuagacguuugacaucucucccuguuugacuagaacgugcucuguagaccaggcuguucuacuucccaugugcugagaguaaaggcaugcggcaccaugcccagcuuucuaaauguuuaaaauuauauuuauuuagugguuuauuguucaaugugggguauauaugcuccacaacacaaguauggaugucagaggacaacuugcaggguuguuuucucuucuuccacgguguggucuuggggauugaaaucagggcgucagacuuugcaguaggccauaucuauagcccaaccuuuuacuuggaauuccauugauaauacauguagccaaauauaugauuuucauagccccuaguauuaaaaguauuuacaguaucaacauauacuugccguguuuggggcuggcgagauggaugagcugguaaaggagcuugccacuaagacuaagguccugcauuccauccccugagcauccccugagcccacaugauggaaggagagaaauggcucacuugaugaucucugcccuccauacaugccuugugguacaugcuugaguggacacauauacauacacgugugcagagagagagagagagagaaagagagagagagagagagagagaaccacaaccuguuguucucuuuuguaauaaaagguucauggggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauaaaauaauaaauaaaucuuaaaaaaaaaaaaaaaaaaaaaaaaaaaaaagguucaucaacauauucucccgggcacauggcuuuugagagacacagcuuaugcagagugcauuguauuugauaacuguggccuggcuuugauagagaaggacccagcucucucuuuaaacagagacucaaugugacagagacuccuaacaaaaagaaucuuguggaguucucaagucacugaagugcucaucgacuuaguugaugggaaaaauguuugacagaaacugaugcuaguaauguuugugucuuuacaggcacacuggagcggcaagagaagguguuuacaaccucacaaaauccauggcuuuggcgugggccagcagcggagugaggaucaacugugucgcuccuguaaguaacugcuaugugugaagucuacugacaaacugggcuccugauucagauuguguuguggauaauugugucacuggugugugugucuguauauauauauauauauauauauauguauguauauguagauguagauauacuauguaaauauacuauguaaauauacuauaaaugguugacuuuuaacauaggugaaacuagaaaggcagucauucguuauagcaguaauguuauuugguaacgagauagugaugcacauucuugguauauauuagaauuauguguauuuaaucaguaguggugcaggaacuguacuuccuaucaugaauugugaguacccgcauuauaaaacgcauugaggaauuccaucccacagugaugaagguugcaaaauacuagggaacuaaagagguggcucagcagguaagagugccuauugcuuuugcagaagaccugagcucaguucccauaccacacugcaucucacaacugccuaugacucuaucuccaggaauucugacaccuucuagccucccugggcaccugggugcucguccccuguaacacacacacagaguuaaaauaauaaaaauaaaucuuaaaaagaaauacugcuuuggggacuggcaagauagcucaguggguaaagugcugucugugcaagugugaagggcuggguucagaucuccacacucacguucacagagagacacagcagcacacaccuguaacuccaguccugggccgcucccacgauggccgaccagccugugugaaacagugaguuccaggcucagugagaaacccugucucaaaacaagcaaacaggaaaaaaggagacggcauaaugaagaaccauagaaggcacggauagugaugucuggcuucuccaugugccugccugguugagaacauacaugugcacacacacauguaacauguauguucaccaugacauauaacauaacaaguguggaaaguucaccacacuuguacacacaaaaaaagcacuacuuugaagaguaacuuuuuuccuaagugauuuuguuauuucuuguuauagugugagucccuuauuuggaaaaaaaaaaugaauaucaaugggaagcaacucucaguuuuaagaccaaguagaaguuaaguuauguguuauauaucacaaauguagcuacaguauuacucaaaaaaaaucuuuuuuucuuuuugagcccaguggugguggcgcacaccuuuaaucccugcacuugggaggaagaggcagguggaucucugaguucgaggccagccuggccuacagagugaguuccaggauggccagagcuacagagaccuugucucagggaaaaccaucuuuuuuuguaugggaguggugcguguauguguucauguguaugcaugugcacguacaggcaaaaggcagaguucaaugcuagcugucuucuucagccaaucucuaccuuagcuuuugagacagggucucuguguugaccccaaagcucccugauuugacuagacuaccuggccagcaagccccagggaccugccuguccccgaugcccuagccucccuagugggaugcugcaggccagaaugcagauucucaugauuucagagcaugcaguucaacuaugaccgagccauuucccuggccucugcuugcuuuuugagagcgguucuuauguagcccaggcuggcuagaauucauuauauaaguuaaguuggccuugaacuccuggucuuccugccucuaccuccccaaauauuuauuuguugugaaauaagucauagcuugauccaccugauauuuuguacuuggcauuuauuccaagauacauuagguagaauacaucuuucuccuccuacacagaucaacucagaguaacuuuucuuaugauguuuucugaccgaggauaaaguagagagaauaguuccauuuggacuugggagcacauaucuguaacacuggugaaguguugggagagaggguagcacauauccacggagcccacuaaccaaucagcauagccaucuggcgcucaggccagcuaucguagucaaucagugagcucuggguucaacaguaagguggaaaaugauuaaaggaagaaaucugaugccaaccuuugaccuccauaugacuuccaugcaaccccccccccacacacacacacucaaaauuuaaaacaaauauauauuuuuaaaauuagcuaucaggguacauaucuuggauuuggguguguuuuuuaaacuucacuugaaauguaaaaccaagaaaaauccuguauuuucacaucucugguaaagcaagcaugcucagaggaagagaaaccagacuccccagacgcauuguuccugguuaggugccccacugaagugcuuacauaaacauacuccucagaaacuaagucuuucaagaaaaagaccaagacguagcugguuuuuaaaggggagaagcccccaaaaugaucauucagauggucugcuuuuagauagugguuggcuggauccccuuuugacaguuuugaauaaaguugauuagaaacguuugugcugauguuaagccacacaucuuuugucuucagucagcauauccccugaugccuucuuguugcuaucugugaguucuagagaugggacccagggccuugagcacacugggcaagugcucuacuucuccucugcauccccaacccuuggugucuugacaauuuaauucuccccauuuacccaccuuccugcuuuguuuucuuauauaggggaccauuuacucccagacugcuguugacaacuauggcgaaaugggacaaaccuuauuugagauggccuuugacaguaucccagcuaagcgccuuggaguccccgaggaggugacguaucuggguggcauugaugagaauaccuugagaacuuugugacauuugguacccugggcauguggccuggcugaccaguagagagauuauuucagugccaucaaaccaugucgccugagcuuugggcucugggaaauaaccuaguuaguugcuuugacugcugacagcagacucuccucaggaaugaaggccaugaaguuagagacgacacguuuuuguuaucuuugcagcuacaguuuuauuaccugcaguguugguuccagcagccccaagcaagccagauaaugacagacucgugaaguuccacagaggaaugaaguauguuaaaaaucaauagcuuuucaaaugacugaggaguaaacuuagaucuaacggugguaggauggggaaaguuucuuacugaagaaugaaaaaaaaaaaaaaaaucccagaauaaauaagacacguggggcuggagagauggcucugcaguuaugagcaggaagugcucuuccagaggaccugaguuccauccccaguggcuauaaagaugucucccacugcauggggauccaacaccuccagccucugcaagcacccgcauucacuuguauauuccuaccacacauacacacacuuagacauaauaacaauaaauauuuuaaauaaauaaauacauguuauauuucuugguaggagaaccaauuuuauuuaaaaguccauuuuugcugggccuaugccuuuaaucuuaguacacaggaaacagaagcagacagacagaucucuguggaguugaggucagccuggucuacacagaaaguuucaggcuacccagggcuaccuaaagucaaauuccaaaguuguaggugucaggaagaugcgucagcagguaaagguuugauccaaacuccgcacaggcugcccugccacaggcacacagggccacacacgugagugcagaacccuagaggccagaagacaguguuggacccugcagacuucccagcaguuagcugccugaugggugcugggaaccagcucacguucuuggcaagaacaauaacaugguuugggguuuuuuuggguuuuguuuugagacaggguuucucuguguagcccugguuguccuggaacucacucuguagaccaggcuggccucgaacucagaaauccgccugucucugccucccaagugcugggauuaaaggugucugccaccacugcccagcuaaucuguuuuaauccagccuguaauuaggauuuauuuauguuguuuuuguuuuuugagaccgggucuccugucucugagcuggucccgaauuugaucuguaacagagcgccuuguauuucugacccccuugcuuaggugcccuaugugcuggcguuacaggcugcugcuggcguuacaggcugcugccgccacaccugcuuuauuugcuguuagagauugccuuugggccuugugcaugcuagacaagcaccccaccaguucagcuacaccccaaccccaacaauuucuuuaaagucagagcgaaccugaugucaugaacuuucugugcucuguacuugagccuuccugucacacugggaucuugggucuauuuaacuuguagcauaacuuauugucuuuaggagcuccuuugcaucuagauguugacacagcucguucuguaacuuugaaaggacacaucucuuuaugucucuaccugcugcuugaaucaaaguuuagcauggcagccugagccuccccagaauuccauuuccacuugcaagcuugacuuuugucauggaaaacaaacauucccaguuguuucuguuugcggcaauagccucccuuccuuuauguaaauaaaaaaggugcuugcggaggcucaguggaaguaggggagagaugcgagacaguaauggcgagagugaccaaaauuauguacauacaugacauugucaaaaacguuaauacauuaucucagcaggcaccagucacgugguauguggugcacauauguaugugcaggcaaaguacucaagcacauaaaguauaaaagaaaugcaauuuuuaaauggcuguucaguuaguuuaaucacauauucuuaugauggccaguggacuucucugggcagcaaaagcucuuagggugguuguggugggugugugcgcaugugcacacuuccuguaucaugucuuguuuuaucaccuauaacacuagaaagacugcacucaccccaacccauucccaugauuaucugcgccagaauaucaugacugcuggugccuccaauacuaauauaguucauauucuuuagaaacauuuuuaacacuccuuaaauuuuuuuuuuaugugauagggucucacuguguagcuuuggcuggccucaaacucacagagauccgccugccucugccuuccaagugcugggauuaaagguaugcaccaccaaacccagccacaguuauguauucuugaguugccugugugacagagcaagcaugugguggucagaggacagugcuccgguguuuguccucaccuuccaugggaggucgcagugguuguaucuagaugagcgaucuucgcgacaaacuucuguacugguugagccgccuugccggccccaccuuugacuucuugccgugacccauacugaggcuccagccauucuccaaccauugcuuugagccugugaauaaaauuccaacacggugaugauggcuuugacuuuuaaaauccccugaaggaacgcccaucaagacuuuaacaaacuacuggcacagcuacugugagaugcagaacuggggacaaacucugcucaauuaugugcugagucuaagaucagcaaagcuuucacaccagcugcaaccagugggguguguguguguguguguguguguguguguguguguacaccagagugugugcacaggcaugcuugugcuguggugcacauguggaggucagaagccagcucauggagcugcuucucuccuaccugcugggacuuauucuggcacccgguuucccgaggaaggcagcuaagggccauggagucagcgaccagggccaaagcugcuugcuuuaucucuggcaguucugucuuuaacuuuaacucugcuauuaagauauucccuuuauuuacauuucaaguuuuauccccuuuccuguuuccccuccgaaaaccccccauacccuccccucucccccugcuuaccaacccacccacuccaauuccuggcccuggcauuccccuauacuguggcauagaaccuucacaggaccaaggccucuccucccauugaugaccaacuaggccauccucugcuacauaugcagcuagagccaugagucccaccauguguguucugugguuggugguuuagucccagggagcucuggggguuacugguuaguucauauuguugcuccuccuauagggcugcaaacccuuucagcuccuuggguacuuucucuagcuccuucauuggggacccugugcuccauauccaauggauggcugugagcauccacuucuguauuugucaggcacuggcagagaacucugcuauucuauggcugaaagccaccuacuuuuggcaauucuucuaacuuuaacucuuugcuguuguguggccaagagcugcuugcuuuugguaauguuucucuuccuauaacucuuugcuauucucaggucaaaagccacugauuucugauaauuugauuccaacugauagcagcaggagaauuagaaaaaagguuugguaucucccuggcucaagggccucuggcaggccaggcaagaggcuuggaguuuguuaacuuuuugugagcccgagagagaagagaggaagaaagcgagaaaucaagcacacacacagacacacacagacgcacuuuggccgggccugaccaccugucucaacaauuccaccaguguuaaugcauacuuauauacauacauacauuugguggaagggacugacuccaaaugccacacuuuauuucuuuucucuggcaguuuauaccuucuuagacauaaguucuuuauagaauuaucucauagauagaauguuacgcaacaggggaguuacaaaaggauguugacaguucaaagcaguguuucauucugugagcucaucaugagugguucuucugcaugcucauucagagcgacaguuagcuccccauggccuugcuguaucagagugcucaccuguggcuucauccguggaccuggccuacagugaagguuuuuccuuguuugcagauuuacucugagccagcuagugcaauuagcccaugacacugaaggcuugcagagcucuguuugccacuuuguucuauauggggcuugagauuacuuguaucaacuuaaaaauuauauaaaaucauuaucggaaauugugaaaaaucaucaauucgucuauacagccuuacuacgugaaaguccauagucauguugaucuucaggaaguuugcccaguagggugggucgaugcccagggaucauuaggcuauguaauaguggcagggaaaaugugucaucagcaagaggcaaucccgagaugaaaucuuuggugaccuugcauguuaaagcucacccgucaaaagccgugcaaaauggugagccaucuccaggacacucauuugugugcuuagucuguccugggugguuucugacaccuacccuccgugggaccugaucaaacccaggcuguucgcuccccaucccuuguuuuuguuucagugcccaguacagaagccaggagugggaugcgcuuagggucaccaccccugugagacucugcuccacuuaccaucaguaaaaugaauucuguugguuugugaaguuucuuuaaaaccucgccaagcgacuacguuugggaggaugugauggggaccuugaagucccgcuggugggaagcuccugugauccgcacagcggugcuuugggccugacagggccauggacacacuuaacuguaucugggaccgaggugggagaagcaugugaccgccaugacaaaucagaguuguagaagacaagcagggccucagaagggaauuaacuguugaagcaggaaaccgccguguuuaccuguggcuucuuauaccauugcuguuugccugccacugucugcugcuuguccacaccuugucgccucugcccugguuguuaccugacuucccuuuuguccacacugucucugugcugucaaaucgugcugcacgugcgcgaggauuggugaugcaguccugugggcagagaugugcuuacucaggaguuccgggcucccaggcauggagaagagucuuuccuuuuuccuugucuccuauguauggauauauucucuucuuucccuagaucuccccucugguauguuuccugcuguccccugcggcuuccuauaucacuggacaguugaucaauguggauggaggccaggcucuguacacucacgccuucagcauaccggguaagcagccaggaagugaagaggcacgagcccuucccuguccacgcuccauguuguaagccacugccucagaggcggggguuucuguuauaggccaucgaauggccuucaaaauguugauauuugugauaggauauaaaagaaaauguucucuguuacaaaaacuaucuaaaccucuaagugcacagaagguaggacggaggcaaaggccagcugugcuugaaggguuacagacucgcuuccucuucccccucucugagugccgcacagacggaagaggggcgguccgacuugacuuugcccucucucuggaaucaaaugauaaacuucugugauucaauaacuuuuauuuguaacaugguauucuuuuuaauuauuucauguauaugaaugcccuaucugcauguacaccugcaugccagaggagggcaucagaccucauuacagaugauugugagccaccaugugguugcugggaauugaaccuaugacuucuggaagggcagguagugcucuuaaccacagagccaucucuccagccccauaaaaagaagcaaguuuauuuuaucuuauugaagcagauucucacuguguagcccaggcuaaccucagccucccauuacaggucugugcaacaaugcuuggcuugaaaacuaaauuugcuuucauaaauucaagucaauaacaauauuacacacgauuggauguggcguuggaagggucuuauaaaaucagauaguccagaccagguauagagagacuuaccuuuaaccccagaacucaggaggcaaaggcaaggagaucucugugaguucccagaccagccaaggcuauagagagaggcccugucucaaaacaaaaacaacaaaauaucaaacaauaaaaucagauaguccaguguccuaguuuuuucaaacgacaaaacaaauccccagaaaauaaaaacacaggcuguucuucugcucuuucagaggaucugggucaaucuccaacaccuucaugguggcucacaaccaucuuuaaguuggggagcugauacccuccuuuggccucugcaagcaccaggcaggcacacauguguugcauggacacaagcaggcaggccuucccauauacauaaaacauaaacguuuuuaagagcaugcuaauguucugggauacugcucauccuuuaccagcguaugcaaacccuggauugaauucccagcaccccauaauaccaaacguaguggugcaggccuguaaucccaguagucaaggugguagaggcagaaggaacaaaaaggucaugguuaucuacaaagugaguuccaggacagccagggcuacacagagaaacccugucuugaaaaacaaaaacaaaaaacaaaaacaaaaacccaaagccucaggaaaauauaaacacaaauauauuugaccuuuuucuaaagauaguuacuagugucuguuagcaaacgaaugucugguugacaagacccauuuccuauccuuguagguuucuuaugucccuaaaacuaugaacgguugguugguugaguuuuugguuuuugguuguuuuuuuuguuuuguuuuguuuuguuuuuuuccuucaguguuuugagacaggucucacugucugccugcuucugccucccaagugcuggaauuaaggguaugugccacugugccuggcuucuuucccuuuuugaagaaagauagugcaaccccauuaggcaacauugauuuaacuccacucugcucucuauugcauuucuggcuuugcaacugaagucuuaacaguucauaguauuagguucuguggugacauaaguccagcacaaaagagagaagauucucucugcauuugaagccagccugcucuacauagugaguuccaggacagccagagacccucccccaaaacaaauaaauaaauaaauaaauaaaacccaagacuguauuuccuaggcauguuaggggauuaaguacacauggugucagguccuguguggcuggaguuggucaucaccauuggccuuucagucuccaugaagaggugggacacaucuaagagccuuuuccucuuccucuguguuuguucuggugaaguaucacccuuuugaggcuggcuuccuuggaacuaggauagcagccugccacucugagaccacaggcuuuucucugcccauauccagcugguugaagagccaggagagggaaggacuucaucuuagcagagccugcucaguucugagucggcuucauguugaucacucacaaagauguccaccuguagccagucaccagaggcagggggugaggagugacacugaaguuaccccuuuuauacgcaggaagcuagugaguagcaggcccagcauucaaaggauuuuugcgaaacugccuguccugcaagcucuuuuccuuagccucccugaacuaagaagcaaggcagcaaacaaaaccaugaaguuuggguggaaacuggggggaggggcuuaagagauuugugaguaacacuucacugcuuacuaaacagaucaugacaacuggccuguaggagcuggggaccuuucuauugucaagaggauaaaggaaucuuuuaagaagaaagccaagcucuaacuaagccaaggaaacagccacccaucuuguuccugcgugccuuagcgccuugagaauguuuccuacuucacaagagcuuaugauuucuguguguggggggugggggaucacuuuaauguuaauagcuuuaucuuugcaaagacugcucccaaaauaaaugucucuuccugugcaaaccgguuaucuuuuaaggauuauuuaaggauuuccuuuuuauuacuuuaaacuguguauguuggaggaaggugugugcacacugagcgcagugcccaaggaagccagaggcaucagaucccgugagcaggaacuuuaggcagugugacccaccugacgugggugcuggggacugaacucacuugggccuuccagaagagcaguaaaugcacugggaugguuuguaugugcucugcccugggaguggcacuauuuggagguguggcccuguuggaguaggugugucacugugggugugggcuuuaaaacucaaauccuagcugccuggaagccaguguucugcuagcagccuucagaugaagacauagaucucucagcuuuuccuauaccaugccugcuuagaugcugccauguucccaccuucaugauaauggacugaauccucugaucuuguaagccagccccaauuaaauguccuuauaagaguugccuuggucauggggucuguucauagcaguaaagcccuaagacaugcacuuaaccucugagccaucucuccaggccucccuccuaaccugggacuuuuuaaaagaacagacagacauuaacaaacuuaaagguauagucuuauuucuaggagagauacuugaaaagcugugggcuggggagauggcucagcaguuaagagcacuggcugcucuuccacaggucccgaguucaauucccagcaaccacaugguggcucacaaccauccguaaugagaucugaugaccucuucugauguuuuagcaacagcuuacucauauauauaaaauaaauaagugcauguauacucauacacauaaaauaaauaaauguauauaaaaaagagaaaagcugugaccauucagggucacaaagguguggugacacacgucuguaaucccagaacuuaggagguaggaagaccaaaguucaaggccauccucagccacauagggagaucugaacucgcaaaagcuuuugcaaucuuacuguaaaauaaagaugccacacugggaccgugggauacuuaugaugaaccagcuggaacagaguagucuguaguuucuuugucucaugaguaacuucauguaagacacaacuacugccggagggaagugcggcaugaggcacagcccguggucccacaucacaagacacucuugcaucuccuugguggaggagugguuccugggugggauaccauuuugcaugggauggcuuacccaugaaugugacugauagcuccucuaauggugcagcugcuggguuccugcagagagggaaggcagacccucaccuugaauaacuauaacuuccacaagagaacgucaauacaaagaauuccuaaguaugacaggacacuugggguagaggguugaggaggaguaugcaaauccuugaagcguaugaaaagaauagccagccgugcgggagggcuuaggugaagccuuccccuauccgacacacucaggucuaauagaguggucaccacugugauuccaugcaaggcagagaaguaacuguguuguacuacugcucauagaacuuucuagaauuccauuguagugugcuaaggacaacugaaugugcacaaugucucagcagaggacucugcuacgcuacccuacggaggugcacgcacagcaaucuugguacugucggcucuguggaagucucuugccccucugcacugagaagccaacccaccuccucuuacaucugcaguucucaaccuguggaucaggaccaucaaaaaacacauauuucugauggucuuagaacgccucccccaaccauggguuuauuuucacugcuacauuguagcuauaauuuugcuacugagccauauugagaaacacuguccuauagauucucucugucucucccauuagugacuuuguacagccuugugucugugggaaucaggcuagcaggcucaguuucaagucuuucuauugcucugcccauuauaguucuaggcugugccugacuguucuguggcugaugacuuggagcggguggauaagaauuacugugggagaacacuuuguugccauuguucuuuguuaucccaaaugaucugguguuguuggccacuauucagggaucuaugugcacucuaccccagguuguuuuauguccacagcuaccacauggcucuauccuguacugugaaacagcuacuaccauuagggugcgccuuuaagagcucugucgugggauuaaaugcagaacaccgguuugucuaagcagcucccucuugggauccaaacuauggcugcaacgcuucaacgugagguuuagaaucuucuuuccaguuuuucuucugcacucauuguugaccaggucuaaaccaaccacaguccagagcuaggucuaacuaggcgugccagcugggaaucuagcuugauggcagauugccuuuugucuuaugggcaaaacucuacuguuguaugguagccaaggugcuuuguauguacuuggcagcccuugagcaccaucuccugaaugagcacaugccugugcacuguccccaccuucugaguacugaagcugucagucucuugguugaaucccuggagguggggagugacuccucauuccuuggucuaacuggguucugccaccucuuucaaccugcagccuccaaacuugccuuucgugagguugucaauuuacuaauaugaaacaccuugagucccuccugauugaaaacgugaugagauuuccaacaauaaccucucugccauccuuggcaucuguccauugaucacauuugcuccuuucuguccaccuuuacuuuucugugcaucccgcagaacucuaugcagauucccauuuuuccauaaauuaaacagucuauagaguccacugauguuccagcuucccagauccuaucguaacuugcuguuguaagacucagacaauggagggauuuggcaagcagaccaaguucauaaaucugcuaaucuagcugaaauagccaagcucuagguucagugaaagaccuuguuuagguucagcuaaaaaacaaagcaaaacaaaacuggaaacaacagaggaugaucguucaaauaaaaaucuaguugucacaugcacaacuaaaaaacgccagcugcgcgcacacggugaggggagugcggagcaagaaguggagagacgauuguuuaagaauucuggcagaguaccacggucccuuuuguucccucaggcacuuuaacugcggaucaggaacucaccggagcuucugcauucacguggagcauauuaauuuacacaagccaaacaggucuggcuuuucuagaacucccuuuguauaccaaacugucaucaaacgcaagagauccaacuaccucugccaugaguaacgaaacaaacgacucacagaucuuaaaacugaagagaggagagaacgggcaggccuacagaaccuagguagcagcagccauccuccagacaggauguuucagagucaauaccaugagccacaauuuccaagcuuucuugcccaaugccggacuuccuccaagcuaugggacaaucaaagaggaguaagggugacugagcugggggaacccaacaacccagcuguugugaggaccaccgugaucuacaugcccagagagcugccugugccugaccaugugggagaugugacuggaaccuaugccuccucuccacuggcaagggccugaguaucaauggugacucuacauuacuguuuucucuaccaccuuugugguauuuucacaaagaauaccacucgccacggcccacaacugggccucuauuuuaaacugauacuuugaaccuuagccccaugcauaugcaagcaguacccucccgugccaccuauggugggauuaacugaagugcacaaaaacgacuaccacccaguuggcuaacaaacaugcuguaaugucuauuguuuaaccaguguuauuccccagagggggugcaccguuccuggagguacugcaauaccaggucgaugcguggaguggacggagcaagcuccuauuccaacuccuaguuccaaaaauccauuuaauauauuguccucagauagagggcguaucagauauuaaacugauaagaacagauacuacacuugaucuuagccaaaaggccgagaagcgauaccuagcacacaccaugcagccgugcucugcguccgcgagacacauuaacuucguggugaccgcucgcaacccucacuuccugccuuccccgcagcuccuuccuucucccguccgcgucuugcauccugcaugcgucacucccacuccagcacccacagcuucagcuacaacguccacgaccccagcucucccggcguuccggagcgcgcacgccgaguauaauuugcaugccccgcccccucguggaggguguggcggccgagacuggagccucuucccuggugcuucugcaaggagcacacaugggcucccggacacuuccgguuuauucucccacuccacugagaacaagagcgcuagaggaggguuugcagccggcuguaccugagaaguacaguacagggaugguggucaaagggccgaccuacuugucuaguucgcauuauccggaagacgagcuuuuaaaguugacguuuaugucacuuaugucaguauuuggggugggggggcggggugucccaagaugcacaagugguuuauuccaagccaacucccaaauaccagaccugacaacaaacuugcgugagcucuggaagguuaugguuucccccuguaaagucacugcacagccccuuuaaauguccggggaguggaaggguuccugcaagcugaaugacuugaguuccauuccugaccuacccagcugguagaaggagaggauugaguccuaccacuuguucucugguccccauaugcucugucuggcgcgcgcgcgcgcgcacacacacacacacacacacacacacacacacacacaauuugaauuugaaaauuuagagaaaagaaagcagggagccaaucggcacugcuuauaauuucagcaguugggaaauguauacaauuucagguuucaacagccucagccaugaagcuagcuugcuagauuuucuuuucuucuucuuccuuuuuuuuuuuuuuaaucugaaaagagggucuggagagcuggcucagcugguaagacuucuaacugcucuggaaggaacaaguucaauucucagcccucacaucgggagacuuggagaccugcaggcaucaggacccagaaacacagguacauacacacaauuaaaaguuaaaaaaaacaaucugaaagagguuuuaguguagauugaacuagacaaaaagguggggaacagcgaguuucauuguguggaagggagauuuccgggacaaucuccuuugcagccucaagacugugaauuuaugaacaucaauaugaacuaagcaguauccccagagcuccuuggaacuauaccaccaaucaaagaaaacacaugguggaacuuguggcucuagcugcauauguagcagaggauggucuagucagucaucaaugggaagagaggcccuugguccugugaaggcuugauggcccaguguaggggaaugccaggaucaggaagggggggccuagugggggggggguuuaggggauuuucggaggggaaacuaggaaaggggauaacauuugaaauguaaauaaagaaaauaucuaaaaagauaaaaauaaaaauaaaaaaacugaaaaaaaaaaaaagacugagaauuuauuaccucgggccugauaaugagaaucaaauaccuaucuaugcaggacucauauaaaaaugcuaagucaggcaaggcagugguggcacacaccuuuaaucccaacacuugggaggcagaggcaggcagacuucugaguuugaggccagccuggucuacagagugaguuccaggacagccagguacacagagaaacccuguuuugaaaaaacaaacaaacaaacaaacaaacaagcuaagucagccaucagcccgauggcuaucaagagacaccuaugaaacaaaacauacauagcccuuaguuucaauucauucuuucuuugagacagaguuucucucuauaguucugucuguccuagaaccuugcccuguagaccagguuggcccaaauucagggaucuaccugugagcaccaccacaccaagcucuaaacagcacagccuuucuaauuuauaaaguguuuauaaaugugugccaaugaagccgcucaucccuagaccugaaguccucuggggcgcagauguaagcuuuuuuuuuuuuuuaaagauuuauuuauuauauguaaguacacuguagcugucuucagacacaccagaagagggagucaguucuuguuacagaugguugugagccaccaugugguugcugggauuugaacucuggaccuuuggaagagcagucgggugcucuuacccacugagccaccucgccagcuuuuuuuuuaauuuuauuuaguuauuuaauguauaugaguacacuguaugguugugagccauaauaugguugcugggaauugaacucuggcccaaagacuuauuuauuauauguacacuguagcugucuucagauacaccagaagagggcaucagaucucauuucggaugguuaugagccaccaugugguugcugggauuugaacucgggacuuuuggaaaagcagucagugcucuuaaccgcugagccaucccuccagccccaaguaggcuccauuuuauccaagcugaccaaccugcucucuaagcaacaguaguuauccaaaacauaaugccuguucaauagaaagaacaaaugaauuugauugguuggauaaaaacacuuacauucaaugucaaccaacaaugagggaacccuggggaaagccucggacccacacucuccuccccagaguguaggaugacagucaugcuuccacauuugguuuuuuccuguuaagagguuuuaucuuggugcaaguuuucuacuauuuauaacucaugucaucuugcaacccacuaauauucacugaguuuaguugaaugaggaagagguacagguugugauguuuugaauaugcuugguccaugggaagugcauuauuaagagguauggcauuaucagaggagguguggccuuguuagagggagugagucacugugggggugggcuuucagggccugugcuuaagcucugcccagaacagaagagagucccuuccuagcugccuguggaagagaaucuuuuccuggcugccucuggauggacauguagaacucucagcuccucuagcaccaugccugccuggaugcugccauacuuucugccaugacaauaacggaaugaaccucaggaccaguaagccagccccaaucaaaugcuguccuuuauaaagaguugccuuggucaugauaucucuuuacagcaaugaaucucuaacuaaaacacagguuuaugcuuauuuuuugucagcucugaggggcccuugaggagcauagaauccugguauugugggagggcuggccuugcagaggugagaagggaagagagccuagauguaaacucucaugcaaucgucgauggucuuuuguaucgggaaacgguuacggcaggaggguuguaacagugccguucauuaugagggcacaauaaaaugggaauguuguuggacacagcaguagaguuaacuauggauuuauaguuaacgaugacaauagacacaaacauagacuagauggggcaaaagcaagaaaggacacgcugcaggauucaaaaggagaagugccuccaggcacagguuggggggggucuuugugccccuaaucuuuuaaaagauuuuuuaaaauuuuauuuuauauguaugaguguguugcuugcauauaugucuguuuacacaugaucaucucauuagaugccuuugacaaaauccaacaccccuucaggauaaaagucuuggagagggcuggugagauggcucagugguuaagagcacugacugcuuuuccaaaggucaugaguucaaaucccagcaaccacaugguggcucacaacuaucuguaacgagagcucuucuggcgugucugaagauagcuacaguguacuuacauauaauaaauaaaucuuuaaaaaaaaaagucuugaagagaucaaggauacaagacauauggguauacaauacaacacaauaaagacaauauacaacaagccaauagccuacaucaauuaaauggaaagaaacucuaaguuauuccacuaaaaucaggacaaggcuguccuucucucuauaucuauucaauaaaggacuugaguucuagcuagagcaauaagacaacuaaagagaaaaaggauacaaauuggaaagaaaggaguccaaguauuacuauuuacagaugauauuauagcauacauaugugagcucaaaaauucuacuagugaacuccuacagcugagaaauaccuucaguucagugaaguccuggauacuagauuaacucaaaaaauaaaauaaaaucaguaguccuccuauacacaauaugaaauaucuuauggcaacucuaaccuaguaaaugaaaaaccuauaugauaaaaacuuuaagucuuugaagaaggaaauugaagaagauaccagaagacagaaaaaucuuccaugcucagggaucaguaagauuaacaguaaaaauguccauuuauaccaaaagcaaucuauagauucagugcaauccccaucaaaaucccaacauagagcuggagagauggcucagugcagagcaugguggcucacaaccaucuguaacaggaucugaugcccucuucggguacgcaggaauacauauaggcagaacacuauauacacaguaaauaaauagguauuuuuaaaaaaaauuccaacaccauucuuuacagacuuugaaggaauaauagucaacuccauauggaaaacagaacaaaaccaaaccccagucuagcuaaaacaguccugaaccauuaaagaacuucuggagguagcaccaucccugaucucaagcuguauuaugaacuguaguauaaaaaccacaugggggccuggcgaugguggcgcaagccuuuaaucccagcacuugggaggcagagagaggcgaauuucugaguucgaggccagccuggccuacagagugaguuccaggacagccaggggaacacagagaaacccugucucgaaaauuuuaaaaaaacaaaaacaaaaaacaaaaaaaaacaacacaugaugugggcauaaaaacagacaucuugaacaacugaauuaaguugaagacccagguguaaauccccacacuucacagacaccugaauuuugauaaagaagccugaaauauaccaugaaaaaagaaaccaucuucaacaaauaaaugggguugaucuaacuggauaucuuuauguagaagaaugcaaauagauauguaucuaucacccuacacaaaacucaguccagcugggcgaugguggcacaggccuuuaaucccagcauuugugaggcagaggcagguggauuucugaguucgaagccagccuggucuacagagugaguuucaggacagcuaggacuacacagagaaacucugucucaaaaaaaccaaaaccaaaaccaaaaaaaaaaaguuaaaaaaaaaaacaaaacaaacaaacaagaaaaaccucaguccaaguggaucaaagaccucaacauaaaaccauauauacugaaccugauagaagagaaaguguuggcacaggcaacaacuuuuugaacaaaacaccaauaaacaggcacuaagaucaacaauuaauaaauggggccucauaaaacggaaaagguucuguaaacaccaucaauagaacaaaacagcaaccuauagaaugagaaaagauuuuccccaacucuacagaugacagaaggcuacuauccaaaacaaacaaacaacucaagaaacuagacaucaacaaacuaaauaauccaauuuuaaaaaaugggguacagcugggcguagaggcgcaugccuuuaaucccagcacuugggaggcagaggcaggcagauuucugacuucgaggccagccuggucuacagagugaguuccaggacagucagggcuccacagaaaaacccuguaaaacaaaacaacaacaacaaaaaagacaauuuaugcuggugaggauguggagcaaggggagcgcuccuccacugcuggugggagugccacuuuggaagucaauguggugguuucucagaaaauugggagucagucuaccucucaagacucagcuguaucacgccugggcauacacccaaaggaugcuccauucaaucaaaggacacuugcucaaaccuguucauagcagcuuuguuguguccggccagcagaucacagccuggguucuagccuggaaaggcauuuuggaaaccuggaagagaagggcuaggcgacgagagaaaaugaugcagcuaagacaggcauucugaucaaagcucaauuuuacuguuccgaacgcaguuaugaagcaggggaaaggggcccgauuccugccaauuaaucucggggguccaauagcagggugaccaugugauggcuucagaacaggaaagugacaggcuccagcagugggcguggcagaacgauugagugggaagcuccaccccugagcaagcagguuucagacuaggggaggggagacuacaucuccucccuguuguuaauaaaaaaaaaaaaaaaaaaaaaaaaggcuggccugaggcaaaaaauuuaucuaugcucaauaguucugccugaauuuuuaggucuaaagaaaaaaccugucuccuugggauucccuaacuuuucuuaugguaaaccgugucuggaaaagacuguccuuucuguccuaguaaacaacuaacagaaaagcccugagcaguaggcucugacuuuauaaugcuaauuaguacuaaauaaguaaauuccuaguugaauuuuaaguagggcguuggaacccuggcgaaguuugacugaacaaauuugaaaugcacuuuauuaagaauaacacugaauugauauuccuccgcauuuuuggaugacaggcgggaaacagggaggagggguaugaccggcucuguaguacaaggccaauuggcuuauuuuggggugggaggcugugaagggcuugcccuucagacaguauggucuccaaccucucucccccuauuaauuaaguuuaauaaggccacgcuuaacugaggugaucaaaugauuuucucauccauagaugagugggcuuggguggacauugaccugauuccucccgugggugcugucacgacccacaccuguggcucuugguaucuuugggggagagggagacuacacagcuuuacucauaauacccagaaacuggaaacaaccuaaauauccaucaaccgaagaauggauaaagaaaaugucaccgugcauucacagaauggaauauuauucagcuguuaaaaacgauaauauugggcuggugagauggcucaguggguaagaguacccgacugcucuuccaaagguccaguguucaagucccagcaaccacaugguggcucacaaccaucuguaacaagaucugacacucucuucuggugugucugaagacagcuacaguguacuuacauauaauaaauaaauaaaucuuuaaaaaaaaacaauaauauucagccagggcuacacagagaaacccugucuugaaaaaaaaaaaaaaaaccaaaagaccaaaacaaaacaaaacaaacaggccgggcgugguggcgcacgccuuuaaucccagcacucgggaggcagaggcagucggauuucugaguucgaggccagccuggucuacagagugaguuccaggacagccagggcuacacagagaaacccugucucgaaaaaacaaaaaacaaaaaaaaacaaaacaaaacaaaacaaaaaaaacaacaaaaaaaaaacaaacaaacaaauaacccaauaaaauugugaaauuugcaggcaaauggaacuagaaaaaaaaaucuugaaggagguaacccagacccagaaccacaaacaugauauguacucucuuauaaguggauauuaacuguaaaguaaaagacaguccuacugugguccagugacccagaacagcuaaguaaggaggagggcugaaggcagagaugcaagguucucccugggaaggaaaaauagaauaaauuuugugggugggugugaugguuuguauauucuugggccagggagcggcaccacuugaagguauggccuuguuggaauaggugugucacugugggcaugggcuuaagauccucacccuaguugccuggaagucagucuuccacuagcagccuuuggaugaagauguaaaacucucagcucugccugcgccaugccugaaugaaugccugcgccaugccaugcucccaccuugaugauaauggacuuaaccucugaaccuguaagccagccccaauuaaauguuguuuuuauaagacuugccuuggucauggugucuguucacagcaguaaaacccuaacuaagacaguggggguggcacaggagggaucagguaauggggagaaaauacugggagaaaggagaggauuuagaggacauuucaaggggagagguggaaaucuagugcaauggaaacuccauggaaccugcaagaauagcccuagcaaggacuccuaguaauggugacucucagggccugaaccagccaucuucuguaaucaggcaaggccucaaguggauggauugggacaccaaccuagccacaaaacuuucaacccaaaguuuauuaugucuguagaauguucugggacuggagccuagcagaagggacaccaugagaacagagcucacagaaucaacugacugacacucgugggggcuugaagagaccagggagccuguaagagucugaccuaggucuugcuguguaugcuauggucguguagccugguguuucguggaggaaucauaacagugagagugggggcugucccugacacuuaccuacuugugggaugcuuuuuccuacaagauugccucauccagccuugaguaaugauauguuccuggucguaauguagguuguuuaugcuguguuugguugauguccuugggagaccugcucuuuuuugaguggaggugggagaggguggaucuagggaggacacggguugggacacuagggagaggacaucugcaguccagauaaaauauaugagagaauaaaauauauuugacuuuauguguaugaguguguugcuugcauauaugucugugcgccugguacccauggaagucaagguauuggcucccagacagugcccuaacuuaaccucugagcuauuucucaagcuccuaaacauuuauuuucaucuuauuuuaaaauuaugcaugcaauggggugggggugggggucguaugugcaggccauugccggguaccagcuguaguuaauuugauguuguuguuggcauuuuucacuuuuugauaacacauuguaaugggaacagcuccaaauuacuuugcuuaauucuucaggcuuaaacaaucgccugaguuuggacaaaauggcagcacucuacccauucuucucaggacagucacuagaauuuauuucaggggcuggugagauggcucaguggguaaaagcacccgacugcucuucugaagguccagaguucaaaucccagcaaccacaugguggcucacaaccauccauaacgagaucugacucccucuucuggagugucugaaguacaguguacuuacauaucauaaauaaauaaaucuuaaaaaaaaaaaaaaaaggacugacugcucuugcggggguccugaguucaauucccagcaaccacauggugacucacaaccaucuguaaugggaucugaugcccucuucuggugugucugaaggcagguacaguacucauauauguacaauaaauaaauaaauccuuuuaaaaauaauuuauuucagaagaaucuaggacucugacacaacuucugucagugaaucauuauuuauagguuacuguacaaaaauaacauaccuagagcgggucuuugcugugaaaaucagcauaggcauaaacagucaacaaaauuuuagcuuucagaaaaauuaugcaagccuaagaguuuuuaaugccaccagacuuacauaacuagcaaguguuuugugacaguaagcugaaaauaacuuguccaucuuaguaaccuuacagccucacagcucuuuccagaucaaaagcuagacauuauguagaauauuaugcagcaauguagagugaugugcaguaaaacuaacagguugguaagaaauccacguuggccuaauuucuaggucucuuauuaaaccagcauuauuccccagaggggaaaaaaagagauaaaaaccuuagagucuuucccaccuaaucacaguuauugaccaguggauggaaagacuguguaaaaaaguaaagaagcgagcugcucugccugaaaagccugguaguggaaauaugaaaccugaauaauaauaagaaaaguaaagcaauagaaaaagaucaacuggcggcaagcaggcggacuuccgaguuagaggccagccuggucuaucaaagagggguuaacgagacccggguaacuacaaaguagaaaagaagacagaaaaaguaacugcagccuguauuuacgagcuauaauaguccuaaaugucuuacauuuaaccaacauuguuccccagagggguugcaccguuccuggagguacugcaauaccaggucgaugcguggaguggacggagcaagcuccuauuccaacuccuaguuccaaaaauccauuuaauauauuguccucggauagaggacguaucagauauuaaacugauaagaacagauacuacacuugaucuuagccaaaaggccgagaagcgauaccaaauacagaccacgcagccaugcucugcguccgugagacacauuaccuuuguggugaccgcucgcaacccucacuuccugccucccccgcgguuccuuccuccuccgauccgcgucugcgcccuccacaccucacucccacuccagcacccacggcuucagauucaacguccacgacccgggcucucccggcguucccgagcgcgcacgccgaguaugauuugcaugccccgcccccucgcgaagggcgugacaacacaagcccaaauuaggccugugcacgucgccacgccccucgcguggaggcaggacgugcaaaucagcucuuccccgcggccuccgcgauucacaggccgacucacagacuauugcgguuuggaauccaccggaaauagaaagaccugaagggggcauguccacggccagaugcacuggauaaacucugaggcaggacgguggcugaaggguggaccuacugcuccuaguucgcguugucuuaagacaaucuucccuuguugagaggcuggcuccacagggagucuagcaggcuagugauuuucuguuagguguuuucacaauguugucaaggcaaaccuacuuagguaaaaacuguaguaaaucuugaccaaaaaaaaaaaaugucauauauugaaauccuuaauaaauugugugaugucuuugaacuuuucuacaguuuucaggcuaaaaaauaccgaugguuaacaucaaaugcaauaauaaugcagggaucgaugauguuuggcacgugggagugaagaguggacagucacuacucuuauuagcuccuugguacccagaaccuuagaucauuuucaguuuaaggacagacauaauccugagaggaauuuaccccgaagagcuguaggcucugggcugguucugugccucuuugaguguuauagggaauaaagcuggguaggaugcuuuccaaccacugccacuggaaauugcagaauggaggaccagaucaggcaaagccuaaacuauaugagacccagccucaaguaaaagacaaucugccaaauauaaagggcaaaauacuaaaagaccaaacuucuaaauguguuuauguguaaguacucaauauuguaggauuugggcuuagaguugcccccaaggcuuugggaccucuuaugccaaacacaaacaccauccugauacauccuauuacagagauuuuguuguguuuucuuauauuuguaacuuuaaaucacuuuguaaccaucaacuacuuaauggauugucauuagcauuuaaauccuuuagguaaagguaccagugaugguuugaauaagaauggcccccacagacucauauauuugaaugcucagucaccaggcaguggaauguuugaaaggauuacaaggguuagaagguguggccuuguugguggaagugugucacuggguguggucuuugagguuucaaaagcccaugccaaguccagaaucuuuuucugcccgugcuccaggaauucgcucucagcuacuguuccagagccuaccagcaugcuucccaccacaccaugaugagauugggccacaucucugaaacuguaaacccgccccaaugaaaugacuuuucuuacaagaguugcggggcggugguggcacacgccuuuaaucccagcacuugggaggcagguggauuucugaguucaaggccagcuuggucuacagaguggguuccaggacagccagagcuacacagagaaacccugucucgaaaaucaaaaaaacaaaacaaaacaacaacaaaaaagaguugccauggucaugaugcagcaacagaacagucacuaagauuguaugccauuaauuuuuuuuaauccucugcugggauuaaaggagugcaccaccacgccuggcugugccauuaauuuuugcuuaauuuuugucagauaccucaaugagaccuuggagggcacgggauacuuacuauuguagggcuaaccuugcagaggugggaaacgauuugagaccagauacaugugaucauuauucuugccaguacuggccaguguacucauuuauaauaauaaauaaaacuuugggccagagugagcagggacugagcaaguggguggaccggagcaagcacgguugacaggagcaagcagagguccuaaaauuuaauucccaaccuccacaugcaggcucacaaccaucuguacagcuacaauguacucauauacauaaaauaaauaaauaaaucuuuaaaaauacaauaaaaugggaauacuggauacaccucuguaguuaacaauggguuuauauugggccaggcauguggugcaugccuuuaaucccagcacucgggaggcagaggcagguggauuucugaguucgaggccacccuggucuauaaagugaguuccaggacagccagggauauacaaagaaaaccugucucgaaaaaccaaaaaaacaaaagcaaaaacaaacaaacaaaaaaacaacaacaaaacaaaggguuuacaaagauguuguagagguuuaaaacauggaaaagacagggcugagguaaggacaaaggacacacuacacuaaucagagcaugaauuuuucaaggcacauauagacauuuaagguucauauguguguggaggacaaaaaaaaaaaaauacucgugcacacagauaaacacuggaaaugccaggaaacuuuaaacacaaagaagauuucaccucugcuccuggaaugcuggagaaggauauaguuuccaaccuggugauucuuugguaccugcuguuacaggcucugccuguauccccagagugugugaaagauccugacaggauguaaaaggucacagaagcccugaaaguggcaaaacagauuucauuguuagcagaacuagcuuugcugauuuagaaaaauagaggugcauaaugcuauggccaguguacucauuugaacccgugugucugccaauguucugaccguuccuugaacccaggugugugcccacugcugaaguccacugucagguguuugugauauugguugcuggggaagagucagaaaaucuccccagaagccacagccgggccaaucuggaguugcugcaccugcaccagacucuuuccuuguaccccucccauacccauuucuugagaaaucauuuuagaauagacauuguuuagaucuggaaauccccuacuccccccuuccuuucccccugagggccuauaaaaacugggaccccuuuccccucgacgucgacuccucuaacccugcgugggauacgagucgucccuagagcuuuggcuuucccugaauaaagccucaugugguuugcaucaagcuuggucucuugugaguucuugaggguccgcuauuaucccgagacuugagugagggucucccuuugggggucuuucauguguuucacucauccuagacaauucccuccaaauccucaacacugcuuuacuccauaaaaccuauccuuagcagugacgucauccgugcuuuccaacacuauaggugacuucugucauccuaggccagccaauccugacucccacagauacuaugcuuaccccaaucaaucucccuagacaauuugggugcuaccuuugaguaaacaguacucaucuuuaagaaagaagccagauguacuuuguaaagaauuucaauguaacauguguuaauuuuuuguacacuugagacugaguuaacuguuaucagaaaaccuuuucuuucuauccuucaaauugugcuguguuucaauguagcuaaaauaaaccaacuggugucagacucuggaaguuugaaccggagauagcaauuaaguugaacugaaccaaauuucacucuucccuuacccagaccauuucccugcaggcugaacagaucauuuucccuacagaagacucccaccaacacacacccacacacccacacacacacauacacacacauacacacacacaacacacaacacacacacacacacacacacucacaaacccacccacauacauacacacacacacacacacauacacacacacacacaacacacacacacgcacauacauacauacauacacacacauacacacacacacacacacaccacacacacacacacaugcacgcacacauacacacacacagugugcauuuucucugaggaugaauaguuugucaucuuugcauuccauaagaucacuaaauugaucccacagaugugagaaagaccgccgacccaaaucguggccaaauuaaagcaaaccauuaaauguuuuuuaaaaauucauguacucagacuguaucucccucaaguugaggcucaaaucagcuuuugacuggggaagauaagguuuuuauugaucagagauaagggauuugcaauuggcugaaaauggcaggcaaauaacuucuguggaguuacagaagcagaagaaaagcauaaguuggucauaacagccucugcgaaacaaagacaugcugcaaggugcccauaacaagguggucauaacaacagaauuuauuuaugggcgggugaaauggcucagcagguaagggcacugacugauuuuccuaagauccugaguucaaaucccagcaaccacauggguucacauccaucuguacagcuacaguguacucauauacacaaaauaaauaaauuacauaaauaaauaaauaaauauuuuuuaaaagaauuuauuuuuuuuuaagauuuauguauuuauuauauguaaguacacuguagcugucuucagacacuccagaagagggcgucagaucuuguuacagauggcugugagccaccauguuguugcugggauuugaacucuggaccuucagaagagcagucgggugcucuuacccacugagccaucucaccagccccaaaagaauuuauauauguaugugaggacacuguagcugucuucagacacaccagaagagggcaucggaucccaucacagaugguugugagucaccauguguuugcugggaauugaacucaggaccucuggaagagcagucagugcucuuaacugcugagucaccucuccagcccccauaauggccucuugaaacaaaggcaugauugccauuuucuggaccaggcaguauagaaccguuuguaauaaagguugcagguggggcauagcccaauccuggaguaacaaauuuaauguuucauagaaaugaacauagagcugggcaugguggcgugcgccuuuaaucccagcacucgggagacagaggcaggcagauuucugaguucaaggccagccuggucuauagagugaguuccaggaaagccagggcuauagagaaacccugucucgaaaaaccaaaaaaaaaaaggaaagaaaagaacguaguuugucauuaauauggcuuuccagguuaagauggaggcaggcugguuuaucaauaaugugaucaugaacauuugauaaaaugaauacuuauggaggucacaguugucuguguaagguucuguugaaagucuacauaccauacaacauuguucccagcacgacuugaacacacagagagcugugggggcucauuuaucugugacaggagaguuuauauagaguauuuuuggaugagcagugcaguuaaacaugguguagaaaaaguguaggagaucuggccugucuuuuaccaucccagggucaugacagaggauuuuccuuaggggaccaucacucucuugcuuaguccaagaucucacccuuuccugucuccugucuuccccuucucuugagcacugcauaagacuuguuccaccuauaaagcccgauucccuccaucagcacaagaccauuacuucuguugugugccgacaaggcucaagcccgggccuguuuguuguacggcugugaagaaguuauucucuggauuagagagaaagcugugcaagacagagcuacuguaagcaugaaaguggcacuaacucagcccggggcgaaagcagaguggaucgcaggugugcaccacuacccuuauucccugguccgaaucaaccagccaccagggccauggcacauucaggcaauugugggcuuuacagcugagggagggaacacuuguuaggaaacaggaaggaccuggaaauaaaagacacgaccaaaacaaccacagacuaaaaagccccuuagguuuagacgacucugguuuucuucuugccuguacugcaaguauuugcuugcuuaugggguccuuccagacuguaucucuacguccuaauuuuuaauauccauuuuaauacaaaugcuagaaauaccuuaccaugagagguauccugcucugcucauagcuguuuccucuuaguucccaaguuuccagccugcaaagaaacaggcgcccgugugugcguguacguacauacacacacacacacacacacacagaggcauuuaaaaauguaauuuuuaaugacacuggcuuccucccucaauucucauuauuaaucucagauacaaucgagugaauagugaagacuuuuuuuuuuuaaguggcccuuuaaguagcacaguccucuaaugucuaauuuuaguuauguaaauauccaaaaccagagaaaaagcuguaacagaaagcaccggcuaggcauuacuucucugacagugcaaagaaauguaacuuguuagauugcauuucauagcaacuuagccugaagaugcagcaacaaaaagggaaacaaccagacuucuguacaacaugaaguuuugcuucaacacaugaaucaccaaaaaagcaaccacauauacacauuacccaaauccauuuacguaaaaaaaaaaaaaaaaaaaaaagaugaaaaccuuagagucuucccaccuaaucacaauuauugaccagugucugaaaagguaaagaagcgagcugcucugccuaaaaagucggguaguggaaauaugaagccugaauaauaacgguaaaaguaaagcaauaaagaaucaacaagacccggguaacuaaaagguagaaaaagagagaaaaaguaacugcagcacauacauaagaguuauaguauguuccaaaugucuuauauuuaaccaauauuauuccccagagggggugcaccguuccuggagguacugcaauaccaggucgaugcguggaguggacggagcaagcuccuauuccaacuccuaguuccaaaaauccauuuaauauauuguccucggauagaggacguaucagauauuaaacugauaagaacagauacuacacuugaucuuagccaaaaggccgagaagcgauacccagcacacaccaugcagccgugcucugcguccgcgagacacauuaacuucguggugaccgcucgcaacccucacuuccugccuuccccgcggcuccuuccuccucccgugcgcgucuugcauccuccacgccucacucccacuccagcacccacagcuucagcuacaacguccacgaccccggcucucccggcguucucgagcgcgcacgccgaguaugauuugcaugccccgccaccacugcacugaaacuccucugccugccugcgcgcggguuuuagaaccgcugagaacgcuccugcuacggccuccaaggaaaaaggauacggcauuguggugggagaugcuccaggggagacgcaguggcgcaugguggcagaaaagagcacacccacuguuccuaguuugcgcuuacgugagcugacagacgagcuucuccggcccgcggagagacagcuuccaagucgagagggcggugca

SEQ ID NO: 210 - RNA, 25157 nt, Mus musculus
cggggucuguuugguuacguggccaaggacugcuacuaauagagcuacuucugaggaacacguggucuagcuuuagcaagaacucagagacagacacuuuguggccaugggcucuuggaagacuggucagagcuaccuagcggccggguugcugaagaaccaaguggccguggucaccggcgggggcacaggcauuggaaaagccgucucccgggagcuccugcaccuggguacgugagcaggccucuggggcugggcuaguguccgcagagguccagcucggguaaacuggguucagagacagaggggagugcuggcggaccgggaagagguugcaaagcuccggucugcagagcugagcaaugagggaaaacgaaauaacagagguuuuauuccgaauagccgagaaauguugagaggcccugaucagauuuucuucucacguccccugugcuaaaagcaagaaaaaggaaaaguuauuaaacuuagaaugaucacguaaacacacgcacaaggaagccaucaagaagaaaauaguuacauuuaauauuuaaauaugugagaaugugcaucuucuuuggguuuacuuuuuuuuguuauuuuguuuuguuuuuuuuguuuuuuucuagacaggguuucuuuuuauuagcccaggcuguccuggaauucacuuuguagaccagcuggccucgaacucagaaauccgccugccucugccucccgagugcugggauuaaaggcgugcgccaccauguccggguuuuggguuuacucuuaacccaaagcaaacuguucccaggugguggugacauaugacuuuaauuccagcacucaagaggcagagacagguggaucucugugaguuucaggcuagccuggucuacagaucgagguccaagucagucgagguuucacaaagaaacccugccucgaagauguggguaagaaggaagagugcaaaguuuauaaaggcauauuugaaaaguauuuccaacacgacgcuuguauugugcaaagagcuuugacaaguagauuuuuuuuaaagauuuuuaaaauuuuauuuuauguauaugaguacacuguagcugucuucagacacaccagaagacaguaucagaucccauuacagaugguugugagcuaccauaugguugcuggaaauugaacucaggaccucuggaagagcagacagaucucuuaucugcugagccgucucuccagcccugacaaguagauuuuuaaaaaucugacaucaaguggaacaaaugagaaaugauuuggccuugacauuccaugcugaacuaacacaagaaauaaauacauggagaaaugauugacuuuaucuuaucagcaguacacugcaaaaaaaaaaaacaagacaguauugcaguuugcacuuuaccauuacuuccagccugucuuccaccaggaaacuuccccugggaggaggaauuauuaaaaaaaaaaaaaaaucaaccaguaccuguuuaguacaaaggucaggaucuuggccucugucagcaaauuugcagaaccuugguuccucuucuguggauugcuaguuguugaaccucuuuuugaguaaguuugcauugggcaaacacuacaccaguucuggggucggccaacagaguauuguggcaugacuguaaauauaaggccacucagcccuggagaugcugugagaguccugggguaugucccuagggaaauacuuccuacaccuaaaagagaagugaacauuguacugcuguauuuaucauuggauugccuuccaugagagaauaugggaaaaaaaguucuuuuaaaguuuuguuguauuuuuaauuauauauguguauugggaggcagaggagggccugugagugggaguacaggugcccaugaaggcuggaaguggcagauccccuggaacuggagugugagccacccagugugcguggugagagccaagcucaugcccucugcaagagaagcacaagcucucuuaagcuccgggcuaucucuccagcaccaaguaugugaaauacucucuccuauggcuuuuucagucuuuguuguuguuuuuuugcuaacgccagaauuaauggcuguuuucuguuguuaugucaacccaaauuggacaguagacuauuauaaagcauuagccgagagcuggcaggaaggcuuaguggaugaaggugccugcggccaagccugauggccuaaguucaauccucagaacaggaaugggggaaggaggggacugaguuccacgaguuacccaaccucugcacaagcaccaggccccccccccccccacacacacagauaaauucuuuaguaaaguguuagcuggucugccuuccucagauauauaggcuaucagaacgucuuaacaacuguuacaggugucccuggcacagcacagcacagcauaaaggagaccuagcagcgaccgugagcuaaugcuaugcaaaacaaacuggucaucuuugggggggggggggaauuacaaaugucuccuuaccuuuguuguuguuguuaguguuguuguuguuguuguuguuguugaaaagucuuucauuucuaguuacagacauguacugggguggaggaaggcugugcuauaaccacaccaggcuaguguugguaggaagggguuggucagaagugccagugucaucuggagggaguuggggauggggugaaugugcccagaauacguucuaggaguucccccgaguaaauaaaagcaggaguugaaagggugcaaaguuucaauuaggaaggauaacgucuggcuggcuguugcccauagugcuuauuaaaugcacaguuacuaagacuguguuguacggaggcaccugcugccgagaauuccuaggaccuacaugguggagagggcagauuccuggaagcucugaccuccacaugggugcugugacacacacacacacacacacacacacacacacacacacacauugaacaaauguaauaaaaggaaguaauauaguuaauguuucaaaauugcuagaagacuuuuuuuguuugguugguuucuucuuuuccuuuauagcuuuggcuagucugaaagucacagagauucaccugccucugccuccugaguagugggauuagauucaagagucacuacaucuggucuuuacuuuacauuuaacugacaauuaaauuaucuguacugagaauugaacccagagcuuugugcaugaucagcaaaguucuuuaccaccuggauacguccccagaccucucuuuaaaaacaaagcaacaauaacaaaaccuuuuuauuugaagucuggccuucucacucuguagcccaggcagcccuggaauuggugauucuccugccucagccaccugaguagcucagauuauaagcuagaacaccaggccugcuuuaaggauacuuuaccuaucaucuaccuaucgcagaggaauggcuaaguaugaaaggagauguguucauuagucugauuuaaucauuacaugguauauaaaaauaccaaaaacaucgaaaauauacucagugaauguacaauuauuugucaguuaaauguaaaauaaaaccagauguaguggcucgcucauuuaaucccaggacucgggaggcagaggcagguggaucucugugauuuuucagacuagccaaagcuacauagugagaccuugucucaaagggaaaagaagaaauggccccaagaauuucuguaaugugaagcuuguugugauucuuaaaccucuccgaccuucagcucaaccauuuucccuguuuauauugagaagucugcacuuagcagugccuucuggcuacgccugccuguaacucucuccaguguguuagcaugccugcaucagcucaucccucucuaaccccccgggcuuccguuguuagcaguuuuuaauuccuuuuuuugcuucuaucgaauuggccaaucuuguuugaucaaucacuuuugcaacaugucacacaguuuagcauggggaguugaggaaaugacacgcuaugaucuguaugucuguguuugagcugaacagcagauggccaagaaucaguuacuaaaagaccuacccgcuccgcacauagaguuucucuguauaucgauggcuauaccggaacucacucuguagaccaugcuggccucaaacucagaaaucugcccgccucugccucccagaguacugagauuaaagguguaugcuaccacugacugacugacugacugauauacacauacauacauauauauauauauauacauacauacauauauauauauaugaguacccuguagcugucuucagaaacacaagaagagggcacagaucccauuacaggugguugugagccaccauguaguuacugggaauugaacucaaaaccucugguuaagaacucgguuaagaugacuccguguuccuaaccgcugagucaucucuccagcccucuacauauacuuuaaaucccacuacacauuguuaauucuuguccuucaaaugauccuuuuuuuuuuuaaagucagugugaauagaaagaagaaacaguuuguauagucacaaaauuuucauuuccaguucugauuuuucagucuuugauaguucuauacagguauguaaugaauuuuaguggcuucuaacccccugcuguuaucucucauccccgccugucuuugaaacuaguuucauuuggauuuugaugucuucugaugugagagaccuacugaguuuaauugcaguuggcuguuugaugagugugaaagggaugggguguuuguuuuguuuguuuuuuaaugcaugagcaacauaccaguggguauuagcacugaagaaaauuacucucagcaaccauugacaucacauagccccgcaggaaggggcagggccucaugagcaccucuucgacccuugagaaaaugaugcugguccuucccagccuugugcaagucuggguagggcaagcacagguugggugaguguuuccaccacucguucccacccugacugacuccgcuuuuggaaggacuuaacucuccuucugaugucauuuuuucuucugcuugaaggacuuuagauuggcugaauucuuuuuuuuuuuuuuuuuuuuuuuuuuaaugagugcagugcaggucuguucugauaaauucuucucauuuuauaugcguggcuuuugcuaucguucuugagaggguguuugcaguuauuuugcuuuugcguuauuccacugucuucugccuggcucuguuuugaaagccgucauccguccuuauuguagaucugggcaucaugcauuguuuuucucuaacuguaguaauuuuuuuuuuuagauuuauuuuuacuuuucauccuguaucuguauauaugugggggaugugccugugagugcgaguacccuuagaucuaggcuggagcaucggaucccucagagcuaaaguugcaggugauuguaagcuaccuaccuagcacgagggcugggaacugaaccuggguccuuuaagagagcagcaagcgcucuuaacccuugugcucucucuccagccccaucuggguuucuauuaguuggcaucucuugguguggguuauuaucuucuugcugcuaugcagguccaggguugaguuugcugguugcugacugaguugagccuuguuauauuuauagucuuauaaaucagcucucccuccccaccuuugagccacacugggaugcagcucaguuaccuaaaaaaauaguuugauacuuccaaagagugucucgaaauucagaguucggccugggagccuuucaucucuggcuaaugccgcuucacugccaaagcuacgcugcaccuggugaaagauuuuuuauuuuauuuuauuuuuauuauuuauuuauuugguggucaacagauugccugcuccuggugcuggaugcuggguuccuucccuggcucauuuugaagggcucuuuccaguguuccuguccgcccaugcacagaucugcgcucugccaagcugaagagcagggagccaaaaaugccagguucuucuugagaacugaggcuuuuacgucucuggagaguuuuccuccccuaaauuagaagauggcugauuggcccacaacuauugaguaauuugcccugauccuaccugaacuuguugaggcaauccaucagccaggcccuuugggcaggagaaaaggcccacaaggccauaguauuaagcugccagacuguugucucaagucaggggggugaggaagaagccagcccaaguucaccaccauuauugccuagucuuggugccucuccuaucugucugucuaacucuuugucucacaauaauaugguuuauucuuagaccccuucuuggacuagcaugcucucggagguggcuacuuauuuuucguuccauggcacuugauauucaguauuucaaaacaguugucccuucccaccccguguguguguguguguguguguguguguguguguguguguguguuuguguguguguguguguguguguuuguguguguguguugucuagcuucuuagucauuucaguuccuauuguuucaacauaucuucaaccaaaaccagccuaacacucuuccacacuugccuuuuacagaauacacaaaauaguuucuguaguuuggacagcuuuuuauuaauuuauuuauuuuuauguguacucuaccuacaggucugcuucucacauaugugcuuggugccuguggagaccagaggggggugucagaugcccuggaacuagaauuacagagaguuaugagcugcuacguggaugcuggggauugaacuugggucuuuuggaggagcagccagugcucuuaaccacccagccccuuaaucugcacagcucuugaagcuugcuuacuuuuuccucuggucuuuuccucuuaggguguaacguggucauugcuucccggaagcuggacagacuaacugcugcuguggaugaacugagagccucucugccucccuccagcuccgcugaagucuccgccauacagugcaacaucaggaaagaagaagagguaagacagacaugucggcacggccuacuuacccaggguucuuugcagaagugguuccuggccccugcuguacuccaaggugaugagggaggcacacuagaaggcagagcuccugacuuacugagcuggugaccucagaaggaggaguggugagcuaaaccagaagguacucuugaaccgggcagugguggcgcacgccuuuaaucccagcacucgggaggcagaggcaggcggauuucugaguucgaggacagccuggucugcagagugaguuccaggaugccagggcuacacagagaaacccugucgggaggugggggucgggggugggagguggggagaaggaauguacucucagcuagaaacccuuuaaagcuguaguuuucaaccuuguaauccugcaacuccuuaguacaguuccucauguuauggugacccccaacuauaaaauuauuuuuguugcuacuccauaacuguaauuuugcuacagcuaucagucauaaugugaauaucugguaugcaggauaucugauaugggacccugugaaaggguuguuggaucccccauccccaaagagguugugaccccaguuugaugaacgcuacuuuaaggcguuucuuaguguucauuuuggccugguuuucaucauuuuuguuuaaggucgguacuuagaaacuaaugcuacugaggcuuguuguacuuagggguuaucuauacucuccagugugucuugccauccaaauuagaauuucggcuuuucguuuaggagugugguacagugguaaauucacacugugggaucuggggguuuauucagugguggcuuuauguguuuggauuguaguauuuagaaugaauaugcauuauauaggagucuacagacugcauuauauuucuaaaccugggccauguuguagguuaguuguuaaacuuucccuuuccguguuucucuaggugaguaaucuggucaaaucuaccuuagcuaaguaugguaagaucaacuucuuggucaacaauggaggaggccaguucauggcuccuguggaagacaucacugcgaagggauggcaugcugugauagaaaccaaccugacaggcaccuucuacaugugcaaagaaggcaagugucgacagcacaaaaccccagcaugaguggagcgugguggcgcaccccuuuaaucccagcacuugggagacagaggcagguggauuucugaguucgaggccagccuggucuacagagugaguuccaggacagccagggcuacacagagaaacccugucucggaaaaaacaaacaaacaaacaaacaaacaaaaaaaccagcauggcuucaguaagagaucacagggaaggcuggaagaggagcuguuagggacucaagcccauaucaauaacguuucuuugguaucuuaacaaaauucauaucuuguacuuguuuucucucucucucucucucucucucucucucucucugagacaggguuucucuguguaacaguggcugaacuggaacucacgcuguagaccagggugaccuggaaaucagagcucuaccugccucugucuuccaagagcuaggaucaagggccugcaccaccgcugccgcccaacuggcuaugucccuuuagagguuuauuucuuuuuauuuuaguauauauauauauauauauauauauauauauauauauauauauauauauauauauauacacaugccugaguauaugcauguacaccauggugcacagucgccugaagaggggagguuaggugucagaucccugcaacugcacuuuaggguagacaugagguccuagguucuauccuugccgcucuguaagccagccaugacgguggacaacugugaccacaucacuuggaugguagagccaggaacaauagcaguucagggucauccucagcuaccuagggaauucuagguuauccugggaugcauacaaaacaaaacaaagaacuugucucaaaauuuuucucuuuaaauucagguuauaguagauacuuuauggcuguugccgucuuaacugagucacuguuccaguaauuuacauauagauuauuaguuuagcgaagaguuuuuuucaagcuuauuugaagcucucacugaccguuuucagcuuuaccucauggcucauuaaauucuugcuauacagcagucaggaucauccugggcuacgugagaccccagcucagggacaaaaacuaaguuaaaauagaaaauaucaauguauguuggcgcaggagauaacaaaggaagacgcuguuuaacaugguuacugucuguguguguucugcaguuuacaauuccuggaugagagagcacggagggucgauugucaauaucauuguccuucuuaauaauggguuuccaacagccgcguauguauauuuuuuuccuuucugugucuuuggauuuuguucucugaauuggggggggggacuaaaucaaugauucacccuuuuaauaaauuauaacccuaauaauuuccuuucuaaguaaugaucuuauuaauucuuguaaauuuucaugcaguguguguagugguuugaauggguuuggcacccauagacucaugcguuugaaugcuuggcccacaggaagugucacuuuuaggagguguggccuuuuuagacuagguguggccuugcuggaguaaaugucacugcagggguagguagguugagcuuugcaguccuaugcucaagcucugcccagugcggaagagagaggcuugaucuuuaggucaagauguagaacucucggcaccaugucugcccggaugcugccacacuuccugucaugaugauaauggacuaaaccucugaaccuguaagcaggccgcaauuaaauguuguccuuauaugaguugccuuggucauggugucuguucaaagcaaugacucccuaagacacuguauauuuugaucauauucaucccccaccccauuuccuuuuauuugaacuuuaaaaacaaauuguguaugcuagaggccagaggucaacaccaggugucuucaccaaucccucuccaccauauuucuuugagaaaagaguuacucacugaaccauggcuuucugauuugccuggaauggcuggccaguggaucccagggauccuccugucucugucucccccuuguuggaauuacaagcaugcacucccauacaugacuucuguguaagugugagcauccaagcucacguccucaagcuccugcagcaagcacugcaccuacugagccuucucccuaguugcuaauagugcccaugcagguggagguggccgaauacagugguuugaaugagaauggcucccacagacacauauguuugcaugcuuagucccaguuaguggaaccauuugagaagaauucagagguguggccucuuuggagugggcguggccuugggagauggugugucaccggcagugggcuugagguuuccuggagguguacacuuuugucauuuaucugaaauucauauuaccuggaggcccuguaucuuuucugccaaguaacugagauauuacaaaucuagcugucacugugggaaauagcuucuuuguuaaauuagaaaauuaaauagaucuggacucauuuagauaucagaaacucugaguuucugaaacacacacagaauuccugaggaauuguaguucuaacuaguaacaaguugacuuccucuauggaaauuuuaauaacauucuagcuucauguauuaucuaggauuccuucagcuguggagaguaucgguuacucuuugucucucuaaccacaauuccuggcagagaaggcuuagugggggaaggguuuguuugggcuccugguuucagaggacuugcauccaucacagugagccaggaagcagagaucagaagaugcugguacucagccagcugcuccuuuguccuuuauccucaccucuugggaugacacugcccaccuucaaggcagauaggucuccccaccccccuccccuucucacagugaacccuagugaauucucucaggaaacaucuucacagacacacucaagagguaugccuuaagaaauguggcacucuccaucucuugcaaagcucuacguaguccuguggcauucacaccauguguggugcagacggcagagugcagcucuucacgcaggcacugggagaugcccauguggaggucaugaaggaaggguuacauugaaaguccuuugugcugggccuugggguagggagcagagcugcuguggcuaagggccugagcgccugagacugucccagcucacccugacaggcaacuuagcacaccacgagaaugaaaucuggggagaccaagcuagaacuuacagaggcugugugaccuggguaccaugugccgugauguuugauugccaguuuuuaacugccaguaugucaguugcgcauuugacacauuuucagggguuccgcacgccugcuuguaugcgcggaccagucuuguaugcuucuggguuuuuucauauugcugagaacuuuuuuuuuaauguauuuuuuucuaggauauuuaaauuagcuauccaauaauaugcuccagauaagguaaggaucagguuaugaacaaaccuauuuaaagcgaucagguauacuaaccacuuaguaccaagacucucagauucucuggcuacauaauuuauacagcuuuccuuuaugcucccgcucccuuuagagggacuuccggcgugggaggcuagguauucauacugaugaccuuuuuuguguuugaguaauagcauuauuagcaugaaauucacuguguguguguguguguguguguguguguguguguguauguguguguguugcuagcgaucaaacccgaaaccuugugcaugcugaccacauacucugccaguacacuaugaccucagccccaaauuuaucccuuggaagaauacaacuuacugauuuucauauucaaaguuaccaacuaucaccacuguccaauuucugauuauucugucauuccccaagaagcucucucagcagcgugcagucccccuccucugacccaaccccaguaaccaggaacacucuccaucucugugcgagugccuaauggacguucauaaaguugguagcuucacccuguuuagagagagaaagagagagagagagagagagagagagaggucuuacucauuccuaaugaaucaaaucaagcuggcaaucuaaauuaacuguuauauacuagcuuuuaacugcugagccaucccaaguucucuacccagugggauauauguugucggaacagaggggaaggggaaucuuucaaugaacuaggaaagaguugaucagcaaacaugcagagcuaaaaguugaaggaaauccuucuuuccuuacuaccuggucugucuuuccccgcugguuucagaugcucaugaauggauuuuuccacauuaaaccauauggcagcuggggauauuauuaugcugcacauagaaauuccgaaucacauuacccuguaccuucuuuuuuuauauacuuucuaaaaaaaagauuuauuuauuuauuauauaugaguacacuguagcugucuucugacacaccaaaagagggcauuagaucccauuauagaugguuguaagccacuauguaguugcuggauauugaacucaggaccucuugaagagcagucagcgcucuuaacugcuaagccaucuuuccagcccugauaccuuuuuuuuuuuuuuaaagugcaugguuucauuguuguugagccacgguuaccuggcuuagacguuugacaucucucccuguuugacuagaacgugcucuguagaccaggcuguucuacuucccaugugcugagaguaaaggcaugcggcaccaugcccagcuuucuaaauguuuaaaauuauauuuauuuagugguuuauuguucaaugugggguauauaugcuccacaacacaaguauggaugucagaggacaacuugcaggguuguuuucucuucuuccacgguguggucuuggggauugaaaucagggcgucagacuuugcaguaggccauaucuauagcccaaccuuuuacuuggaauuccauugauaauacauguagccaaauauaugauuuucauagccccuaguauuaaaaguauuuacaguaucaacauauacuugccguguuuggggcuggcgagauggaugagcugguaaaggagcuugccacuaagacuaagguccugcauuccauccccugagcauccccugagcccacaugauggaaggagagaaauggcucacuugaugaucucugcccuccauacaugccuugugguacaugcuugaguggacacauauacauacacgugugcagagagagagagagagagaaagagagagagagagagagagagaaccacaaccuguuguucucuuuuguaauaaaagguucauggggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauaaaauaauaaauaaaucuuaaaaaaaaaaaaaaaaaaaaaaaaaaaaaagguucaucaacauauucucccgggcacauggcuuuugagagacacagcuuaugcagagugcauuguauuugauaacuguggccuggcuuugauagagaaggacccagcucucucuuuaaacagagacucaaugugacagagacuccuaacaaaaagaaucuuguggaguucucaagucacugaagugcucaucgacuuaguugaugggaaaaauguuugacagaaacugaugcuaguaauguuugugucuuuacaggcacacuggagcggcaagagaagguguuuacaaccucacaaaauccauggcuuuggcgugggccagcagcggagugaggaucaacugugucgcuccuguaaguaacugcuaugugugaagucuacugacaaacugggcuccugauucagauuguguuguggauaauugugucacuggugugugugucuguauauauauauauauauauauauauguauguauauguagauguagauauacuauguaaauauacuauguaaauauacuauaaaugguugacuuuuaacauaggugaaacuagaaaggcagucauucguuauagcaguaauguuauuugguaacgagauagugaugcacauucuugguauauauuagaauuauguguauuuaaucaguaguggugcaggaacuguacuuccuaucaugaauugugaguacccgcauuauaaaacgcauugaggaauuccaucccacagugaugaagguugcaaaauacuagggaacuaaagagguggcucagcagguaagagugccuauugcuuuugcagaagaccugagcucaguucccauaccacacugcaucucacaacugccuaugacucuaucuccaggaauucugacaccuucuagccucccugggcaccugggugcucguccccuguaacacacacacagaguuaaaauaauaaaaauaaaucuuaaaaagaaauacugcuuuggggacuggcaagauagcucaguggguaaagugcugucugugcaagugugaagggcuggguucagaucuccacacucacguucacagagagacacagcagcacacaccuguaacuccaguccugggccgcucccacgauggccgaccagccugugugaaacagugaguuccaggcucagugagaaacccugucucaaaacaagcaaacaggaaaaaaggagacggcauaaugaagaaccauagaaggcacggauagugaugucuggcuucuccaugugccugccugguugagaacauacaugugcacacacacauguaacauguauguucaccaugacauauaacauaacaaguguggaaaguucaccacacuuguacacacaaaaaaagcacuacuuugaagaguaacuuuuuuccuaagugauuuuguuauuucuuguuauagugugagucccuuauuuggaaaaaaaaaaugaauaucaaugggaagcaacucucaguuuuaagaccaaguagaaguuaaguuauguguuauauaucacaaauguagcuacaguauuacucaaaaaaaaucuuuuuuucuuuuugagcccaguggugguggcgcacaccuuuaaucccugcacuugggaggaagaggcagguggaucucugaguucgaggccagccuggccuacagagugaguuccaggauggccagagcuacagagaccuugucucagggaaaaccaucuuuuuuuguaugggaguggugcguguauguguucauguguaugcaugugcacguacaggcaaaaggcagaguucaaugcuagcugucuucuucagccaaucucuaccuuagcuuuugagacagggucucuguguugaccccaaagcucccugauuugacuagacuaccuggccagcaagccccagggaccugccuguccccgaugcccuagccucccuagugggaugcugcaggccagaaugcagauucucaugauuucagagcaugcaguucaacuaugaccgagccauuucccuggccucugcuugcuuuuugagagcgguucuuauguagcccaggcuggcuagaauucauuauauaaguuaaguuggccuugaacuccuggucuuccugccucuaccuccccaaauauuuauuuguugugaaauaagucauagcuugauccaccugauauuuuguacuuggcauuuauuccaagauacauuagguagaauacaucuuucuccuccuacacagaucaacucagaguaacuuuucuuaugauguuuucugaccgaggauaaaguagagagaauaguuccauuuggacuugggagcacauaucuguaacacuggugaaguguugggagagaggguagcacauauccacggagcccacuaaccaaucagcauagccaucuggcgcucaggccagcuaucguagucaaucagugagcucuggguucaacaguaagguggaaaaugauuaaaggaagaaaucugaugccaaccuuugaccuccauaugacuuccaugcaaccccccccccacacacacacacucaaaauuuaaaacaaauauauauuuuuaaaauuagcuaucaggguacauaucuuggauuuggguguguuuuuuaaacuucacuugaaauguaaaaccaagaaaaauccuguauuuucacaucucugguaaagcaagcaugcucagaggaagagaaaccagacuccccagacgcauuguuccugguuaggugccccacugaagugcuuacauaaacauacuccucagaaacuaagucuuucaagaaaaagaccaagacguagcugguuuuuaaaggggagaagcccccaaaaugaucauucagauggucugcuuuuagauagugguuggcuggauccccuuuugacaguuuugaauaaaguugauuagaaacguuugugcugauguuaagccacacaucuuuugucuucagucagcauauccccugaugccuucuuguugcuaucugugaguucuagagaugggacccagggccuugagcacacugggcaagugcucuacuucuccucugcauccccaacccuuggugucuugacaauuuaauucuccccauuuacccaccuuccugcuuuguuuucuuauauaggggaccauuuacucccagacugcuguugacaacuauggcgaaaugggacaaaccuuauuugagauggccuuugacaguaucccagcuaagcgccuuggaguccccgaggaggugacguaucuggguggcauugaugagaauaccuugagaacuuugugacauuugguacccugggcauguggccuggcugaccaguagagagauuauuucagugccaucaaaccaugucgccugagcuuugggcucugggaaauaaccuaguuaguugcuuugacugcugacagcagacucuccucaggaaugaaggccaugaaguuagagacgacacguuuuuguuaucuuugcagcuacaguuuuauuaccugcaguguugguuccagcagccccaagcaagccagauaaugacagacucgugaaguuccacagaggaaugaaguauguuaaaaaucaauagcuuuucaaaugacugaggaguaaacuuagaucuaacggugguaggauggggaaaguuucuuacugaagaaugaaaaaaaaaaaaaaaaucccagaauaaauaagacacguggggcuggagagauggcucugcaguuaugagcaggaagugcucuuccagaggaccugaguuccauccccaguggcuauaaagaugucucccacugcauggggauccaacaccuccagccucugcaagcacccgcauucacuuguauauuccuaccacacauacacacacuuagacauaauaacaauaaauauuuuaaauaaauaaauacauguuauauuucuugguaggagaaccaauuuuauuuaaaaguccauuuuugcugggccuaugccuuuaaucuuaguacacaggaaacagaagcagacagacagaucucuguggaguugaggucagccuggucuacacagaaaguuucaggcuacccagggcuaccuaaagucaaauuccaaaguuguaggugucaggaagaugcgucagcagguaaagguuugauccaaacuccgcacaggcugcccugccacaggcacacagggccacacacgugagugcagaacccuagaggccagaagacaguguuggacccugcagacuucccagcaguuagcugccugaugggugcugggaaccagcucacguucuuggcaagaacaauaacaugguuugggguuuuuuuggguuuuguuuugagacaggguuucucuguguagcccugguuguccuggaacucacucuguagaccaggcuggccucgaacucagaaauccgccugucucugccucccaagugcugggauuaaaggugucugccaccacugcccagcuaaucuguuuuaauccagccuguaauuaggauuuauuuauguuguuuuuguuuuuugagaccgggucuccugucucugagcuggucccgaauuugaucuguaacagagcgccuuguauuucugacccccuugcuuaggugcccuaugugcuggcguuacaggcugcugcuggcguuacaggcugcugccgccacaccugcuuuauuugcuguuagagauugccuuugggccuugugcaugcuagacaagcaccccaccaguucagcuacaccccaaccccaacaauuucuuuaaagucagagcgaaccugaugucaugaacuuucugugcucuguacuugagccuuccugucacacugggaucuugggucuauuuaacuuguagcauaacuuauugucuuuaggagcuccuuugcaucuagauguugacacagcucguucuguaacuuugaaaggacacaucucuuuaugucucuaccugcugcuugaaucaaaguuuagcauggcagccugagccuccccagaauuccauuuccacuugcaagcuugacuuuugucauggaaaacaaacauucccaguuguuucuguuugcggcaauagccucccuuccuuuauguaaauaaaaaaggugcuugcggaggcucaguggaaguaggggagagaugcgagacaguaauggcgagagugaccaaaauuauguacauacaugacauugucaaaaacguuaauacauuaucucagcaggcaccagucacgugguauguggugcacauauguaugugcaggcaaaguacucaagcacauaaaguauaaaagaaaugcaauuuuuaaauggcuguucaguuaguuuaaucacauauucuuaugauggccaguggacuucucugggcagcaaaagcucuuagggugguuguggugggugugugcgcaugugcacacuuccuguaucaugucuuguuuuaucaccuauaacacuagaaagacugcacucaccccaacccauucccaugauuaucugcgccagaauaucaugacugcuggugccuccaauacuaauauaguucauauucuuuagaaacauuuuuaacacuccuuaaauuuuuuuuuuaugugauagggucucacuguguagcuuuggcuggccucaaacucacagagauccgccugccucugccuuccaagugcugggauuaaagguaugcaccaccaaacccagccacaguuauguauucuugaguugccugugugacagagcaagcaugugguggucagaggacagugcuccgguguuuguccucaccuuccaugggaggucgcagugguuguaucuagaugagcgaucuucgcgacaaacuucuguacugguugagccgccuugccggccccaccuuugacuucuugccgugacccauacugaggcuccagccauucuccaaccauugcuuugagccugugaauaaaauuccaacacggugaugauggcuuugacuuuuaaaauccccugaaggaacgcccaucaagacuuuaacaaacuacuggcacagcuacugugagaugcagaacuggggacaaacucugcucaauuaugugcugagucuaagaucagcaaagcuuucacaccagcugcaaccagugggguguguguguguguguguguguguguguguguguguacaccagagugugugcacaggcaugcuugugcuguggugcacauguggaggucagaagccagcucauggagcugcuucucuccuaccugcugggacuuauucuggcacccgguuucccgaggaaggcagcuaagggccauggagucagcgaccagggccaaagcugcuugcuuuaucucuggcaguucugucuuuaacuuuaacucugcuauuaagauauucccuuuauuuacauuucaaguuuuauccccuuuccuguuuccccuccgaaaaccccccauacccuccccucucccccugcuuaccaacccacccacuccaauuccuggcccuggcauuccccuauacuguggcauagaaccuucacaggaccaaggccucuccucccauugaugaccaacuaggccauccucugcuacauaugcagcuagagccaugagucccaccauguguguucugugguuggugguuuagucccagggagcucuggggguuacugguuaguucauauuguugcuccuccuauagggcugcaaacccuuucagcuccuuggguacuuucucuagcuccuucauuggggacccugugcuccauauccaauggauggcugugagcauccacuucuguauuugucaggcacuggcagagaacucugcuauucuauggcugaaagccaccuacuuuuggcaauucuucuaacuuuaacucuuugcuguuguguggccaagagcugcuugcuuuugguaauguuucucuuccuauaacucuuugcuauucucaggucaaaagccacugauuucugauaauuugauuccaacugauagcagcaggagaauuagaaaaaagguuugguaucucccuggcucaagggccucuggcaggccaggcaagaggcuuggaguuuguuaacuuuuugugagcccgagagagaagagaggaagaaagcgagaaaucaagcacacacacagacacacacagacgcacuuuggccgggccugaccaccugucucaacaauuccaccaguguuaaugcauacuuauauacauacauacauuugguggaagggacugacuccaaaugccacacuuuauuucuuuucucuggcaguuuauaccuucuuagacauaaguucuuuauagaauuaucucauagauagaauguuacgcaacaggggaguuacaaaaggauguugacaguucaaagcaguguuucauucugugagcucaucaugagugguucuucugcaugcucauucagagcgacaguuagcuccccauggccuugcuguaucagagugcucaccuguggcuucauccguggaccuggccuacagugaagguuuuuccuuguuugcagauuuacucugagccagcuagugcaauuagcccaugacacugaaggcuugcagagcucuguuugccacuuuguucuauauggggcuugagauuacuuguaucaacuuaaaaauuauauaaaaucauuaucggaaauugugaaaaaucaucaauucgucuauacagccuuacuacgugaaaguccauagucauguugaucuucaggaaguuugcccaguagggugggucgaugcccagggaucauuaggcuauguaauaguggcagggaaaaugugucaucagcaagaggcaaucccgagaugaaaucuuuggugaccuugcauguuaaagcucacccgucaaaagccgugcaaaauggugagccaucuccaggacacucauuugugugcuuagucuguccugggugguuucugacaccuacccuccgugggaccugaucaaacccaggcuguucgcuccccaucccuuguuuuuguuucagugcccaguacagaagccaggagugggaugcgcuuagggucaccaccccugugagacucugcuccacuuaccaucaguaaaaugaauucuguugguuugugaaguuucuuuaaaaccucgccaagcgacuacguuugggaggaugugauggggaccuugaagucccgcuggugggaagcuccugugauccgcacagcggugcuuugggccugacagggccauggacacacuuaacuguaucugggaccgaggugggagaagcaugugaccgccaugacaaaucagaguuguagaagacaagcagggccucagaagggaauuaacuguugaagcaggaaaccgccguguuuaccuguggcuucuuauaccauugcuguuugccugccacugucugcugcuuguccacaccuugucgccucugcccugguuguuaccugacuucccuuuuguccacacugucucugugcugucaaaucgugcugcacgugcgcgaggauuggugaugcaguccugugggcagagaugugcuuacucaggaguuccgggcucccaggcauggagaagagucuuuccuuuuuccuugucuccuauguauggauauauucucuucuuucccuagaucuccccucugguauguuuccugcuguccccugcggcuuccuauaucacuggacaguugaucaauguggauggaggccaggcucuguacacucacgccuucagcauaccggguaagcagccaggaagugaagaggcacgagcccuucccuguccacgcuccauguuguaagccacugccucagaggcggggguuucuguuauaggccaucgaauggccuucaaaauguugauauuugugauaggauauaaaagaaaauguucucuguuacaaaaacuaucuaaaccucuaagugcacagaagguaggacggaggcaaaggccagcugugcuugaaggguuacagacucgcuuccucuucccccucucugagugccgcacagacggaagaggggcgguccgacuugacuuugcccucucucuggaaucaaaugauaaacuucugugauucaauaacuuuuauuuguaacaugguauucuuuuuaauuauuucauguauaugaaugcccuaucugcauguacaccugcaugccagaggagggcaucagaccucauuacagaugauugugagccaccaugugguugcugggaauugaaccuaugacuucuggaagggcagguagugcucuuaaccacagagccaucucuccagccccauaaaaagaagcaaguuuauuuuaucuuauugaagcagauucucacuguguagcccaggcuaaccucagccucccauuacaggucugugcaacaaugcuuggcuugaaaacuaaauuugcuuucauaaauucaagucaauaacaauauuacacacgauuggauguggcguuggaagggucuuauaaaaucagauaguccagaccagguauagagagacuuaccuuuaaccccagaacucaggaggcaaaggcaaggagaucucugugaguucccagaccagccaaggcuauagagagaggcccugucucaaaacaaaaacaacaaaauaucaaacaauaaaaucagauaguccaguguccuaguuuuuucaaacgacaaaacaaauccccagaaaauaaaaacacaggcuguucuucugcucuuucagaggaucugggucaaucuccaacaccuucaugguggcucacaaccaucuuuaaguuggggagcugauacccuccuuuggccucugcaagcaccaggcaggcacacauguguugcauggacacaagcaggcaggccuucccauauacauaaaacauaaacguuuuuaagagcaugcuaauguucugggauacugcucauccuuuaccagcguaugcaaacccuggauugaauucccagcaccccauaauaccaaacguaguggugcaggccuguaaucccaguagucaaggugguagaggcagaaggaacaaaaaggucaugguuaucuacaaagugaguuccaggacagccagggcuacacagagaaacccugucuugaaaaacaaaaacaaaaaacaaaaacaaaaacccaaagccucaggaaaauauaaacacaaauauauuugaccuuuuucuaaagauaguuacuagugucuguuagcaaacgaaugucugguugacaagacccauuuccuauccuuguagguuucuuaugucccuaaaacuaugaacgguugguugguugaguuuuugguuuuugguuguuuuuuuuguuuuguuuuguuuuguuuuuuuccuucaguguuuugagacaggucucacugucugccugcuucugccucccaagugcuggaauuaaggguaugugccacugugccuggcuucuuucccuuuuugaagaaagauagugcaaccccauuaggcaacauugauuuaacuccacucugcucucuauugcauuucuggcuuugcaacugaagucuuaacaguucauaguauuagguucuguggugacauaaguccagcacaaaagagagaagauucucucugcauuugaagccagccugcucuacauagugaguuccaggacagccagagacccucccccaaaacaaauaaauaaauaaauaaauaaaacccaagacuguauuuccuaggcauguuaggggauuaaguacacauggugucagguccuguguggcuggaguuggucaucaccauuggccuuucagucuccaugaagaggugggacacaucuaagagccuuuuccucuuccucuguguuuguucuggugaaguaucacccuuuugaggcuggcuuccuuggaacuaggauagcagccugccacucugagaccacaggcuuuucucugcccauauccagcugguugaagagccaggagagggaaggacuucaucuuagcagagccugcucaguucugagucggcuucauguugaucacucacaaagauguccaccuguagccagucaccagaggcagggggugaggagugacacugaaguuaccccuuuuauacgcaggaagcuagugaguagcaggcccagcauucaaaggauuuuugcgaaacugccuguccugcaagcucuuuuccuuagccucccugaacuaagaagcaaggcagcaaacaaaaccaugaaguuuggguggaaacuggggggaggggcuuaagagauuugugaguaacacuucacugcuuacuaaacagaucaugacaacuggccuguaggagcuggggaccuuucuauugucaagaggauaaaggaaucuuuuaagaagaaagccaagcucuaacuaagccaaggaaacagccacccaucuuguuccugcgugccuuagcgccuugagaauguuuccuacuucacaagagcuuaugauuucuguguguggggggugggggaucacuuuaauguuaauagcuuuaucuuugcaaagacugcucccaaaauaaaugucucuuccugugcaaaccgguu

SEQ ID NO: 211 - RNA, 18738 nt, Mus musculus
ccuucgcggcgcgcuaggccuccucccagagcuggaccgcuccuggcggccgcccgcagccgucugcauccucagcuucccuccugggucccagugaaggugugggugagacuccucguucgauuuuuuucauauuuauuuuuaaaugucggugacauuggggggaaacgacagaggaaugaaaagagagugagaaagaacgaaaugggaaggauauuuucuguucugaaaauccaauccuuggggccauagcucccaccguuaauuaaaauuacaucuccagagcaucuguguagagaaaggcugcaggucugggcccucgcaguaccgaucugcaacagacaucuggcugucugggcuucagcagcugugugcagagggcuaggaaguggggaaaggcuuagguuagcugaagggaagccauccaggucccagaucccuucuucuucagggagggagucgaaagggaggaggggguggggcaggagagggcacacaguugcaguuauccacagagccuaaauaaugaaugauuaaacaaaaugauuuuaggccacccucaccucauucucagugccccacccagaaaugaaaaaaaaaagcacccuuccauagauuugagaccugguccguuucaucuggguuauauagcagcagauaaagaugaaucguugcaugguucuuguaagauucauuucuagguuuaugguuuuggaaccugccuuuuagcuccuaccuucagcaaggaacuuaucagcucccaguugguuccaaggaacaauuuauuguucacauucuguuuguuuugaauuaauuauuauuauuaauuuuuuuuugagacaaggucucucucucuauagcccuggcuguccuggaacucacuauguagaucagguuggccuggaacuuaagagauucccccugccucugccuacugaaugcugggauuaaaggcaugggauaccaugcccugcccuucuguuuguucauuuaaaaauuaacauuacauaugugugugugugugugugugugugugugugugugugugugagaagacgaauugcaggagucaguucucuucuuguaccguaugggugccaccagggauugaaccccaucaucaagcgcagcagcagcagccuugcccucuuagcucuuuucuguuuaucucuuuccuuaugucggacuaugcuaggucauuggucuuaauccaggacaacagucuuucuaacuuugccgggggugcucuguuuucccuuuuccagucaacaaaugccauuugugucuguuuggggagguggcgguuggagccacuacuuaaaaaauucacagagagaagugaaguuagacacugggucucucgcaccagccagacugcaguucugagagcaccucuaggcccuccaccucccuggccuucucugaccucuuuuuagaagcacuucccucuccagcuuagcugcugauggauuccaaccagcacgcagaaaggaagagcuaaagcucucuggcuguuuuugucugggaaguccaucaagagcucugguagccgucuguuuaugucaguuaugugaucaugaacacauuaaaaaauggcaccacuguaaccucuuuuuaaaaauaauucuuuugugugugugugugugugugugugugugugugugguguauuuguguguguauguguguuccuguugaagccagaggagauugcuggauauccuucuuuagcauugucagcccuauaaucccuugagacagggucucucacugaaccaggagcuugcccccuuuaacuggugggagucacagacauccuccugucuggcuuagccaggguucuggggauuugacuggggucuuaauccuugcacagaaauuaguacccuuuccugcuggaccaucuccacaguccccuaaaaauacauuuaaauagagauguugaagaauuguuucagaaaaauacaguucccagcuaugugauucccaagggcaaagugaucuauguuguuuguucuucugccaugcugaagauccaaccacggagcuugcacucgaguuccuccacagagccgagcuaaaccuccaucucucucaaaugugcagagagagagagagagagagagagagagagagagagagagagagagagagagagagagagaggucacugaacagacugaggcagguacucuuaaugagaacugacuggggaugggaggcaguuaaguccaaugggcaugacaaggugccaucucucagcugcagggauuuugcagcugagcagucaguucuuucccucaauucuguuaaaaccugugguucaggggugugggaucucuccaagggcuccuugguuuaaaauaaagagauauguucucuuugucucggccucccgccgcccggguuuuaagauccuccuagccccugaaaaaucaccacaccuggcaauuucaccuggaaguccuuuauuuucagauuugaguccuggccccugguccaugccucacccuagaccaccaccaugcugcuuuggugacuucuugggccaaauccagcgcuaaucucuauauucugcugcagcugcuuccuuuguccuggcgaagagagcuugcugucacagugauccauccacacccccugugcugucacaggccauuagcaguggcuuccuuucucuucugagaugcucuugcuguucacccagcucccugacccucccccucccccuccccauuuuccucguuagcucccccccaacccccuugcaaaacagcugcuggcuccgauugacagucaacacacagacucacagaaucuguguagcaggaauaccaguaaggcaucuaacucugcucgugccuccaagcaagagcccucacuuaugaggcagcucacuuaugaguguucagucaguauggcacucccugaguucuuguguaccagacauggggaagacagcucaggcaagggggugcuuggguuucccugucuuuguucagucuuccauuguagcauaggagaggaggggguggacggugggagaagaacuuaucacauuagguagggcagaaaccaaauaaaggauccaaucuucagcucuuacgguaaggagcagcguacaaggucuuuauaaacaagcaaccaccccugcuuccaugaacuguuuucuuugcagacagauggugcagaaucagccucaguguuguuuauuuguuuccucuuuacuagggauugaaccaauggccuuaguauguguaugaggcaaaagggccuauguauaagaaguauggacucucccacagaguuguauuuccagcccucuuaauuucuuaccucaagcaagggcucuccuuaguugcccagggugccccugaccacacucuguagucaagcauugaacucgcaauucuccugccuccagaguagcugaguagcacugagggcacggguccauaccaccagccaggacuacugaauucuuucauuuuuucccaccgcaaaagccagugaaugggacagauugcuggggacagggggaacgcagcagaccaagaagauggcagggagcuaccacucuucaagguucgugauagagaaccuacagccuccaaggcugguauaggaaaaggaagaaggaacagguggccagugggcaucgagguaauggcugagcuaggucuucaccaccugcagaugggcguuucuuuccucuucugcuguugcaaccuugaguuaauguguacuuucauucuccaggcugugugcugaaacaugcucuuggugaguuagcuaucuuucugcaaguuaaacauuuaaccuuaggggcucugcaguuaagagcacuuccugaucuccaacaggaccccaguuuggcucauagcaugcauccugggaagcucuuagucaccuguaacucagcccuaucggaucuugcugcccuccuuugguuuccguaagaaccugcaagcaugcaccugugcauccucacacacacauaugcacacacaugacaauaaacucuuugucaaaaauguaaugcuguguguaugugcacaugugaauaugugugcaugugcguggaggcaggaagacaauacagagugucauuguuagaagcccucaaccgugguuuuuuggcauaagggcucucuuuggcccagggcuuagcuagcagacuaaguuggcuagccaggaaccccccaaaucagccugucucuaucuucccaguguugggauuauuacaguauaugugccacuaccccuggcuucccagggcuugcacucauggccucaagcuugugaggcaaucauuuuacugacagaagcuagcucucuaugcuauugcuaaaccuuguuuguuuguuuuugaggcaggguuucacaagguagcccuggcuguucaagaacucagaguauagagcagacagaaaucagacucacagagauccuccugccccuguuucucaagugcugggauuaaaggugugcaucaucaugccugccugccaagaaacuuuagaaacuuuacuugaacuuacugaugcguaaaauuuaccuuccaugucuucucagagcuggcuuuucccaggaacaucggcucuuccaguuagucauuaagacucagaaaggaguuuuggcuggaaaaaguugaccaugagaagcaacacugauagguugcuucagucagaggcgucauuuaccccacccuagugggacacuaacaccauucagcugcauggccuuccgaguuaggaacugcuuuucuuucuuuuuucuuuuccuuuuaaaaauauuuacuuauuuauuuuagguaugugaguacacucuugcuuuuuucggacacaccagaagagggcaucagauuccauuacggaugguugugagccaccaugugguugcugggaauugaacucaggacuccuggaagggcagucagugcucucaaccgcugcaccaucucuccagcccccaauaacugcuuuucaaaagaguauuacucauacucauuaccuaugagugcucugccugcauguguaguggggcccuuccuuccuucaugucugguacccuuggaggucaaaagagaaccuuggauccucugggacuggaaucuaggacaguuguuaagcugccauguaggugacagguaucgaauuuggguccuuuacaagaacagcaagugcucuuaaacgauaaacuaucucuccaucccuccccuaaaucaguaauuuguaaaagcaccacgggaagauggcucauugggcagggugcccucugacaagcccaaggaccuaaauuuaaucuuugggacccacaugguggaaggagagaaccaacccccaaaaaguuguccucugccaccauauguguucuguggcccacaaaugugcccucacugcaauauauguauuaaaaaaauaaacacaaaugaauggaaacagaaacacaaaggaaaaggaaaggaaagaugacugcuucuaacaaugauggagaagguuuauuguagauaaaaggaagaguguagccagagugagcaggacccugagcugauccauguggggagaggugggaagggaaggaaaagggaggagaggggaagaggagagagagagagagagagagagagagagagagagagagagagagagagagagagagagagagagaggugcagcagucaggaggguauaaaaagagugaguaaucagaaugguuggauuauacagggaagagcagcccagccuacugagcuggagaguucaugguaggcggcagguaugccagccaggagggcccuguaaaagguaagaucugaggauugcagggagaaccuaguggucaggucuacucugauauguuaaauaggcacccaaccauuuguccuggguuugaaaucucaugaaaagcaacugaaguuguaggaugugcucaagucuuuacccuaguuacgagaggaccagagagaagcaagcuguauccugacugugcucacugccccuucacagcaacccgccggaggcagggaggucuugcauguugcuguaccacaauuccagucaccuaguacuggccuaagcucaguuccuucccaccuuagaggagacugcaagaaagcuuggugacuuuuggugguaaaaccguaaacacuuugcuuccuuggugguggcaaaccucauaguggucaguugugaucagcagauuuuggccagccccagacaugugaugugugauccuuggaugacagacgcacagauggggggugggguggggugggggugggaagugggaaagacagcaagucagaggcagggugcacuucgccguguaguggcagacugacuuugggaagguagccuuccacacuuguauacuuguagccacggcagaucagcugcaccaagggaaagaggcaaaagaccacuccugccgggugugguggugcacgccuuuaaucccagcacucgggaggcagaggcagguggauuucugaguucgaggccagccucgucuacagagugaguuccaggacagccagggcuauacagagaaacucugucucaaaaaacaaaacagaaacaaaaacaaacaaacaaacaaacaaaaaaaccacuccuaagauuuucagcagcaucggauuggaaacuucuuguccaacagcggcauguagcccauccauguuuuguuuugguuggucauccgccuggccauuuauuugaaaaugggccaaucacccaaauugaaaccagaaauuuccccaugaagcuguauacaacccaugccaaaugggccagucuuuaugaaagggguuggcuggacaguaugcuuggugagagagaaagucaccgcaacuuccugguugaugagacccaagcucuugucuuucuuauccuuacauguccacucuacugucaagguuugcugccauugccuuuauuaacucuuuccagucaaaucucaacccacucaucagucccuugcuacccugcagugcacacagggguagcacaggccucuagguuuccugguuucugcaccgacuuaagucuguaauuuaagcugaauuaucugaaagaguagagggaugugcuggauugguugcgagcagagagguagugugaccagacuguagggaaaccacaagacguugaaguguccaccaagauacagagaggcaguucuacagguugggcauggagguagacuaguaaccaaauacuugcuuacuugggaucuggcugacccuucgaagacacuguaggcuuacucauuuugaggguuugaacuuugaaguauuuuagugaugaauaaguaacuucuauuuaauaaaacaucauuauuggccccgcuuauugcaagcauccacuucuauucauguccugggcugcacugagcuccccaguggauuucuucucuccuuuuucuuuuucuuuuucuuuuuuuuuaagcuuguuauuucauaccuaugguuguuuuuggcuugcgugucugucugcgcacaaucuaucuucccagagcauguggaagccagaggagugugucggauucccugaaacugccguuacagauaguugugagcugccacaagggugcuaggaauugaacccaggucuucuuaaagggcaauuggugcuuuuaacugccgagccaucucuucagaccuccaggggauuucugauugaacuugagccaguaucacuggaauaauccauuguacugagcaguuggguuucagaauuucugggcucccagaagaaucaaaaugacuuaaguuacccaauaucagggaucaugcuauuucaaaaugcuccuuaaacucuguguauaugccaguauacacacagcagagggauuaagauauaaaauggccuugaaguguuguauuccuauuacuuaauacaagacuccccugcccacauaagucuaaacaaaaagaaucuaugguccuauauuuaauucuuucugugucauucuuuugucuucugcugucacuaaggggaaugcuuugaucugaauggacuauggaaggaucauguuccaacuccaaaaagagaaguagagggacagacaguaauacugcauacucacauccauuuguccagacaguaaucacaccuagcugcaagggaugcuacgaaaugugaucuccucccaugcccccaagauaggguuucucuguauagcccuggcuguucuggaacucacucuguagaccaggcuggccuuaaacucagagacucaccugccucugcuuccugagugcugggauuaaagguguaugccacugcugucuggugggaaaggucaucuuuaauuaauuaauuaauuaauuaauuuuaauuacguguauauccaugcaucucucugugaguauaugcacaugagcgucagugcuggaggaggucagagguuucagauuccuggaacuggaauaaucagcagcuggagcuauccaauguggguacugaggacuaaacuuagguccucugcaagaacuguaugugcuguuaaccccagagccaucuuucagccuaagauuguuaucuuuaccagagacaucaugugaccaccugaaaccugcauuauuagaaaggagaaauaggacaaguucacaacggccuguaauuacagcucuggagggacgagacaccucuggccuuugcagguaccugugcucagguguguacuacuccuuccuaauacaaacaauuaaaaauaauagaagcaaacauaauagaagcagacaauagauauaggaggaaagccuaccaagugugaaauagcuagcacacaaaagagcacauugauaucuuucuuauauuucucuuuagucucgaucccaaaauuaggcuagugauugacuacugccuuugaaagcguuuucuuaaacaucugcucuguugagccacccugugacuccaccucucacagauuuuauaguaucauauagaggacagacaacaaacagauaaaagaacauuuguuaauaauuaaauacuuaauuacaagugccuauaaguuuuacccaggaaaaugguuuuggagaggaagaaucgugaauggcaaggggcccauuuuugguugugggaagagaaagccugggagaggggacauuugaacuuaggacuuaagagauggucaugugauggaguaggauagaacggcauguuauucagcacagacagcauuuaaauaugucaaggaggaaaguaugugguacucuugagaauccagucagccagaguggcuauagacagugguuguaagggagaugguacagcacgggagagugauauuagggguggggggcuauguucuacuguccucggacuacguggaaggucugcauuucauuuuauagugguggguuuuaggcaaaaaaaaaaaaaaaacaaaaacacauuuuuauucagccuuuucaaagaucuuuguuucuuuguaaauacaaagucucacuaaauaacccaggcuggccucaaacucaugauuccccugccucagccuccugaacucuagaauugcagaugugugcuaccaugccuggcuccaaaaaucuuuuaaugaugagcugaaggacugacuaagguaucaagauuagaagccaauggcuuaagccauuuuuuccuaaucaugaguccuggaguauaaauguguucuccaauaucccagaguccacuuggagguuaaugcucugcagggcaaugcuggcuaucagacuuugaccagggagggcaggcagaagauagucaaagccugagccagaaaggacaccaacguuguguuuuuucucuugauccuauuaauuaaaguuuggggaacuuggcagguuuguuuuacucugucuuaucgaauccaaaaaggaggagagagaaccuguuucucacaccaaacgccaaagcauuuuauguguacaaaagucagaaagagaauuuaacugucugcuuuuuagcaccucuuuacauuauucaaaguaguuauucauuauucaaaaugauuuauucaucaacuauuucuccucugcccuaagaagucaacaggugaauacugacucucuggcacauggcccacccacuaguggcaguuccugaccucuacaaguuuacagucugccuguagggaugaaggagagcucacagugccacucccuacccacgacaugaagugcuguauaacuaaguacuaagaauauagaacagaaggcaauaccaggguuaaaggugcaugcccaugccugguuuuacaugggugcugggauuugaacucaguuccccuggcuugcaaagcaagagcucuuacccacuaaaccaucucuccagccccuggcaugcacuuuuauuguuguuguuguuguuacuuguaaagacauuuuguuuggcgcuggggaguucucacagaaccuguuacaccccgucccccuucaguucauacaaacugacuggcagaaaaguguuuaccuggaaagaaaacacagaugcuguccaggaggcagagcugagggcaacgggauucuuuguuguuauuguuguugcuguuguuguuuuuguuguuguuuuguuuuucaagacaagaucuuacuauguaagucuguuuguccuggaccucacaauguuuacaaggcuggccuugaacuaagagaucugcuugacucugcuucccgagugcugggauuaaagaaguauaucacccugcccagcugguuugaacuagacucuuaaagaaugauggagaccaagccuggagaaauccuccauccaguaugggaauuucccacccauggucucacuguauccaaucacagugucacuguaacuccuucauacuccuauacaagacuugagccaaguaaagggguaaauuggaacauaaagugaacuggcugguuuugugugucgguuugacgaaagcuggaguuaucacagagaaaggagcuucaguugaggaaaugccuccaugagauccagcuguggggcauuuucucaauuagugaucaaggggaagggcccuuaugagugggaccaucucugggcugguagucuuggguucuauaagagagcaggcugagcaagccaggagaagcaagccagugagaaacaccccuccauggccucugcaucagcuccugcuuccugaccugcuugaguucuaauccugauuuucuuuagugaugaacagcaguguggaaauguaagcugaauaaacccuuuccuccccaacuugcuucuuggucaugauguuuugugcaggaauagaaacccugacuaagacacaaaguguccucuauuuuccucaggguugaccuugaauaaacugauuaacuuccacuaauuucuuucuacgcuggauuuuaggacagcagugaguggacugaccuuagauauggcaacaccaggaguccaccugugguugaauaggcucugccuguuccucugcagaaggggcaaugcgcccacgaccaguaggaagugugucgggaacaggcugccugauugucaauaagggcugaugccacuuuugacagaacagucugucagacagugggugugagucugagauuacucuaaugucuaugagagagccucccacagcaagucugaggcuguaguuggggaaaacgcuaggcugcuucugagauccaggauaaagaucuugggcuauuuuugugucucugacguagucaugcucgguucggauuacauauuacauugccuugucuggcaccauguuccguggaauuauuuauguuugauuuuuaauauguuucuuuuuugaauuucauauauauguauguguauauauauauauauauauauaauguauuuugauuauacccaagccucauucuguccccuaacuccucccagauacacuccuuaccccacauacuuuuaacaaaauaaauuuuaaacuucccauaaagacaggguuuuugucuuuguucucuucccugugaggagcugggugcugcugauguucacucuguagcaacagcgucacaggauggcucaagcuaaaaaauggauugcagggcuggagagauggcucagcguguaagagcacugacugcucuuccgaaguccugaguucaaaucccagcaaccacaugguggcucacaaccaucuguaaugagaucugacacccucuucuggugcgucugaagucagcuacaguguacuuauguauaauaauaaauaaaucucuggggcuggagcaagcagagacugagugaacgggguugacuggagcgagcagagguccuaaaaauucaauucccaacaaccacaugaaggcucacaccaucuguacucacauacauaaaaucaaccaaucaaucaaucaaucaaucagucuuuaaaaaaaauggauugcagccuccugagaggucagcugggcucaucugucuugauuugcuugauguggcuugccuuaacaccgugaaccccagauaaagucuccugauuuucuccuauaacagcaguucucaacauguagaugauguugggggggggggucaaacgacccuuucacaggggccucauaacaguuauccugcaugccagauauuuguaucacaauucauaacaguagcaaaauuacauuuaugagauaguaaugcaaauaauuuuaugguggggagucaccacaacaugaggaacuguauaaaagguuauaacauggggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauauaauaauaaauaaaaauuaaaaaaaaagguuauaacauuagcaagguugagagccacuguccuagaaaaucaauauuagcccaagauuaguuuguaaauguaaguagugugccuacauuuucucuaaaagaugcuccaccucuucuuucuggcuuagcugcagaacagaaggauaaucuguagaguugaaagcgaaagcaaccuggauuccuggaacuucggaagcagguucuuccauagccaugaagguuucauuacccccauuugggcauuguuggaauguauucuugguagucagaaguccaaaguacuggccccagccaugucagucuccgcauaugaugagaggaagacuggauuuaacccuucccugccuguggaccuccucacuuucucaaacucuguacccuuuaacuggacucaugagguuuucguaagacuacacguuuauuccgucucuguuaccgaaagaggauuucuauggaccccucccuccuacacugcuuucccacuuuaucuccagcccgcccuccgugauuccagcugaugcuuuggcuuucugucuuucaggucgcaggcauccucaggggcaugucugcauagcccuuucccgauagaaaaaaaaccugugugauguauggcgcuugaguuugcacaaacaagucagacuccucuguaaaguaagcucagcuagcucucaggccuaggauggaagagucggcaccgguggaaagucagggucagcucccaagcccccaccacggcucacugaggagggcaguggcugcuguccuggcccuggauggggaauccacauugggccgcaggaagaagaggaggaaagacucccgcccggaauccaucaucaucuaccggucagauaaugagaagacggaugaggagccugaagaaucugaagguggagaucggccuaaagaggaagagggggaggacuuccuggacuauccuggggaugauggugaguuuuucaggagcacguuguucaaaaucauaggaagaaaacgaaagcagcauccacccuccagcuggugggcaccugcuuucuggccuuuucuuucugacgaugcauaucuugaaggguugcugucuucacucauuaaacuaacaacaguuacuuagagccugcagugcuauaauuuagaugggacaggaucucugcccuuucacaacugcuguguaagagaagugguuuuauaggcuaauuacauuaacagauauaaagaacaacaguuguuaccuuuccuaauaauuaugaacaugcagccagguauggcagcuuauacuuacaaucccagcacuugggaagcugaggcaagagaaucaugaguuggaugccaucuuuggcuauacagugagacuaugucucaacaaaagaaaagaaaagaaaagaaaacaaaacaaaacaaaacaaaagguaaaaccaaaaaagaaagaaggaaaggaaggaaggaaggaaggaaggaaggaaggaaggagaaaccaggagauugguguguuuuuuuuguuuuuuuuguuuuuuuuuuuuuuuuuuucaagauaggguuucucuguguagcccuggcuguccuggaacucacucuguagaccaggcuggccucgaacucagaaauccgccugccucugccucucaagugcugggauuaaaggcgugcaccaccacacccagcucgggagacuguuuugaguuuugaaaucagugagauguacuauucccucacauuugggaaugucaagauuugugugcaauaugauagcaugauuauauuaaguauuaaguaugauuauguggaacuggauaauacucuccuaccccucaagcacaguuagagucacaccaaccacacugucggggaccggucaauauuaugaagauacacaguguacauacugugugucacagaaauucuuaggaucuccaccaugaauuuauuaucuguguccuccacguuucagaauguuugcugcuacuagggagccugugggucaucuguguuaagaacuaucgugcacuacuagauagucccauucauguagaaggauagaugcuaggacucccgcucagaguaggcgacacgagcagucucucugugcucaucacugagcuuuuagucugggaagacagacagugaacaagaugacuucaccugauaauaaucauuccaaagacaacgaaaccuacagcaguggggaggguggcagggagggacucugugccacagaagaccucuccaaagauguggcauuugaacucauccaaggaacacgaagaaaccagcuaagaaagguguggagcagagggcgguuugugugucuuguuuugaaaaaagcaagugucuugagguaagaacaacacuggccuauugguggggaggggugcuucuauuagcguguggauagaaccaagggaggaggugaaaggucagcaaggaagccaggcuagauccuggugcaucuugcaagggcacaguggagggcugggaacuguuggagccaguggaagccaagggggacugucaagcaggacagacauugucuuauuuuuuuuaauuauuugaauuaaacacacacacacacacacacacacacacacacacacacacgugcgugccuguguguuuuaguuagggcuuccauggcugugaagacaccacaaccaaggcaacucuauaaaggacaauauuuaauugggacuggcuuacaguucagagguucagucuguauugucaaggcaggaagcauggcaucauccuggcagacauagugcaagaggagccaaggguucaacaucuugaucugaagccagccaagaggagacugacuucugcaggcaaucaggaggauacuggaauuccauaguggguagagcuuaagccuaggagaccucaaagcccaccccacagugacacaccuacuccacaaggcuacacuuccuaauagugccauccccugugugccaagcaggagucuauggggccaaaccuauucaaaccaucacaauguguguguguguguguguguguguguguguguguguaauuaguggauauuuauagcuuagauuuaacagcuagggugucuauaaacaugagacaccauguuccccauuucagggaaacccagaacuaggcauuagaagggaggggauguauacauacauacacacauuuuaugcacaggucaauacccauaaauaaugccuuuauaacaguaucgugauaagguggcgaagagguuccuugucuaugacagagacugugucaaggcugugguccagaaaaaaauguagagacaauaggaaggacauguuaaucuugcucacaguuuucuuggggcccacacuguggagccagcaaucucugugggaguaauagcagcagagauugccuuccauggccucaggauggcacuaagaugagcuguggauuccucaguucuugaugcucaucuucucugugugcugcagguguguggaacaugccucuggacagccgcuaugucacacuaaccgggaccaucacacgagggaagaagaagggucagaugguggauauccaugucacucugacagagaaggagcugcaggagcugaccaaacccaaggagcuguccagggaagcagcccccgagggaaggagggccugccaggucggggcggaccaggggccacacgugguccucuggacacuggucugccugccuguggucuuugugcucucuuucguugugucuuucuauuauggcaccaucaccugguacaacaucuuucugguguacaaugaagagaggaccuucuggcauaagaucuccugcuguccgugccucauucucuucuacccagugcucaucaugaccauggccucuucccuggggcucuaugccgccguggcucagcucucaugguccugggcagcgugguggcgagcugccugugacauggagaaaggcuucugugguuggcucugcagcaagcugggucuggaggacuguucucccuacagcauuguggaacugcuggagucugauaauaucucgggcaaucucuccaacaaggaccccauccaggagguagaaaccucuacugucuagaccucuagugacuuccuuccuagguccuaguugucuauagucauucaauggaaucuaguaguucuuuccuuaaacuaucuaaugcccucuacauuccugggacagccuagcccacacuggcguaacucaucaucuucauuauuccaagaugacggaaaauagaaaagcgacuugugccaaagccgugcaucugaaauacaaaugcgucuugacucuuugcccuauaaugacuguuuaugugcuacaugaagauacaucauaaauuccuucaggggccugaagauguuauuggugccuaugacccaggggagugugugccuaaaugugacagaaaggauaaagaggcucaggggugaccagauccgccaagauaauagauggggauggagugacacauuuagggaguuaggcuauuaaagacugugcaucacuguauuuagauagaacugcacauaacuaaagccacaaauauuagugagccaaacaagagagaaauauacuuccuuuuuaugcagaugucaggaggcagaucaucccaagaccuaugaaguuuucugggguucacuggauggcagaauguggcccuuggugcuccucaguuuuuaaauauugacuacaacucuuaacugucauagcaacagagauggaaaggagagcacacucagccuauuuaaggaggcuuuaaaagccuccccccucaauauuuauuaucucucauuggccauacuauagucacaugaccccacaaucaaaggaugcugggaaauguagucuuucaucugggcaauuauauucuuagaugaauacugggguuaugugaauuugagaaaagggggauaguggcuauuggguagucaaguacaaaucgauaucuuagaacagguauuuagauacauccagaauuccaaauuacaaaugcagcuuuauuuguuuauuuauauaauuauuuuggcccuagucuuagauggagaguuuauacauagaucugaguuacauauacuaugcauaugccuuagacaguagcaucucguguacuuggcaacuuaaccuuuugucaagugguuucaggguucuuuggaaagacccauuagauaggagcauauggucacacagccacagcacaauucuuccuggaaaggaaggggaacagggauuaacaguauuuaaucuauaaagauggagaagagagagagauugagagagagagaguaaaucuuccaaacgcuaacccagcagggaucaguagcucaaaauucaaaccacaguuugccugugguuucaccaaaccuaggagccuuauucauuugcucagaccuuucuagcaugaagcuucucugacaggguuaggagugauguaacagauuaauccagaugaaaagauucuggacuggagaaauaacagcuucauuuuuaagaguguccugauuucaaaaugcugagucccaagaggucaguggguuugggguuuggguucauaaaaggagcgauauuauuauuauuauuaucauuauuauuaucauuauuauuauuuuugaugugugugucucagaaagaagugcucugaagcacucaacaaaccagagggguugaucaagcucccccaaaaccagccagggacauuuauuuaauguauggugcugaacuccacuuucagagaauuaaaaaaaaaauccuguuauuaguuugaucaaaaggaaaagaaaauguguccaguauuuuugaggauagcuguggugcuuccuggugcauuuccagagauaugaauaauauaaaugaaaauaaagauaauaaacucugau

SEQ ID NO: 212 - RNA, 87536 nt, Mus musculus
caugcucagagcccauggcuuccccgccuugcacgcgggacgucuggaucuguggguugcccggaacugaguugcgacacucuagguuuccgcccggaaaaaguaaucaaaucaccugaggaccagcauggcgugguccgguaauaagguaccgagagcagggccuuuugccuuuccuaagccggggaucucuagaggguggaagcugugggaaucgcagcugagucagcacugaaggauggaugcucaaaacgaaagacuugggguucggaguucugcauuugagucuugugcaccuucacgcuuccgaaauccucccuccugcuucuccagccucucacccuucccuccucccucguugcuucaguuuacuuucuauccacgccaccugcuaacacagacguccuuuauugcuuccgaaccuggguucuaaaaaucuuuguaaguuaucgaggauagauccccuacaugccaggcucguaaaacuucagagggguuuugugauucugugaaugaaauaacucaagguguaauauuacguaauauuaugaccuucauaauaauuuaaaaaucucgaauuuauugaaagcuuacugugugaggcacaacuaagcccuuuauuccuauuuaauuaaaucuucacaccaaaccgugagacgaccauuauuacccuuagcuugucaguaggagaaccaagcaagacaugaagaacugaagugauuagaacguggucacccuuuccaugagugguaacaugugaaugggaauucauucggagcucugaaagaaaagcaaaacagaaugcucaauuucuaagaaucuaugaucuuagaauccuagauuaauaauggaaauuacuguaaacuuuagagagguuguuuuugaucacuagagagagaugcaauggcaaggauccauucauucguuuaauacaaacaagauagggguucaauaacggagcucuguuuuccuccacccccauuugggaauuugaugaaauuaugaacccauaaugauguugcucgcuuccuuuguuccucugccuucaguugcugagaacuuuguagcucccgugaaggacuuacuguggcagauguacuugauaaaauucuagcagguuguauugcuucagugugguaaugaagagcugcaguacccucccaguuugucuucccugguuuucuuacugcuuccaaagacuuuaaauuaucauaaaccauucuuccagaccagaauuuacacugucaaacucuuugaugccuuacucugaaucucuaauucuugacaaaagacucccagucuuuuaguguuugcuacuuuaaaaguagauuuguggccgccuauuaaaggaacacagccagcauauuuugugaugccuacauuuaaaaaaaaaaaagauuuuuaugcugaaggaaucacugugggauguaauuugaauuccucucaaagguauucuguaguuuauuaauguucaucccaagauagguuguuguuguuucugaaaccuguuaaauuucagagugucaugugauuccauucuuuaugaacuaagggaaacuaguauuuccuuugaguguugcaaaaacgucaaaauugggggcucaucccccacuauaggagcugguccaaguuuuccaaacaccucuagagucagaugaugaccgucuuaacuggucacuuuucagucuuugucgccuaagaugaugcccagaacagcucacauucugucuggucagcacaaaagcacggaugagacugguaggaucaggacuguuaauucugcaaacagcuuuagaccucaucaagcccaacaucuuacugccugacugaacuaacagugagguuaagugacauugccuaggggucagagcuaauuagaggagauaggacuagacccaggucucuggauuacuaaccuagguuuuugguuauuuuuuccccaccaaaagacccuucauuuucuuucuugaauacauuauaguguuuuaacaacauaaaauguuugugaggauagacuguuaaagccguaucaucuuggugacucaaucuauaguuuacuuugaaauuaugagcucaggucuuuugugguuucuguuuaauuaaauuuugugugcaaaaugcauagagcuucacauaugucugguuuugcuucugauuuguuuuauuuucuuagucucugugauaguauuaaucauuaaguugacaaaccuuagaaucgugggccuuagaaucagauaggccuuugggccugccugugggggauugucuugauuaugguaauugaugagcaaagacccaucucaacugugggugugcccguucccuccucaaaggacucaggauuuuauaaagugggagagauaagcugagcauuggcaugugugcguucauugugcucuggauguaacaugaccagcuguggcuggauguaacaugaccagcuguggcuggauguaacaugaccagcuguggcuggauguaacaugaccagcaguggcuggauguaucaugaccagcuguggcuggauguaacaugaucagcugugacuggauguaacaugaccagcuguggcuggauauaccgugaccagcugccucaagugccugcugacuuguuauggcucccucacuaugaugagcuauaacaugaccuaugaccuaaaauaaaggcuuuaucccuuaaguuaccuuccucaggguauuuuaccacaaccauaggaaaagaaacccagagaguccacaauauaugauugcugauuaauguccuggugcuguugcuuaugacuguaacuucaccagucacaugauugaccccucugucuauguggcuuuuaggaaauaguagagccauucacaggcucuccagaguggaacuuuacguguuuuugaaacucaacaccgucuuaaacauguucucucccuuuauccuuuuuacguagcaggacagggacccacuucagaaacuuugcuaauagcgucuuuuuucuuguguacuuuuggggccuuuguuucuaggcagcuguugugcuguguguggauguggggguugccauggguaacuccuuuccuggugaagaaucuccaauugaacaagcaaagaaagugaugacuauguuuguccaacgacagguaaguuucagauuaaccuugagcuugugacacacacuuugaacacucacugccuuugucuccuaacauaagacgccagccuccacuguauuucuagccuguguuucucaagagucuguggggcguuucuuacauguacccaagccugcuuaccucuggagcccuauauccuuugcuuuuccugaucaggccucuucucuagauacaauguugcuuagcggaaaggaaaggcaguauaaaauguuuaauaaaagucucuagagcugacaaguugcaucugaauccuugcuuuaccugucauuuacuaaccccaagaucucgggcaagcccuuaaauuuguuugugcccaguccaguuauuuuuuuuuucagugcaucacaaauauuaauaucuuaauugacuuuuuuaaaaagucauagcugggacuggcaagauggcucagcgguucagagcacugacuuaucuucugaagguccugaguucaaaucccagcaaucacaugguggcucacaaccaucuguaaugaaaucugacgcccucuucugaugugucugaagacagcuauaguguacuuacauauaacaauaaauaaaucuuaaaaaaaaaaaaagucauagcuggaugguggcccaggccuuuaaucccagcacucgggaggcagaggcagguggauuucugaguuccaggccagccuggucuacagagcaaguuccaggacagccaggacuauacagagaaacccugugucaaagaaucaagagaaaaggggguggggggagagucacuguucauggcugauggguuucauggagaggcccugccugugucagugucauagcccagcuuuagaaaucucagaaugccuuuuuguuguuuuguguuugucaauaagucauuaaggccaggucacauuuaauuauggagcaggaauuagaaucucuucuuuuauuaaaaaguagccugaaaaugcaaagggauggauguuggcuaucuugaagacacguaacauaaugcuucaaugcccugugugcaaaguaagaaaaauaauuuucccuaucagacaguguugcuuucaggaauaaagcaguucuguaaucugggcguggugauguaugcugcuggccucagcccucagaaggcuggggcauuugaggucagcaugggcuacacagcaaguuuuuagccaaccugggcuacaggaaaagacccugcuucaaaaacagcugcccugguuuauaguuucuguuucugguauaacaacaacaacaaaaaaaaccuaaugaaaaauagcuuagaggagaaaggguuuauuuuacuucacgguccagguucaagcccgucuggggaagugaaggaggcagggacugaacugccagucacagcuaagucaggagcagagagagaacaaggcaugcacgcuuacugugcugagaugaaagguaagaccuacagauagugacaaaucugcuuaggugcaggagagacugcucagagguuaagagcacuggccgcccuuccagagggugggcucaauuccuagcacccacauggugguucacaaccaucugcaucucuacuucccagggauccauauucuuggggcaccaaccacaaacaugaacagaugcacacauaggcaaaacacccaccuacauauaauaauaaaauaauauuuaaaaacuagaaaaagugugcuuagggcauaacuaucauuguuaguagucccauguuuuuuuaaucuaguaucugguggcccuggggaccugcuuaagggggguaauggucuuccugcucccugaaaguuagguguucuccaaggugauuccaauagucuucagccucuggcuauuccuuccuagguauuuucggagagcaaagaugagauugcguuaguccucuauggcacagauggcacugauaaugcccuugcuggcaaggaccaguaucagaacaucacagugugcagacaccugaugcuaccagauuuugauuugcuggaagacaucggaaacaaaauccagccaaguucccagcaagccgacuguauccuuucugugccuaaaacgacaagauuuccccauuuaucuggggagucauaauccaguuuggugaggcucucccggagucccagaugugacugacuaucugggcauauuuuccuccgaggaaaggguguuuguguaauuaauauggaguuaauuaguacccagcuccagggcuucuagugucuugcucuuucuuugcgcugugauauugagagguugggaaguagaggaaguagaggaaggggggaguccgagggaguauaugcacauacugaccaggggauggguuugcauuggggcuggcuugcaguucagagguucaguccuuuaucauggcagugugcagacuggagaguagcugagaguucuacaucucaauccacaggcggcagugagagagagagagagagagagagagagagagagagagagagagagagagagagagagagacagauaccccagugacacaugagagagagagagagagagagagagagagagagagagagagagagagaaagagcacgacagauaccccagugacacauuuccuccaacaaggucacugcugcuccaacauggucacaccuaauccuuucaaauagugccacucccuacgagccucaggggccauuuucauucaaaccaccacaaaugacgucuauucagauuccugugcuaaccgcuccgcucuucuggauggaggauguuuuuaugccaaaaaauaagguugcuauugaagcagagauuucucaucucuuccauggaggccugcuccaauuugauucucuguuggugugauaagauacggaccauaaucaaacugggaggaaaggguucauuuuagcuuccuuaugggaggaagcccauacaagagcucagacaggagccuaaagcacaaacaaauggaggagugcugcuuacuggcucccucaccuccacccccauguucagcuaucuuucucaaguagcccacgcccaccgccuagagauggcaccacccacuguagucugggcucuucuacaccgcuuaguuauuaagaaaaugccugcagacaugccaacaggucaaucuaauggagacaauucuugaguugagguucagccuccuaagugugucaaguucacaaucaagauuagccaugaaaauaaaacccugucucaacacacacacacagagaauaggguucuaaucuuuaguauuuuucuaaaaaauuaguaguaccauucuugaccacuaggaggugcugcuguguuugguguugcuugcuggcuugcauuguauuuaagaguggauugcugacgaaauauggguucuaagaauuguuaaaugacaucuuagaguuuuuguuaaauggauauguguuuuuuccuccacacuauuuguuaggauguauauaaagcacuuaugaaauagagucugggacacauggggcaagcccuuuuaaguuguccagugucugcuguugucaguaguaugggcuuugcugggagaaacugugauguucaugguuaagaagggaguguugguguucuuucaauccuuaacuagcugaguccuggacgcccugauugugugcauggauuugauucagcgugaaaccaugugagugucucaccugaagacaggaguggggcuuucugggaaaaacagggguccauguguucagaggaugcgugguuuguuguuaauuaaguagcgcguuagucuggcagcgccuuucuagcuuaugaaaguuuaaaacaaaggacuaccuuuggugggaguuucucuggaugaaauaaguauuuggcauacuuugguuuucuuguuaacuagcuuaaacuaguuaaccccaaaucuuuaaaaaguaccaagugguaugauccauaaguaguuggugugcuguacacaguaacugucaacuuccuaauccauuugcuuaauuacugagucuuaaaaguguaugcccuugaacacauaggguugcauuguuugaaaagacauuuugugauaauauccugggccugagucuuuuauuauuguuucucagucuguauccuuugcaaaauccugcaacuaaucccagguguaguucccagcaagauguuugggaagugcagcugccaggcugaugucuucuuacaucuggagucccuuguuuaugcucugaagcugugcaggugggaaggcauugcuuucagucacagugcuagaaaccagggcugggcacacaagaauauuacauuuuguaauguugagcccagugugaacuauaugaagcugauuuuguaucuaauaggaacucaacugagcucaacugagcucaaauguaacugugguuacauuugagaauguaaccacacuuaauuauaucagauucacgccaucucucugaucagugaucauguauauuucagcucuuagaaaaaaauuuaggagacuacuuccuuuaaaaucucucucuuuuuuuuuuaauguuuuuuguguuuugugucugugcgugcacaugcauacacgcauguguguccacuuaugugugcaugcuacagcauauguuggaggccagaggacaacuucauggaguuaguuuucuuugugugcccugggugaguuuuggugauugcaggccacaggcuugcacggcaguugucucuguggugagccaucucccuaggccucaaagaaugaccuuuuuuuuuuuuauuuugagacaggguuucucuguguagccuuggcuguccuggaacucacucuguagaccaggcuggccucgaacucagaaauccgccugccucugccucccgagugcugggguuaaaggcgugugccaccacgcccggcagagaaugacuucuuaauguguucauucugucuuuuagagggaagaaguuugggaagaagcauauugaaguguucacugaccucagcagcccguucagccaggaccaacuggacguuauaauuuguaacuugaagaagucuggcaucucucugcaguucuuguaagauccugagaguaaagcauaggggaucucggcaucccucaugcagggggcagggccuacauagauggcucccagggggcuucugucucagcugaacagggggagcugcuaggugggauuggccaccuugcauguaucggccauuccuguguucauggaacuguucugagcugagguaagaaagagaaggaaaauagugauauugggcucaauagcagaucacugcuuuuagaaccaaagaaucaaggaauuuaaaaaacaaacaaucagacuccaucuuuugaggauguuuaguuugucuccugucugcauagauggcaucaacacccugauaguuccuuuuuuguguggcucagagagugauaucuacaaacagcaguagauugaggguagacagaacuguuauguugggaaucaucuuauagcacauagaguauguauguuuaacccuuucucaggaugcagacacauaauaaaauguaauauguauauuauaaaauuuugggagaaaacguguauuuuauaauguaaaaggaagagggucccuccucuccuaguaacuugaauuucuccucuagccuuuacuuucugugucuuacauccccacuaaaacuuacugucauacuaauccuuccugcugcauuuaaaacccauuuuuucucguccuauuuuuggccgaagcagagugaugauacaggguguugaauuauuaaucugaucagggacguucacuuuucaaauugagaacugcacuaagaagccuucaguucagagugguaagccugcggccucuuagacugccugccaugggggaguaugaaccccucuagcaugcacgugugucccccuuaagacugcugagggacaccuucccaggggacuauagagaagacuucagaagagcccaccacaucggcacucguuaagaugguacuucagagaaauuaagugcuuuuuaaguggcacuugucaccgagcugggguuucucagugcugcggaaggccagcuuagcucauucuccugcccguagucucaggaugccuccuauuugaagcauauuguacugcacuuucuccugacgucagcugcuucuaaucucuuuaucuuucuaugugcguccacaguagugugcucaggaggaagguagucugucuucugcuugcuugcaugcacuggaugcauuugcccucuugcauuuguuuucuuucuguaggauaagcugccacuguucagugcauuccauguauugccaguugccuuaguuccauuuaaaacauacuuguuccuucggcauaguuuuuagcuuccucuacucuggucagaugcagcagagaacgagcuguucuaggcuaaucgugugcaggccauguggaucugucaugcuaaguaaacggggaaaaggcuuacacagaaagccuuauuucaaguguagcaagcagaaugauugauugauggccuguaaaguauccacccacacaggggugaccuacagagugugggggaaaggguuacccgauucggccgccuguguuuggaagaauggagugaagucagggaugccggagcacaagagcuucacccuguuggucaggugacugaguggcucugggacaguuguuucagcucaguggcuuuaguuccuuuucagaaaagagaagcagaaaucuccacugacuuaguauaugagaacccaugcuauuauuuagaugaaaacauuucuacaguaccauaucauaauauuaucuuaacuauauuugggugcuuuucaauuugcauauguauugauuaauauguuuuuaaauuaauuuuuauuuucuacguguggguguuuuguucacauguauaucuguguaccacauaugugccuggugccuguggagaccagaaaaggguauuggguccccuggaaguaaguuacaugugguuguaagcugccauauaagugcugggaaccaaaccuggguccucugugagauuaacaaguucucuuaauugcugagccagcuccccggccucugauuaucuaguauaauuugugauuuguaaucucaaccuagauuuagccucauuucaaacaaauaacuagagagaaacauaacagaauuagguuuuauuucugucugggaauauucugauuucuggauaagauuuuaaugucacaauagcauuugaauuuuaaguauuuuauguuucacaaccucuuauuucuuauuauggcauucaggguccugugcaugcuaggcagucagucacucugucacugagcuacauucucagcuucauccucgaauccuugagggguccuagguggcuucuccagcacucuguuugcuauguggugccuggccuugcucuaggaagcauuucuucugaccuuuaaccucugguauuagugacccucagugagcucuucuagaucucucccucagacuguugauuccugagauuuguguaaguuugaagucagaggguggaacacuugaguccuucagagguauauugugggacacacugugacacacuaccguguccacacgagauguuuucuaugcuuuguuuuguuuguuugugugguuuguauuuaauuuuuuuagggggguuuacaagggcggaggacggguaugaagggccaggagaugagugggacuguggugggugaggugaaacucacagagucaauagacagacaaagcaaagcacacggaguccuucuuagguaguagaguugggcagcaugagcuugccucgguccauuccaguugcugugacaguacaggccaggggauuuacagacagacaguuuccccucacaggucuaggggaagggaagacugagcucacagugccgaugcaaaguuuguauuuggugcaggggaugucugucuuccaggugaugcugagacaucacaugacagaaaggacggaaaaggcagaagggcacucagucgccugcucagccaucaaaucaaccugcugccccauccccguccaccccugccccccuucacuuucaauauaggaaauuugggguacagagcaacagaacauaguagagcaguguggaagaugccauucugagagggcagccagaacaaggcaguguggaggugcagugaagugaaccauggagauggagagaaaggauccaggacccggcuggaacuguucguuuuccgcacagagagccuuuuaguuauuugguugccggcagccagcuuucccuuucuaucaaaucaaaggaguguuggcuauuuaaagcuggaguaauacucggguagauacacugcauuugacagauaaaauuauggagcugaguaagguugacugauaggcaggcaucuuccccauugguaguaacagucacaggguuggaauccaggcuuggaaucagagcuuaucuucuuucucaauaguuugccuuuuccaaucgacaagaauggcgagccuggcgagagaggggaccuggacucuggcuuggaccaccucaaacccuccuucccucaaaaaggacuuacugagcagcaaaaggaaggcauccgcauggugacaagggugaugcuguccuuagaaggcgaagacgggcuggaugaaauuuauuccuucagguaggaaauggggacaccaguggcgacucuccgucuucccacgugaucucucucauccgauggcuucuuaauuccuuaaugcugucuuucucugagcuguucuugacuuugcagccauucuuuaguaaguguucugacuuuuauuaaagaagucuccagcucacucuuaaaucuccuuuucuuaguugguaugguuugcccaggguucucguuuauucccagaugugcgacugacaugugggagcgcauagaggccucggggacaguggugggcuucaucuucauccaggcuuggggcucauguguuggaccgcacacuuacacauuuacuaaacccauuuagaaaaugcuuaaguccuuuuauuaguauauauugguuauagguaauuguucuuguuaugucuuuucuaaacaauucuuuuuuuuuuuaagguuuauuuauuucauguauucauauacaugaaauauacuguagcugucuucagacacacuagaagagggcauuggaucccauuacagaugguugugagccaccaugugguugcugggaauugaacucaggaccuuaggaagagcaggcagugcucuuaaccgcugagccgucucuccagccucuugcuaugucuuuucauucacgugaauuaugucuuuugaucacacucacuccacuccugcccuuucauuccuaccgaucccuccuuuucucugcauuuccuuucuacuuucaugucuguuuuugguuuuggugaccugauggguuuauccaaugagggcuguuuacuggagcaugggcgagggauuacuuauagacaauaacuggcuuaccuguagucaugcuauugaagaaaauaucucucuucuuauccuaccaaaagaaaaaaaccuauccuccuuucuuauaaaguguuaacugccuauagaacuugaagcaagggcagaaccugugagccccuccacaccaugauggaguguugaaaggcccagucuuggaauacaacauucugcaacauuccaccacguccuccagguuuuacauuuuuuuaugacccaucuucugcaguguucccugagccuuguaggugauaauauagacguuccacuuagggcugaacauucaacaagcacuuacucuuagcacuuugaccaccuauaguccuaccuguaguaaucaccaccuacugcaaaaagauucucugauauagcaccacaaaucuaugugcagaaacauaaauguuaagaagauaauuugaugggccuggagggaucgcucagugguuaagggugcuuccugcucuuccagggguccugaguauguccucaugugcauauaccuaaacagacacagucacagauacacaguuuuuaauaaagaauuugaggaggauauuaugucaauuuagcaaaauaaugguagcuucuucacuagggccugugaccuuuguagccaugggcuuuugacuagguuuacaauacuaaauguggucuuuuuucugugucaugaacccuaaauucaagcauggagggguugguugccagucaugcuacgguuacaucugugugccugucagguugguaucacauauacaguguccacaucguggacugaguaagaccuuugaugacaguuugcgcagcagucugcaaaacgucuuccagcauuggaaaagcuacacagcagagagcaagcuucucacucagcacuggcuugcuuucucugugcccugcaaccagaucacauggugccuucugcaggagggucuuuccacauaguucuguugugcaacacacaguagaggcaauaguccuacuguuugcaggaucucaggaguuucccuuaccguuauucauaauaguaaccuuccccugggguuuucauuuagucaccuguggcuucugggacggcuuugucacccacacaggaaacuggaccucucugcucagucuuuaaaguucucucuucuaaucagcuuacggagaggaugauuuccuuacagcuuaggaaggcuuuuagaaaagauuagcuuuuuuacuuuauuuguaugaguguuugccugcauguaugugugugucuacauguaugcccauugaccacagaagucagaagcagguauugaauccuucgaacuggaguuacagaugguugugagccaucauaugggugcuggggauugaacaaggguccucugcaagagcucucugugcucugaaucccugagcucucuccggccuccuuacagcucuuucauagagccuuaguuuggguugacucucugucuccuuacuguucuacacacacacacacacacacacacacacacacacacacacacacacacucacgaguucaggcuucuuuuguccccuuguaugggcccuucugguuucccagacucuguaaacucccacauaauccacauauauaaaaauuagaagccagccucccccuaauacagaugagagaauauguauuauuuauuuuucagagccugacuuaucucaccuaauauauuuuucaguucuauccacuuucaugcagauuuuauaauuucccuuuucuuuaaagcugaauacaauucuauuguauauauguacuacauuuucauuauccauucauaacggaugguugucuaggcugguuucuuuccuuacuguugugaagagaacagcaauaaacgugauuugcagguaucucugguaggaugcagaugcccaaaguuauauaguagcauagugccugacuccacauuaauuuccauaguagcuguacuagcaagaaccauuuuuaauuguaagaaauuaaaacucguaauuaaaugucugagacucucaguguuccuuuacuuuuugauaaagguuuagagagcaucuugggaaggaauacuaugguuuuuauuuggggccuccuucuucuucuucuucuucuucuucuucuucuucuucuucuucuucuucuucuucuucuucuucuccuucuucuucuucuccuccuccuccuccuccuccuccuccuccuccuccuccuccuccuccuccuccuccuccuuuuccuccuuuuccuccuuuuccuccucuucccccuccuccuucaacuccuccuccuuauuuuagaucauuaaauaguuugagcaaguccugguacaacaaauaagcaaacaaacccccucucagauaaguguagacaauaaaacacccaaaguccaagcucaaaaugugaagaguucauaaccauugucacugcaaugacaguguugggaagggaagauguccaccuugguauuggaaagggagaugaaaucccuggccaggugauggugucgcaugccuuuagucccagcagaggcaguggaagucaguccugggcuacagaguccccaaguuccaggauagccaaggccucaagguggaauccugacuugagaaacaaccaaagggugaaggggcuggagagauggcucagcgguuaaaaacacagacugcucauccagagguccugaguucaauucccagcaaccacaugguggcucacaagcaucuguaauagaaucucaugcccucuucuggugugucugaagacagcuacaguguaggccuauacauaaaauaaagaaauaauacguaaaacaaacaaacaaaccaacuaaccaaaacaaccaaagggaugaagcccugaaguaccauguaacccugaaagagacugauguucccaucuguccggaggccgugggagagacucucucuauaaucugucuuacuuuccguuagagcuggaggcacacuuauucugagcaaagaauccgggaagguuuauauagacccgcugccauauuuuugaggagugaaacuuggcaaaggaggcaguacaaaguuggccaagaagugacuuguguggcuucagagucuccgacagugcugccuuuguuuaggaauuaaucccauugaucuguugcuacguggaaucguggaaucgagggcuguaugcaaagcucucgguugaaguagguuggcaauugguguuuuuacgaguagcagcaguugaccugguuuuuuuucagcuacaguuuuucuuaaguauuucuggaaauuuguaauugacaagaagcacaccauaauuuuauaaauacggaaaccccugaaguuauugguaacuuggaaugaaauuguaauuuuccaaggggucaccgaaggaacuaaugagaaauccuacaaagugaaacaucuugacuaauaguguucuugucacacugugugcagaugacuaauauguguucuugucacacugugugcagaugugcauucuuaagcuguuucucagcuuugggaauacaugccuuaagcuaguguguaaugagcuaguauaaguucacuauuuuaaaauuaucuuccgcuaugccccagcaagcagauaaaucauugacuauguuugugucuuaguacuuuaaacugcuuugguuucgggucuucuauguaggucagaacuuugucauucaaauacgaugacuguucuuauuuaagucaacugcaaacaacuggacuuucaaauucaguuucucugaaacugcacauguaugcucucuggccuuuugauuguagaaaugaaaucagagauuaaagacugaauguucaggcaaaauaauuaauuggaaggaaaaggggcuuguggaaaaacgacaacauuggcugugagaaaguauauaauuuuuaaaaaaaauucucauuauacagaauccauaccucaugguugucauggauggacuaguaaugucucaugagaugauuagaucuggugcggucauuuuuccacaaacccaaagccaggguguacugagcuuuggaggcagggguucaagcagaacagcugcuugcuaccacgguucugaggacuggaguccguugcugucucucucacucuaacuggguaaugucagguagcucucuaccacuucauaggcuccucuuucgucuguaccaaggacaucagucguaaggucuggcuuguacauuguguguauuagaucaucaguuacuuugcucuuucucucuuggauaccacauccuaccucucauguggucuucuguucuguuugacuaaagguaaauagaacuaggcuugacuuuuauuucuccccgccccaaccucugagacaggguuuuacuguccuggaacucacccuguagaccaggcuggccucaaacucagagaucagcuugccucugccucccaaguggcugagaugaaaggugugugucaccacacuuggcugaaugucaccccuguuuaaaugaagcagugcucuauguuacauuuaucuucucccugcccuccuccaccaaacaggcuagggauuccuuuauucccuggguaguauugauguaacccucucuguggugugccuaugaaaccauccugucuuuuauuuagggaguuggcauuaaguaaugaacugugagcagagcugcaggcugguaccuugccugugauacuccagagcaggggcucauauccucuuguuuucugggaggugcugagcgccuuccauugugugccagcucauugaugaaugugguuuugucaucuccucagugguguccuugguccagcguaaauguuaagaaucuuugguauagcggaaagaaacgaucuacuagaggagggcccagcagucccuuucccugucaggacagugacuggaguucucccucccaagccagcucaccugucucuggcuccuucccagcugugguucucauuuuccuaccgccugcugcucuuucugucuuuauaaucaacaacaacacacgucugauucuaguaaaauaaggagaccaucuccucuaaauuaacauuggaaaauugucuuucauuauguguuuuucuuuauuaagugagagucuacgacaacugugcgucuuuaagaagauugagaggcguuccaugcccuggcccugccaacugaccauuggccccaacuugucuauaaagauuguagccuauaaaucgguagguaguaaagugcuuuuuuuuaaagccguguucccaggcagauaaauaugcuuauguaagaagcugacaauucaugugcgagcuauucagaguauaauuacugccucucuuacugcucucccuuuugauuuaaucucuguauagcuuuucaucuaaaaggcaugcgggcagaggcuuuaacaacuguuuauaauauggcugcagucccucuuccucaagaauucaggccuuggugucuuuuccuuuuaggggaaagaaacugugauggauuaguuugucuuugugugucauaguggggaugucaauaauacacuagaguuauguguagagcuguggagauauggucauaccuaguucaguaguuacggguccaguaguaauagcaucuauaagaugucaaaaacauuggcuuauuagcgucagguugugugucaguacucaugugcauuugcgcaucaaaguucacuuuccaaagucaguugccuucugcaguuaaaaucugaucuaagcuucaacaugagcuuccuugucccccccuuuaugcugaaaguauaacuaaaucugagaaauaaauauacagauauuuuugaauguuuaagaacuuaauucccaaguacaugaugagaaccauagagguaauuuugaguuauuuugguuucugucaaggccaaaagagcaugccuagggaugaaaauauacucucacaguuuccuuuguuggcuucuuccucucuuugaugauggcaaaauguauucucccucuuuauuagucaauuugagaguuuucuauagaaaguauauguguauucagaaaucaguuugugccuauagccuaccaaaggagaaaaggggaauguagaaacagcuauaaggcauucccauuugaaauaaaccaaaauuuaauaaaaggagagaagaggcuuaauacuguagguagaauaguuguucagagagucugucagauuuccauuuucuuuggucaguaucuugucucuccucauuuucuaucuaucuuuugauaauagauuguacaggagaaauuuaagaagaguuggguaguuguggacgcaagaacgcuaaagaaggaagauauacaaaaagagacuguuuauugccuaaaugacgaugaugaaacugaaguuuccaaagaggacacuauucaagguaugaagcaagugucugcacuuucacccaagagagauuuucucuaagguggugggaggcagcguagauuggucaccaagagacacuucuuugagauacaggggugcagcagaaacacuggguccuguaggccaguggggacuccagcaagauggcucugggggaaggaccuguguauuugauccuuccaaauuuaaaugugucaagugacaggacuuguccuuggcuuucuucccucucgcagauucacucgcuaggagugugcuuaucaagcgcugaagcagcucucgcccuuccucuucaagcgccaaugucaggucuuagagccuacuggcuaugcuuccuuaggggaaaauauuaucugugguuguugucguggcuuaaacacacuaggcucuuuaaagcugggcuaaauauacccaacccauguggccuaaauaguauguuuagacgacaucuuuauccagaggacuuggaaacuagcugagaauaucugaauauucaagagcucaaaucgucagaugccagaugaugcuuaagauggcagccaggguacguggauuagcuuauuaccagguugugcacugcuuaguguaguuuuaagucuccaguucugggggaaaaaaaacccucauguauggcguuauaucuuaccacagguauuuagugugugagggaaugggauaguuugaagcugguaguauguacaguuauguacagaauauaaggaauacuuugaaauaucuacuaguuugauugaguucaguagcagagcauagagcaugacuuuuggaauuguagaugagcuggaaucaugagcuugucauuaguggaucauucuaucugguggaaggaccggcucagggugggcagaggaacgugaguaaggugcaggccaggcucagagggccugugggguauccugaguagcagccugcauuuucucuuauugucacagccuaaugaagcagacaccguugcuaugucuguuuuccacagaaggacuguaguagguaguuugcuuacugcugugacaagagcaacucaaggcaggcaaggcuuauuuuggcccacaguuugaggauacagucugccaggcaaggaagggcagguggcagggaugugaggcccgccgcgucugugggccuccuuuucuccuuugugcucagcucuggaccccagcucaugagucggugccauccacagucaaggugcgucuucccacuucaguuaacccagguggcgaacuucagagguucacccagaggaguguuuccauggugauuccaaaguuauuaucccaucaaguagaugaucaagauuggccauagcugaaagauacucauuaacguaaagucacacagcuagcugcgcagacacagagcuaaacugagaguuuguuucuucauucuguucagaacuaaaggguuuggggagauagacucagagcguaugcaugguguuaaagcucauggagccguugaugguucaggggauuugcauaugucuacgguguuuaggagugguccguggggagaugagugggauagcugguuuagaaaggggagggacuagaggagaggggaccaguuccuuaaguuguucaaaaaaagcucuguuagcugggacaaacggauucuuagggcaggcaacugaagggaagcguuaggcacagccugggucgcagauggaaguuagucaguucuccucuucccuuucuguuaccgaccacuuuccuucgccucuccuccacugucuacucacucauggguggguugcucucuuucuuacccagaggauguaguagauacaugugagccagaguguggugguauguuacagucucuucuguccuccuuggcuuguaggaacguuauuugcacuugaaguagaagaaucagaaagcucaguuaguuuucacgagcaccucugagauuuaugauucuuauuaauucaaauaagaacaugauugaugauaagaaaaaguuagaccaauacuugguguagggucugggagacggcuggugagcaaggugcuucugugccaggaugagguccuagccguggaucuagagcacccucagaaaagccaggcaugggcuggacacgguggcacgugucuuaaccccagcacucagaggcagagacuggcagaucucugucugaggccagccuggucuacagagugagugcaaggacagccagggcuacacagagaaaacccuaucuugaaaaaaaacaaaacaaaacaaaaccaaaaaccaaccaaccaaccaaccaaauaaacaaguaaauaaaauaaaauaaaauaaaauaaaauaaaauaaaauaaaacaaaacaaagccaagcaugucagugcacacuuguaacccuggugcuagggagguggagacaggugagccgcaggggccugcuagccagucagcugcauuggaaugggagcuccuggcuugcuuacaagcccugucucagaaaguaagguggagaacaguagaggggagcugaccucugaccuguacacguacucucaggugagcacaugcacacauguguacccuuuccccuagcugcacacaagugacuggaaacaaaaccauucgguuuagaugccaugcuuaaucgugucucaugcguuucccuguugaguuuuugguugcaacuuuugaauugguugucuuuuucaaaaagccaugcaugagacuagaaauugcuuuaaaaagaauuuuuuuuauuaauuccauggccccagcagccucacggacugauuagacacuggauuauagucugucuugggacucccacuguuucugggguucuggugacccuguuugcguucacacuggagagacgcucugccgcaggagagcagauaccggagaacagggcugggcuuggcuuuuuuccuuucgccuuuuuccuuucgugaggacacacgagcccauauuuauccaaccuaagacccugaaagcagacacagcugagucccaguaacagaguaaauucaaacccagaagaguguggggcuugucgguuagaugcuuuuaaaacagaguuugggcuuccucugucagauggcugcagguaugucuacuuccagcguguguuuuuuggacauuuuguucugaugauuuccgaugggccguuuacucuguguggaccucuggguuucagaauaaaugggcuuuugaucauguuuacaagucacucuuguucugcagucaacacgguugucuucggaggcugacuaacgugcuguguuuguacaguuuucucugcugugugaucauuaagauaccuagacugcagaggaugcugccuuaaaaauguaauuagaccuuaaucguccguaagcggcacaugcgguuuguuucugccucugcuuuugguggggggggcaauaauuugguuccagggagcagaagagacuggcucugggauacuuguauugauguguauacauguauuaauauguacacacguguguugauguauuuaaacauguauugaugcauguacacagcuuaccucaggccgcacauggcuaacacaugcucugcucucauucuccaggguaccgcuacggaagugauaucauuccuuuuucuaaaguggaugaggaacaaaugaaauauaaaucugaggggaagugcuucucuguuuugggauuuuguaaaucuucucagguacagcaaauacucugcaguuguggacaaaguacaugccuugagcuuuugacucguuguuuuauuuacacuucauacuuacuucucauucaguaucuaaaauguaguuuggggaugaguguugccuuuuuuuuuuuuuaucuaaaaaauacuaauuucugugugcaugugugugugugucugaguguguguguauaugugugugugugugugcuuaugcaugaguguuuccacauguguguggaaguacauaugugugugugaauaggcaugugugugugagugggcaugugugugugaguggacauguguguguaaguuggcauguguaugugaaugggcaugggugugugagggugcaugugugugugaguacagguguuagaggaaggacaggagucaggucccccuagagcugcaguuauaggcaguugugagccacaugacauagaugcugggacuugaacucaguuccucuggaagagaagguuguguacuuagcacauggcaccaucucuacacuccagaguaucauugguucaugguuggccaccuuuucccucaauuucuuuugugggguucuaagaugugaaccuuauccauaagucacaauuuguagguacaaagugcagauacauggaguauagaaaaggggacaugcagcagcuugccaugggauuccacagaugguccuaggaagcauggcucaguauuuccagagaucuuagguuugcugucuuugggguagaccacaaaaugaugaauacuaauauuauuauuauuauuguuauuguuacuauuuuaguuucugaggugguuuuucugguagccuuggcuauccuugaauucacucaguagaccagguugaccuugaacucagagauccucgugccucagccugauggguguugggauuaaaagcuugcaucaccacuccagcaagaaucuuuguaugugaauuucucccuaaauucauagugaugaagagauucuucuaggagaacucaagggaauugaaaugaaaguaaauaccacccauagacugaaucugugugccuagcacacaagccuuauguagucuuaguguuagguuaguucagugagcuguaggagcauuucucucaugguuaucucuacuguuagcagugucuucaaggccuggagagauggcucaguggugaagaacgugaacaacugcuagagcacuagaaguugguucuuagcaccaagucagguggcucacaguugccuguuacucuaggucaagggcaucugaugcccucuuccagucucuaggagcaccuguauaaacauggcauguauuuacugcauacacacacacacacacacacacacacuuuuuaacaaacaaacaaacaaacaaaccaaaccucuuuaagccaaaaagugggcaaacuuaccuaggaucccuaagaauguacugaaguaggaugugcuaagugagcauaacacuuucuggaaguuuagggccccuaaaaauucuuuaaggagaaacuaauugcauugcaaaauaauguaaguuaauauuuauuaaucuugagugaaacuaaccuuauauagaccaauuuguagaaacugucuccccuuuuaaaaaagauauaucuguauuucuuauuuuaauguacauggcuguuugccugcaugcuuaucugugaaccaugugcaugcagugucugcagagguccagagagggugcugggccacuggaacugauguuaaaggcagugagcugugaugugggugcugggaauugaacccggcuccucuggaagagcagccagugcccuuaaccccugagccaucucuccagccuuucucucccuuuugugagagagaucuuacugugguuggucuugaauucacagagaucugucugcuucugcauccuaguugcugggauuaaagauuuguguuacuacaucucacugaaacuacucuuuccacccuugcuagauagacagauaagcccuaucucaaacgccuuuaguauaauuuagaauugcuaauacugaaauuaccuuugucaggcuggaaguaggggccuacuuuagcuaaauaacaugucccuuuaaaaaagacauuuauuaacuucaaauuuuacuuuuaaaaucauguucucucuuuuuaacuucuaaaucaauuuuauuauaaugauuguucuguugaaggaggaaaauacuuuuguucaagucugggcuuagaaaauggguaaaggcuguccaucucaaagagaagagcccuccuguucccagugucagagaaggaucuccuaggucucacagguuuccugagaugggauaagcccaggcucaucucuuuaaccaacagccaggcaaugccccacucaacuuuguaacaaaguucugucucagacaaguaucaugaaauauuauaauuauaacuaccauuaaugcacacuuacaguguuccaaccaguguaagcauuugauaaaaauucucaguuaauauuaccuuuccaggcuuguacuuauuguaggcacuuuuuugguuaagaaauugaggauuagccuuguuauguaacuagcccaagaccuuacagugaaacgagaguggcugcggauuuugaggcaggucuccuugacucuagagacugggccaucguccagugcuacucuuaccaugugaacuagcacaguucugaguaguccacuguacauacagcuuucacguaugaucuuacccagaggacaggaggcguugcacgaaguauuuuccauacggaauaggacauaauacagaggcgcaccuuuuagcagacgagugguugucaguuauuguauaugaaaucauauguuccugcaccccaucuucagcgggaaugcuuacaaaacaccaguuauggaaugaauaggugugaaauaguuuuuguguguggauggugacuguuugcuaggcaagcacacuaccacuuguguaugugugugugugugcacacuguuuauuuuaaaauaucaagcaguuuuucaguucucuugcuaaguugucaaguauucuggguagauaauuaugagacagaaaagacugugguaauuagcuucccuccagauuccuggcuguucuuuuaaaaaaucauuuagguguacuagauaaagaugucauuagcuauuucuuaaagauucccuuuuauuuuuaauuaugcaugucugugugugugccuguguguagcuaugugcacgugaacgcaggggcuuguggaacccagagguguuggaucuccuggagcuggaguuacaagggucgugagucaccugacaugagugcugggaaccaaaguuugaggcucugcuagagcauuguggcucuugacugcugagccaucucuccagcucccucauuagcuaguuuuugaauaagucaaggacuguuauaauuucuaucaggguaaggggaucucucgaucugcuguacuggcaguguaggguuauucuuguaugccuucgcauagugguuuucagcugggacuagaaguggaagugagggacguguggaccucacaccuuugcagcucugugugcuugagcuaucagcugcuguaacgugcuccuuguuuccaggcuucagaggaaagagugcgagggaaaagcagaugagaaaugcugcccagagccacacauggcacguccuucuagaaaagcgccaggcuccacaggcagugagagccagagcuugguggacggguguaggggcugcgauuucaggagcguuaacguucauuuucuaggcagguauugguagaguucugugaccuugacugcauuucaggagcgcggaggcaccagccguacguaguuucccugccccgggucugcucagaguuggcuuucuuugucgucugcaguacauuagaggcuugucccaucuccugaggacaucauuccuaagagacuuuuggagacagucuuuguaaucgcucauuuuuuaccuguccccuugugcugugccccggcauuguucuaaaagcaggaccaaugaacacauacucuguucccgucacuccagauugcggucgcugugaugucugcucuggagccagugcauagaccuugcuuuacauuuuccuuuuucaagauguauuuuuaugugugugagugauuugucuacauguaugaaugggcaucgugcacgacugauacccuugguaagagcagcaagugcucugaacagcugagcuagcucuccagccuuuacauuuuccuuuugguuaguuucuacuucccaagucuuggucaguuuuuacguacucuucugaaaccaucacaggcuagugcagugcccuguguuggacuguaacccagcauugcauuuaaucacacagcuauugaggcuuuugaggagcaugguuauauccugcucacuccucugucucacugcauaccauauaggacaauacaggccaugcguuaggugcucauguaguugagcuucaaguacucgguuguuuccaguugcucuugcuguuuuccaguaagaacauucugagcagacauuuagcaacaugugaccuuacaguggugcauauuucaaaacgcguuuucucucucccaugcucuuguagguucauagaagauucuucaugggacaucaaguucuaaaggucuuugcagcaaaggaugaugaggugaguuggguuggagcuuugagacagugcuacaaacugaacuguuauuuugggaaagugggcuguuuauagccuuuguuuguuuguuuguuuguuuguuugaaacaggcuuucucuguguagccauggcuguccuagaacucgcuuuguagauuggcugaccuugaacuaggaaaucaucagccuuuggcucccaagugaugggguuaaaggugugcauuugcaacagcugugggaaagucaccaaccuuuaacucuaaaaauggggagaugauaaacgaguuuguuuuagcuucaacguaaugcccgaggucauaguauugcacaacaaccccugaccagcuugacuuagguguaggugucggcuguuaaguaguuuugguucagauuggccuucgucucucaugaacaccgagcauuaguaugguguguggaccuggagaagcgcuccugaucugugggcgauuucccugguuucccacguucuuaagguuuucugucgucaggccuguuuaucccuggcuaacaacucugacuuucacaaccuacacucacgcuuugcucucugcacauuuucuuuuuuuuucuuuuuuguuuuuuuuucauuuguuaucaucuuuuaauaaguauaucauuuuuaacaauagaagccaugugagcauagggauauugaaagaagcaauguaccccucucucuccaagcaaaauuagaacauauauauaguagcucccacauugaguagauuuucugaaugugauacaaguuuacaauuaauugguuuucuaauuucauaggaauaaugcauaaacucauacugcaaauaaucccuauaauacuagaaauggggauauucuuugcuguuuguccugguucacauuguaaaugcaguauauaaauguauuuuacauaguauuucucauuaaaaggaaacuuuuuuuuuauuacguauuuuucucaauuacauuucuagugcuaucccaaaagucccccauacccuccucaccacuccccuacccacccauucccaacucugcacauuuucuuuuugaaauauuaagucagcacucaauguuucguugguguguugacuccaguacagaguguuaaaccagcugaagcaggcuucuaaauucagagguauuugcauuagaaaaugugaacaauugauugcauugaugaccuuuuuuccccaugcuucuggaacauggcuggcugcucaccuaggagguggucaugucagugucugagaacaguuaacaucaggagaagacgcuugccuuccccucuccugggugugagggggugaguucacuacaacacauagaugacuucacacuugagaauucuagcuagugauguucuccuaacuccagccuuagaaacugugcugcucuggucugguguguucuauaguuuuaaacuuuuugaacuccagcuguggacauaacucccacuugguuuuuuuguuuguuuauuuuuguuuuguuguuguuuuuguuuuuuuuccacgaaggaaaucccagugacuucuugagaguucugcugcagagcuauauugagguaccugagcugcaaaucaaauuugucauauacguaacuagcuucuguugucaaagucaaacgaaagugcagagacaaguuucugaugaagcaucuuguguuuggaauaaggacuaggaccguaucucgggcccaugggaugacagugguagccggugugguugggugauggaggaggguuugggguuuauuaggaccaggaaaccugugcaacucuuaugaaugauuccuuauuggcacuuucagugcucuagggucucggucagcucugaugagugagcgguggaaguuccuagguaaaguuagucccaagguuagagcuggcuguucugcaguuagucaguauauccaaacaaagggcaagcugucucuccuugguuacuugagaucauucugggguuagauauuggugaccuagguauuucugcuuucuuaugguccuuugauucuauuuuugugaguugugacagaucuggcucauuuuguauaauaaaucgucauauaucacugaaguuuuuaaagaaaagacacuuucauuuccuaauggcucuuugguaucugugaguguagucaaaaacugauauugucaaacuggagccuaugagauaaauaggaggcuagggagaguaugcuauaugagagcuuccaguagaaaaugcacgcagcggacuuguguggguagacaggaguaggaggacggugacagaugcaauagcagucuucagacauuuugaggaggaucauggggaguagaaauuaaucugugcuuccuaccagagaacugagcggggccugacgggugcggagcuuugcuccaaaugaguuacucugucaucagagaucaccagcucccgauggauuaccuucuugugagguugucuuaaguccgaccaugcaaguuuuugagcagagucuccaauagcaccagccaugugcauuguuggggucguuaaaaugggugaauauuauuguuuuucaguuaaacuauucugugauucagugacuaacuccuuaaaauguuuucucuggcuauuuguguguguguguguguguguguguguguguguguauguauguauguauguguguauguguagaauauguauauuuaugugcugauuugcacuguguguggagaagaagggcagggguaagaggaaaggaauagggacucaguggaguuagauacagucucaguguuguuacaauacagaaacagucauuaaucuauuguccuuuacauuaaauauucugacugguccuaucaaagacacacacauucaaauuccaagcaaauuagaaauagucucuuccccagacucucugcuugucugguccucucuuaugggacuuacuguuagaacagacaugcucaguugguacaucugucauucccacuaguaaggaguaucuucacucaaugaacucagggggucugcuuuaaucuaugacagggccuugacaccuagcaaggaauaggcuuaacauaagugguccuugaaaugaggggaaauuuauguauuaucaaaucuguagacuauuuugauagcaggauauugaagccauaaguuuguaugaagggaugggacacacauaccuaacugugauacaggccagcuagcugugacaccggaaaggccauagugcucggaagcguggagggugaagcuuccuuaguaaggcaaaucugcgaugcguuagaggacaugggugcgguuggugcuagaaggaaauuaugugagcacaagcacccagggaagcaaggcauaagauauaucccuggucaccaaucagcucugugaugcuggaauagaacuguuggagguuuguagaagagacuggcagggucaccucugaacagaagaggcagugguguacuugagagacggcguaggggucaggcugagggaugaggaaggucaaggacuuugaggccauaguuugguugaguuggaggugcuggcaguggaagugagagauacaggaggagaaagguacuaguaagugugggaagaggagagaucugccagucaaugccuggcucacaggacaguauuuauuugugugcccacaugcagaagccagaaaaagauacuuggagccuuucucucuuucacuuccuugagacugggucucuuacuggacaagaaacuuguccuuuuggcuagguuggguggccagcaagcccccuggggccgccagucuccacccgucaauguuaggguuacagacagagccaugccuggguguuuaugugggugcuggagauucaagcucggaugccaaagacucaaccuuugauccuuaguuaauaaggacaaacacucuuacucacuaaucuguguccccaucuccuuggaagaguuuuuaagacuuuugauucuuccauucaugggacuggacgaaacaaucccggaacugaguuuuagagugagaagaaggaaaaggcugaaagcagucuuuuaagagcugguuggaagaagaaaggagcuuguggggcagagacccacauggaguaaucagaugaggcuuacuucugaagucagaguguggagagguggaccugggaucugugcuuguuaccaagagccugcaacgggaagagagcagaugggccccaugugaucgucaggucuugucugugaggagcucucacagugugacaggaccugugcugacauauacucuucucccuuacaggcggcagcuguugcccuuuccucucucguucaugcuuuggaugaguuaaacauggucgccaucguccgauaugcuuaugacaaaagaucuaauccucaaguugguguagccuucccuuacauuaaggacgccuaugagguaaaaccuacaggcuucucaccuucccggccccuuuccauccuuuccuuuaaagaaaaaaaaccucuuuugugguucuggagauccaauucauccaugcuggggccucacgccugcuaggcugugcuugauacugcacuauugcccucugucucuuuauccuaaacagugcuuuaggacguuguuaaaauacguauucuagcucuguagggcuaaguaggaaccauuuucugaauguccugcaaacucccagauaauguugggauugcuggccuucaagccagguuuucagcuagaaaacaacgugauuccugaauguuuuuaaggagggucugauuaaaccagcgaaggugaaugcaggacucucucuucguucccauccccuuggccuuuucagggccacaugggaagagaaaucgccuccaguuuagcaaauaaggaccaggaauaaagguugggugugacuucacugugucagugugaagguugguccauuugaggcucuccuauuugagguacaggccaagguugcuucuucucccauuccucugggaacuccaugcggcaggcugucggagaggguggggauggugacuucccagucagauguccugccauccagcucuccuccuugguucugcuugguccugugcuuuuaugguuaccuaacagccuuccuuugaggcauuucuuuuauaucugguaucugccauacuguuugcaacugugaacucacuacuaggcggcaaaauacguuaccguguuuuagucagauuugcacaagguuucgaacuauuucugcugugccgcuuccgcagcaucugggaccacuuggaugugucuccauuaaucugaugguuucugcuuguugacuccuuucucucucauuaguguuuaguuuaugugcagcugccuuucauggaagacuugcggcaauacauguuuuccucgcugaaaaacaauaagaagugcacucccacaggugagucuauuccauuuggcccacugauggcucugcacauagacucuuuuugggaaaucaccuggcugcagcugcaucuggggccaggaccucauggggcgaaugaaguacuuggauucuaaucacacacucacaaucacgaugaaggugguucagcagguguucugccaggaagcaaguucuccuauucuccuagccuuccacacugucugcuuuuuccuuccgcaucugaggaacagcuuguuggauggcugcucuccagguguaagcggaaagcuugcuccuguggaagcgcgcaugcaugccucugcauucugugcgugguuugauguagcaggagcgacaguggcacuauucagcaucucuguccucuucguucuuccuuugaaguuuaugacugcaguucaguucuuacuguggcuuguugugaguguccgguaguugcaccugcagccagcucucagugccagagcgaccucacagccacaggugccaucuucuaggcagcucgccauuugucauuauuuguguaguugugggcagaauguaaaauacaaaaccaaaaccaaauaacuacaacaacaacaacaaaacuaugaaaacuaccaaaaauaaacaacagcagaugaugcuagaggcuuaaagaucauccagcgagaucuaacaaaugguaauggauugcguuaggcuacaagucuaauauuaccuguggcaauguaggguuagggaauuuuaaggugaguuugaaaaugagguguucucucugcauucuuagggcuaggcggaguguccuuuucucuagagcuggugucuuccuaucaugacagaggcaccuguggaccugaaugucagagaaguuguugcugugcuguugguuguguuucugccucuugguuccuugcuaauuaauuaacuaaggauuaauuggggauugaacucagagucucaugcacauugugcagucaaucuaaucccugagcgcuaccccagcccucauuccaaacguguugagaaguucucuuuaugaaucagaccgagucuaaaaguugaacaccuuuugaucaguugacuuauuuccuaugucauagugaauuuucuuaaaucuauuggcaaaucucccaaguugauguuuauggggaaguuuaugacacuggugugaucuagcaaaagagcagcugagagcguuguaggugggacucacugacuguugccuugugcaagcaauggcugccuggugggcccuagcuccugacuuaugaugguggugguuguggcagguucagacaggcagacggugccuugugauaaguaacuuucaucuugugacacagaagcauuaagguacuguuuagaagccgcuuacacuuccugccaccagcccacgauugacauuagaaccaguauuccacuuggauggcucugcagacggccguggacccucaaagugaaaggcacacgcguggugggggucagaagcuuuccagggaagauaugcugcuuguccacauagcucugggcugcgccauuuguauugaccugauagauuuuuauugaagggcagcugcuagguauuaagugagacaucaaagagacacugucauguuucugccaucaaggaacuuuagaguuuaaauagaguguucucagguguguguaguguacucaguagcuuugcaaaaagaaaagggcgacucugacagaacacaaggaauucacuugcucuggucagaggugucuucuuguugcuggagggcgcuuggggucuucagaaagcuuggcuucauuuggaaguuguuaguuuguuuaaaugcuuuuucucuuuagcuaauuacuauuuugaaaauaccagcucauuggauacuuaguauuuuguuuaaauuuccauagagaagugauuuuauuauuuaauuuuuuuauggcagaguuauuuuucuggaacauacucuugcuuuuguuaucauauuccauggcuaaauguuugcugaaugguagaacuggaaaagaaucaagagggcaguuacucucuguuuuguuuucuucuuuucaaaccaggguuugcuauguagcccuggcugcccuggaacucacuauguagaccucguggcccaugaaguuuuagagaucugcuugccucugcuugcugaguucugagauuaaagguguaugcugcuaugccugguuaaucaacuucuauuuuuuuuuuuuugagauuuauauuucuuuugauguaugaguguuuugcuugcauguaugucuguauaucaucaugcaugccuagugcacucauagggcagaaaaugguguuggauugaccaggacugggguuacagcugauuguggaugcugggaaucaaauccugguccuuuagaagagcagucagugcucuucacuucugugccaucucuucagcccccaggcaaaauccuccucucccucuucuuccuccucucccucuucuuccucuucuuucuccuuucccuccucuccuuccucuuccucuuccuucuguacuuccuccucuuccuccuccuccuccuucuuuguuuugugcuuacauuuaaccuaggggauaguuuuuuguuuuuguuugcuuuguuuuuuaagacaggguuucuccauauagccuugguuguuccuggaacucacucuauuuaucaggcuggcuucaaacuccuagaguucugccugcuucugcuuucuaagugcugagauuaaaggcaugugccagcacuucccagccucaacuagucuuaauagcaaaaucaagggucaggccaaguacuuacacagcuagggaauacuuuggcagagcaggcgcuguacaaccugccaguguuacugcauucagaaguggaaagcaguucaucuugauagagaauaauagaaauaaucuauuuuuucccuuugcuuugcuaucauugucuuaagaggcccagcugagcgcuauugaugaucugauugauuccaugagcuugguaaagaaaaacgaggaagaagacauuguugaagauuuguuuccaaccuccaaaauuccaaauccugaauuucagcgauuguaccaggugagaaaggaaaggucagcccauuauguuuuucuuuucuuuuccccuucuuuacucccucuccccuuccuuccuuuuuuucuuuuugagauggggucucacuauuuagcuguugcuggucuggagcucaauaaguagaccagacugguuuugaacucacagaucugccugccucugccucccgagugcuggaacagauacagagccauaggucaacugcuguauggaaacacgguggaaacaaggagaggagaucuuuggaaguggauuuuauggaacccuccucugagguagaaaccuuggacggagaucuaaaagaaauaugcuugacaggagacgggcaugaugcaaagccacaugguuagccaguuccauuugucuggagagaauucagaggaagagucuggaaaccacuucaacaucugcguguagacaggauuuucccaacaggacucuagcuaggcauccaggaaauaaggccaacaauugacaaauggaaccucacgaaauuaaaaagcuuugcacacaaaaggaaucaguuaauggagugaagcagcgucgucagcuggucuucacagagaucaauagcuagaacggacgagaacccacugacacggccugaggaagcucaagcgggagucgggugauuaagggugagcaaagcaggaggugaaguaaacgaacacggaaaagaagcaaguguacuguggagaagacgaacuguuggugcgcugaggggaugcuggagcgaggagcacgugguguggaguuugcaggauacugacuccuaggcgauucucuguugagccucacaaucuuuuguuuuuuuuuggauacagaccucuagauagcauuuucuuuauuguaugaaaacaguucaugggauagaauaauaugcuuugugauaugaaauaguuugaaauugcaagaacuacuuagcuccuuuuuuuuuucuuucagaauuaccaaucucugaguuguuuaaacaugggaguagggcugggcauggcuuagugacagaacaugugccuggccugugcaacacccuggguucaauccacggcaauaauaaacaaaacaggccacuuagagcuuucuucgcgggagggacaccucaaugggcugugucauuucauuguuucuuaagggcaucucggugcuuaccuggcucuauugucagagcaguggcucuccaccugugagucucgaccccauugguucuguuaacccuuucccagggucacauaccggauauccugcaucucagauauuuacauuaugauucauaacaguagcauaauuaguuaugaaguaucaggucagaacaacaugaggguugaucaggaaggcugagacccucuguuagagugcugccuuuuuguuaaauacaaguguugccaaggccugacuuagacugaugcagacagaugacugaguggcaguagccugauccgcucacuuggacaguggacaaccugccucucccuugguccucuccccacucuuggugcuucuuucuggcaucccugucaacagugaguguccuagagaagagcauuuagucucccagucaauaucaucagauacuuacuauaugccaggcauauuuucugugcuuacaauucagcaguacacaagagaagauaccuguuuccaaggggaagggagaauacauaagugaacuaagcaauugaugagacaauuguaaguaaaugcuugaaaaacacaaaauugggaaacguuagaauaugacuagacaacagcuugcaagcgaagaggcugcuucguacacagugucggggaaaggcuuucugagagguuaauauugagcagagaccaacaugauagaaaggggcuaacuccauuagagccgggacaggcagaggacacaggaguguuacccaaggccccagaggcaggagugaccccagaagagcucaucuuuauuuggcugugagugaggaggcagguggcagugccaugauccaucggggaguggggccuugucuuacagggcuuccuggguuguguaaggaacugggaagaguuacuuuugugucuccaaagcacuugaaggaaacaagggagggaagaauucccuccacucaguuucagggguucucacagcuggaaaggcaggacagagaagcucaaucauaguacacggcagagggcggcuguucacauuguggugggccuggaagcagcacucuagaaacgggcuuuggguaaccuucaaagagccaccuccagucaccggcugucaccaacuuuaccccccccccccccccagcuccugaaggucucacagccuccccaaagcacauucauaagcuggggaauaaacauuuagaacaugagauuguuuucagaugacuucagguucaguguagugucaacagaggcugagguggccaguuagaaggugacuaggccagggcugcugggccagggcaagaguggucugucugucugucugucugucugucucucucucucucucucuuucucucuccccauuugucauguccucucucucucauucucucuuuacaugggucucagucuguuucaguggggaugcugggcauguggagacagggucacgcgcugcccucccuggucgcagcuuguagcagcuggguauugucauguuuuuguccuggggcucagagugggcagcucuccuuaggccuccaucucacccaucacacagggacuccuaaagccacaugauagagaacaugccugcgaugaagggaacgaaaagacguacugugaagaaccuguaaucuuggagaguuggcgaguuacggcuuaggagccuuguguggucccugaguaguuuauaagacgagggcuccucuaggagguuuacagaaggguuugcuucugugcucgagucuguuuuuauagcugguuuuagaugugaccaauguccucugagccaucccauuuuucucugcuguuuggcaugagucuccuagcccuuccaguuagagauggaggcuuccugacuggaaaacagaaagcuauauuugaugucagccucagcguuuuuaacaccuuuguucuuugccuacagugucugcugcauagagccuuacaucuccaggagcggcugcccccgauucagcagcacauuuugaauaugcuggauccccccacugagaugaaagcaaaaugugagaguccacucucuaaaguaaagacccuuuucccucucacagaagucaucaagaaaaagaaccaagugacugcucaggacguuuuccaagacaaguaaguaccugaugaggucaccuuggggucuguagcaaugcggagggauaggggaugggcggggugggggccggaacagcagugagucuggaauuacuggaguuauggugcugcccaggguuacagagggcaauagagcagcuucuaaauccuuguguagaaauaugaaacucucacaccuguccaucagagucauagucuagccuugauguucaucugggcucagucuucugguuuggauuggcuuuuguaucaaccauaaaguuuuugugaguuauacauaggaaggcuaagcaacaugagugaauacuugaggcugaguuuccuucuuuuaaaacaguucuuauuauaguuuucucucucucucucuuucucucucucugucuuuguguguaugugugcaugugcucaugagcacacacacauguguauguguaagucagagaacaacuuggauguugguucuagggucaaauucaagcugucaggcuuggcagcagguuguccugcuggucuugaguugccccuuuccuaaaguacagagcugggggugggaagggcaggcuggaugucacgaggcuucuguggggugucagcuugugugugugucuugggugggggcgguuaagugucggugaggucuucgguggagacccacagccaccauggcccuuuagcuguucugucagugggucacugacgugcuugacccaugacauuugggaggccuuuacagguuaaggaguggaauguguuuccuaugguguaugagcuaagcuugcagagggcuaagaaaguguuuucuucuucacagcuuguucagaaucuauauuaaucuccauauaaauaaaaaacuagaagaaaauauccauuguacagaauccuuuggguauguggcauugacguuccagaauucauucagcugguuauuggugauuuuuuucuuaagccaaaauaauguguuucuuucugcugcauuuugagcuuuggcaucagaccaugacccucucccccuccuccccauuuucuuugguuuccuuucuacagcuguaucuucauugacaaaguaaggcuuauuauuuauaaguacccagugggaaaggaugaguaauuuccagaaacuuucauugguuucuauaaaucaauguuuagugaauuauuguacaaguugaauagaaagccuugcauuuuucauagcuucccagagguaaauaccccaaccuuugugagauuuugaaggaaaaaaagaaaaaacagacuaaacuggauugauccuguuccauguacucccaucgcacccuggagagcuuuacugcccuuuuuauucuauccugcuuucuucuacacaggaagccugucccccaaauuccaccccaccuccaucuuucuccuccuguuugccacuggauccaauugcgagccacucaaugaagucugugucucucuuccuguggcaccuugcucuggucucccugcaaccacgcagcuauucucuccccauauuaaacuccaguucaguuugugaucuugauuaccuucugguacugugggaaagaaauagaccguuuucuccucuuccuuugauuaaaauguaaaugagcugguuaagagauaaaccacagagucccccagggcaguuacccugugaucugaucccugcagugauuauaccuucagcuucgguccuaucacucaucacuggggaagccugggugugcucgauuucuuguucuuugcaccugugaaacuauugacacgaaggcgaucugccuggggccugggaauuagcucaggaguacacucuuacccacauuccuuuucuccaccuuuuauuaucagaagucuuaguuuuuaagaacuguagaaaugauggauuuagcacauauuuaccuagcaccucuucuauucagggaugacucugucuccuugacauggaucauaaagcccuccauuuuaauggaaagccuccaguuagcuucaaagguuaugcuaagggggaaaacagaucgccaauacugagauguguuuuuguauuuauugaucacccuugaauccaguuuacugauuuccagaagacaggaaaagagcuaagauuugggagugacaauuaucugcugaggaaguuucauaguaaaaagcaagaugucacuugauaggauuuugguugaauaauuuuaucuuucugauaauuucuuccucuaaauacagccaugggcaggcaagaugguucaauggguaaagaaagauuccugccuugcaagccuggcuaccugaaaguggguggagaagugguccucugaccuccccaugaucauaugacugcauacgccccuccacaacaguaacugaagaaaguuagaaccaguuucauuuucaagagauaucauggcuacaaauccaucuucaacauguuggauaccuaauacauguagugguaaugucuucauuuccaaagggaaagagcucuccuggcgccugcauggagucccacgauauacugcauguguugccuacauugucugaaagcauugcuucccuugauguuggcauagaccuuggagugaaaguaucaucucuaggucagguggugcaggaggcuuggggcaucugauguccagcucugcauguaugacacacgcguguccuugcuuucuuuugcacuuuguauagcucgucuaaagucugcuccuuuuuccaaguuuccuaaaacuucucucggcguuuacucucagcaccugcuacucuacuacagcuccaucugacuaauguucaggacuugacucuagagucagccagugagaguuaacucccgugcucugugggcuguagguagaaggugcuuauccucuguuuccucaugagugagauggggauggcaggaguaccugucucaggggugucacgaggacuauuggauaacucaugcugcuuaccuagaacccaacacagugucgucauaucguaucacaucauaucauaugauagcauaucaagucauauccuaagaacagcauuugucagucaacagucuucuaacacuccucaucaggucccuagcaugucaucaagggcagcagaggcaaugauguuccugaugauuucauagagaagcuagucgucgucaguugguccuuccaguggauggacccucucaugucugaacauccugcuuugcagucaccuuuauuuccuucucuccagcacagcggacacaggacaccucauccuucaucccuucaccaucgcuguggccugagcucccaucuguugucuucucugcuacccugguccacuaaugucuucuuuccacuguccccccacccucuucauguuaacagcuuuuucaucuaaaacaaaacaaucccuccaggcuccuccuccagauugcugccuguuauuaauuacuaaucuaaccacugucuuuccuuugaaggcuaggccuauuggaagaguagccuacauugcugcuuuucuugguguauccuccuuggcugccucuuugaagauccaaacuacagaaucgcuuaaguugccuucagccuugcucucucucuuuuguuuuuguuuuuuuuguuguuguuguuuuuuuguuuuuguuuuuuuguuguuuuuuuuuuugagacaggguuucucuguguagcccuggcuguccuggaacucacuuuguagaccaggcuggccucgaacucagaaauccgccugccucugccucccgagugcugggauuaaaggugugcgucaccacuguccggcuuugcucuccuuuucuccagagacuuuucucuucccugcauuucacacugucaauuauucuucugucuugaagcuuuguaucuccccuaacuuaagcuuccagauuuuuuccuugucuuugaaaacucccugccagacuccugugauguuuccuuucccugcccaccuuaucuuauagguguuguguauagcgcuugucuucaggacagcuguaugaacacacuaugaugcugaaaugccuuccuugcauaucugcuuggaugcucuggccauccuaugaaguagauugcuuuguugauguucucucaagucugacaagacugaggacuggagaaaaggaacaacuugccugagaucuuaacaaguguuagaggaagaauuuaauaaaugugugcagucugacuccaaagcucagacacucagccagaauaccauuuacccuuacaguacaagccccagugacauuuuauguacggggcuucaaaagccacacagucugucugcguccuauccguggguggcucaggugccugcauuuaucugaaauucaguguauacagaaauggcuucauugucugucucugagcacucugcucuccaacgccucuccucuuccuauuugagagaauggcagguuuugagagaauuugagguuuuggguucagcccuuucuuccacuugccaugucuggcugguuuaccaaguuguauuaaauuuaccccaaaucugcuccuuucaguucagguuaauguaguggcuaauggcauugauuuuuggagacaaauagauuugaaucuaaauccaggcauuucccuuuacuggcaguugaaguuggcaggcugggcugggccguguaaaauggauaccuacauuugaugaccuuucauuugcucaucuauagaagacaauggcagaagagacuugugagggcuguugcauaguuuagcugagauaauuuagccgugcuuggcuuacuuagugccuggcccuuuagcucuuaauagcauuucccaccagcauugcuuaugcaugcuuugugccuccuguuucagccugccuuacugagacagucuguggcuaauuuucuucuuccugguuucaauccuuuccaaacgcucggcucccucagcagcaaguuuuguguuucuuuuucccuuuucagcauuuccugguugauguuguggaaaauacagaggaagaggugcauagagugagguguuuagaaauaucuccaaaugucugagucuucuagugaacugcgauccaggguccuucaugcucagaagcugucugaacccugcucauuugaguuguuguuguuguuaaaugaaauauuaauuuauguguauggguauuuugcuuucauguauguacgccacacacaugcaaugcccauagaggccaaaagaaggugucgauuccucagaacuggaguuacagaugguugugagccacugugugggugcugggaauugaaccuggguccucugaaagagcagucagugcucuucacugcugaacccucucuccaacccacuuugagaucuuguggaaacuucauuacauaggcaagauugauuacaucagucgccauuggugagcagguuaaccuuuggccucaccccuccuggggggggggggguagacuagcaucucugcuuccuaagccugccuuaggcuuuuuaguggugccuccugauucccuuucccuacgcuacucagaggcugccagccagugacacugaguuucuaaaaccuuuauuauguucuguguguaugugugugugaauaugcacuguggcacacauaggggguccaaggacaaccugugggaguugauucucuccuaggcccuggagaugaaacucagguugucaggugagguggcaggugccuuuguccccugagcaaucucccuagccuaagugauuugugaguaugcauguguguguguguguguuuaaaaaguagggucacaucacugcuauuuaaaguucuuuaaugccaugauucuuaauucccccaaccccuugucugggauggacucauucaguauaaacacuaagagccucucuccagaucaguacccuuacacuccacauuuuggaugugauuucagggguuccgauuccucagacugcagaccagccuugcuuucagugcccccucugcuugccaccuaagaugaugggaccaguacucaaacaaaaaagccagcagccagacagaagucuaagcacucccccugucuugacaaaaccaucugccgucccuauguucauaaucucuagccccaacucuugcuacuuuucagcuaauguagccacuugcugguuguggcauggugcuuaguuuucgcuucauuuuaaaggugcccucuucuauggacucagugucugaagguggggauuugagcagaaagccaacacauuuugaaauauagaauugaaaaucuuuaauagagggaauggcgccuggcacacacaagauucugagugugaucccggcaccaccuccaaggugaagugacucauuagcuccaauuagucauaccacgauacugguuacuuauuuuaaaccaucaugucauuuuuugacauauuuaauuuuaguuuguaaauuaaaauagauuauuucuugguguguaugcaugugugugcauauguguuuaugcuuguauauguaugcacauguauguguagaggccagagggagaacuuuuucuggugacauccuuguuuaaaaaaauuuuuuucaugagcuaggaucucucacuggccugaaacucaccacauaggcuaggcuagccagguccaaggaaccaccuaucucugccucccaaacacuagggcugcagcacaccaccaucucacccugcccccauaauacacauccccgccccccccgcccccccccccccacacucacucucacacacucgcucugucucacccugccauggguucuggaaauuaaacucagguccuucugcuugcaagacaaggcacuuuacugacugagccaucucuccagcccuagcuagaccuuaguuagaaauuucuuaguuacuaauuucaguuguuuuuuuguuuguuuuauuuuguuuauguuuuguuuuguuuucaaggcauuuauuguagaaaggcagagagagggagaagaguagagaaguagagacuggcuauggccacguggagggggaggggaagggaagguagagagaggggaagcaagagggcaagagaauaagagagcaagaguuccuccuuucuccccccccccccaguuguuucuugauggcugcucuuggccuacuauuucucugggagaaaauucuuccuaucuuuguguuucacugugagagagaugauaggcagcgucuuuggguugaauuuccaguucuccuuuaauuauguuagcauccccaugucucugaagccaauauguuaggaaagucagccuguuacuugaggcaagauauggccuuucucggagccaucuuuuucuugaugcuggugaacauuguuagugcugugcucaaauaaaaucagggcuauaagaaaacagauuaaaagguuugcuuaaaauuuuuuuuuaacuuaaaaaaaaccccaguuuucccauauuuaccuugugauugccuaguaaguuuugacauguuuagcuaggagcuuauagagcucuuacagagauugguacaguggagaagaugggguuucaaacacagcgcucacccauguacaugaaaggcuauagcucuggauucugagauggggaccaagaagacgccugagggacagaugaacuucuuaguuaacguucagcuuuggauguagcugcugcugcugccuucuguauugcugcaaagcaaaacccacauuacuccaaggccuccugucagggccccagggcagagagaaggcacccgcuauuuggauagaaugucuguuaugcgucuuuacuuuugaugcuucgaagauaacgcuguacuuuccacauacaauaucuuagcgauugcauuuuaauuuuguuguaaaggggaaacaccuguuucuuucccucuagucaugaagaggggcccgcugcuaaaaaauauaaaacugagaaagaagaagaucacaucagcaucuccagccuggcagaagggaacaucaccaagguaaacugagcuuuuccagugucccucucucccuccacaggaaggccaagguuugggcuugaugagucugcugacauaccacucugucugguccucucuguaugugaaccauauaggccaaucccacguucuuccuuucuucccagaaguaauuaauaauagugaaugacauauagaauuauguguuggauuauaguaagcagaucucugaauaagauguagaccacagaaugccuucauuuugcauuuucuguugggucaagaugauaggauuaagugggggacaguuaaugauaugagucuuauuccccaaauguguaaaauugaaguaaguauaucuuuccugacuucuaaugcaaugcuucagaggcuggagagauggcucugauaguugagagcacccaaguucaguccccagcacccauaugggguggcucacagccuccugcaucuccagcuccagggaauccaacacuuacagagagaaucucuuauggacuguguggaagcaucaccugucaauaaaaagcugguggcguauuaacugaggcaggaacuagaaggcagacacuugguagagagagaaaauucagggaaagagucaguaacaggagguuucuuucuccuggacugaagggagaugagcggaugaaagcaggagagguagccaaggagagggccacauggcagacacagacuaaaauaaacagguuauauaaguuauaaacuagucagagaauaagcccaagcacuguaaugaauaauuaacucucagaguuguuauuguaggaacaaagaggcugggcaaaaaagcucauggcuacaaacaccuggcuuucucugguaccugcacuuaugugcacaagcucacacaaaguuacacauguguaauuuaaaaauauuaaaaaauaaaucuaaaaacacaaaccccaaaaaaccccuucgaaacagaauuugacuaggacuuuccaaaucaaauucccuuugauauggagagagucauuuaacgagaagguuuuuggaaccugaguguauuaccuucuuauguacagccuuucccuguuagcaaagucaaacagaaauaucucagaacaauugcaagucucaacaguggauuggauguggugggcaucuucuguaguauugagaagucaagaugucaugcucaggggcuuuucugcgcaggauuccgagcaaagcugaagcgguacacucucuuguaaaguuuacugacacucacgggaacccuuuguccucgccucuccgagcuaagugcugcagaggcuggguuagggcggagacugauuuggauuaaagaugggacagugugacaaagaguuguauugcuuuagaucuguuuauaugauuugguuuuucaguggauuuguucuguauggacaucuuuauguguucuaccaaaauuucagugccaaagguccaguagcaguaccucccccacucccugugggaaaaacaaacaaaacaagcaaacuguaguuuaguaggucuaacauuuggcuguuguugcuaaugucauccuaaggggaaauguauuuagcaugaccucacacaacaacguccucccuuuccuaacugguuugguauccgaauauacagguggucuuuaccacauaaaaccuucaagcugggccggcuaguggcuuggauuguaauacuuuugacuccucuggagacaaggcaccuugaaugaugaaagucaagugaaaagagacagggcaaccaaguaacugcuugaauuuuccagguuuuauuuucguucauguuuuaauauguauacaugugugcauacauacacauacgcaugcuccauguagaaauaagacaacuuggaagaauugauuuucucuuucuauccuguggaugcucugaguucagucuugcccaccccugaaucuucuaacuuuuaagagaguccuggaaaucaaaaugauagaaaggucuuuuuugucuuuaagagcacacuuacuauuuuaacccaucuaucuuaccuaacuaagguuugaugguuaguuuuaacuaucaacuuaacauagucuagaaucaucugggaauugagucacagugagcaacuaucuagaccagguuggccuaugggcaugucugaggagcauuaucuugcuuacauuaaucgaggugggaagaccugaccaccguagguggcaccaugcccuaggaaggggauucugcaguucagaagauuggacacuaccgugcacacauucacucauugcucuuuuccuguugauggaugugguaugaacagaucuccucacgcuucucccacugugacuucccugcuaugauggacuguaauccagaacugugaguaaaauaaacccuuucuccuggaagcuguuuuugucagcguuuuaccacagcgacgggaauggaauuaagauguaggauauugccaaaaugugaagugaccugcaagugugugaccugugggucuguucuagguuggaagugugaauccuguugaaaacuuccguuuccuaguaagacagaagauugccagcuuugaggaagguaagaggcaugccacucacuuggguuuaagagaagguagguagucuaauugacuuaagguuuggauucggagcugagguguucugcugcaaugguuucucaacaguggucuucaugggcugaucugugcugcuugccagggcuuacagaguuacagugggguggggguggucagcacagcacagacuggccagagaugagacuauagggccagucugccuauugcagaagcuuuggaucagaacuguggaacguuuauuuccuccuccuugaaguucuuugguguccuuugagugagguagaucccgucuuucuaucuuuugaaauacgauucuugcaccaguccccaccuguacagucucagaaggauguugcugcugcuucuaggcuggauucuucuuacuggccuuguccucaucuuuccuuagcacauaguacugguaacucuauucagguuguggcuaauaucaaaauaguuuacagagaugaaugaaugaaugacuuguuauauucacgugauuucauuauugcucaugaaauuuacucuuagaaaggcagcaaauaguaguuaguaaagcuguagguugguugguuuguuuguuuucuuuucucuuuuguugguuugagacaggguuuuucuguguagcccuggcugcucuggaacuugaucaggcuggccucaagcucagagaucggccucccucugccucugccucccaagugcuaggaauaaaggugugugccaccauggccagcaguuuuuauauucauucuggacauccauuuuugcuccccagagucaaguuguuuaugaguugccuuaucuauguguguuucucuucauguaugccuagaaaucucucuuccaacauggcagcuuuuuagugcaaaacugaaucuuagguaccacuccucccuaccuagcacagguguguacuccggggucuaacaggacaacuguacuggcucuguuauuggccagagacaagcauaaugcacuaagcucagaaggcaccaacaguucccaggucaggucccauuggcgggcacaccagaggccaagugcauguccuuuccugagaaugaucagccucuggugugaugaucugaggacagaaggggucuguguauguucuguguuugagacagaggaagaggcuuuugucuuguuaaguauuacuauauaggaaaaaauccuuuuaguuguaagacaaaagaaaccuucaucuaaacugggccuggugccacaugccuuuaaucccaucaauuggagaacagaggcaaauggaucucugagcuugaggccagccuggucuacagagauagguccaggacagccagggcuacacagagaaacccuggcucuuacaaacaaacaaacaaacaaacaaacagacaaacaaacaaacauccccuaaagccagagaccgaacaucccuucaucuaaacagaaggaaaucuagaagucugggcacaguuucaggaggaguggcagaacagugccuuagacaucaucugucacugggugugggucccagggcuuggcaggcagugguaggaagaucgccaucuccuuuuuuuuuuuuuuccccaugaauugacaucaucaguaaguaggcaagggacuuuuagaaugauuuuguguuuggaggccagauaaauuagaggaccauguugguguguguguguauguguauguaaaacuguuuuuuugucuucuuguuuuuuuuaagacagggucucagugugcaauccucuguggccuagaacucacucuguagaccagguuggccucugccucccaaguaccuguauuaaaaggagugagccaggcugggcgugguggcacaugccuuuaaucccagcacucaggaggcagaggcaggcggauuucuaaguucaaagccagccuggucuacagagugaguuccaggacagccagggauacacagagaaacccugucuuaaaaaauaaaaaaaaaggagugagccaauaauucuggcauguuagagaaagauuuaaaucuuagcuuuuaauugcuuauugucuggucagucaauguccaguacuguccucuggagguggcuggucuuccagauuccugugggauggucucuucagggaccaaauauggcuaugaucaccacugugcugucuacuguguacagaacguugggcuagcuuuauccuaguacucacuauccuaguauagcuggcacagcaguccugcagucacguugagaaaauggagaaaacguuagaacuuuggagggguguuugagagggccacuuuuauucaggaaacacuuggguggguguugagagcagaaagugaauccuugucccuaggcuuggucaucagucauuguaaggcuucagaagaagggaaaugcauagcugcuuagaaaguagaaauccuguggcuagaguggguucagugguuaagagcacugacugcucuuccagagguccugaguucaauucccagcaacaugguggcucacaaccaucuguaaugggauuccaugcccucuucuggugugucugaagacagcuacaguguacucacauauaugaaauaaauauauaaucaaauaaacaaauaaauaaaaggauuaaaaaaagaagguagcaaucccagagcuggaccuagagaggaggggugaggagggcugagaggaggugagagggggugagaggaagggaaagugagugaauuaaccaugggcauguuugugguuuucaccccggguucccauaugauaaccacaaaaccaagauggucgaaacuauagcuggcauugcccaguuuaugugcuguacugggugacaauggugaaggggaaguugaugucuggaauuacuuccacccaggcacagguguucucagaguacagaagaccaaaguuugaugagaacaugagaaagaaccuuccagagaaucucuuccaucuuaggaaaacaugguuccuuugagccacagcaauagggguuugaaucagucuuaggcauuaacaaggcaaacagaccacauggcauauagguuauaagagguaugguuauauucauuuugcugaugaaaaacaauguuacauuggaagagauggaccuaaaaaucacacagggguuugaacauaagccucauucacauacuggauuucccuauuuugccagauuguuucccuacauuuaauuugugcgugugcacguaugcacguaugcguucaugcaugcgugugugugugugugugugugugugugugcgugcgcgcgccagaagacaaccugcagcaguugguuuucuccuucugucacgugggucuccagaauccaccugaggucaucaggcuuggcaucgagcagcuuuacccacuacacuauuuugguggccccuuucccuacuucguacauaauaucacauaucuaaagccacgagucuguggugggccuuuugaucaggauguucuuuuacuuugaauguaaccuugccaguguugugacaguggaugcccucuguacuuccaccuaggguguggugaaucacagcuccccauggcugucaccagacuagaccugcccagauuguuaacuagcgcuuugugacuccuuucacaugcuugcuuccuccuauaaguuuuguguguucaucucgauugacucuuugugauccaggacuugcaguuccuugccuaggaaaguguacugaauccagauuugaagcacccucccuggucgugaucccugcaagagaccucugucugggcaaagagaacaggaaguccuacucguucuuuaauugauuggacagaaguuuaacuaauaguagauuguugguaauauuacuuagguagaacugaccauaucacugguuaaaauucaggaguccuucuuuucuguccugucuacuugcagcauagauccaccgauaccguggucaugccaucuucugaugguuaguaguccacaguagacagcuacacauuuccuuaucuucuguuuuucaauggggauggugauucauguucuaauuguauugguaguuuccuggcugcugggccuucugggagcugugguugaugcuuucucagguggcuuucuagugaguuccuuucccuguucccccugccacucugucaccacaguuuuacaauggagaaguuguuugaccaugacugcauacauaauagcauccuucaguugugaaagucagcucauuucccuguugauucacgcuguucauaagggggcugcuaucaccuaugguuuauuuauuaccuccgaggcuccugaaaucaaaucuuuucacuugugugaaugucuuuuucaacccagccguuaggagggcugcugaagaguacgcaaauuucuaacaccuucucuacucuacucaaaaagaaugcugaccugguuugaggguagacagcaagacagaggagaaacaauagcuacacagcucuagucauuucccaguucccacgugacugagauaugucugaacugauaaauuccacguuaauaugggauguuagauagaagagcuaggcucuuccugucagaaaagaaggacacguggagacagcuaguaggauagaacggaacuuacuuaguaaugagacgacuuucucauuccuggaucuggcuuuugccacauagauuaucgaaugaucuguuuuauguuagacuucugugcaguggcaggaacuggaacucuacuccaccaaauugaauuuuuauggacacgacuggcuuaaaagaaagugucguggcauuccagguggaaauggugcagaucccauccucugcaguucaucugacgcugacuuuauguguaagugaggagcgaugcacugugcccguuugauagaaaacacccaguuucuucuguagccuccaagcucuucucaauccccuccccuuuccuuuaguuucuuaagaucgaaucgcauccucaggucucugugucccccuuccucacugccuucuuuguauguuuuccuuaaaaaccauaagaaacauucucuuaaauguaagagaugcuuucuaaaguucauccccaaguucuccuggcacuagguuacgcacgcugugauugaguggugaugaacuuauguuauccaucaaagcucaggagaugcauuuuuccauccuguguuuguaugcuauugcuguuucauuuucacagacacuuauuuauauaaauauguuauuuuuuggccaugagucaauuaugaacuguggaucuuugagccuuaugaucuagaaucaaucaaucaaucaaucaaucaaucaaucaaucucuuucccuuucucucucucucucucucucucucucucucucucucucuuucucucucucucuccccccuuuuuguaguuuguccugauguauauaauuuugacuaugaauuagauaaucuuuugaaguuuugugcagauaaagauuagauuaucuugucaacuuaaagugcugcuaaauauuuugaacaucuuaaaagaagauacuaaauauggcgacuacuuguaaacaucuuuagacccauaauuuuuuuuuuaaaguuugacauacuuuuuuuauuccuuccccagaauagcucugaugcauguagucaugagggagagaauacacaauugccaguucuugguguuagacgauaauucauauuuuuuauuaaauauuuuuacuugcuucuuuuuugacuugauuuaaauuguuuagucuucgaacucgaggaucaggcuuauuucaugcaucauuuaucaggacaugucaucuuacucgaacauaaaagucuauguggacuccugaaggacuugcgaaagagguguguuacuauuugacacgguaauuagacaucaguggcccuuggagucaucuuccacuuggguggauugaggcccagaacaaucuggagggcuuacacauauuacugcaaauguguaaaagacacuguauccaguuccagagaggcaguucauggccuccguaacuuaaauuggcacacaacacuacccugaaauauacauuuuaguguaauaaaacuuaucagccaaaucauuaaaaugaaaugugaacuaaagaugaaaagagaaacuagaaauggcauuguauggaaacuagagauuaccauacaaguuaacuaucaugagagucuuuugaggagcucaaaccauggcuuaguugcuuaggugccuaccgugcaagcaugaggaccagaguuuagauucuuagcucucacauaaaauagcccaggcaugaugguggaugcucauaacucucuggggaggagagccaggugaugcuuggaguucauuggcuagcuagccuagccaaauuggugagaguucuguuagaggaaggcuggcaagaugguucaguggguaaauguucuuacuguguaaaccugaucucugggacccacauaaggugugagggaaccccaccucucugucucucugucccugucccucucucucucugucugucucucucacacacacauucucuuucuaucauaaugcuaauaauaaauuaaaaaaauaagguggaaaaugaagaaggcauuuuaauguugaccucuggucucuacaugguagugcucacacacacacgugugccuguaggggaacccugcuaauuaaggcugaauaagguugaagucuaccaugaccacauaacuccucugaguucaacacagaauuaccagcagggcuuccccuucucugaccuuguguugggagccugaccucccacacccucaaccuggggaagguugaauaguccuuggcagaccuacaaguccuggaugguuuguuuccucaugcagagccauaaagaggcuugcuugaaacuugauggauaagccccccuccccccagugggaaagauaccuuuuccucugggugaaaauaugaauuaaauuuugagauuuauuuuuauguauauguacauuuugcauacaugcauaucugugcaucauggguacagcaccugugaagguccugacaggagaagccaucagauccccugauacuggaguuacaggaaguagugagcugccacaugggugaugggaguugaacauagguccucuggaagagcaaucagugcuuuuauacuugagcaucuuuccaguuuccuaaguguagaacuuugucuuuccugcaucagauaguuagaagaggccaguaucuauacagacauuuccuucuacauacuaaaccaccagcuugcauuggugacggcugcugucaaggagacagggcacaacacucauaggugggcucuguggaaaggcagaauuuguagguacuuaggaggaaagggcaaugccauucagccugccaccagaguuuguacuugcacagaguuuguacuugcacgcgguaugauuuauaaggcagaaagcagugaagugcuuacucauuucaguuugcuuccccccauuccacugucuauagauucugagucuucuuugcaugguagaucguuggccuugcagacuguugcguuuggugcuugaauugggcugucuuaaagauugcuucucaggcccagcugguggaaaaaaaaaaccugauuucugauugugcugaugugcaaacugcuuuaaucaaugacuuaaagugacugcuaguggcaaacaacagaagcucuuaaccaauuaagauguuuaggaaaggauguuagacuuuucuuaaaaugggcacuaaucagcugaaauguguugagaggagcugaggagcagcuuggagucucacuuaaauguaauaaaagcgguccucuucuuucagauugcaagcccaaggccaaaaauacgcugacgcaggaagagguggcaaguaugauccggacagucaguccucuugggccaugcguagcuccaugggacuugaaacuaaaaauggcacaugcuuguuuccugggccagcaguggggaaggcauuugauucacacacagaagaauuuagcagagauuaggaauggugucagcagagauggcuguagaaaugagcugcuauuggaacaaaggccauucuuccuguucugucauuuccuguagucuuuuguauacaucggggcugguuuuccagcugagccuugguggcuguucccuaggagaaaugcgcaguguuuccccacugagguuuggcuccggaagucuccuguguagguuguagucacuguuggugccagcucucuacagcuguuuugaaggaaauguuugugcugugaggucucccuguaaguguguuuuaggggagcuuuuaugauuucguagagcuuuucugucacucuauggaaaaaauguuuucuuuccccuagaagcuccucgugucugccuggagucauuucuugcuucucauccuuccgugagcaaauacuuucugucugaagugaaguccuauuucuagaaaaaucuaguggaaucguucacuggcaguguuuugccuccagcuuuggacugaugguguuuuugagguaguccgcauuaguguauagcagaacuugaccccugugugucagcagguugcuuauuccucagcagcgcaaguacagagccuuaccuuugaccugcuuagcucuucaggagcaccaccucauguucauccaugauggacacgugcauugguucagauugugcugcucugacauuuguacgcaagggugcuuugcauguguugaacuuucugaaaaaaaauuuaaaauguauuauuauuauuauuguuacuaauuuguguguguguuuguauguuugugugcaugugcauguucaugugugugucugugcacuccuuugcauguguguauauaugcuuguggacuagccucaugcccuguauggaggucaaaggaggcuguucuuuuucuuccacaguggguuccagggauugaccccaaguuaucaggcaguuccacccaaugagcugucuuacugaucccauuuuaacuuuccagaagcagccacacucuuaaaaagaagccuaucauacaaacacacagcguuucuguugagauuguuuuaaaguguagcuguuuguauacuauucgugugucuuguguguguguauauguauguaugaauugacauuccaaguuuuugaugacuuuuaaccaguuuuaucauauugagauacagagauauguauguucugguuaaguuaauuauguaaguguguguguguuaugugugugugccacauguguguggacgcccacagaaguguguguguuaugugugugcgccacguguguguggacgcccacagaagcuuugacuccuagagaaggagucauggggaguugcgagccaccugaugagacuaaacuugggcccugugagagagcugugugcucaggagcaggcuuucaggucagguccaccucagaucuccagggccugugucccaaggggccgguaucuuccuucagggacuuacuuucaaccaagggcugugucaguauucaccuugguuuuaaauucuaggccucucacugguuuggagcucaguauauaaccugggcugcuggucuuuucuuacauaggccuuuacagccagacauccaaucugagcaguucuucagccguacauccuaaauuguguguugugagcuuaguuuuuaacauuuuccaguaucuuucaugauuuuuuuuuuuuuuuugagacaggguuucucuguguagcccuggcuguccuggaacucacuuuguagaccaggcuggccucgaacccagaaagcuugccucugccucccaagugcugggacuaaaggcgucugccaccacgcccggcuccccuggguuauuuugaaacauuuguuuuauuuguuuggcuuugccuuuugagucagggucucauuauguaguucaggcugcccuugaaccugcuauauccuguacaccagucuggccuugaacucauuucuuuuucccuuagccuuccagguucuggaauuacagacaugugccacuaugccaagcaauaaauguauuaugaauuuuucaaauauugacaacuuuccaacucacuguugguuuugaauugaauucugcuaugauuaaaaagcauuaggaauaguguggagccuuuuucugagaccuuuuauggcuuaccacauaguuuccacugacauguucccuguggccuaacaaggcgagugcauucugcugcccuuagcugaaggguucugggaguguugguuuggcugaucauuuguucugaugcaugucuuuguugauuuucuaucuagugcuggguauugaaaguuauucaccucgagagcuuuugagcuagugagaccuuuguaaucuucgucacuuacagaggugaauuucuacacggcaccaaaaagaaaacguggucacaaguuaucaucguuuuagaaaaaugaacucagauacauuuguugcaagguuauacuuguuuuuagaacccucuaccuuucaaaaagaauuuguucauaucguuaaaagguaaggauauucaggguaggaaauauuauauagauuucagaauuucuuagagcauaaaggucauuccuugugagacacaaacagaauuuuaauaacaguagaugcuuuagugucuugggucuuacaccaguguuuauaauuggcagaauuguugguuuguuacuccuuucaucugggcucuuucuuuuaugcuacuuuuauuaagcucauguuauucuuucaucuuauguacugaaaagaaaaugcauauggaauaaucuaggauauauuauuccauaauuuguuccauuucuuuuuuuucaauauauuuaaaaauguuuauuaaaauuuuuuacacauguguaaaauauauauauauauauauuuauguguguauauauacauauauaauauguguauguguauauauauauaaauauauauauaaauaaauaauguguuugcgugugugugugagugugaaugccauguguguauaaguagguaccugcagugagcaguuaaagagggucagauccuggagcuggaguuuuagacaguugugagcugccauaugggugcugggaguugaaccugggucaucuggaagaguagccagugcucuuaaccauugagucauuuuucuagcacccuaaaauggauuuuugagggauuggaggugguucagaaccaccuguagcuguaguuccagaguguccuacccugucuucugacuuuuuuagguaugaggaaggcacaaggugcacauacauauaggaggcaaaagcuuacacacacacacacacacacacacacacacacacacacucacacucccccaauagacagaaacgacaacaaaaaauuaauaaaauuauuuuuaaaguuauuuuugaauugaugcuuaaaauaaaaauugaacauauuaaugagguaguaugauauguuaaacauuuuugaaaugacuuuuauuuguguaaguauuuugucugcaugugaguuagaaaauacauacaggauaauguaggcugcauuacagcaagugugccugguaccugagggagaaggucauaagaaggugugggcucccugguuuggaguucuagauaguuguaagacagucucgacuuuguugugaaaggaaccucgacaagagacugucuagacuagggugguuggugugucuaugggggauuauguugauuguguuaacuaggugggaagacuugcccacugugggugacaucauuccauucuggacuguguuaguggagagaaaucuagcuaaagacaaaaauacauucauuacuucauugcuuucugcccuugagcauggauguguagugugacucacuguuucaaguucuuguagccuugacuuccacacugaagaauuguaaccugaauugugagcaaaauaaaccuuuucccucucaaauugcuuuugccaggguaauuuaucacagcaacaggaaaagaaacaaaggcagugugucuacauauaauuacgaucauacuggacaugucucaaccccuguguuguauauaguuucuuacauagcucauucuuuguggauuuucuuaauccauuaaacaucauugaaacuguuuccauuucuguaaaauuaaaaggaguuggagacucucuguuuccuuaagugaauagcaaauauacaguauguuauuuuaaauuaaaggaacuccaagaaagcaccuucauuccaagagguuuuagaagaucagaccagugagacuuguaucauuuguucauggacuuagcaaagguuuguugaauguugucugugagccaguuauaauggcaagacauagauagcaaacaaaauacugugugugcuccauagugauuuguaccuaguaguuuccuagugcuccuggagcggaguuagacaaauugacuuaaagcaucagagaaugcuucaaauucauggccgcuuuuuccuuaauuguuguugggagugcauguauguauauaaauacaaccuguuuggacuguauacugauacuccuacguauguuuuuagggcugaucauuugguguuggauaacuaguugcauauuuuucccuggggaagauugcuucuucuauagcuuaucugacauuuuuaggagacauaaucucacagccaacuuccuguuccucuggcucuuacaaucuuucugcccccucuucaggaaugaucccugagucuuagguacaggaguuguagauguauucuuggaugcuguuaauaauguauugcucaauuaaaaaaaaaaaagaaaagaaaaaacaaugaagauugcugucaccauucuggagauuggaagccugaacuccaugcuuggcaaacuuuguuucuuuugaggacucaaggggaaucuguuuaguggcucuguguaacuuuuggugauaccuggcuaugcuuggugcucuuggcuuaugauauauuacuguagccucugcuuccuucuaacauggaauucaucauauguauuugugucuaaauuugcuguugcuuagugaccucaucuuaauuaugucuccaagggucuuauuuccaaguaaggucacauugucagguucuaaauuggacaugaauuuugggagaaaucuauccagcugauuacaguauuauaaagggagauuauacagaaugauaggacugggccuucuguaguaagggauucugugcuacugugcaaagggucggagaccucacuguuguggaaggaagaguccagugagugcucauuauguuugcaggcaggaacaacaugcuccucuaaagcagaccaugcacggcugcucuucaggaaagccagugcggucccuggaggacagaaggagagggguuagagcaguagcuggacagguaucccagagaucuggaucuucaggaaaccacugaagggugaugagccggagcggaucugauugaccuaugacuuaugccucugugaaagagguagacaugauggaggcaggugauugaauacuggguuaaaucgucauggugcguggaggggaggugguggggguggggugggggaagcaaggauuagugagaagaagucuugaugggguuugaguguacaguuggcaguuuugcugaucaggucugggaggaagaagggugacucccaguauuuuugccucgagcaucuagaaggaauugccauggaugagagcggagugucaugugauguugguuaucaaaucuggacuuaauuacuuccgggggaauugaccacagaaccgauccauagagccaugagacuggaugugauccuucagcagggaaggugugcagggaagauguuauguaguagagggaagacaggugagcaguggcugaggaaguguccaaagguaggucauaaagguuggguaagagaucccccaaaguacccugaacacuuucuaauguuuaugguguuggcggcaccuuucccaaauauguuuuuguuauuuuugucccuucacugucugacuguuuuagaccacuuccgagucacuuuuaagugcccuucauuucuaaauucauucucucagaucuuuccauccuaaguacugcugugcuaucccaagcuuucauucuuucaccacuggucagauccagcauccuauguuaguuauccauaaaguucuuaucuucagucuagcccaugaguuuguauagauuuagcuuagaguaugcaggucagcccuuuuuaaucaugcaccaugucuuugaaaucaguccaccaucuaagacuuacugccaugcucugacacauucacauuauucucauggucucuucugcgaaaccuauacucaaaccguauucccagugaucccuuccagacgggagcuuucuuuucugucuaugcuugcucaugcuuuucuaucugaaaaacaaaaacccauuaucuuuucucuuucccagacguacucugaaaaugccuuugcuuucagagccuauagguaguaaugucuaguuauuguuuucuuauaguauauguaauuuguuaucuugguaauguaguuagugaguccaucaccagugagacaaaaugacuaaaauguuuuccucugaugccugcaccccgccagcucauagugagcuacuuuguucguguuguuaacucuaacagaugagagcuuggaaggaacaaaaauuugaauuuuugaguugcaccagaauuuuuucuuugauuauuucaaucaguuuccaaauucuaaaccuaagaaagaagaaacagaacauauuaguuacuuuucucacugcaauggcacaauucuugacaacagcaucuugcagaagaaauucuuuauuuuggcucacaguuuguagggagacuguccuuaguaguagggaaaacauggcagcaggaugugagguagcugcucacacugcagccacagccaugagucagagagacaugaaugcugguucucugcuuguuuucucuuauuuucagucugggacccaguccaugaguugucacuuaugucuuagucaauguuccguuucugugaaggaagagacacacacucacuacagcaacucuuauagaggaaaauauuucauuggggguggucuacagguucagagccuuaguucguuaucaucauggugggaaacauguggcagguaggcagacaaggugcuggagugguagcuaagaguucuacaucuugauccccaggcagcaggaagagaaagagauacugggcuugguuugagcauuggaaaccucaaagcacacacgcagugacacucuuccucuaacaaggccacaccuacuccaacaaggccagacuuccuaauagugccacucccuagugaccaagcauaugagucuguggggcuauuccuguucaaaccaccacaacuacucacauugaagguggguuuucucucaguuaaacucuggaaauucccucaaagauacaacagagauauguuuccuaggugaucccaaguccaggagaguuggcaaagaagauuaacuaccaccuagagaaauauagcuuuucuguauuuugaacucuagauauuaaauguucuucauuaagcaauagaaaauaauguaaaugagagaaaaaggagacgaucugaggaguucuuaaggaaaggagcuggauuaacaaaggguguuaguggaguucuagaggauuuauguagaauaugguuuucugaaaugccugguagugauauuucaagagugacgcagauucuugaugugcuguguaaacagugugcugccucugcucuggugugcacagaagcaccuuucauugcuggcugccuguguggaggcugacucaucacucacucuggagugucagcugauacaugaauuucaauuucauucaauuaccaaguuuuaauuggaucccauugccagacugguccccuguuccagacugucuccucuaagcuaugcuguuacuauggcuacuugguuccuucugcuuuaucccugaugucaucccugcagcaguggaugacaucaacaccuacucagguagacuccagacaguuacugcaaagcacugucaccuugcacuugcuuucuucuuacuguccaucuggaauaggagcagaccauggugguaaggcucuuaauuucccuguaucucuuuuacuuaguaacuuuugccaaguguaagaguucugggaccuuaggaacuuguggaagccaucuuucucuucccuuccugacucucaaugagcccagugcauucuuuuaggaguauggcauauacuguacauaaccaucugucguacaguuuacauaaaugagccaaaagacaucgcuugcguauuuaacagaaugucuuccuuugcuugcuugcuuaugguagcuugguguagguuuuuuuuuuuuuucucucccucucucuucaaauguauuucuuuuuuucuggagcuggagaggaugaaucauuucagagagagaauaaucuuuguucuguauuacacugcuauguugcuauauuucuuguguuaauugaugaucuuuaugcuuucugagaaauguucagugggcuuuuaauguuuaacauauguguuuuuaaugaaaaaaaaaaccaacaaaaucauaauaugcuauggaguucuuccauugaccauggaauuuaaaaauugccaucggcccuggaggagaucuggucuuaaaaccaacuguuucagaugaggaauacuauccauccagauuuuagaaugauauguuguuaugcuuuguaucaugugcuuggguucacagccuacaaccucaccucacuggauguuacuuuucuaguuucuucuuagcucacacuacaggguaaacuaaggucgagaggccuucaauaucuuccuuucuuguagcuacagaaguaggacucacaguuaacacaaauaaaaacaaaaauaaaacaagagagcucucauaguccuuaggaauagaaucugacaauaaagacuugcauuuacucugcucccugcgccugcgguuuuaauuuaacacaucaaugaaaagacagcauuuaaaaagggagggaacacccagcaggacuuacuuuuauuagugcaauuuguaagaaauuacugcauuuaaugagaaaaucguuaagcaugaaaaaaacgggcugagauggaacuuguggagcuuagagggugagguuuuaauugaguuuuuuacuuauuggagagagauggugauaacgaugauguuguuguuaauaauaauaauaaucgucuggggcugcaccucuucuaugaggaggucagcacucuguauuuaguucugcuccccugcuacccagcaugcguagugugauaguguuggggacccuuguguaccuguggacccuuuuucucuuucugugaggaagccacagcauugugcuaacugggggauuaggaggcagaucccugcagaacaguuccuaaggggcaaaggacaaaagaggcaaagggcgagugaugugucccucacugcugcgugaacaggcaauuucagaggccauuuucaggcucauaaacuuuaugccuuuuugaaaaguucugugucuuuugauuucuuuuuccccaaugagaauauucacuagaauuuguaaaaauggaagcaaggaacacagacauccaaggaaaacuucuuggaaucuuagguuaagaaauaaaucggggugggguuggagagauggcucagugguuaagagcacugacugcucuuccagagguccugaguucaauucccagcaaccacauggaggcucacaaucaucuguaaugggaucugaugcccucuucuggugugucugaagauagcuacaguguacucauauaaauaaaauaaauaaauacauuuuuaaaaaaagaaagaaaaaagaaagaaaucagccugucuuuuguuguuuggggaaaaguauuuaaaauaccuucuuuuuguacuuagcuacuuaccaguuugaccccugugaggacauggguccuaugggagucacucaguuacuucuaggaccuccuguauauuuccacaaucauguggugguaugguaacugcuguuguguccucccauguuaaauaucauauauauauauauauauguauauauauauauauauaaaauaaaauauguauauacacacauauauauaugaaauauauauauauauaugaaauguaugccacuuagauaaagcuguuauacguaguaaaacuaaugguuauuaugugacucucuuucuguagaguaaaacuuauuaaauaaaaaaagcaaacaucuaguaaaaguuucagaugugcuggugaagcuuuguagccacuuaauuggguuuuguugugucccaccucauuagagaggaaagagaaaguguugcaaaggcugucuuacuuuaucguuuauauuaaauaauaccuuguucauauccaguucuccuggaaauauccaguucaaacaaagggguggucauuuuuguuaccucaugauaaaggcacacaccagguggcccguagaucuaaaccucacucuaccccuguacacauugcauggucaaggccugggaggcccaggcggccccuugccaguugccuuucccauucuccuaggucuauagacuucugcaggguucagucaaagggaaauugugacagaaaaacgguauggggauuggcggaaaugucagaguaucuccuuuccugugaugggcagcaucucugguccuucauggcucugccuccaguuaccccauauucccuguucuuuuugcaacauggcacaagguacuaaaggcugcuugccaugugcugcuugcuucugccuuacauggauggcuucauagcucuucauccugcgaguaaggacugcuuggguuacauuuccuguggcaaauauuuaaagcgaauucuuuccuucuggcugauaaacuugcaagcucuacccacagcagcugauucauauccuagaucagugguucucaaccuuccuaacacugccacccuuuaauacaguuccucauguugugcugaccccaaccauaaaauuauuucguugcuacuucauaccuguaaauuugcuaccuuugugagucauaauguaaaucucuguuuucugauggugcuaggugaccccugugaaaguguuguuugacccccaaagggguugugccacacagguugagaacugcuguccuaaagagaaacaaaaagggagccauuuugugaucauuuuagcugccuguuguaaaaucuacaccacagacucccuuuuauuaucgagcacauauccuuuccaacuuucuggcuugaagcagggguuguaauuuccaugucgauuccauuggugaaagacuccuugccuagagucuuaucugcugaugggcaucauucauuuuuauucuguuagugauauccuaacauuauguuuauuugauuuaaaugccuacauuuuuauuguugccuuauaauuuuuaaaaguaaagauaccacugucacuaggaauauaaaucuguuuuugccauuuaaaaauuauuuaacuacugauaccugaaaaaugagcaguaagcagacuucccaugaggcggugcagccggaagggaaauucagaagggagacauccugaaugaugcucggauccaauaaagccauccauccaggaugcugucagguugucauauacgguaugugaccaaggggggagccuaccacucucuuugcuguuagauaagaagaaaacccauaguuacuuucuuucauuugaaugaaaauaucuuuauaggucagagggguggguaaggggcaggcuagguuguggccccagauguccuggcccuuguuaccaugcacugagaaggaggguaguagucuguuguauaggacuuggggugguauuuuguagagggaagguaugcauuucagauaaaacaagaggagucucguuuuccucugauggaacacaucugagucuagaaauccuuugagugugacaugguugcuuggcucguuucacuuaugaacaagaucuggacuacuguauuaagcccauguacagccugaaucuagaauagauaucuuugaagccucuuugagauaaaugauggccuguaguauccuaagauggauacuccuuccaggggccaauuuuuauauuugcuacuaauaaguguugagucacuggcuaauucugaaggacauuuuggugcauuauaauuggaucugugacuuagggagaauggagacugucagucugucucuuagcccuguuauugcuauagaagcagagaagccccugguuaucagcaucuccuucauacagcagaacaggggaaccaaaagcauaaaccagcuaggaagaaguacuggguuuucccagucguuuuguuuguuuuuuguuuuguuuuguuuuggguuuuuuuuuuuuuuuuuuuuuugcaguuuacuauauuaaagauggcagggaaaugggcucugcccccaaauguuggaauggaagucucuuguccacaucucuucuaauauucaguauguaaagcguuauccaccacagcuaugcccugauguuaaaugguucauuauagucagugaaccacaaaauugucuggguaaaggggcagaauucagaaucaggggccagaugcaccugccugcuucuaaaggacaaaaacccagcccuucgucuucacuggauuguuggaaggucgguguguuuaucugccugaguuucucaaccucgugggggaaaggacaaggcagucugauagacaaaauccgaauagguucuuggguuccgagaguaucguucucaaauguaaaugggacgccgagacgccuucauucuccguguaacuucuucaccacaucaccauugugcauggacaggcagcuuugguauuugcugauuuuauuugaguuuggguauuuucuccguaaacuggucugugucucugucucuuuaaugcuggugagugugaguguguuugugaguauagucuguaugaguguguucuuucauauuucaggauaagcagguaaggaaacgguuuuugugaaauaguucaguaucuccucucuucauuguuuaaugggcucccgugcuagacaacauaaucuguuaucacuugauccuuuguguuuuuauguauuucuuuguagauuuuucccgcgcgcgcgcagggacaggcacacuauggugcuccuguagagggcaacuuguagaaauguauucucuccguuucucuuguggguuccagggacugaagucagaucaucaggcuugguggcaagcgcccuuacccacugagccaucuggcccuuucauagcuguuucauaaaaugugggcacagagucucucccuucuucuucuguuaauucccaugcuccaaguccugguuuauauguuccugcgaacuuccuucuugacuuccugccaagcucccacuccucugucugucuuuaaauguccuuuccaaguccuuggccuugaacccuuucuaauucuauucuuucaaaggagccaggcuccacccucaucacaaauaugcacucucaugaugcuuccgugcgccagagcuucccggccaacucugacuccuucuucccuuacucuugcccagucacuccaggcacucucccucuccuacccucccuucccauuucuuuguguguguguguguguguguguguguguguguguguguagaggccagaggucaauuugggguaucucccucuauuacucuucaccuuacuucugagauagcaccucucacuuagccuggaacccaccaauuuaaaucggcuagacugccuagccaaggugcccugggauccuucuuuacagggcugcuggggagcugaacucauguccuuguguugugagcacucuaugugcuaagccugggcuguuggagagaaaagccagcugcuggaagaaagccaccuucuaccuuucauugcucaguuaagaaccauguucacuggugaugccuccugaaucaccaacaauuuaaaguucaugugauuucauaacauucauagccuucuucauuauuuacacccaguuguuguuguuguuguuauuauuauuaguguguguauauauuacauuccccaggagccuguuuaguccucagagggaagggauuuaccuuaaacuuauugaauccuaaggaacacugcauccuauccuguacacagcagucacacaauaaauaugaacuaggacaagcugaugaaguggcugguaaacuaagcaaagagaaacaguuacgccauagcuuccuaagauacuucauccucaucucagaagaaauggaggacuugggguauuugggauuaguguccuuaaccucgaaggaaauuuauuugugccuagagagauaaugcuaagugaacuucuuaucaaaccaucugcaaaaggagcugucgugaacuguauuagaaacgccagccauuugguuauuuugcuuuugcaagcugaaaagagaaacugcuuuguuugcuuugaguuucuuguugacgguucucuccugccagguaaucaggguuguauuacuuaccucccuaagacgaccauuggaacgugcugugucuccuuugaauaguguguggauauuaauuuacugccagaggacacauugggggagauuucugaaauugcauagggaaguguuucuuuaauccucaaauuugucaaaugcuuuauaauaauggagaucauaaucuccggguuggaaggagaaauggaaugguucuuggggauauuuuuuccuuccugagaaauugcuauaugagaugagaaaaugcuucauucguuuuucuuucugcaugcuuuaaggucuuccggaaaugaguagauggcacugauucaggucuuuuguaagaggcugaacaguguucaggucucugauucauagaguuaguggccgcgagcccucaccggcgacucuuaaaagcaguuugcuuuaauauugcacucucacauacauuuuaaacagaauguucaaaugaggucaugauuuugggaaauagcagccauagguauaucagcauugccccagaaguugucaggcagccaggcagugcguggcuccaggaaugagggagagcgugcccguaggcaugaugucccguuuccauugguuucuucugcugaggccaaggcauguucccauuguccucugcuguuuucaugcugaaggguucuuuuuucuuuguuagugaggcagccacaaguuucagcuugccuugcaaaugauaacauuauuaauguccuucugcuuuccaagccauuuauauguugccugcuagcagcuauuggguauuaaguacccagagcuagugcagugcugagaagcacgggaaauauucagguccaggaagggcacagauacaguaaugaucgcucauucugacgacgaaugugggcugcucuuucccagugcgaucugggauugguaaaggguaggccgugcuagcucguuacuuuucauugccuggugcuguuugacaguuacuuacccuaagucucagaguugggggaggaacuggaggauucauuucugaugaauauuuuaagcaagguaguuuugaauuguucaaacuaaaacaacaacaacaacaacaacaacaaaacaucaccaccaccaccaaaccaccaacccuccccccccaagauuuauaaugaaacaagcaaauaaaaacauaaaacaaaccauccuacuacaaccugcagaaggaaaacuuagguauaauuuuaggcacuuaauuucuaggcacuaaaauucuagaaauuuaauuuuauuucuugacaaauaguguuaccaaauuucuuuauucaaaagauuuacuauuuuuaauuauauguguguguaugugucuguguaaguguauaugcaugugacugcagugcccacaggagccagaagagggcaucagcuauccuagaucuagauuaagagacuguugugagcugcccgauguggguguugggaacagaacucucagccucuagaagaacaguacaucacgugcucguaacuacugaacuguuucucuaccucuuuaccaaaucucuuuccuuuuccuuuuccuuuuccuuuuccuuuuccuuuuccuuuuccuuuuccuuuuccuuuuccuuuuucuccuugccucgccucucugccucgccucuccccucugccucuccccucugccucuccccucugccucuccucuccucugccucuccucuccucuccucuccucuccucuccucuccucuccucuccucuccucuccucuccccuccccuccccuccccuccccuccccuccccuccccuccccuccccuccccuccccuccccuccccuccccuccccucuucuucuuuucuuuccuuuccuuuccuuuccuuuccuuuccuuuccuuuucuuuucuuuucuuuucuuuucuuucuguguuuguuugguugguuuugcucuguuuuguuucgugagauaggguuccuuuguguagcccuggcuguccugcccgugcuuuguagaccaggcuggccucaaacuuaaauagaucugccugucuuugucuccugaauacugggacuaaaggcguucaccaccaugucuugcaccaaaguucuuaaauaccuacuuuuaagauaggauuuugcaucaucucccucccuaaagaaacuuggcaaguaugcaugcagauuccgagacucuugaccaagaguucacccuuacagcuguguuccaagaauuguacuauguucucacaaacauccccaugccugagagaauaaaucuauuaucuuauauucuagcgagucuccaguuaauaagucacaucgaacaauuuuuggauaccaaugaaacacuguauuuuaugaaaaguauggacugcaucaaagcuuuccgggaggaggccauucaggugagugugcucacccgucucccagcagcugacggcaggggcacgcagcgucccacagguaagccuagcuuguggaaagcaucguucucacggucaauugugcaguaugccaaguggaaaugaccaaacgugccugucaucgucaucucucgggaggaguggaggucguggugugguagguggggauaaacuaacucaucuaggaaaauugaugaaagguauauaugagugugagugcugagagggauuuauagagaugggauagguguaugaaugccaggagaaacaaagaacccuacacacagcaguaguuucccagugcuguaagugaguuuucuucauuuuguuagggacuuacagaaaacacuuauaaaccucuaucagauuauuugugggccuuuuucccucuaagcaagaagugagccaguuugaaauggaagguguguuuuaaaguuggcacagugguugagugugucuuugugcaggugcugaugaaauaucugcugaauaaauaaauauuugauuaauucaggugcuuauggagaaugacaggaaaauuagaaaauggcugaaauuagaauaaaagacucggaaguagaugauacagacacgccacagauuaaaaacaaugaaauuuuggaaaagcagaaccaagaaaaggcuaagggugguccagacgagugcccuguucccaccacgagucagguuaggacuugggugggaaaacagaaggaaggcuaggacuguuccucucagcagccuguguggacgggcccugugcuucaucugcaucacauaacaaagaagagagcaagguggaagaggagcaaaagagaccagagacagauugguccuucuucauguagaccuguguuaagaguaaaauuaguuuuuuuaaaaagaacaugaaauucaucgaaagaaacaaaauaccaaguggaucuuugcucccuagagaccuuucagauccucugguacaugauggcauauauuucuccuuuccuuccccucugaguggucucccugacgacugucagggucucagugguccugacuggcuuagaacucucaauauagauaaggcugaccuugcauuccucauccccuacccuccaucccccugugcuaggaugcuaggcauguuccagggagccaagauguguaugucucuuaaguaaaauacauauuuuagaaaugacauauagaaagauuuauaauugaaauaauaugacuaaaguuaagugacuugggcugugagaggcagggguggagacaguccaagauugguuguuacugcuggauaacgcagcccagugagggccuauggucagucucucguaaucacaaagugauacaaagauagauaaauugaccaaucuuauagucaaauaaaugaucagggcaugagcauccaguaaacuguaaguucuacgcugccaagaucucuguggcuccuggcugugugccuucuguggauagacggcucucuguuucucaaagaacagagcagucugaguugccggcuuccaguuacggaaguacauucuuucugauggauucaagugcagugcauugguugaaggauguuugcuugcucugacuugcuucuuguucccuguccaccuccaguuuucagaagaacagcgcuucaacagcuuccuggaagcccuucgagagaaaguggaaauuaagcaauuaaaucauuucugggaaauuguuguucaggguaagguggugguguuuucuucaaauauuuaugcuacuuaaaauauacauaaaaacuuuccuuuuaaguuuuucauuuucgugugugguaugcauguaugugaguaugcauguuuguauguuuggggcacuuacaugcgugcgugugugugugugugugugugugugugugugugugugcacaugcauguggaagcccaugguugauucuggaaagcaucuccauuguuuuccaccuuacuuuguagauggaguuacucugaucaccaaagacgaaggcccaggaagcucuaucacagcugaggaagccacaaagguaucgagagccaaugcccucccugucuuuagacgaguuaccccaugagggagcuccuuacacagugaacacauuccuuaccagccaggucaacagccucagcugcagcugcacucccagaacaggcacgcagccuguucuuguucccaugguugugucucuagaagccaccuguaguccuggcuucaguaacuacagaacuguuaaacgucauagcccauuuccuuuguagcccagauccuaauacaagcugugacagaccacucucccaccccucucuuucccaccuuaaauuuuuguuuaaaugacauugggugggugggugggugugggugugguggagugugugacaugcagugguucaugacgcaugcaugaaugucugaaacaagugcgggcauuggucggcuccuaccgucguguggguuccagggguuaaauuaguuugucagacuugauggcaaacacacuuacccacugagccaugggcugcacccucccagucucucuuaaauacugguuaaacagcaaaggcugcgcggcgauccacgguagaguuauuggcuaaaauagcaugccugagguacuggauuuguucccuugcacuaaaaacaaaacaaagagagagacuccaaagauucugcugguuugaggcaggucugaggagugauuuguuugugguuuuaaagcuauucuugugaauauguuguggagcugguagagaaagacucccauucuagcacuggacuagccagguguuuucaaugaaugaccuccacauauacagaacccacagcuuuugauuggcacauuuguuaggcuaaggccuccuuguuugauguuuugaauauuaaaucugacucagcugucagucaaauauauguagcuauuuaguucaguaauucuucuuuguacuucaagguuguaaugaaauuuuuaugaaauuacauugaguagcucaggguacaugguuuauaacagccugcuucaguugcagacacaggcugaccucgucucacgagcacaggaccugggagcuggcaguagacugagcuguggcaucauagucauuggcuuagguacuaacacuggccccuagaagcucagguggucaguucugggugcauagggcugugcugaagacucagagguaagcacaguggggaaggagaacuuggccuggggcuggagagccagaguagcuguaaggaauggcaggggcaagacugggaauggucauuauucaucuaccuucaggccaaauggaaaaugccaggaauuuucaacucagaaaaggcauuagacaggaaccaaaguaguauucaggagaaaaguuagcuaauuuuuacugaguauuuugauuugaaguuuuuuuuccuuguuuauuuauuuauuuauuuuuguuuguuuguuuguuuuuuuuuuuuuuuuuuuuuuuugguaacagggucuauagccuaggcaggccuugaucucuccauguagcugaggaaggccuugaacuugaaaacaaaaucauuguguguguguguguguguguguguguguguauaccuguauguucauugugaguacagguacgcucaugcuaugacaugggugugguggucagaggacaaucuuggguauuauuauacuugucuuccuguuugagacagggucucuucucaccacugccugugacagugucacuggcccaucagcuucuggggcgucugcuguuccuccuucccaucuuacuguaggaacccugggauuacagauggcacuacagccuccugcuuucacagggcuacugaggacccaaaugcaggucuucaugcuuguucaucacaugccuuuccuacugagccaucuccucagcuuggccuugaauucugaccuugcugccuccaacuucccagucuugcgauuacagguguacauccccacacuggugccugcagugcugggaauugaacccagggccuugcgcuuuacugcagaagcacucugcuaccugaccugugcuacauacgucuuuguuaugaacaggcaugggccugcucuugagcauggagaucauagagcucagaagaaugcucugccaucucaguguccacaauaccuggagcuacuucugccacaguugguacugggaacccugggcuugagagcguugcucaaaugugcagcuucauuucugucacuuuauacagugcugaaaucaaucaguguccucaaagaaacaccauuagaagagagggaggcagagagagagagagagagauugauugauuguaucuguuuaacccagaccuuauaaaaagaaagaaauuccaugguuuucugcauuuaaguuuggcuuaaaguuagacuagaaaauaaaaagugaccugaauugggaaaaugucagucaccacauuguauuauccuacaacuugaucuuuuuauagaaggagagcacucaguaaguguucaguugucggccuccccuugcaggcacacacaagcugaguguggguauaggcuuuuuaugccaagccucgcuagggaggaccucaaaucauaacugguaaagacagguacuuugauugucuuuauccuucgugaugaugggugcuggcugccacugacccaugaccuuauacaguuaaaaauaacagagugugucccuucagaagcaaaggcugucucaagguaacgucgucaaugggaagggaauuuaucugucagucucuguuccccacagaugacaagacucaucuagacacaucuuaugcacguuaucagggagaugagagcuuugggucgugccugccaccaccguugcagucucuuguccagcaaagagaggucuagcugacuuuaaggcaccugcugugucauccaaggcugauuggaugucauccugauuggaugaggcuuacuaacauuaucaaggguguucuuaaagucaguuuuuauaaacguucaucuuaccuacaaaauaucaucacagcaacauccagacagcauuugaggggacagcugggugucaggccuagggaguaaagcucugccagucagcucuugcuaaacauagucaguucacguauaaguuaauucuaaucacuaugugcuaugaaauucugucaucuugcugagauugacuacguauuccaauuuuuaaagaaaguggggaaugcugauguucagaagguaggcuuuccucccagcaacacaucuuagccaaaaaugucacaucuccguggauauggaguuagagaaggaaggaaucuaaagggauacagccuuuucagacugugugaggcaauacugcacguguggugucuucuuccagaguaaagagcacagagccuaugcagcaggaguuuuaauagcugaugauuaagcuuuagagggaaguguaagcuaauuguuagggauaagguagaguccuuagaugauucuaguaucacagaacugaugcaguuugaguuuaagacaacucuggggcugucaccaucuuugaguagacguagcauagugagcacaggugggaacagcucuccugucacuggcugccugguuccuucuugcauguggaacaguguuucacuagcaguaaaacuccacuuuaugucaguugagagcccaggaagugcagcugaauccauggaggaggaguagcucagugagaggcucugcgguaagcauuauccuauagccacugccaaaguacauuacguaucagccuugcagauuacauagugcgucaagaaaacaccauuuucuuucuuuuuuucacauuuuuagugcuucuacuaauuuaauauuuuaugcauguguguguauguacauguguguguguaauguguguauauaguuguaugugggauacauguaccuguguauacauggaggccagaggaagauaucuucuuucaaauuuaagauacccugcucuaucaugcuccaccauaguccucugagaaagagagucaugauuuggcugugauaaaacaccauaacagaaagcaacuuaggggccaaaggguuuauuugacuuccacuuccagguugcaguaccucauugugggacagaagcaaccggucauaaccagcaaagagcagagaaugaauguauacaugcuuaucuauguuccaaaaacaaggaauguuuugauuauaugcuuuucccuuccccaacuccucucauaucuuucucaccucccuacccauccaacuucauguucuuucccuccuccaucucaaaaagcaacaauaaaaccaaaacccaaaagaacacauccauugcaagaagaugccucucucgcgaggguccagucaugcacuggccuaugggcauagcaguuucauuaggagccauauuauugcuguauuccuuuagcagaacaguacuugauuuuccccuaggcccaaugacuuaguuagccuuagauccuuggccacuuuugcaguguugggugcagguuccaucucaugggaugggccuuaaauccagucuaaaagugguugguuauuaccauaacauuugugccauugucacacuagcaugucuuguaggcaggucacaucuggcuauuuaugugguugcugagaucugaauucaaguacucguguauguagcaaguauuuuuagcucugaauuuaguauuuauaucaaauguuuauaugauaauaguuuaacuuccacauugugugauauucauuuaggacauguguauguguacauaucauauucagauaagagaaggaaauaaugggaauaaauuuuguauuuauuucacugcaaaaucagugguucucacugccacucugauuuucucagugaccuucuaagagccuacaagagugaaauaccauccuguuaccacugggaagccaagcccuagaaagcuuaaauggggcuauacugugagaagaggcagcaagauuagaaugccagucucugugcacugcacugggccuugguucccaagugaacgaauggucuucucaguagaaccuuugaccagcggucacuagaacacacuugucuccaucugcuucauuuccacaaguaacuggcaccaccaagaccugcuuacagugaccuaaagaccguaaaguagagccugaacugugauuccgcuucagagugcauucugucugugucaugugcaguuaggcuuuugugucugcccuaauaucaaugaaccuuuuauacuaaagaugcuuuuauggcuggggauugcucugggguaaagcacuuaguacacaacaaagaaaaagggacugugggagaaggcaaggacuggccuggaguucuccucugaccuccugcacagugcgguguguguguguuuuuaaguuuauguguauauguauuuugcuugcauguauguaugugcacuaugugcaugccugguccccucagaaucagaagagggcaccagauccccugggauccaaguuacagacagcugugaacuaacucaggccgucuggaaggagaguuagugcucugaacuaguuaggcagucucgaaagaaccguuucuuucuaggcgaggugacacucgccuguaaacccuguccucaugaggcugaggguccugagcucaagaccauagccagacccugucuaaaaaaggaaaaggaaggaaggaaggaaggaaggggggagggggagagggagggggagagggagggggagggggagggggagagggaaggagggagagagagagaaugagaauuaaugaaugcaugggaaucauuucucuaacuggugggugucucucuuggacccugugaauguuucuuuuguuucuuucugcuuuaaaucauugaugucauuuuuucuggauguuguggaguaguggugaaaguggugugcgugugcauguguguguguguguguguguguguguguguuuuaaguuuuaccuaaugguuauugaaagcuugguagguuuuuuuuuuugucuuguuuuauuuuuugaguuuuuuucuuccuccuccauuuuccuccuccuccucuuccuccucuccucccucucucucucucucucucucucucucucucucucucucuuucucucccauucuccacccugccucugguacuaaaggugugagcuaccacacacagcaagcguggugauuuuuacauuuaacuuuuuaugaaggcacaccuuacauguaggaaacauucacaagcaucaugugugugcuacuugauggauucuuaaagagcauauaccuaaaugucugcagcccaaaagggccuccaguaccuucccagccagaaccucacaucuccugcauugccacuacugucacuggagccuuuuuguuugcuccugguccucguguacuuggagucagaaccuuugugauuuccuccugaucucuugccuguguucuggcuggguagugucccuaguacugauucuaccuaccauuguucaauccuuucucccgaugacaggcauuugguuuguuuggagauuuugacauuugcaaaugaagauaugguagauauucuaguacacacuugcauauaaauugcauauacucccuauaacuagcacauuuccacuuacauaagcauuuuuuccugcuuuuguucaucugaggcuaagcacagaccugugagcuggaggcguuugggaauaauugguuuuaagacagucaaguccuugcccagggcuccuaggaaagcagccgagcuaacguucuggcuguguuuuccgcaucgggcugcacagucccucugcugcagucugucuuuaugauugaaguaagcuguccaugucauuuuagguaaccuuguggguuuuuaggccagaguucauguaacccaugcuggcuuuaacuugcaauacaguagagggugaccuguuccccuuuucuucaccucaugaguggggauguggcuuuguuugguuuguuuguuuucuuaacuuuuguugcuauaguguuggggauuggacucagggcuuugugcuagcuggacaauccuguaccacuacugauguuuuugaaggaucuauagucacuggauggugcccaguaaaagccuugguaauuuguuuugagacaaaaaucuuaauuuaugcuccagacuagccuagaccuuccuguguauacccgguugguuuggaacucccagcaauccacuugccucaaccuccaaacgcuggcauugcaugugugagcuaccacauccaugugcuuuuaauauggguguugauaaagaccugauuguuagcuuuuagucuuaauggaggaguaagacuagcaguuccuaugcaaggguuauugguuccauuucucuggaugggaccagcugcgucugguguacuuagagguaguacuguuuauucaugucauaauggucuauagacaagcaggcucuuugugguuaacgccaaguaaaugauggugguuugaggaaggggaaagcaugucaccagguguacauucuggguuuucuccacuucagcguauugcagaggaaaagaaugacagaaggcgggaaugacucuuacccucucugcugcgaucuaaggaguugguucuuugauacagcaaagcggucccugagugcuggauaucuagcgggucugucaccgcacagacuagaacuuacuugcguuaaaacugacgaggagcugaagaaauuucuagauuacuagaaaaguacugauaauuguugcccaguaucauauagauuuuaaaugauacaguuuucuuuucucuagcagaacauguuagagauaacugaguuuucucgaaaaguuuuguaauaaugggcauuaaauacgucacuauucauugcuuuuauguggacaacaaauuaucaaaugaccuauuaauuuuuuucccaguaauauuuuacccuuugacuauguaugaaaugugccauguuaaacugccagcaguguuuuuaucugauauuaaauauuuuuaacuuaaaaaaaaacugaugaggagggaucauuggaagagaucagccucgcccggggcuuuggggaggauaaggaggcagcugagccuuuagccguaaucugcuuauucaggagcaagagcagacccgucagggagucagccucgggggcucugcacuugguggaaaccccaguucuucguucucuuucuuuccccugccacucugcucuuccuaggaguuuggccacaucucagagaugugccauuuguguuuaauuauauguaccucagccauaccgugcaggcaguccuaucuuaauuuauccuuuaauugugcuguggagaggccuugcaggaagggagacuguggaacuguagcuuuuagaggauggaugccaaagauaguuaggcgucucuagauucauccaggaguccccaccacgguucaggugacugaggggcaauauguagugggcugcugccaccgagcccuugggcuuugucauuuccuaggaggugcugguuauuuguggccccacagggguauagcaagaaccagcaguacuuuuuaccuuuuuuuuuuuuuuauccuaacucaguaagucucagcuauguaucuccgacauguggaaaauugucuguguugguuaaugguaaugaguggaagggccaagguagggaauaaucauuauaguacaguaaucaggacaacuaugaagauuaagaauuaaggggcgagcacagcuuauuuuuaaccuuuggcacaguaaaccaugacacaguaagccuugggcaaacuuccuuuaccugcauuuggcccuuagauauuuuuauuaauaucacccagaauaaauauauaguacagcgaugccugagcuucauuacaguucuguucagacugucugcccuggaucuucucucugauagugugguucccaacucuguacagaaucuaguggagggucaccaaaggacuaugggaagauccauaacauccuuuaagaaucucagucaaaguggagaucaacaagaagugaggaaaauacccagggaagagaagccguuagcagacugccauggcuuccaucccagugcugagaacagagccaguguguuugagugcccguguccgugccugagcagagcgugcucuggggugugcugugcacagcugcuuacuuaaugggggacagugcuuuaagguuguuaaggagauaucuucaagguauacccugaguuucaaaggucauggucaccccauggcucauaagaagaauaggauucauagggaaaacagucuugccaguauucauguuaggaaagcaggaaaccugcaaucacauguuuucucugucgcauggagacaggguugaccuggaaggcuugcuuaccacacagaauacucagggagccaugcccacugcuacuaccccauuucaaacacuucagcaggcuccucuuaccuuaccuggaguacaggugccacaggaaggccaccuucuguuuugggacaguagguuuuaggccauauuuuacaugcaguugccacaugccccaaagucugaaaagauggccugcuucucagucuuggaggggcaggguggggagugaugcucagaucauucucggagccacucgguacuucuaaacucugaauaucacuccugauccguagcagacagucgguucucugcuuuaguucacugauguggaguguuuuuaugccucuuuucaaaccaucucuaacacaaacagaaggauuuccacgaaagaccaaacagccucccaagcucgccauuuuguucucuguggcuguuuguccucaguuguguucaggaauagaugauuacaauccugcuuaauucuucugcuccuuucaaaugagacaagaggugcugguuugauuugggaaagggguuuuauuauuuucuuagccugaacaugccagcgcgccccgcggaaggcaugagauaucgggugugcgcuuucucauccuuaccaagcacugauguuuccccuucuccacaagaacucucuagugagagucaguguggacuauugacccucaaaacuagcccucauguuaagagacaaaggagcacuggcugagcuccugugucucagagccuuucuguguuugucuguucuuuuugucaaaaaagacaaaaacgaucauucuauugucaugacugacuuucuguucauaguuucuggcccccaaagacaaagcaaaagaagauacaacgggaccugaagaagcuggugauguggaugauuuaguaaguacuuuuaacaugcaccagguguuuaaagaccaaauugucugagcuguaaaugcagccaccaaaccugucacugcaggcaugguuuuuauuugugcauuaaccucacacacaccagacacuccuugcacuguuaauuauuaccauuacaaaucuaaucauauagguaaucucauaaugggaauuccuauguucugugguuucaauuauaguguucauucagacuaauccuccccucugaagagcuagaaaagagccggggaagccauucccuuagaagaaaaauguuauaauuuacugaaauuguucuuaaccagaaauaagcaguguaucgugcaguuuguguggguugacaaauacaaacauccuuuuaaaagcccacuuccuaaauguucucaauuagcuaaauagaaacaaagcagacugauaggccuuugaaggcagcccucgacacaccaugcugugggugcuaggaaguugcaaaugugggcuuuugcagccauguuugggaaaaacaugcacuuuaguaucacaggaaaacuggagugaugaccacacacuaugcugucagccuuuuuguggaaaaguuuuuaggguugaaaugagaagauauuuaguguuuagguccuaaaauaguuggcagagaauaccaguacagguuuuuguguguagcuaacuggaacugcagaucugagaguggccugguuccuuucugaauauguuguucuuguuuacagcuggacaugauauagaucauggauguguggggaauccaagagugccagcucugugcugcugagagcucuggcagcaucccugaggccgugcaggggaugugaagcucuggacgucauccuagcagacaacuugggaaugagucacuccaggucucuacagagugaccauaaggacauauauuacaagaaauaacuuagacccuauucaaauuuauaaagagccauuauuuucugauugguauaucauu

SEQ ID NO: 213 - RNA, 609 nt, Mus musculus
ccauuuuuuuuuuaaacuuuaucugcauuuauuuuuugcugaacuuauuccugggccaugaguuuuguuucuucaguuucuucugguauaucuuuuucuucugugcagccuccucuucuggcuuuggaacgaucuguuccuucucagugaggaucaucucaauguggcagggggagcucguguauggguuaauccggccaugagcucuguagguucgucggcgcaucuuaggugucuuauucaccuggauguguucaaugacuagagaaucuacaucuaaauccuuaaguucagcguuacucucagcauuuuuaagcaugugcagcaaaaauucagcacucuuuuuuggccaccgacccuguguccagccccacuguuuggccugggcacaacuaccaacuccaccauuauaccgccggaauggcacacauugcuucuuuaaagugacauccuucagauacuugguggcuuugcagauaugcauacccuugauggccugggcaguuucucggguguuauuuugugggguugucugggucaagagaguagcgaaccaucuuggcaggugaccucuggcugcuuacaggaagagagcuacuagccuccauu

SEQ ID NO: 214 - RNA, 3099 nt, Mus musculus
ggucuaaaaccgcgcaugcgcauugcgucccuuccucuucggacuugggcuuggguuccggcgacauggugagugucuucguaaccgcuuuggaagucgcuauccaucgucaucugccuuagucuccggcgucccgcucucagcccaccucggguagucugugcugucccuguccugucugcugucgggcuucucccggcgucuggagccccguacgcggccggaggcggcucggcggggcuuggcccagcgcgguaguuaaugcacaaucuggagccuuuuggcgcucugugggcgccuuccuugaugguugagcuugagggaaaacaggauucagccgaguuugugcucagcggcgcguuggcgugcaccgacuggcucaaugucucugcuccguuccuuuccucugucaacaggcuaaacgcaccaagaaggucggcaucgucggcaaguacgggacccgcuauggugccucccuccggaaaauggugaagaaaauugaaaucagccagcacgccaaguacacuugcuccuucuguggcaaggcaagucggccucggguuagggaggagggugccauugcucccgagcuaaggcgguuugggcucgcuuuuugcggagcauucguuguuuacuugcaacuagugaggaacuuaagggugaaugguuuggagaggaaaaaguccgaucuugggaaauugauagcgaugucagcgcaucuguaccaaccccaaagaggucuguuuagccuguaaauaauacucugcuuggguuacuagaauuuaacugcuaauggauaagcuggcuuuuccauaguuuacucucuggaagucucagggauuuuuuuuuuauauauauuucauaacaagaucuuaacuacuuacagaccaagaugaagagacgagccgucggcaucuggcacugugguuccugcaugaaaacaguggccgguggggccuggaccuacaagugaguguuuucuccugugguauaggaaaggcuauggacugcacagcccguguuccaggucuggugcauaucggauuuguuuuaguuuaaagcaaaucaugaguuuggguuuaaaaguuaauaguuuuuggucagggcuauacagugaaacccugucucaaaaacaaaguuaugguuauagauaaaagcucagagccgggcgugguggcgcacgccuuuaaucccagcacucgggagguagagguaggcggauuucugaguucgagcccagccuggucuacaaagugaguuccaggacagccagggcuacacagagaaacccugucucgggggaaaaaaaaaaaaagaagaaguucagacuuugauucucauauuccuuuugaauuguacagucaccaugcucuuuggaaaauuacaguugaucuaaguccauugguguuugugcuggacuugacuuaacacuacaaguuauuucuauaaaaugguuugagguuaauugacucgggauuguauagaacauuggaggcuguuugggcauauuuagugcuaugaccuugacagagccagauguuguugaaaugaagccuccugucauuguuugcuuuguucuuaagagcuuuagcaucucaaaccaacagcugccccuccaccccugaguuugcuggccagaagucugguauccaaguggugugguguuuuuauacuuccagcauggcccucugaguguggcuaguugcugaggaggugaacauguggguugcaguuuuucuugacgccuugguauugaaaaaacagucugaguguguuuaagagcagcuugagugcacaaggaguagugguagcaagugcucuguccugauaggugacugacuauucauacacaguguguggucuggcuguuugguuuggggguguaggcuuaaaacuuaucauaggccuccucuauccugucuacagaggagagcaccuuaagaucucguggagucugggucugucucuuuuucaauauugaagaaaucagaugcucaagcaccuuagaauagugagagugccccaagucuuggcuuuugaagggugccaccaugccagugugacaucagcacuggucuuguuagguaagguucacugcagcaugguugguguuggcgaaggaugcuaucauucuuuccaugagaaaauuaagaaauuucaggacuauaggggaacaaugggacagauacacucagguguucuauguuaacauucacaguuauguuggaaaugguuuuucuucacagcaccaccucugcagucacagugaagucugccaucagaagacugaaggaacugaaagaccaguagaagcccugcugucugagacuugccuagccugcaauaaacggguuauuuacguaacuuuuuuuuuuuugccuuguuugugguuaauuaaaacauuugguguguguucuauuuuuuauuuucgaaagaugcuuguuuugagacauacugugugacccuggcuggccuugagugccugguucuccuuacaaguguagauacaucuggcuuaagauuuuagucuuucagaaauaaaaauguugcuaagacaauuauguacauagcuugguuugcuauauugucagcaaacugaaacuagaauauuuauagaaauguuaauaagauugaauuaaauguagugugaguacuugguaggaaauaaaugauaauacauagguaaauaacaaaaaugagggucuccugacaaauuuaggguuuaauauauuuaggaauaguuuuauggcuagccuuuucugaaacuuuacaguuaacugccagguuugucaguuaugcuuugaccagccaugccaaagcuacuggacuccuugggagccaccagacaaguccuaugcauuccaaguccagaacagucauuuuccuuagaguaaaagcuugaccuuuugugggcccauccccaucuuacacagcagucacuucugacuuucuuauucugagguuuacucgguuccuguuaccugugcuccaguucugccuagacacauccuaagcaguacuuacuagaccuauagcaguaaccgcuugaaauuucaaguaagcaguuaaacuugugugugagaagugcagggguuuuuu

SEQ ID NO: 215 - RNA, 3099 nt, Mus musculus
aaaaaaccccugcacuucucacacacaaguuuaacugcuuacuugaaauuucaagcgguuacugcuauaggucuaguaaguacugcuuaggaugugucuaggcagaacuggagcacagguaacaggaaccgaguaaaccucagaauaagaaagucagaagugacugcuguguaagauggggaugggcccacaaaaggucaagcuuuuacucuaaggaaaaugacuguucuggacuuggaaugcauaggacuugucugguggcucccaaggaguccaguagcuuuggcauggcuggucaaagcauaacugacaaaccuggcaguuaacuguaaaguuucagaaaaggcuagccauaaaacuauuccuaaauauauuaaacccuaaauuugucaggagacccucauuuuuguuauuuaccuauguauuaucauuuauuuccuaccaaguacucacacuacauuuaauucaaucuuauuaacauuucuauaaauauucuaguuucaguuugcugacaauauagcaaaccaagcuauguacauaauugucuuagcaacauuuuuauuucugaaagacuaaaaucuuaagccagauguaucuacacuuguaaggagaaccaggcacucaaggccagccagggucacacaguaugucucaaaacaagcaucuuucgaaaauaaaaaauagaacacacaccaaauguuuuaauuaaccacaaacaaggcaaaaaaaaaaaaguuacguaaauaacccguuuauugcaggcuaggcaagucucagacagcagggcuucuacuggucuuucaguuccuucagucuucugauggcagacuucacugugacugcagagguggugcugugaagaaaaaccauuuccaacauaacugugaauguuaacauagaacaccugaguguaucugucccauuguuccccuauaguccugaaauuucuuaauuuucucauggaaagaaugauagcauccuucgccaacaccaaccaugcugcagugaaccuuaccuaacaagaccagugcugaugucacacuggcaugguggcacccuucaaaagccaagacuuggggcacucucacuauucuaaggugcuugagcaucugauuucuucaauauugaaaaagagacagacccagacuccacgagaucuuaaggugcucuccucuguagacaggauagaggaggccuaugauaaguuuuaagccuacacccccaaaccaaacagccagaccacacacuguguaugaauagucagucaccuaucaggacagagcacuugcuaccacuacuccuugugcacucaagcugcucuuaaacacacucagacuguuuuuucaauaccaaggcgucaagaaaaacugcaacccacauguucaccuccucagcaacuagccacacucagagggccaugcuggaaguauaaaaacaccacaccacuuggauaccagacuucuggccagcaaacucagggguggaggggcagcuguugguuugagaugcuaaagcucuuaagaacaaagcaaacaaugacaggaggcuucauuucaacaacaucuggcucugucaaggucauagcacuaaauaugcccaaacagccuccaauguucuauacaaucccgagucaauuaaccucaaaccauuuuauagaaauaacuuguaguguuaagucaaguccagcacaaacaccaauggacuuagaucaacuguaauuuuccaaagagcauggugacuguacaauucaaaaggaauaugagaaucaaagucugaacuucuucuuuuuuuuuuuuucccccgagacaggguuucucuguguagcccuggcuguccuggaacucacuuuguagaccaggcugggcucgaacucagaaauccgccuaccucuaccucccgagugcugggauuaaaggcgugcgccaccacgcccggcucugagcuuuuaucuauaaccauaacuuuguuuuugagacaggguuucacuguauagcccugaccaaaaacuauuaacuuuuaaacccaaacucaugauuugcuuuaaacuaaaacaaauccgauaugcaccagaccuggaacacgggcugugcaguccauagccuuuccuauaccacaggagaaaacacucacuuguagguccaggccccaccggccacuguuuucaugcaggaaccacagugccagaugccgacggcucgucucuucaucuuggucuguaaguaguuaagaucuuguuaugaaauauauauaaaaaaaaaaucccugagacuuccagagaguaaacuauggaaaagccagcuuauccauuagcaguuaaauucuaguaacccaagcagaguauuauuuacaggcuaaacagaccucuuugggguugguacagaugcgcugacaucgcuaucaauuucccaagaucggacuuuuuccucuccaaaccauucacccuuaaguuccucacuaguugcaaguaaacaacgaaugcuccgcaaaaagcgagcccaaaccgccuuagcucgggagcaauggcacccuccucccuaacccgaggccgacuugccuugccacagaaggagcaaguguacuuggcgugcuggcugauuucaauuuucuucaccauuuuccggagggaggcaccauagcgggucccguacuugccgacgaugccgaccuucuuggugcguuuagccuguugacagaggaaaggaacggagcagagacauugagccagucggugcacgccaacgcgccgcugagcacaaacucggcugaauccuguuuucccucaagcucaaccaucaaggaaggcgcccacagagcgccaaaaggcuccagauugugcauuaacuaccgcgcugggccaagccccgccgagccgccuccggccgcguacggggcuccagacgccgggagaagcccgacagcagacaggacagggacagcacagacuacccgaggugggcugagagcgggacgccggagacuaaggcagaugacgauggauagcgacuuccaaagcgguuacgaagacacucaccaugucgccggaacccaagcccaaguccgaagaggaagggacgcaaugcgcaugcgcgguuuuagacc

SEQ ID NO: 216 - RNA, 16986 nt, Mus musculus
agcuagcugaaugcacacuuuuauuaaauaaaugcuuugucacgacaaaagacaaagaucaaggaguaacauaaauuauaaguugaauaaauagaauacagaaaucuucacuuuguaauaaaaugugagaucuuccagguuuuucuuuuuuauuuccuuaaguacaaaaugcuaaagaggagccgagcucuuccacaucggggugauuuuuuuucccauuuuuuuuuuuucacaaacugguuuguuguucaauuuuuuuuucaaucuguuucaccaguaaaaagcauaaguauuuuuuuuuaagucaaaaccaacaaaauaagagaggacagagcuacggugucugaacguaacacuauagagagcuacaguaauaugugaugugguuauugcuguuguaaaaaacaaacaaacaaacaaaagaaaacaaaacaaaaaccaaaaacaaccgguaggcgucucggaaucugaaggagucuugucugaacuguacuauccgugugacaggcuacugugugacagugauggugucggagaugggggcugaagccggugacuagggaccagagaagugggggugaauggaugcggggugacgagggaccccuuccccucugacccucuaccuuccuuuuccccauccagagagacuuggagaggaggccagagucugugaaguggugaaagucuauacuccauuaaaaaaccaagaaagucugcucaaggaaaugaaaaccuaacagggaagagaggcgggguaacaagagugcaggaaacauugcacuuuagugguuuaaaaaauaaagacaguacaaccccuaagcuccccgggagaggucgacgagaccucuuucccuucuacuguguuuuaaaucauagccuucuuucucuugaaagccagaggacuacagggucucuucuccuuggcucacuccucucuuaagcuguaaaauuucaccuagaguccucuaggguucugagcagaaggacagcugcccugccugggaugggcaggugguugggagguugccauggcaacccuugguagugggagaaugauggugaggauguuaccauggagauaagucauggucggaagagggucuuggaaggagaagaggagugagcacagcugaccuccuccguauccuguggggcagauguucccaagccuugucuguuuaggccuggccgucagagaaacguagagucuuugucagaggaacguagagucuuuuauucuccagguucccugcuuuguucuggcuggucaagacuggcugggguggagaauagguccugguuaggucucuuuguuaccuggcaguagagggggaagagagcuaucuuuccacugcucgagugaggcauuugucaaaaaggggugggaagaaaccuuccacgggauaguagagguggggacaggccauacuugggccuacugcuguggauaaacccaacagagaggccucuaauggaguuaaaggcuagccugggccaaaagcuucuugcucagggcaugaugggaucguugcaaacuugccuucucucucccuaaccuggagaaggacaucccucuucucuugaugaccccauccauguccauggucucuguauccuggguucagccagaucucccauuuggaagguuuaguuccaucugucuguuaaaggcaagcuuccucuagaagacuugcugucuuagacaugccucuccauaugagcagcggggagacucacaaguuugggggagguaggcugaccuggggaaggcuaacugucuauacaaugaccuccaucuguggcucacagcgaagagcccacauaagggacagaggcucacucaaggucuaguaaguuguggggugaagagagcaccccucacaggaguuagcuccaggcucgggagggggagcgaguaggcaguuccuggcucagucuuuucuuggggggcagugguaccccaguauccacuuggcaaaucucagucagaugacugcucaagaugcggagaaauaauggcagaaaggagagacuuaggucuaggauacuggccuaagauauauugaaguuugaguuggggguuggggauguugugcggggugauggguauacugacccugcaggucugguaaguccuucuauugccaucccaucaggcccuuugucuuaugaagaucaauuuucucuuuccuucccagccaacuguccuguccaggcaacaggaggcaucccuuucugugcccgcagccacccauguccuaugagucgacgcacgucaguuucuuugcucucccuuuguguugcuccauguuccggguuggagggggccucuacuaugccaugccaucaagagagcgcaaagagcugugucccccgccaaaaggggccuccuguaccaauguccgagucuccucuccuggaagguuaucuucagucuucaaagacaguccugagccuuuuguuaagcaccucuuuguugaagaagccagugggcaaugagaugcuucucuuggaucaaaaucaggcuggcaaaugacaacagucgugaagauccgggccugaguuguccugggcuuucuaccauccuccaucacagggaaggauguuugagucgggcagaggagacucaugaagcacuugaaggauucuuuggccucaguuccuccuugggggccugaaguugaacugaaguugugcugucuuuccaaggcauccucuucacccuucaauacccagucaggcuaaccagccuuguuuccaaccgugugucucaagucuggauccugccucaguuacccaccaucugggcccugugacuugaacugaccucauuucuaccucaaguucuuccccugccuucuuuuuccucucaaaucucagagaguugauuagaugggagacaccaaggaaaauucuauugguauuuuccucucucugucucuuucuuguccuccccacccccagaccucugcuccaucuucuaugucucucuguggaagucucugcccccacccuccacuuccuccuccucugucaucucucauguuaguuucucucugaucugucagccuggcaucugagggaggcuuucaaaaugcaguucaaaaaaaaaaaugcagaugggaaaaaaaggucugggcaggccaguggguuacagauggaucuggcagguuuaugugguguggugugagacaguuacuuucugcggguuggaaggcugaaauggggugaccugggcuaugcacuugaugcacccuugggugcuggcaguuaccuggcuugguggauucacuucaacacacguuuggaaucaugagaagauccaaaucggugccccacaaaagagccacacuuguagcucacgagaaaggcugccuggacgcaggccaagcuggcguucuggguuguauuugugaaauauggauuuuucccagaaugaggaagaucuucaguguccuaaaaaaaacuacuuuaaagagguaaugcaaaacuucgaaagaaagggaaagggaaaaaaagguaaagaaaauagauuuauaugccuauaaagucuacauggagucuugugggugaguacaagccccuugguuuucuccaccucucauccuccuccacagaggcugccgggccagcuuugagucuagugaaaucaagggccgaagccacgcgcuucugaauugcuugucacccuggagaaucaagucuuuccaguguugggggugcguacugacuucuuaaaaaaaucuuuaacaagaguaaaauuugcacacauucugaguucacuugucugcugggggaaaaccuaucuucaaucacucacuuuuguuuauuuucagagggauggaaugcauuuuagucuuuguaaauuuggggaugaaaucacccugcacuuggguaagaggagaggagggugaggggucuagccauccacacugcuggcugcaggaggggacagacccgagaggcacugacacaccuuguuucuuuucuccccuugaccaaucuaaacugggugucacugaaugccacacuuuuucugaccccaggcuagagcugaaagcaaaagggcagauucagccuugguuguggaguccuuucugccuugcuguuucucucuucucucucuaauccuaucuguccuucccucuuuuccucuauuccaacgcuuugcuuucuuuccaucucucgcucccucuugcuucuucucuccuucccuucucuguccguucaacuugcuucaaaaaggaauacauuuccggggucaugguggggagugucuccuuagcccuugcuagagauuccgagguccucaguuuccucaaauauauauguauauauauuuccccuaaaugagaugaaaugagugacguccugggguggagggaggcgcuggcuggaguuggggcuggggggguaggauagggggaggaagggaggggacgcgucacucaacguuacugcugucgaaggcguggcacugaaaguccccauccacguacuccaugcccggcagcuucauuccguacuuguccacacaccagcagaugccacguuugcggccacgggagggcuuacacugggagagagacaagcggcugugagauacccgagcggcgguguaccccgaggcucucuucuggcucugaccuuucccgaugcacuugaggguuaaacggauuccgccuuuagcuaacucuugggguuuugcugauucuaucucaugggaggacccaaagaaaauaguuaguucaggcauccugcccugggauagguccugccaucucccuuucauuauuuacuuuggguuacccaucucacguucuccagggauccucaagagaggaccucggucaucaaaguaugaaacacuacucuggcuccaucacaggccaggcgaaguuuaacacgggucauuguggcaggagccgaucucagugcuuugucaagauaaaggcuuauuucuccccaucagaguaaaguagauugcuagucccaauuuuacaugagaaacuaaagacccaggggcuuuaaauagcugggccaaggguuacacagcuagaaauggcggggucaagauacacgccaaggggcccuagcuuguaacuguuaacuuagauuagggaucccaauuagaaaugcaaagcacuuggagucgucuggaacugccaaucggaaaccucagaggugaagcccggcacaggggcauguaccugcuuucucuuguagaauccuuugcggucacaguugggcagguacacagcacggggcaccaugcgugggcuggcuuugaacuccuggagggaagcuuccaugugucugcggcaggggcccugugaacacaggaggaacccagguggaaaccacucagcggugcccucugauggcucauguguggcauccaaagggacccgggagaaaaaucuaccaccuuuaucugaagcuacuuaggaucuuucuucuccuucaucugucugcugccuugguuguauaguaagccggcacguggguaggcagcaagcccugggucacuugcucucagcuuuccuacccuuccaagcacugaagauauacagcuuacauucucuaaaugugcuaggauaguguucagccucuuccugggacuggccauagcucuaggggucacauuccuggugcaugcuugcaguuacaauaggacauucuuugaaggagaacuaccucuguuuccacuaacuuggaucagcccucaguccagauaaauaaauucaaggucucaaaagcauccuuccaaauucccagcugagccacugugagcaauaggucuguugguaggucuagccugugcauccucuaugaccacagaugcuaaaguaagacacaugggaaaucagauugggaugguggccaggguauggggaagagaagccccugagacucacuuguucggauuccugucucaucucaggugcagggaugacucuggggugggcaguguucucugcaccccccacaaacuuggacugggucagcuucuuucugcgguccuucuucacagccucagccuucagcucggaaaugcgagugugcuugggccggaagaccuugggggaguaggucucuucagccaucucggaggugguggguuccucguguucccgagagucucucucuguggggagaaggaggcggagaaucagcuucuggggccagagagcagugucuagagaccagaacugggaggacucgggucagaggagucauggagacucagagagauccaaugaugaggucuaagaaagcaagagggggcggggaaaagacaucauggugggggguguauucuugacuacaccucacuaguacacaugggcaggcuagagaaggagacaggacaaggcucaaagcaggugaagguuauguaaaucaguuugcucaggagagaugaaguggcuggagacagaagguuaagcagucagggcuuggagagcugggccaagggaagaaagcagggcacaguccagacauaggcaagaacagccaaguguguccguccgcuuaaagaggucuuuguacuuucagaacagcugggcugaggggugacagauguuuggaccuggguguccagggacaggagcaguagagggggcagggggacuguggugagggcugggagaugggagaggcagaaaugugggccccggagaggaacaaauggaagcagauggaagacagaggccucauccucuuacaguggcucccaacuggccuugugcugugcucuggacccuuggaggcugggcauuccucagcccugucugagaggggcugacagcuggcuggggccagaccaguuauccauaggagcaacuuggugacuauacuuggugacagucuauacuuaacugacuuaggaccuuuagaaaaaagaaguaggacuuuguucaugugucucuuacucucucaacgccaccugccuagcccaucucagcacauauuuccaguaaggucuuuucucauaggugcccccggucuccucucagcccccgaccuugcaaccuucaugaguggggagaccuuagauggcugucuccaugcuucagaugacccacaagaccaaacgcagggucagaaagggguggaggacugggcuccaucaccuuuccuaauuaaauguucaaaaaggagagggagggcuuugugauaucucaaauuaauuaagcagggugaaggaaaacccaccgguccucagauaccucagauaugaugguagcugcauaucucagaugugaaagauaagggagagaauccaacaaagucgaggcgagggaaagagaagaagacuuuguggaaugucuccaagcucccagcccaaaugaagaucuggugugagugcggggaggcauguggagauuaggccucaccugguuagaagaacaaacggcaccacacacccagcaucugcuccucuagggcgugucaagcuuaaugaacuagauguuggcuccuacuaggaggaagccucuagggguuuucauuaauccugauugguaaugggcuugggcgaguagucacaagaaaggaaggggaggggugggaguaccugucaguguuggggcgggcucucccugagucaaacucucuguggggauaucagcccucccccugcacccccuccccccccccccagugccugacucuacgguaucagaaccugccgggaugccaaaucccaggcugccuguccaaagaggaaucucucuagggguuaauagaccguauuuggggugaacccaguuuuuuggguuguggacuuggaggacaggaugcaggaggaggcaugucuaguuuggggguucugugcagauagaagaguagagucugauguuuuuccuuaaggaacuuuugcaaacucugggacucacuaagcaaagucuaggcuccugggagugucuccucuccccuaauuuucagucgucuugcuugugaagaacaggcuuaaaauuuucauuugccucccaguucuugguguugcuuccugaaggacacaccaggaccuaggcuuuuagaaacaagcagggcuauaccucuagguggccaguagguggcgcaggagaccaaaggcgcucaauuugugcacauuuccagggaagaugaagguuaaaagcuggcacuuggcugucucccccuccuacuaguuugggaaucccaucaauccuuucccccucuuugugugcuugcagcaugcauuaagaaggugcgggggggggggaggacgacaaaggagcacugugcaggaguggaggacugcgcgagcaagucuuaguuguguguggcagaguguugcuucuuuauagugacuagaaagagaagagaaacacaucccaacacccuccucccucuagaugcugcugggaagguuucugcagaggaugagaaacguggggugcuuuuugguuaagguuuuucauugcagcaauaaagacccuaagacagggguguuauauucugguauuuccucugauguauguugugcuacggcuccagcuuuguaaugugccuacucugucacaggaauguugaucuauucaucccccccuucccaugacuuaggaccauggguacaucagcgucucccugggaacaggcacagcuuuauggcugcugagacaccccaggaagggcagcauugcacacagcacuacagcaccaugcacacaccuuacccaagcucaaccucucuaagcacacagucuggcugccgaugcuuuccuguagacgucuggcucuuuaccaacauaugaagacguguucuuaggaugccuucccauccaaccuugcuuccuaguccuucuaauagaugaauccaaugggaccuguugcuacuggaacuauuacuuuccacccugggcuucuugucauucuggcaccaugaauaauagccugauccugggcugcuauuggaugcuggcuugaccuguccucacaaacagaagucugggggagacuuaucugugaugauuucucuuccaucagaaaaccagcuaagcuuggaguucauggcccaauaggccacuuacaaucugcaaagagaaguucagccgagaaguaguucugugauauaaauggggcaacuuauagcuuaacggaugcuggggugggggguggggugggggaggccaucugagucaugccccugccucagagcaugauuacuuugccacaggaaggugaagagacaagcaguccaugaagaaggugccccuggugugugagguuucuguuuggcugaggcugugccauccagaagccaauguggcauuuaaaugaacaaauacauaauaauaauaauaauaauaauaauaauaauaauaauaauaauaaugauaauacacccagagguccucauuuccaguucuccccagccacacguuggcugcuacugggcuggacaguacagauauagaacacuuucaucaucacuguaaguuccacuagauagcacuggcccaagacauccaucaggacaaaaauagucagcuagaugcucugcccauuccguguccugucuuguuucccagccaacaggcagccuccugcucuuugcugcagugcuaggcuugggggagaaucagaaucuggcugcucauugucccccccuccccaauccacccaaauguaagcuguguuucagacuccccaagucucacugcuuuccagcugcagaugggugcuauuuagcucagcugcccugugugggugcauuugcauauagagagaaagaggaggggcucuggguagaggcuguggaguguccccuggccuuccuacuggcucacagcagcaucugccuggccccaggcucacuccugaagaucccauuuucuuuuucacuguggucagcaauagagggaguguccagggguucuagcaaccaggaugaugagcugacuuuucaagagaaaacaaacaucgacagcuguauccuuagguggggggagggccagagggcucucuuaauuucauaaaguuuaaauauaaauuuugaaacaagagaauuugcucacugggaauguuuuaaguauguuuggcagagcauaccauaaacuuuaugacauauacauauaugucauaugcauauguauauacguauacagugucuaauugagauuuuucucugaagguagaaaaaugccauggauuuaaaagacagcaagugaaagaaaguugaugauuucauugucauucuuuggguacauguggagaugauaauauuuucugguacgcucuguuaaaauacaccaguaaaauacauuuccucugcuucuucuuaaccuugaaaauuuuuggcugcuagaaaaaaaaguaugaaaauuguggucccuggaaaaugaaacguuauguaugugguuuguauuauauuuugguuggaugugcuagucuaaagacuccugaaggagacacgccuuuagaggggacagagagauguuccccauggaagcccugauggacagagcuuagagagcaaauaacuagauccuauauaaauucacagauugguagagguaucauaugaggcccuguucugaguacaguuucauugaaggccuuuagacuuggcagggaaaggccguugaucugacaguuuagguugaaggcuaaaguguaagauaaacuauuugguugagccuaaaggcucagcugguagacccuacugggaagauaggcuugcguuaucugcuuccuuccccaacaaccccaaaggaaagagcuuccucagccucuggggcaaguuagcaugagucuuggcauagccucugaguaacccgaaccccuaaaaccucucagccaaaggcaggccugcugaaaacccgaggcauaccccaguauguucacaaggcguuccugaggcuuccucuaucagcuuuccugauggauggucuccccuucuuucugauguagaaaccccguaguuacuucugucaguccacucuaccucaggucucauuaugcaguuugccagccccaggggagaccuaugccauuagagacaggcuaccacaggcaguagaccacggacugaaguacuauguucuccagagaggcaggaagcauggacaaccacagggcugcaaagaccugccugccacauuaggagaacuccuuguguucaggaaaugagguuuggcccauagacacggaggcugugcugaaugccgucccuucaaacccuccuugcucacuuucucuggccaaaccacuggccugagccagcugucugggagacuguguagaaaaggggacggaagaagccauuccuccaagaggguauuggaguucccacuuuuaggucacuuugauacuucucuggcccacagaauagagcaccccuaaguggagggguuuccucuuugcuuucagaacaccuaccacuggaagguagcauuuggcaauguuggccaagguugcaagguuagaccaggccuaggcaagagcccuagugacuagugaaggagccagaaauagcagaaauagcagggcagagugccucagccccuagggagaagccaaguucaaguccugacaaccacagaucuugucuugggcaaguggcuuacuguuuuaggucucaaugucuuuaucuguaaaguggggcccuugaccaugaggguagcccuggguuuacuuccagcuuuaagguucuuuggacacuauccagacaauuccuggagaguugcuaggacacagcuaagacauguggccaggcagaaaaggccacuucuccauacaaacaaaugucuaguuacucaucuggauuuauguuuuauaagaaaugggaagcagacauaugcaucacaguccucgguuauuugccuguuucugcagacaugugacuaaucuuauugccuugaauagucuacccaguuagaaauguaaugguagccuuugagaauugcuaguuuucaccuaauuggcaaaagugcaaacuuacaauggaacaaaaccccucccacuugcuagcuguggcuccugguaaccauccccucgcuucuuggcuccuaaggggugccccuuguucauacuugauuauauacagaguuccuccaccuucugaacguuguggcucuggaggguauaaucccuucuuucaauuuucauuuuucuccacauuaaauacuucaagguuucauaggcaugggcugcuugggugcaaaguaaaacuuuuuuuuuuuuuuuuuuuuuuuuugguaaaucuuuccgucccucuugcuccuccucccugaauuaagaaagcgggacccggucagcagggaaucuugcuuccguguccuccguucuaaccagcuccgugaccucuggcugggggaucagcuuggcccugcccgugcagcugcagguggcugcuugcuuaaagcgagagggcaaaggcggaacugcucagauuuaaaacuccgcccucaguuggggcguggacaugagggagggguuaggggagcggaggagaggcuaccgaaguccgugggggcgugggggaaagggacuuggaaagaaaagcagcuucauugggccagcugugcugucuccucuaagccuugcugacacagcagaaagaugggggcaaaggcaagaaacguuaaagccaucccucucgcccaacucccguuuugguuggcuucggcauagcccucacucacagacuugcuucagaggagggcgugcggcgggaaagucaucuggcuccuucaauuuuucauaaccuuguucaauccagacaugaauuuggccaaaaagucuuagucuggguuaacuucagcguggcauuuggacuaggcuuggagcugaagccaggucgauggagaccaaagccgcccaagaagcaaaggccgaauucauuuucauuuacauaauguaccccuccccuugguuucccagaagcacauuuuuuuuuuauguugcucuuugccuuauuucucaaugacaggauugacauucacagcccucugcucuccacaucucagauuuugcguuucugcuagcucaggagacacuccccagauucuccgguauguuaggcucccaccgcugaaagcacauuuucuagagaaugcccucaacacauuuuaggccuuccuugauccaucgaggcucaucuuucuugguccuagaaaccccugugucccuaguccccuuagccucacacacacugccuucuguaucuaucgcuggccccugaacuggccaaaagaaaaugcagggccaggcgcgcuccaagcccuggacaucuaggcgacucccucuccaguugccaagcaacgcaaccagcaaaaccccaggcuccgccugccugcguacaccucccucucccgaagcuuuggcugccagccaccucuccuucgcuccucacuucucaaucuagaaacucacuguacugggggguggggguguuacauaauauaauaauaugaauauauaauauauauuuuugguugcauaccaaauauaaauacaacauauguauauuauagcuuccaacugcgggagaagaggauuguccaagcucacacuacucagauuucaguggugggggagggggccuagggagcaagaauuucuccuaaaggacccagaagacaaucuccucucuucauuauccauuuuccuuucuuuaagaaugacgucaucuuuagcuuuuuuuuggggggggggugggcauccaaauaauggcucgaaggaucuucuccgagagccggcucccauucgggaggaagguauuaaccuuugccacuguggucggcagccagggugcaauuguaggcuguuaggcaccugccugacgcgggcugggguuggagugagggcgaggagaggguguugcuucugguugcuucggcugcagagaauucuaaagcgaucuggcgcgggacaaaaauaugguucguacgugugugcauguaugcgugcacgcgcgcgugugcacuggguccacuugggaaguaggaugcugccucuuugcugguccagcaucugcgugagugagugcgcacagagcucacuccuuuuauuccuagcuacucccuaucuaccgcuuggcugggcaaauaaaaguggggcgaggauacugcggagucauaacuugcgcaauucggcugugaugggauugcuagccaaccuuuuugucuccaagccaggugauggauuccuacggcuucagcaggcaaaaauguaauagaaauaaccuaaaaaaucggucucugggggcuuccgcgguuuguaugcccccaacccccucauuaugcaacuucucacgauagcucaaacuugcaauuuccggggagagaggcugagcucacgcaagcucugcuaucuacugaugggcacucacguacccuccuacgugguggaauccauaggucuuuagcuugcguucagaaaaauuacaaaccuccucacguuggaguaauggaggacgacagguggugagaagggcuuuaucuuuguaaggaaccgcaccaaauaaacauuuagcuaagucuuaacaucucuccuagcucagauuuugugcauuguugguuaagcuuaaauauuuauaauauauaaauauaaaaauaauuugauaaaaauauauaaucagguaacucccccaagaaaccuagcucgaggcaaaacuguuuugauugaacaagaagcucugucaaucauuuaaaccacagacuccaggcacggagaauuuggaggcggggcaagagggggcggggcaaacggagggguggcucccagagcguggucuuccugucuccgccccuugaguuuugcauucuguguuuccagggccccucacgcacuuagccacacucacuuuuagucugguuuaagugauggguggaggguggggcugcuggggguggggguggagugaggagagagggaagggagauggagagggccagcauccagugggaacuugaggaugucuucacccccacaucccucuucaccucucaaaccuguguccaucuuuuuaucuuaacuaaaaucugaauuuaggaggggaaaaaaaaccauuagauucagggacgaacauucagcacagaacaccaaacucuuucagcucauaccccacgcccuaccccagcccucccgaaguauucuuucucuuccugggaggaaaaaagagagacguuuuacagucuaauauguuucaucgaucauaaucaaucauaucaauucaaaagcagcaaguguacgugugggugagcucucaauaccuccacccaaaagacauuaguugucaagugggggggggggauguacgcgcguacgcgcgcgcgcgcgcuccugagcaaauaggaauagagugagagauaaauuuagaggcacugagaugggggcggaggggugaggcuuggagggaucaagguagaauuagcuuuaaagauggaacgcaucuucagauuccaauuaaaaugaccuuuuaacagaaaggauuuucuaaaguuuagggagaaaaguacgggguugggguggagaagggaguugauaauuuaaccuguucuuuuucagagaggauucucuugggauuuggacuuugagacucaaaaggagcucagagucagaauugccacgaguuaggagugggggagggucggguugggguggagaugaaguguaaacugguagagacgguuagacagccgccuaggauagcuugcucugccagggauucaagugugaggugcaaggacccaccccaucuacucucaggagcuacuagggucuaagccacuugcugcgcgcgcaaagcgcgcggguucccaaucgguccccgguccccacccauccaaggugccucccuccccagcuccugugccgugcaacugaaaccccaguagcgcucaccuaucuugguuugcucgccguagcucuuuucguugaggcaaaccccgcggccgugcagcagggcgugcagcggcuucuccucauccugccgggggaggcagcgcaaacccugggcgcagcgcuccguguagacgccacacgacugucccuccgccagggcgcaagucaugcagcagccacagccgggcucuuugaccagcucacagcccagagggcuggggggacacauggacagagcuuucucgucgcaggguucacagugcacgaaagaacccaggccuugagccgguacggcauaggcggccagcagcaggaggaccacgcugaucaccauuuucucggagucuggcuuuaccucggggcggggcaggagagcgagaguguguggagaaagagggagccuggagauuuuuuuccuuuuaaaucucuugcagguagagcaggugcucucccccaaacacuugcaaaauaugaggcaaggaggauucagaugccugcacgcaagucccaauugcgaggauuaaagacuugcaacagguugggggugaaaaaaagaggcgcgccaggugcacgcagagcgagcggagaccguagaaacccccaggcgggaucgggucagaauuggggguggugguggagagaaccacagaauugcucacuccaaagcaacagaaauaauuagcuuggaggccuugaaaagggaggaggugaagaaaaaaauggauugggcuuaauuuuccccccuuugcuuaaaaucuaaaacgcaaccccacuccgcucggucucagcggccagcugcgcugcugccgcagaacagguaagaggcgucggcggcugacaacaagaucgggaaaauguugaaaucgaggggggaaaaagggcaaaaacccagaccucaccaaaccuggaccccaacaccugcucugucaccaccucuucgaaacccgcagguucugcgugaaguccggagaagggugcagaccgaggggggggguaacaaaaaggaacaaaaagggggaaaaaagcccaaacagcuuugcagcucuuuccuagcucuuuuagaaguuuccaaagagacugcgggcucuggucgagcaggcgcuuuuaaau

SEQ ID NO: 217 - RNA, 16986 nt, Mus musculus
auuuaaaagcgccugcucgaccagagcccgcagucucuuuggaaacuucuaaaagagcuaggaaagagcugcaaagcuguuugggcuuuuuucccccuuuuuguuccuuuuuguuacccccccccucggucugcacccuucuccggacuucacgcagaaccugcggguuucgaagagguggugacagagcagguguugggguccagguuuggugaggucuggguuuuugcccuuuuuccccccucgauuucaacauuuucccgaucuuguugucagccgccgacgccucuuaccuguucugcggcagcagcgcagcuggccgcugagaccgagcggagugggguugcguuuuagauuuuaagcaaaggggggaaaauuaagcccaauccauuuuuuucuucaccuccucccuuuucaaggccuccaagcuaauuauuucuguugcuuuggagugagcaauucugugguucucuccaccaccacccccaauucugacccgaucccgccuggggguuucuacggucuccgcucgcucugcgugcaccuggcgcgccucuuuuuuucacccccaaccuguugcaagucuuuaauccucgcaauugggacuugcgugcaggcaucugaauccuccuugccucauauuuugcaaguguuugggggagagcaccugcucuaccugcaagagauuuaaaaggaaaaaaaucuccaggcucccucuuucuccacacacucucgcucuccugccccgccccgagguaaagccagacuccgagaaaauggugaucagcgugguccuccugcugcuggccgccuaugccguaccggcucaaggccuggguucuuucgugcacugugaacccugcgacgagaaagcucuguccauguguccccccagcccucugggcugugagcuggucaaagagcccggcuguggcugcugcaugacuugcgcccuggcggagggacagucguguggcgucuacacggagcgcugcgcccaggguuugcgcugccucccccggcaggaugaggagaagccgcugcacgcccugcugcacggccgcgggguuugccucaacgaaaagagcuacggcgagcaaaccaagauaggugagcgcuacugggguuucaguugcacggcacaggagcuggggagggaggcaccuuggauggguggggaccggggaccgauugggaacccgcgcgcuuugcgcgcgcagcaaguggcuuagacccuaguagcuccugagaguagaugggguggguccuugcaccucacacuugaaucccuggcagagcaagcuauccuaggcggcugucuaaccgucucuaccaguuuacacuucaucuccaccccaacccgacccucccccacuccuaacucguggcaauucugacucugagcuccuuuugagucucaaaguccaaaucccaagagaauccucucugaaaaagaacagguuaaauuaucaacucccuucuccaccccaaccccguacuuuucucccuaaacuuuagaaaauccuuucuguuaaaaggucauuuuaauuggaaucugaagaugcguuccaucuuuaaagcuaauucuaccuugaucccuccaagccucaccccuccgcccccaucucagugccucuaaauuuaucucucacucuauuccuauuugcucaggagcgcgcgcgcgcgcguacgcgcguacaucccccccccccacuugacaacuaaugucuuuuggguggagguauugagagcucacccacacguacacuugcugcuuuugaauugauaugauugauuaugaucgaugaaacauauuagacuguaaaacgucucucuuuuuuccucccaggaagagaaagaauacuucgggagggcugggguagggcgugggguaugagcugaaagaguuugguguucugugcugaauguucgucccugaaucuaaugguuuuuuuuccccuccuaaauucagauuuuaguuaagauaaaaagauggacacagguuugagaggugaagagggaugugggggugaagacauccucaaguucccacuggaugcuggcccucuccaucucccuucccucucuccucacuccacccccacccccagcagccccacccuccacccaucacuuaaaccagacuaaaagugaguguggcuaagugcgugaggggcccuggaaacacagaaugcaaaacucaaggggcggagacaggaagaccacgcucugggagccaccccuccguuugccccgcccccucuugccccgccuccaaauucuccgugccuggagucugugguuuaaaugauugacagagcuucuuguucaaucaaaacaguuuugccucgagcuagguuucuugggggaguuaccugauuauauauuuuuaucaaauuauuuuuauauuuauauauuauaaauauuuaagcuuaaccaacaaugcacaaaaucugagcuaggagagauguuaagacuuagcuaaauguuuauuuggugcgguuccuuacaaagauaaagcccuucucaccaccugucguccuccauuacuccaacgugaggagguuuguaauuuuucugaacgcaagcuaaagaccuauggauuccaccacguaggaggguacgugagugcccaucaguagauagcagagcuugcgugagcucagccucucuccccggaaauugcaaguuugagcuaucgugagaaguugcauaaugaggggguugggggcauacaaaccgcggaagcccccagagaccgauuuuuuagguuauuucuauuacauuuuugccugcugaagccguaggaauccaucaccuggcuuggagacaaaaagguuggcuagcaaucccaucacagccgaauugcgcaaguuaugacuccgcaguauccucgccccacuuuuauuugcccagccaagcgguagauagggaguagcuaggaauaaaaggagugagcucugugcgcacucacucacgcagaugcuggaccagcaaagaggcagcauccuacuucccaaguggacccagugcacacgcgcgcgugcacgcauacaugcacacacguacgaaccauauuuuugucccgcgccagaucgcuuuagaauucucugcagccgaagcaaccagaagcaacacccucuccucgcccucacuccaaccccagcccgcgucaggcaggugccuaacagccuacaauugcacccuggcugccgaccacaguggcaaagguuaauaccuuccucccgaaugggagccggcucucggagaagauccuucgagccauuauuuggaugcccaccccccccccaaaaaaaagcuaaagaugacgucauucuuaaagaaaggaaaauggauaaugaagagaggagauugucuucuggguccuuuaggagaaauucuugcucccuaggcccccucccccaccacugaaaucugaguagugugagcuuggacaauccucuucucccgcaguuggaagcuauaauauacauauguuguauuuauauuugguaugcaaccaaaaauauauauuauauauucauauuauuauauuauguaacacccccaccccccaguacagugaguuucuagauugagaagugaggagcgaaggagagguggcuggcagccaaagcuucgggagagggagguguacgcaggcaggcggagccugggguuuugcugguugcguugcuuggcaacuggagagggagucgccuagauguccagggcuuggagcgcgccuggcccugcauuuucuuuuggccaguucaggggccagcgauagauacagaaggcagugugugugaggcuaaggggacuagggacacagggguuucuaggaccaagaaagaugagccucgauggaucaaggaaggccuaaaauguguugagggcauucucuagaaaaugugcuuucagcggugggagccuaacauaccggagaaucuggggagugucuccugagcuagcagaaacgcaaaaucugagauguggagagcagagggcugugaaugucaauccugucauugagaaauaaggcaaagagcaacauaaaaaaaaaaugugcuucugggaaaccaaggggagggguacauuauguaaaugaaaaugaauucggccuuugcuucuugggcggcuuuggucuccaucgaccuggcuucagcuccaagccuaguccaaaugccacgcugaaguuaacccagacuaagacuuuuuggccaaauucaugucuggauugaacaagguuaugaaaaauugaaggagccagaugacuuucccgccgcacgcccuccucugaagcaagucugugagugagggcuaugccgaagccaaccaaaacgggaguugggcgagagggauggcuuuaacguuucuugccuuugcccccaucuuucugcugugucagcaaggcuuagaggagacagcacagcuggcccaaugaagcugcuuuucuuuccaagucccuuucccccacgcccccacggacuucgguagccucuccuccgcuccccuaaccccucccucauguccacgccccaacugagggcggaguuuuaaaucugagcaguuccgccuuugcccucucgcuuuaagcaagcagccaccugcagcugcacgggcagggccaagcugaucccccagccagaggucacggagcugguuagaacggaggacacggaagcaagauucccugcugaccgggucccgcuuucuuaauucagggaggaggagcaagagggacggaaagauuuaccaaaaaaaaaaaaaaaaaaaaaaaaaguuuuacuuugcacccaagcagcccaugccuaugaaaccuugaaguauuuaauguggagaaaaaugaaaauugaaagaagggauuauacccuccagagccacaacguucagaagguggaggaacucuguauauaaucaaguaugaacaaggggcaccccuuaggagccaagaagcgaggggaugguuaccaggagccacagcuagcaagugggagggguuuuguuccauuguaaguuugcacuuuugccaauuaggugaaaacuagcaauucucaaaggcuaccauuacauuucuaacuggguagacuauucaaggcaauaagauuagucacaugucugcagaaacaggcaaauaaccgaggacugugaugcauaugucugcuucccauuucuuauaaaacauaaauccagaugaguaacuagacauuuguuuguauggagaaguggccuuuucugccuggccacaugucuuagcuguguccuagcaacucuccaggaauugucuggauaguguccaaagaaccuuaaagcuggaaguaaacccagggcuacccucauggucaagggccccacuuuacagauaaagacauugagaccuaaaacaguaagccacuugcccaagacaagaucugugguugucaggacuugaacuuggcuucucccuaggggcugaggcacucugcccugcuauuucugcuauuucuggcuccuucacuagucacuagggcucuugccuaggccuggucuaaccuugcaaccuuggccaacauugccaaaugcuaccuuccagugguagguguucugaaagcaaagaggaaaccccuccacuuaggggugcucuauucugugggccagagaaguaucaaagugaccuaaaagugggaacuccaauacccucuuggaggaauggcuucuuccguccccuuuucuacacagucucccagacagcuggcucaggccagugguuuggccagagaaagugagcaaggaggguuugaagggacggcauucagcacagccuccgugucuaugggccaaaccucauuuccugaacacaaggaguucuccuaauguggcaggcaggucuuugcagcccugugguuguccaugcuuccugccucucuggagaacauaguacuucaguccguggucuacugccugugguagccugucucuaauggcauaggucuccccuggggcuggcaaacugcauaaugagaccugagguagaguggacugacagaaguaacuacgggguuucuacaucagaaagaaggggagaccauccaucaggaaagcugauagaggaagccucaggaacgccuugugaacauacugggguaugccucggguuuucagcaggccugccuuuggcugagagguuuuagggguucggguuacucagaggcuaugccaagacucaugcuaacuugccccagaggcugaggaagcucuuuccuuugggguuguuggggaaggaagcagauaacgcaagccuaucuucccaguagggucuaccagcugagccuuuaggcucaaccaaauaguuuaucuuacacuuuagccuucaaccuaaacugucagaucaacggccuuucccugccaagucuaaaggccuucaaugaaacuguacucagaacagggccucauaugauaccucuaccaaucugugaauuuauauaggaucuaguuauuugcucucuaagcucuguccaucagggcuuccauggggaacaucucucuguccccucuaaaggcgugucuccuucaggagucuuuagacuagcacauccaaccaaaauauaauacaaaccacauacauaacguuucauuuuccagggaccacaauuuucauacuuuuuuuucuagcagccaaaaauuuucaagguuaagaagaagcagaggaaauguauuuuacugguguauuuuaacagagcguaccagaaaauauuaucaucuccacauguacccaaagaaugacaaugaaaucaucaacuuucuuucacuugcugucuuuuaaauccauggcauuuuucuaccuucagagaaaaaucucaauuagacacuguauacguauauacauaugcauaugacauauauguauaugucauaaaguuuaugguaugcucugccaaacauacuuaaaacauucccagugagcaaauucucuuguuucaaaauuuauauuuaaacuuuaugaaauuaagagagcccucuggcccuccccccaccuaaggauacagcugucgauguuuguuuucucuugaaaagucagcucaucauccugguugcuagaaccccuggacacucccucuauugcugaccacagugaaaaagaaaaugggaucuucaggagugagccuggggccaggcagaugcugcugugagccaguaggaaggccaggggacacuccacagccucuacccagagccccuccucuuucucucuauaugcaaaugcacccacacagggcagcugagcuaaauagcacccaucugcagcuggaaagcagugagacuuggggagucugaaacacagcuuacauuuggguggauuggggagggggggacaaugagcagccagauucugauucucccccaagccuagcacugcagcaaagagcaggaggcugccuguuggcugggaaacaagacaggacacggaaugggcagagcaucuagcugacuauuuuuguccugauggaugucuugggccagugcuaucuaguggaacuuacagugaugaugaaaguguucuauaucuguacuguccagcccaguagcagccaacguguggcuggggagaacuggaaaugaggaccucuggguguauuaucauuauuauuauuauuauuauuauuauuauuauuauuauuauuauuauguauuuguucauuuaaaugccacauuggcuucuggauggcacagccucagccaaacagaaaccucacacaccaggggcaccuucuucauggacugcuugucucuucaccuuccuguggcaaaguaaucaugcucugaggcaggggcaugacucagauggccucccccaccccaccccccaccccagcauccguuaagcuauaaguugccccauuuauaucacagaacuacuucucggcugaacuucucuuugcagauuguaaguggccuauugggccaugaacuccaagcuuagcugguuuucugauggaagagaaaucaucacagauaagucucccccagacuucuguuugugaggacaggucaagccagcauccaauagcagcccaggaucaggcuauuauucauggugccagaaugacaagaagcccaggguggaaaguaauaguuccaguagcaacaggucccauuggauucaucuauuagaaggacuaggaagcaagguuggaugggaaggcauccuaagaacacgucuucauauguugguaaagagccagacgucuacaggaaagcaucggcagccagacugugugcuuagagagguugagcuuggguaaggugugugcauggugcuguagugcugugugcaaugcugcccuuccuggggugucucagcagccauaaagcugugccuguucccagggagacgcugauguacccaugguccuaagucaugggaagggggggaugaauagaucaacauuccugugacagaguaggcacauuacaaagcuggagccguagcacaacauacaucagaggaaauaccagaauauaacaccccugucuuagggucuuuauugcugcaaugaaaaaccuuaaccaaaaagcaccccacguuucucauccucugcagaaaccuucccagcagcaucuagagggaggaggguguugggauguguuucucuucucuuucuagucacuauaaagaagcaacacucugccacacacaacuaagacuugcucgcgcaguccuccacuccugcacagugcuccuuugucguccucccccccccccgcaccuucuuaaugcaugcugcaagcacacaaagagggggaaaggauugaugggauucccaaacuaguaggagggggagacagccaagugccagcuuuuaaccuucaucuucccuggaaaugugcacaaauugagcgccuuuggucuccugcgccaccuacuggccaccuagagguauagcccugcuuguuucuaaaagccuagguccugguguguccuucaggaagcaacaccaagaacugggaggcaaaugaaaauuuuaagccuguucuucacaagcaagacgacugaaaauuaggggagaggagacacucccaggagccuagacuuugcuuagugagucccagaguuugcaaaaguuccuuaaggaaaaacaucagacucuacucuucuaucugcacagaacccccaaacuagacaugccuccuccugcauccuguccuccaaguccacaacccaaaaaacuggguucaccccaaauacggucuauuaaccccuagagagauuccucuuuggacaggcagccugggauuuggcaucccggcagguucugauaccguagagucaggcacuggggggggggggagggggugcagggggagggcugauauccccacagagaguuugacucagggagagcccgccccaacacugacagguacucccaccccuccccuuccuuucuugugacuacucgcccaagcccauuaccaaucaggauuaaugaaaaccccuagaggcuuccuccuaguaggagccaacaucuaguucauuaagcuugacacgcccuagaggagcagaugcuggguguguggugccguuuguucuucuaaccaggugaggccuaaucuccacaugccuccccgcacucacaccagaucuucauuugggcugggagcuuggagacauuccacaaagucuucuucucuuucccucgccucgacuuuguuggauucucucccuuaucuuucacaucugagauaugcagcuaccaucauaucugagguaucugaggaccgguggguuuuccuucacccugcuuaauuaauuugagauaucacaaagcccucccucuccuuuuugaacauuuaauuaggaaaggugauggagcccaguccuccaccccuuucugacccugcguuuggucuugugggucaucugaagcauggagacagccaucuaaggucuccccacucaugaagguugcaaggucgggggcugagaggagaccgggggcaccuaugagaaaagaccuuacuggaaauaugugcugagaugggcuaggcagguggcguugagagaguaagagacacaugaacaaaguccuacuucuuuuuucuaaagguccuaagucaguuaaguauagacugucaccaaguauagucaccaaguugcuccuauggauaacuggucuggccccagccagcugucagccccucucagacagggcugaggaaugcccagccuccaaggguccagagcacagcacaaggccaguugggagccacuguaagaggaugaggccucugucuuccaucugcuuccauuuguuccucuccggggcccacauuucugccucucccaucucccagcccucaccacagucccccugcccccucuacugcuccugucccuggacacccagguccaaacaucugucaccccucagcccagcuguucugaaaguacaaagaccucuuuaagcggacggacacacuuggcuguucuugccuaugucuggacugugcccugcuuucuucccuuggcccagcucuccaagcccugacugcuuaaccuucugucuccagccacuucaucucuccugagcaaacugauuuacauaaccuucaccugcuuugagccuuguccugucuccuucucuagccugcccauguguacuagugagguguagucaagaauacaccccccaccaugaugucuuuuccccgcccccucuugcuuucuuagaccucaucauuggaucucucugagucuccaugacuccucugacccgaguccucccaguucuggucucuagacacugcucucuggccccagaagcugauucuccgccuccuucuccccacagagagagacucucgggaacacgaggaacccaccaccuccgagauggcugaagagaccuacucccccaaggucuuccggcccaagcacacucgcauuuccgagcugaaggcugaggcugugaagaaggaccgcagaaagaagcugacccaguccaaguuuguggggggugcagagaacacugcccaccccagagucaucccugcaccugagaugagacaggaauccgaacaagugagucucaggggcuucucuuccccauacccuggccaccaucccaaucugauuucccaugugucuuacuuuagcaucuguggucauagaggaugcacaggcuagaccuaccaacagaccuauugcucacaguggcucagcugggaauuuggaaggaugcuuuugagaccuugaauuuauuuaucuggacugagggcugauccaaguuaguggaaacagagguaguucuccuucaaagaauguccuauuguaacugcaagcaugcaccaggaaugugaccccuagagcuauggccagucccaggaagaggcugaacacuauccuagcacauuuagagaauguaagcuguauaucuucagugcuuggaaggguaggaaagcugagagcaagugacccagggcuugcugccuacccacgugccggcuuacuauacaaccaaggcagcagacagaugaaggagaagaaagauccuaaguagcuucagauaaaggugguagauuuuucucccgggucccuuuggaugccacacaugagccaucagagggcaccgcugagugguuuccaccuggguuccuccuguguucacagggccccugccgcagacacauggaagcuucccuccaggaguucaaagccagcccacgcauggugccccgugcuguguaccugcccaacugugaccgcaaaggauucuacaagagaaagcagguacaugccccugugccgggcuucaccucugagguuuccgauuggcaguuccagacgacuccaagugcuuugcauuucuaauugggaucccuaaucuaaguuaacaguuacaagcuagggccccuuggcguguaucuugaccccgccauuucuagcuguguaacccuuggcccagcuauuuaaagccccugggucuuuaguuucucauguaaaauugggacuagcaaucuacuuuacucugauggggagaaauaagccuuuaucuugacaaagcacugagaucggcuccugccacaaugacccguguuaaacuucgccuggccugugauggagccagaguaguguuucauacuuugaugaccgagguccucucuugaggaucccuggagaacgugagauggguaacccaaaguaaauaaugaaagggagauggcaggaccuaucccagggcaggaugccugaacuaacuauuuucuuuggguccucccaugagauagaaucagcaaaaccccaagaguuagcuaaaggcggaauccguuuaacccucaagugcaucgggaaaggucagagccagaagagagccucgggguacaccgccgcucggguaucucacagccgcuugucucucucccaguguaagcccucccguggccgcaaacguggcaucugcugguguguggacaaguacggaaugaagcugccgggcauggaguacguggauggggacuuucagugccacgccuucgacagcaguaacguugagugacgcguccccucccuuccucccccuauccuacccccccagccccaacuccagccagcgccucccuccaccccaggacgucacucauuucaucucauuuaggggaaauauauauacauauauauuugaggaaacugaggaccucggaaucucuagcaagggcuaaggagacacuccccaccaugaccccggaaauguauuccuuuuugaagcaaguugaacggacagagaagggaaggagagaagaagcaagagggagcgagagauggaaagaaagcaaagcguuggaauagaggaaaagagggaaggacagauaggauuagagagagaagagagaaacagcaaggcagaaaggacuccacaaccaaggcugaaucugcccuuuugcuuucagcucuagccuggggucagaaaaaguguggcauucagugacacccaguuuagauuggucaaggggagaaaagaaacaaggugugucagugccucucgggucuguccccuccugcagccagcaguguggauggcuagaccccucacccuccucuccucuuacccaagugcagggugauuucauccccaaauuuacaaagacuaaaaugcauuccaucccucugaaaauaaacaaaagugagugauugaagauagguuuucccccagcagacaagugaacucagaaugugugcaaauuuuacucuuguuaaagauuuuuuuaagaagucaguacgcacccccaacacuggaaagacuugauucuccagggugacaagcaauucagaagcgcguggcuucggcccuugauuucacuagacucaaagcuggcccggcagccucuguggaggaggaugagagguggagaaaaccaaggggcuuguacucacccacaagacuccauguagacuuuauaggcauauaaaucuauuuucuuuaccuuuuuuucccuuucccuuucuuucgaaguuuugcauuaccucuuuaaaguaguuuuuuuuaggacacugaagaucuuccucauucugggaaaaauccauauuucacaaauacaacccagaacgccagcuuggccugcguccaggcagccuuucucgugagcuacaaguguggcucuuuuguggggcaccgauuuggaucuucucaugauuccaaacguguguugaagugaauccaccaagccagguaacugccagcacccaagggugcaucaagugcauagcccaggucaccccauuucagccuuccaacccgcagaaaguaacugucucacaccacaccacauaaaccugccagauccaucuguaacccacuggccugcccagaccuuuuuuucccaucugcauuuuuuuuuuugaacugcauuuugaaagccucccucagaugccaggcugacagaucagagagaaacuaacaugagagaugacagaggaggaggaaguggagggugggggcagagacuuccacagagagacauagaagauggagcagaggucuggggguggggaggacaagaaagagacagagagaggaaaauaccaauagaauuuuccuuggugucucccaucuaaucaacucucugagauuugagaggaaaaagaaggcaggggaagaacuugagguagaaaugaggucaguucaagucacagggcccagaugguggguaacugaggcaggauccagacuugagacacacgguuggaaacaaggcugguuagccugacuggguauugaagggugaagaggaugccuuggaaagacagcacaacuucaguucaacuucaggcccccaaggaggaacugaggccaaagaauccuucaagugcuucaugagucuccucugcccgacucaaacauccuucccugugauggaggaugguagaaagcccaggacaacucaggcccggaucuucacgacuguugucauuugccagccugauuuugauccaagagaagcaucucauugcccacuggcuucuucaacaaagaggugcuuaacaaaaggcucaggacugucuuugaagacugaagauaaccuuccaggagaggagacucggacauugguacaggaggccccuuuuggcgggggacacagcucuuugcgcucucuugauggcauggcauaguagaggcccccuccaacccggaacauggagcaacacaaagggagagcaaagaaacugacgugcgucgacucauaggacauggguggcugcgggcacagaaagggaugccuccuguugccuggacaggacaguuggcugggaaggaaagagaaaauugaucuucauaagacaaagggccugaugggauggcaauagaaggacuuaccagaccugcagggucaguauacccaucaccccgcacaacauccccaacccccaacucaaacuucaauauaucuuaggccaguauccuagaccuaagucucuccuuucugccauuauuucuccgcaucuugagcagucaucugacugagauuugccaaguggauacugggguaccacugccccccaagaaaagacugagccaggaacugccuacucgcucccccucccgagccuggagcuaacuccugugaggggugcucucuucaccccacaacuuacuagaccuugagugagccucugucccuuaugugggcucuucgcugugagccacagauggaggucauuguauagacaguuagccuuccccaggucagccuaccucccccaaacuugugagucuccccgcugcucauauggagaggcaugucuaagacagcaagucuucuagaggaagcuugccuuuaacagacagauggaacuaaaccuuccaaaugggagaucuggcugaacccaggauacagagaccauggacauggauggggucaucaagagaagagggauguccuucuccagguuagggagagagaaggcaaguuugcaacgaucccaucaugcccugagcaagaagcuuuuggcccaggcuagccuuuaacuccauuagaggccucucuguuggguuuauccacagcaguaggcccaaguauggccuguccccaccucuacuaucccguggaagguuucuucccaccccuuuuugacaaaugccucacucgagcaguggaaagauagcucucuucccccucuacugccagguaacaaagagaccuaaccaggaccuauucuccaccccagccagucuugaccagccagaacaaagcagggaaccuggagaauaaaagacucuacguuccucugacaaagacucuacguuucucugacggccaggccuaaacagacaaggcuugggaacaucugccccacaggauacggaggaggucagcugugcucacuccucuucuccuuccaagacccucuuccgaccaugacuuaucuccaugguaacauccucaccaucauucucccacuaccaaggguugccauggcaaccucccaaccaccugcccaucccaggcagggcagcuguccuucugcucagaacccuagaggacucuaggugaaauuuuacagcuuaagagaggagugagccaaggagaagagacccuguaguccucuggcuuucaagagaaagaaggcuaugauuuaaaacacaguagaagggaaagaggucucgucgaccucucccggggagcuuagggguuguacugucuuuauuuuuuaaaccacuaaagugcaauguuuccugcacucuuguuaccccgccucucuucccuguuagguuuucauuuccuugagcagacuuucuugguuuuuuaauggaguauagacuuucaccacuucacagacucuggccuccucuccaagucucucuggauggggaaaaggaagguagagggucagaggggaaggggucccucgucaccccgcauccauucacccccacuucucuggucccuagucaccggcuucagcccccaucuccgacaccaucacugucacacaguagccugucacacggauaguacaguucagacaagacuccuucagauuccgagacgccuaccgguuguuuuugguuuuuguuuuguuuucuuuuguuuguuuguuuguuuuuuacaacagcaauaaccacaucacauauuacuguagcucucuauaguguuacguucagacaccguagcucuguccucucuuauuuuguugguuuugacuuaaaaaaaaauacuuaugcuuuuuacuggugaaacagauugaaaaaaaaauugaacaacaaaccaguuugugaaaaaaaaaaaaugggaaaaaaaaucaccccgauguggaagagcucggcuccucuuuagcauuuuguacuuaaggaaauaaaaaagaaaaaccuggaagaucucacauuuuauuacaaagugaagauuucuguauucuauuuauucaacuuauaauuuauguuacuccuugaucuuugucuuuugucgugacaaagcauuuauuuaauaaaagugugcauucagcuagcu

SEQ ID NO: 218 - RNA, 736 nt, Mus musculus
uggaaacaagaaauagcauccuaucucagaucauccaagaaauaacagucucuuagaccaaagguccaguucugcugaaauacagaggugagcaagaaucagaauguagaucuguccucaccauauccuucucauucuggugagugaacuguccauaauacuuugaaguaucuagucccaagugggaccauggcuguccugauaggagauaugacauuacauugucuccucaucugaccaguucaagagagaaggucuauccaacaauuauuccaagaaaaggauccacauuccuuuucaacaaaagccaucuccccaccccuuccgcuaccaacuacuacuagaaacuacauccuuuuguucaucagaaacuuaaaaagaaacaaaaccugagucccauuggauaagccaagguguagaggaaagauuccacaguugggagagaacacuguaggaaaauguucauaauuacaagaggaccacaacgacugccaacucuucuuggaggccaccuaaucaccuaacgcagccugcuuacuugcaaacaagagacaggguccugagaaauccaaccagucccagaaccaagaugagaugucuucuguugagaccaacuuaacaccaugccggcaccacacagcaauccagacacaaaaugggcuuucacguaacucguuggcucaaucugaagggcaguguuacaggauaguagacuuugaauaaaugucaaagggca

SEQ ID NO: 219 - RNA, 1077 nt, Mus musculus
agaguguucugggaggcagcaguagcugcugcuucccuaauucaaguccaggucaaugcugcauuggcuacuggugugguaggcagugcuggggccuggauugucccucuuggcucuuccucgaagcacucguagacaccuuugggcagcuguccuccagggggcuguguagcgcugaucacccagccccauggccacaggcacagcggcagcacuggugcugcccaaugagaugagcgauaacagaguuccaggcccuaguggugggcgacgcucauaggccaagacugacaggagcaauguggccacauagggcccccaacacagcaagaagagcaguguggcuccugccugugcccuagccugccuccaggugagagcccuagccaggguugaggguacaucgcggcacacugcccgcuccagucggcggaucucacacagcuggcggugggcaguggccaacacgcggacagagagaagggcaguggcccccacggcaggcaacaggaggccauaaacuuccagguagagguagggggcugggaagacagcuugggagcugcaguuggcaucagggcuccaaugguuccagcccagagcaggcaggcuggcaaagaacagggagcugacccaggugaggaacagggcuagccgcacacuuccauggggccggaguggcugcaacacugccauguagcguuccccaugcaccagcagcagauuggcaagcagggaaaggaaacaaaaguugggggucaaguggagaaggaggcaggaccaguagcccugaugguuccggcuccauagcccaggcagcaugggcagugccagcccugugagcagcccggcuaguaguaggcuuaggaagaagcagccagcaggugggcugcgcaaguggcgguccagggcgaugccuagggccaggagcagguuggcgaugacgaugaggcuugccagggccaaggaaagccccagaacccccaugggaauggccgacagcucagugcuguugggugucaucaugggucuuggcacauggaggguccggagcugcagaaagcaugccuggaugga

SEQ ID NO: 220 - RNA, 5222 nt, Mus musculus
cugccaaugggaaguauauuuuauuuacauuuuuaaaaucuguaacuagucucucuuccuccuuuccuuucccagagaguugggaagggaaagaacgggaaccucaaagaccuaaccccaacauacaaagacgcaccccauggcucacaccagcgaaucaaagucaaagagacacggccuccuacaaggccccagggcugggcaggggagggagggccuggcaaggcgggucuccagggaggaaaaggacaaggaguaagcaggucagcugaaggggucagaaagcaguccaguggucuccccuccucuucccucugcaccccgcaacucugcugggggcaggggcgucccuuuaucccccuuaacaccagacaccaugccagaggcuacagcuguuaacggucaggucucuggacacaaaauacuuuugcuuuguggucuccugauguggucaccaccagggaagcaucucuguagacagaacacaggggucaaaggacagaggaagcugaggcccagugcaagcccacucccagggguccugauauaguggcuccagcaucgccucuaccaucagccccugccugaaucugcacuugcuucucagacccuucucccaaagccagggagcugauucaacuaugcccaugcaaacugcagaagaaccagugaaggaagccccuaacauaggaggaccacagaccgagcaggacuguucauucucagggucaggccccacaauggguaguucacugccaaucgcugggauagggcuggguucuaggacugugacugcacagauggacggcccagcaugccuuuauuacaggacacagucaggcacugggucccguuucccuuaggaaucgccucccauuccacaaaggaccugugcuaccucacaccagacccacuuucuagagcugccagcccauaaugcuuacuugcugagggcaaaguccaggaucucagcaguguggccccgguagucaguaagcaggcggccaguccgggcaucccagagacguacaacaccauccaggcuacagguguacaccacagcagugccagccucccacagcagcugaacaaugcccgacugucccggagugugacacaguaacauaguagggcagaagucagaagggagaagagaggaccccaacccacccugaggagccacagaggacaggcugccccuuagccagcacaacagccccuaaguaggaauuaagccccagacaucacaccuggugcugacauuggugccggagugucugcguagacaggucauagauggccaagguuccguccagauagccaacagcggccagaggcaugcugggaagcaagugacacaaagaaggcucuugagguccuagauucauauaccuucccuccuccuuggucucaauuccuagaugccuccucaaagccaccuccucccucagucucuugggucuccaggccaagguucugcucacacucacacacugcagaagcccaaggacuccacggaguuagacucacucuccucccccucucccaggcugggcugggaggcgacugucucaggucugaacacacccaccaccuacagguaagaaaagaggcucacagaccuggacaaagagggaaaagacaggggaggugcagaagguccagacaaagaagcccaggcuacuuaccuugccagugguggcacugaccagcuuggccuggcagucuacagagccagucaggaucagacugccauccugguugguggcuacacaggucagagggcccugaugacccucagucccuagaacaagcagguggacagagguuuugaguccuguaccuggcucaggcuccucccucaaagccaaggaaaacaccccgcccccucugauaccuuuuaguacauggaugggguuuccuugcuugaggucccagauccugaugguaccaucuucauacccuaccacagcucucuucccuaaggaccaaggcacggauaaccagaggacagaggacacucagacacgccaaggaaagaaugagcagaaaggauaguguaggggguccccaaauucccccuggagucacagguaagaccaaguauagggcaggagacugcaaugacugaaguaaccccaagucacuggauccaccuguacccccaggaagagauaacugcucucaccaucagggaggacgcggccacagguugcagggcaguuggggcccugaaaggucuuacagucaccauucgggaccuuccacauccaaguguugccaucggcugugcccgccaacaggacaggagcccgagggugccacuccauccacugaucagagagggaggaucagcaggcagggccuacuacccagccuaccuaaguccaugagccucaucuaaggugugaccuucuaaggucagcgagaacuuuacaggcgaagagauacauugcuagagcugggcugcuauggcucuaggcaaacuucuccaggcuagaucuggauccgucugccgcuaucccucucacuuaaggucccaaagaguggaagcucacuccaaggaucucaccuccaggucuccugcuucaaaggaccagacuucuuccuuggugucuaccugccauacuuucaaaagaccacucauguccccuguggccacuaggguggaaucgugacugaaaccagcgcaugucacagagucuuuguggccugcagcaaagagaaguaggcagguuuuaaacucaaguuugccuaagagauguaccaaguuugaggccagccuugccaacauccaaggccaacccaacuauauaaccuuuaaaaagguggcaaaaaagaacauuaaaaaauaccuaaauguuggggacaagugacccaugcaucuagucacuguuuaaaggcaacugagcagaaaagaaaguaggaggaccucagcaaagaagggggccaaacuugcugcagcuccagggacuagcacucccguuucccaagaacagauacuacuggccccacuguuaagcaaccagagccuaucuucucugugccucugucuacuccuaccccagcaccaugcucaucucagccagccucucuuggccuauuagcauguccuguccaaaugccugccaaacaguucuuccauugugggucccugaauccggcacaagacagaggcugguaaacggcagcuggguauucucaggggcccccugccaggacauccaaaggaacacaaccuccccagccucucaccugcacacucaaagagcagcucuccaucaccgagccuccacacgaaggccuugucgucuucgcccccugucacugccaagguguugguuuugggguccaggcucacacagaacacagacgcugucccaagacauaguccaugagaauggggauggaaccggguucucaccuagagcucugucuuucagaaccuucaggaagcacacucccuuuuuccccaaagccauagcugcucuuuccugggacagcugcauccaguucuugucuggagccucagguuguuagagaaacccuuccagagcccacagagcugugaccuccucuggagcauagcccccugcugugcuguuccccuuaccacguucucugaggugcacagcugacaggacaggccauaccaggcuagguaugaauuaaguuaugagaguuucaugaggcuggcauccgagauuauuauuaaugccccuucuggaauguaaacuaccuuuaauuuccacuuagguuacuuccauucacuuucauacaagauuuuauauauauauauauauauauauauauuuuaaagaauaccaagauccagaaagcuaacaaagcugacagacugcuaaacagcagagguaggauuugaacccaggggucacacuuaaccccagugcccuauggcccuuccuuugaauauccugcaggccaaaguagguggcuuucacuuuggucucuuauaauagcugccuaggaccaacaggccauacucaaaagcccaucugcacugaucugagauguucaaaggccuaccugagugcaaugcaaaggugaccucacuaucauccgggcccuccaugcuaccgaccaccccuuccugggguuccaagacccagcccucgucauugcccucuucuucuucuuccucuuccucaaaguccacgucuuccaucuccugggccagaucaucugcuuugagagaagcguuaaaagauggagcuccaaagauaauacaaggaaugggguaaggguuaaagaaugaaaaaggugaagcuagggugggucguguggccaaagguuaagauguugucucacacguaccgagcaggaagagagcacuuggggggcggggagggggagagaggcuaggucugaagaucugguguuggccagcgaccgugugggaagagaggacagagggcaugaugggaagggggugugugaggggaagggcuaggggaggcgucagggaacccccacccagccaggccuagaaacuaaaggugggggguaggggaggaggucugggagagaaaugucgguaggaacgaccgguagggaaggggggaggggggacuggggagaagcaggggucagaggccaggggugagcgccucuugucccguggccucaggagcgucaguucucacccggguccggcgggccuggauccagcucuaccaccucaaugaucucuucaucuccgugaaagcucagagucuccagaggcggggugucagcggccgcuccgcucuccgauucggacuccaugcggcgaaagcuaccgauccacuucucugggcccaaacgccucccagagucagcucugcgcgacgacgcggaacucgagccccuccucccgggaggaaguaggcguaggugacucccggccgaaagagcgacggcauccgggccaauggcgacagugguggacuaacagagccgccaaucauaaggcagaacuaggaugaccaggccggggcguggcgggagagcccaagcuccaccuuacaugacuccgcccccagcugaagggaaacaagcgagcgugcgcgccuccagggucuccugggaggaguaguucuccggggcccgcuacgcggacuucugggaaauguaguuuuugcucuguaggcaggacggaaggcgcgggggaggccccuuacgcaaacuacaauucccgacggggagcgcagugaaggggggug

SEQ ID NO: 221 - RNA, 708 nt, Mus musculus
gugucugaguguccucuguccucugguuauccgugccuugguccuuagggaagagagcugugguaggguaugaagaugguaccaucaggaucugggaccucaagcaaggaaaccccauccauguacuaaaagguaucagagggggcgggguguuuuccuuggcuuugagggaggagccugagccagguacaggacucaaaaccucuguccaccugcuuguucuagggacugagggucaucagggcccucugaccuguguagccaccaaccaggauggcagucugauccugacuggcucuguagacugccaggccaagcuggucagugccaccacuggcaagguaaguagccugggcuucuuugucuggaccuucugcaccuccccugucuuuucccucuuuguccaggucugugagccucuuuucuuaccuguaggugguggguguguucagaccugagacagucgccucccagcccagccugggagagggggaggagagugagucuaacuccguggaguccuugggcuucugcagugugugagugugagcagaaccuuggccuggagacccaagagacugagggaggagguggcuuugaggaggcaucuaggaauugagaccaaggaggagggaagguauaugaaucuaggaccucaagagccuucuuugugucacuugcuucccagcaugccucuggccgcuguug

SEQ ID NO: 222 - RNA, 68767 nt, Mus musculus
aguaguucuccggggcccgcuacgcggacuucugggaaauguaguuuuugcucuguaggcaggacggaaggcgcgggggaggccccuuacgcaaacuacaauucccgacggggagcgcagugaaggggggugggacccgaacauggcggcggugguagcugcuacggcgcugaagggccggggggcgagaaaugcccgcguccuccgggguaaggagagggacccucgggagggcaggguuuuaaaagauuccguuuccuuuauaucccacccagcgcgacagcaggaagucagcaugccaauugcugcccacaccucucugcaagaucuuagagagucugggggugaaaagaugcucuagaggucacccaguccaacuccugcguuuagguugcgcggcgugucuagggucuuauugcuagagaggguaccaaagaaaccuuuagacucccgcgccccagggguuucacacucaccgcagugcagaggaaagagcccugggcaucuggaggcuugaguucuagcacugaguaauuagcgguuugaccuugugcgaagcagcucgucuucgggcuucagcuuccucuucgacgggauggaguuaguuauccuuaaggauagcuuaagguccugcaguuuuaaaacaguuccccggauuuccuucauacguaugucuccggugaguuccucugcaguccuucccagccugacuucugaauagaacagcagcgaagcucacugccuuggcaccagggugaggagcccgcagugacguuuaaguagccuuccaaaggugucacccgauggcgauuuucccauuucucuuuagauucuucacugcacuuguuacuccagacugcagucacuccccuuccucaucucccauacugacaugccauacuuucauucacagggauccucucuggagccacagcuaacaaggcuucccagaacaggaccagagcacugcagagccacagcucaccagaaugcaaggaggagcccgagccccucuccccugagcuagaauacauucccagaaagaggggcaagaaccccaugaaagccguggggcuagccuggugaguuuaacugcucccuuugccuaccaguggggagugcauugaaagguguggggaccuagaaacuucucugaaaugcggguggagagcugaauccaagggaaggaaauugcuggagucaagggauggacucucagaaggggggggggggcuaggguggaaaaauauguaaaauugggggauaguggcuuuucuguggagcaaauugagcugaucugauuugaauuugagucacuggauucauccuucccuuugggagcaggggucacauuccaaucccaguaauuaagugucagauugcguuguguagaagcuagacguguuucugugaauucuguggaucugauucuggccuuaauacauauuacugauuaucacucacuaaaguaaaaggaagggaaauuaacauuuuuuuccauccaaugucugagguaugacaauacuuugccauauaacguuugaagcuuucugagguaaaccuugcauuuccaucccuccaaggagggaacagaggcucccagcugugauugucaccagcucuuguggcuuccuguucuuuggcccuuaccaaugcccucuuucaguuguagcugcuaagacugagaguuggucgauguaccuuagugguugugcacaagcuuaacaccauaaagaaaaauaaagaggucuggcacgggacaugagacaguguaugcagggagguccuuugcuaacucagagcaagccugggcuacuuaggcuaucacacagaagcauucaacacaagugaagagacucaugaauaucagccgucagaggagaaaugaagagguagguaggaccacacugggcuuugaguacuaugccuaggaguuuggaguuggcuaggauguaauagagcacuauuacgguugucuaaagcaggcagcagcaggaggcucugguuuguggggucccuccagcacucagcacaaaggacagguagacguaagaugucucaccacagcauuuguacaagugacaaagcuggccugauucuucuagcuccucuggcucagugccagucccugcccaaacccgguacacaucuccccaucccuagggccaucggcuuccccugugguauccucuucuucguccucaccaagcaggaaguggacaaggaccgauugaagcagaugaaagcucgucagaacaugcggguguccaacacgggcgaguaugagagccagagguucagggcuucaccccaacaagcccaguucccugagguugggucuggggcccagaccugagugaggaucacugcaaccuugugcuagacuauugacugccgucuuguguggccauggcuccugaggcccaccagagggcgcaggaugcccaagcugcugccagcacccaacucuuccacaccguggaaggagccaaaugcaaauaaaguuauuaaguacugacacggaaaggaggccagguugaauuuguaaguucccaggaggggcgggucagaguggaaauagcugcucauucccuguucccucacugacccaucuguguucccagauggcugacggagccacggcaagccuaggagcaggcucuggagacccaagucuuagagccacuaguuaggaggguagcuacccauugcagcugaaacugguuaaaauuagucaggcguacugguuaaaauuagucaggcguggacaucuuuaaucucagcacucaggaagcagaggcagguggaucucugaguuugaggccaggguuccaagacagccagagcaaaauaauaaagagaccuugcccccccaaacaaaagaaaccaaaaaucaaauguagcauucaggauguggaagaaaauuuaaaauuaaaaaagaaaaaaaaaagugcaucuaaauaugucaaccucucugggccauguuuuccuccuuuguaagagaaacuaguuuccaagagauucuaaagcuauggucuagccccuuuccuauaaagauggagcuucccgggggaguuaaagcuaggcaaguuuuacagaggguucauggcauacacgugauccugcgggguggcugagaagccccuucuggagccagugcuccuggagccagugcugcagacuugagcuccguuccucaggcagcuuuuaccauugcagcagccugucucacccaccaccaagaacuguucaggaaagucuuucuuccaaauacuggguucccaccuuagaguuaagaaagccacagcaacucaagggucuuccugccaaacauaaaacuuuauuacauuucuaguugugucccucugugauauauucagaaucaaguacuggacagaauagcucuaacuauguccuugggcuaguaagguuucuaccccaccugauaaaccggcuucuguucccauccugguaccagccggaggaggcacuuggauuacauagaaagcagcagcuggcuugaagaggggguuuuagucugaaaucucccaaugggaauacagaacagauugaacuuguguaccagaguagacuucaguguuucucagaccagagagggcacccaaggcgcuuucccuguccccacuuaucucucacccagacugcuucccagccacacccagaaucccacaauccaccucugugugucagagcaaaauaggaggucccucuagguccgauuuuaaaagccucagaaggccccaaggcacuuugggucuggaugguagccaggcugggcgccaggcaggguggaugccauucugguuuagcccccauacugaugaaacucugcucacugucuuuuuuccccuagccagauaaauaacugauacauguuacuggaagaugggguuggaacagagagaccccagggcacagaucucuucuagcuucuaaagcuaagagaugccaagccuaaagaguucagacagcauaaguggccuaugagcacuggagcuggaggcaaagcaucuggcuuuauuggauccaggagggagacagcuccagcuccuagccuagaacccuguggccgaggugggaggggagccucuuccccucagagcuccuguguucacaggcucccuacuccccuacacacacccacacacacccacccacacacacacacagaguuuggugcauacucgucauggguaaagggaaggagauacaccuucagacuaguucuuaccaagcccaccaagggcuaagaggugccagugaucccagcaucauggcucucacugaacacagccagagguccucccauccccaggacggagaggaaacugagcagauuacuugaggggagacgggaccuagggcccagcccaauaggaaagggugagucccaggccagugaaagggacaucucucuuucucucagucucuacuuccuacgagcuggagcacgaacgugaagauauagacuauaucuguguagaucuguagggcgccugugauguaguccuccgggcugauggugugcuuccgguuccccaggaccagcugugugucauaagccaggaacugcagggaaaccagacaugagugccaaggagcucaguguccaggguucacuuccugucagcacgauguccugagagcccugggccagccauauagcucacuaauggagucagucacuagggaggagugugcuuuuuacaugguuucugccauugagcaguucacuugucuaccagagacuggcacacaucuguuacccagccagcaaugugaacagagcaaaacagggaugucagaaacuuguaaaacaccuacauaagaagagaacaauuguccauggcuccuccccaccucccaagcugccuaaaagccaccaucucagcuccccucccagaagagggaacuaacuuaccagggugaaacagauggcccccagagcugcauagaccauguggagccaguaaaucuguaaaauagcacaguauggcauuagggagccacgcagagcauagccaaagcaggccuuggagacccagcugacccugggacuccagcuagagaggcagguagggaagcuaccucuccaggauccccaucuugccucuagauccugggagaaacugagauuguaauuuaucugccaaaggcugucccacaauguccacguuagcccaucagcccaacugaaagcuagugaaguccaggaaugucuacuggaggucauggaaacaagacaagcccagugcaugcuguuugaagagccugugacagugagcucccaggagccagcccauggaugcagcucacuggcuccuacagcccaccuuagauacaguuuagagaagccuguuggcaaccugccaccccacucaacacuccugccaagugccuguacacagaccaggaccagccauggugaggggggggcagcaccucuuguuuugauccuuccccuccaacccuguguucccgccuuagcugacuggaagcaaagaacgcagcagaaccagcaaucucggggccacuuccauccaggcccaacuuaguccuucacgaaaccuggucucggcuaaccuaucaguuccuguaggaaccaaguggugcuauccagggcuuaagggggcugugguuuaucaccugccugagagaaaucuguuauacccuaacccaaaaggaugguauuguguuggugccugcacuggccaguggagaggugugugagccagagcccgccccugcuccacaggaagucugcugccuggguucugccuacccuucuggcaggacacucacauauuuaaagaucagcacuaugcuugugacaauuccggucaccaucagcacuauucccagcacacagaagaggccuguacacgaggugaaguccaccuagcagaaagggagaaagaggcacgucgauaacugccauccuuagcaucccagaggacugacccugagccccaguuggggagucccagugcugcucuuggggacauggcagugacagugauaugcuaaggacauauaucauacaggaagcaauuugucaaguacagacaugggagcaggagauuaggcuagggaagucccuagucugcaagggucugaacccuuccaugccugcccaagugcugaacccaaagguguguguguguguguguguguguguguguguguguguguguguguguguguguguaagagggcaggauggucagagaaaggccuuccccauccucaccuuagucugaaagcagaagauggugacagagauggauaccacagcggugaugaucauugcuaugaugacagcuuugguuucauacauacuggggaaaaggaagcagcguugagaugggccagaggcagaagccauaaauagacucccuauguucaggauugugcccauaguccauccagccuuccaugacauucccuccccaagagcauggaggauugucccugaacauaccuggaaauagugccugucacaaagcccaaagccaaagucugcgggcaggagagaaugaggccaaugguuaagaacagcaugggcuauugaguauggcucaacacagaacagccucaacacuggucgccaugacccugcaggagcuggggguaacuguauugggaagaacagccacagaggaaagcaagagcagggccagccaaggacaaggguguccccaacccuuccccgaguguaggucuuccauuucccuucuagacuuacaaagauggugagcaagaugauguuccaugggaaucggcgccuggagacagagggagagggaggaagacccugguuaccugccugggccaucaagucucagcagcuccuuuagcagaaguccugagaaauaagccuucuccuuagggaggguacucagauauuuacacaaggauaacccgagacaguccuuuccuguggagccagcauggcugggacuuguuuagaaccugcaugucuccugugugacugugacaaaaucccuuggcgccucugaacccugaguucuuccugauagagaugcaguaacuuucccuuuuauguuuguaauuuuuuauuacguuggugugugugugugugugugugcaugcaccacagcacacauguggagaucagaggacagcuuguaggaaucauuuucuuuccaacaugugggucucgggccucaaacucagaucauuaggcgugguggaaaguaccuuuaccuguugagacaucuugcuacuuccucccuuuuugauuuucuuuacuguuuauuaaaugcucgacaugguacauaucuuguauauaugauucuuccauaucuuguaagauagauauagcauauaggugggcauugcacacuacucuguaacacagcuggccucuuguuccucaucaauacuccuuguaggcucucuucacugugcaaacccuuuuccucuuacaaugcucugccccugucccacuuucugcccuccucuugucagggucuccaacacucaccugggucccuggcagcaggcaagggucagguaggugacaaggaagacagcacugagggaagagaugggacauagcuauaggacacgacaccccccggccugcuccuagcccaguaugaccugaaggcaaugcaaggugaucauagagagccugggcagcaccaugaaaccuucauuccaucaccacgugucugccugcuccuguccugucccagcacuccgugauguuacuccuccucagguugcucuucugccccugccuggagacuggcacaguuucugggaagcccucucucuuagggcauaguucugcccugaacaacgccggucagcugccuccugucccccucccaucccagcagcaacagccugcacucacuaggacacguaguacacagccacauuguuccucacguauuugccgacugguucccuguaaaacagaggacaccaagaaaagaaucauccuguggcuguccgccuccagcggagagccaccccugcauaggcagcccagcaguaacccaggcugagagaggagagacucacacaaaggugaagauugcaaugauggccacagugaugagcagcuggacagaaaugaugcaauacaccuagaacaaagagccagggguauagcucccgccucauacaagccucucccugaaaaacagucagugccaaggccucugcccaccuaccucacccccaacaugcuagugguacaaggggccuccuuuuaguuugaaaggcucagugguuaagaacauauauugcucauggaccugaguucagaucccagaaacagcaucaggcaacucauaauuacuuguauccaacucuagcuucagggggucugaugcuuucuucuggauuccuuggauacuacacucacaugugugcauacacauauacaugcauacacacacacacacacucacucacacacucaauuaaaaauaaaucugucuugaaaagauaaacaaugacuguaauuuggaaggcuccacuuuuccaguccucagagagucuucccugacugcagucuggccugaaagggaccccucugccacuccagccguuucuuggccccuuuccaccuacccagcauccagcuuauaguauagcgcuuacugcucacuugcucugccugcuccuguccuaacagcaguuuucugugacaaggguugaaagaaaggauguguggugguuuagagacaacauguuuacuucagcucccaguugcuugcugucuaacaggacagaacaggaaggggaagugcagaauccaagcccagagugacucugucaucccaaaacaaagucagggcaaugggaaucacagagaggggagucuccucugaggacggugcacagguaggcagcuaagacacguacgugggaaugucuaucuaaaccuagaccuccccuaagccccaacccaguucuuaccuuuuggaugaaggaaugucgaacuuuccggucaucccauucuccaggacgaaagcugucacuuccugcucucuccucuucauuauagucauggccuaggaccagaggcagaucacaucaaccaacuggggaccuaggacacauagccuccaucucaaagcaccccugaccucccugacucaaaccaaggcucaggugccucuguccaaaagacacccuuguaacucagacucuuauuaagcuuggguucucuaggcuuccucaguguaaccccagcuuggcucaggugagaaagagcugugcugucagcaggcagcugcugcgggcuguguguccagcccaccuauuuggagacaggcuaguggcaucgccaucuaggaagcagcuggcauuuagggaguggaacuggcuggcagagcaguggccuugggaguggagugccagagaguaagagggaagacuacacaggaaguagguacaggagggcaugggcugugucuacagcaggcuucacaaugcacaguggucaccucagaaugcauguccaaauaagagcuggccauauacucacuggcucuaggacacugaggcuacugcagccaccaacauuccauggaugccucuuggggaacuacuuccaaaaucuacccagaaggagcugcgguacagcucauaggcauaggcagagcaaauguuuaaugaccuugaguucagucucucauaccaaaaacaaacaaacaaacaaacaauauguguguguguguguguguguguguguguguguguguguguguguguguguauguggguggguggguggguguauauaugugugcauauauauaugcaaaauccacccccaggagaagaggcuuacucuagucuaacaucaccuucacuggacaaccaugacauuuuggcuguuggcaggagaugugucagcccuaggauauuaaaaagugcuuaggguuccuaaggaaggaauggugcccacacacaguggcaacagacuuguugagaaacagaaaugguuccuuagggcaaccacuuagaagccauuacuucacccagcugccaucucuggguguaaguucagucuuaaggccucagucuucuuacugaauauauaggccagcaaguggcuggagggaagaccaggagguuaaggggaaggugagacaggaagagaaaaugguaucaaaggggaugguaggaggaagggaauguaaggguuccucagugccaagcucuaccuugucccaccaaccccagccacccuccaugacucaccguaguucaugggcauuggauggacgggaggaaccggcuguggguagccagcaggaugaccguaaccagguugaggguaggcaggguaggcgggauaaccaccuggcaggacagauggcugcccguagccaccaggagguggagagccaggguacaggggguugugguccucauagggagguggggcacugggauuggacauggccacucaagggcugaggggaaaccccagcuucuggguccugcaauaggaaacaagcaaucagucaugaguuccuggcugcccacuccacccuugcuccuuucuaggcuaugucuguagcuuacacaugccauucaccgcccacaggacaccagcccuuggguuuuauaaucucucacagcagccuuuaucuggggccuccccugcccuggccacaggagaguagggguggggauuagucagacgaccagcgucacagcugaggaucagaacaacacaagagacuggcagccugggaacucccuguucgccuuuaagggaaccuugcagugcuguccugacagcagaaccagggaagaagcuggauggcccuagaagcgcuuccuggugagucacagggcuggccagcugggacccuuuagagggcucaacccagcccccacagcagcuggcuggagcagcaggcuugagggccagauacaggguggagccaagcuagaagcugagcaggaaagaggaggaagaaaacaauccugccacugugccagaauggccaggccccagagggaggggcagggcuggcagcagacaggacucuccaguucccaucccgucacggggcauguggcagccugugccuguugcucccuucgcuggucuugccagggaguaaacagugcuccagagcucccuggaagggggucucuggagucuucccagcagcaguggcggggaaggucaaggaaagcaagcagagaagugagggcacaggauggaaugccucugacaggagagcccugcagcuugccgaagcuccaggugccacacugaugcucaggggagcagugaggcccauuuuaguaaaguagcucccacaguccuggagccagcuguuaggagcacacccugagugggucugguguuaugaguccuucaugcuuugcuguacuuucuaggccuccucugccaagcucaucacagccuguggacccauaaugaaauggcaggcacauccagauauggcagagaugaggacagagacaaaccaaggaaauggugucuuuauuucuuucacagaaccaccccuucccaugcacacccugugacagaguuacccccugcccuacaggaaagacuggcagauccaggucagccacaccuucagggccgcugcuggaagcaggagagucccagcuucucuuucagggcaccagugcagcucagagaucagauagaggacaugcacggcuccucucaggacaacgggagugauucacaaggaaaaccagugaggaucgaguaacaggccaggucucugagcaggucacacugaggaaagcuguucuccaucuccccagagcaagaaugugucaagccagagagaagaaagccuuucuagagaggagggguaugagaagugagccgggcagggaagcuugggagucaggcacugcgcagggcagagcuacuggagaagugggacucccagaguggagagugagucuaagaucagccacuggaacugguuuggagagucucgagucuaugaaaggacagaguaaucacaagcaagauaaaagaagcaaguuuuuccugccccagccuuuggagcaaaagccuuguuccccuaaacccuacucuuucccucuccaagccgccuucugaguccacagaaagaacgacauccugguggaugggaagagggcaaagcagguuaccuuugguauagaggugccugacauuccauuauggcuuuuaucucaguaaucuaggucuauaugaaauccuccauggggggagagggggugcuggcugauggcuaaacaguccuaaaaggcacugccaggaaaggcccuguuguuagagucccaacagugcuaccaagccaugaugucccaaugaccuggcccuucacuuucacaggguaugugggaaauggggugguugagugaucucagggcucaaugacagcucuaagagcugacugugacccaggaaacugaccaugcagggcccccucccucuucccaagagaggggcugcagugacucacugucugggguguggcuccagggucuaggguggcucagcugcugacucacaggccuccccccuguccucccugcccggucgugcugggaggaauuugccaguggaccugccugaucccagcauaguucucugaguccuccaccaccugcccuuuugaaccagagaugaugucaugcgucaguguccccaccuggaagauggguucaacaccacuuaacaguaccucccaaggaaccgucaaaauuaagacagaauauacacacugaguggguggagagaugguucagcaguuaagaacacuggcugcucucccauaggaccuggguucaaguccuggcauccacauggcagcucacaacugucuguaacucuaguuccaggggaucugacacccucacacagacauacaggcgggcagaacaccagugcacauaaaauaaaaauaaguuaauuuaaaaagaaaaggaaagagaggaaggaaggucggagcucuuagaacaaugcccagccuaaccagggauacacucuggcuguuuucagcugugaacugacuaacuccuaacuccguaaaguaugacagcaggugaacagugcuauuacagagacaccgaggcuuagcagaaugaagaaagguggccagggacaccucaccaggcuauaacaaagucaaggcuuacccccaaggcuggcugacucuggugucccuuuugagucccuuauuuggauagucuaucuaucccaauuucucagccaucucccauggcuuuggccucaaauccuccaguaauaauagcaggcucacacagaaguggaugccugacgauucagccccuccacagugcaccccagucccauccaccagcacaaggagacucaacaugucagaaucuagacacccacccacuuaagacaagcugauccuaggcuacaauacaauccuggcugucugacccuggugcaggagaguaaaacccuuguuuuguaccagccagccucugccacacucuccacugagccauggcaugggcgauauuugucagaccagagagaacuucaggaacccagaauacccaacauggcuucuaagcaggccucagcuccugccuggccuccaccaaggcuuccaccagggcugaggucugggcuagcacugcccuaggggcaguggucauucauucuccuagccaggcugaggcauggggacaagagaaggaaacgaguaggaagaaggacaaggacagagaagagaccuggagacaccgagguucuuccggguucacccagggcugugagggcuucacagacugcagggguuacagagaacugggaucauuuuccuaagcugagaaggccuuugccccgucccggcacuuccauguuucagccuguaccuuucucagguaaugcauccaugucagaaaaaacccagaaccucucccugacucagucacagcaggacuggguacugggcccacacagcgggauuuguugguggccaagcuuuucaguguagaaucuggggagacugccccacaaaacccuggguugucucaggaggucaacucugucccuggucugccgaggucgaacucuggcucuaacucuccuguggcauaagaaguguuaagauuauggaaucuguagccagaaggcugagcuacugggguuacaagcaagagggugugucuggagggaaggacagaaaagagcagcccgggcagcuugcccuccugaaugccaggagccaaugcccagaccagaauggaaagaagugcucagcaugcgucucaggaagccccaccccacaccaaggucuccaugccuagcuucuucccuccauucuccccaagaaaacaccucccuccccagcacauagccacugggacagagaagugacagaagcagccaggagcccagaaugaacauaguacucuccgguggccuggccucaggauucggaggugaaauagaggggauccaaauacugaggugucaguagaaccaggaagcccuaaagcaccagcccaggacaggcccuccuggccaagaauuuggaacuucugggccagguauuguaccucaugccucuaauucuagcaguggcaggggaaauaaaucucugugaguucaaggccagccuauucuacuacauagcaaguuccaggccagccaggaaaugauaaugagaugcuaucuugggggaggggguguguguuaaggacuuuagaacuuuccuucccagccucgcccaguaucaaaagcucagcaaaagagccacagaugccaggcaaagaacccucuccaguccccucauuauuucuugcucauccugccaaccuguuacuuuccuccuaggcuccaggccacuccccagcuccuaccucuagagugucucucucuguauccacagaaacagagggccaaguccuagagaauauggaggggccccauccagcagcuucuccaucacccuaaucucagagggcagauuugcaucgugagguuguaauaucagagagcccagccgcaugaccagucaggguggccuuggugugcuuauaaagaaagaggggcugggcagugguggcgcaugccuuuaaucccagcacuggggaggcagaggcaggcggauuucugaguucgaggcuagccuggucuacagagugaguuccaggacagccagggcuacacagagaaacccuaucuugaaaaagccauuaaacaaaagaagaagaagaaaagaagagggagggagggagagaaagagaaagagagagagagagagagagagagagagagagagagagagagagaggaagagaggaagagaggaagagaacaugccagguguaguggcucaggccuuuaaucccagugccugggaggcaaaggcaggcagaucucuuagauggaguccagccuagucuacaaagugaguuucuagacagucagagcuacauaagugagacugucucaaaauuaaaagaaagaaaaaaaggaagccauuaucagggcugcugcuauuuuugacacaaaggccugcccugccccguuuguauugucucuggguuaggaggggagacaaguaggagaacaggaguauuaaucagaccaaaguggaaaaucacagggguggggaaggaagagcgccacggaagagugguaagaucaguacuuaguaagcaaccaagguauuucuuaugcucacaaaagaucacaccuucaauaaaaaugcuacauuugagagccaggaauagugggacacaccuauaaugugagcacucaggaggcuaaagcaggauugcuucacguucaaagucagcuugagcuacacagugagcacaaggccagccaaggcuaaggcaacggccuaucuuacaacagucaguugaaauuaucaggaggaugcauggaggcuuuaggauuuaagcauccauggaaggcaguuugcaagcagcagggacagauuugaacuugaugacugauuuugggugcuugucugccagggaggacaccugaagcacccucaccugguuaggggagcacagggcugagggugagaugguaaagaccagcggaguuaagugcacaguggauauggauuccuuuugccaucuuugcccaggacuccaguguaggagcagggaccuaauucuuguccugguguugguacugaccccaguacaugaauugggguaggucacuucccacuuccaggcuccauuuuuacaucuguaagauggguauauucuaggcugaaagaucaaaauccacugcagcccugccaguuugauucuguauaaacaggcuaacaggacaggaagcuucagagcagaaugacauagccaccucauccccaucucacccccacauaccugggaaucuacacacugacuggaugccucuagucgguaggcauacaguaauguguaggacauauacagaggcacauggcauguucuaggcaagaguggccauuaacacucucuccuccuaagauguuuccacucuucacagccugugugaugcugaccugggcaaccuguuuauuacacaaggaccuaacccuaaggaaaaaaacaugcuucuacccagcucuuaaaacccuacacuuccaccagccuguccccucaaaacaggugcaguaaaaccaagcaaaaaaaucucaguggaccagcagauuaaggcacuugcugccaagccugacaaccuaaguuggcucccuagagcccacaugguguaaggagaggaccgacucccuggagcuguccucuggacuuccacaugcaugcagucaccaucacacacaaauaagcaaauauaauuuuuaaaaagaaccacaccugaauggggcauggugauauacaccuguaacccuagcacuagguuagcucaagcaggaagaucacaaguucagggccauaagaaccuguggguguggguaggaggaccagacaugcccucauucucaugccagcugagcaccaggauccccugcagggucugcucccacccuuagguccagcagcuacuggaacuuccaugguaagauuuauagcauagcauggaggaaaucuaggcagcacagaaccaggaaaguagcaucccuaaacaucacccccggggucauagacauguacugaccagucuauguaaggaagucuuaccuuccucccugaccaaugcauuauguccacgacgaguagaggucuguggacccgugcaucuuguuccuaguucuacuucaaaacaaguccuguuuuggccuagacucccaaaaucuuaguuagguuaaggcuagaagauucuaucaaggucagcucuuguucagcauugccaagagaacugaaggcccucugaagauuuguaccucgcuucgacgcuggcuuguugagauacggucucacucugcagcccagguuggcuccaggucugcagccuggccugcaauccuccuuuugccuuucuucugagaaggaugaggugccgugccccaguguuguuacuguuuugugaggcaggcacuugcccuauaacucaggccacuccaccacacacucagucccucagucccggugcuuuuacucugucuuaagggcccauggugagaggucuuggguugggaggugcucugcuauagauggcuucuaucugaggaucccccauucuuaccgaggaagcugagccuaagugccuauuacccuagcccaugagcuucuccaacuacuugccaacuaauauuuuauuaccucuuugaucugcccaguuuuacaugagcagcccugaagucagacaggaaaucaggacccuugaagcaauggucucaccucccuugaaacuauaaagcaagaccagggccccaugacuggagagguaagaacaggcaagugaagaggagagggaguaugguggccuguuuaaggcagacaaagcagcacaaagaagcaccuggcuugcccagccaccacuggccaggccaaagacaccagcuuugaaaccaaagcucaccacugagauaaauauuucagagucucagagaaccagacaccugccagaccuuccaugacagcucuccccacuuauccgguguuuagguugacccucagccccauggguaccaccacccauaggccacaguggagugagugacuggggaaggaugccccggggaacaagaccuggugaagacaguccaggcucugccuuggcagagagccuuccauuccuuccuccuuuucugguucccuccuggcccucccaaaccugcuuucccuuuucccauuucccuguuucuuuuuuuuuuuuuuuuuuuuuuuuauuuuuuauucugaccuaaagaggucaccagggccaggcaagacagcuuucaccuguaauacucccagcacuuaaggaucugaggcaacaaguucaaggcuugacugggcuacugagugaaacugucucaaauaaauaaauaaauaaauaaauaaauaaauaaauaaaccaaccaaccaaccaaccaaccaaccaaccaaccacaguucaucagcuugacuguacuuucugguaggcuucugaauuacagagcaaaggaacaggagcaggccagguuaggaguaggaauggcuucuucuuuagaccuuagguuggcccgcuggcuucucugagcuagggcucccuccucccaccccccaccuuagacagauucucaucaccaguuuuuacgcagccuggugacgccagggcaagcucgaacagccccggguggguuccaagccucuggcuggcucccucccucccucuccccaccagcugaggaccaugaccgccuccauucucacuugcugcacggccacucuggggccccggagugggggacacguccucagacaaacaagccacucagccacugagaggagcacccuacaagaagcgggucagcucgcgggugcgcaccgaaugcgguugcgccacaagcccgggccauauguccugcccgggcgcacauggaaagugaagaccggaacaggcagaacgaaaggacccuagccuggcuccggagcacgaccggagucggcccgcgcgugccagaaaaguucgggcgccugggcgcagcgccgccccaggccacuuccauuccccgccggucucggguccccaccuccaacggccgcagcccccucacuugccugcgcuguuccggaccgugagauccgccugggccuccgggcgcuggcgaggacugggcugggccgggcuggacuggggcuccgugccccgccccgucucucuccgccgccaguggggaggagccgcccggcaccccgagaccuccagggagcgcugggguccccuccagaccucaaccacgacccaggugugagugguucacauuuacuggaagcaacgccgguucgcagcgaaaacccaaacucacugggaaaaaaauaacuucuuuccaugaauuccagacuccaccccaguaagaagugcuauuuaugcgucaucagugccuacauaucagcgauuugcgcuaggggcuuuagagcuaauccuguugucuuaaaaguuguuauuggguuuguuuuuuuguuuguuuguauucuggguaaaagagcgaugucgcuauguaccucaggcuggucuccagcacuugucacccggccucagcccaaguguugcaauuacugacccugguuucacauagucagauuucacugauuuuuuuucccucuuuuucuuuuuugucacuaacugaucuucagcacuuucggucuaggggcguaggucagugguagaucucuggcuuuccaugugagagacccagcuggguuucauccccaugccaggaaaaccaaacaacaaaagaauaguuucaaugaugcacaauauuguaucacauggcuaugcuauguuuauaucaauucauucuuaaaacuucuuauuucgugaaaaaaaaauuuaagucacaaaaaaaagaaagaaaaaaaaagaaaagaaaaauuuaagucacaaaaaagucuguggugacuaagaauucugugcuuguaagcuaaccgcccuuuucaaauguaaaacuucaaacacaggcaugagacuccgaagcuaugcuuggaaucagucaugugucacuuaaugacagggaugugcuagguuaggaaauuucuguuuugcaaaccucaugguguguuuacacuaacagcucacuaugugugacugggaaguaaaaauaaucuuauagcaguuggcaguaugcuggcuuagggugcgagcaguccuggguuccaucuccagcacugcauaaacaguggaaguggcaugugcccguaaugccagauauuuugggaauguuaauaauaaaauaacuuaccucaaagagguuaagaggagccaaauauguggccauggucagagaaaaccaauauagguuauccaaaagucuguguuccaacaugggaaucguuuggugaaguuuugaggagguuggaaagucaucuuaauuaggguuuuauugcuguaaacaaacaccaugaccaaggcagcucuuauaaggacagcauuuaauuggagcugacuuacagguucagagguucaggcaauuaucaucaaggcggcauccaggcaggcguggugcaggaggagcugagaguucuaagucuucaucugaaagucacuagaagacuggcuuccaggcagcuaggaugaagguccuaaagcccaugcccacagugacacacuuccuccaacaaugccacaccuacucuaacaaggccaaaccuccaaauagugccacucccugggccaaguacauucaaaccaccacagggguguuuugauuugguuuugguuuuguuuuaagggucucaccauguaacucuaguugacuugggauucaguauggagacuaggcuacccuggaacucagagagacugccuaccucugcuucuugaguguugggauuaaaggugugcauaaccauacuaaguuugauaaaguuuuuauaucgguagaaaagaaaguguuaguugaggcacuuuucaaauggacauuuggaaaaacuaaguaggaaguuauagcaaaauggaucaucucaacuauagcucuaggccucagggcugugugaugagacucagccuuuggguugauagaaggguuucaucuauuagucacugaauguuaggccacagagguaggcaaggaauggcuauuuaggggcugaagacaacccaagaucaauuguaacgaggcucuggaccagcaaacauuccacccucuacacagucacuggaauucuagucucuuaaucagccugcucaaaggcucuggugagcauucgguuucuuucuaggaaugucuauucagaaguagaagccgaaggaucaggaucauucucagcuacacggcaggucuaaggcuagccugggcuagagugggacccccaccucaaaacaaaauaaugauuuuugugggcccagcaccauauauucagucccuguuugaccucaucaugugguacaucucugcacuugaagcaggauggucucaguuccacauggugguguacauuuugacguugcuaaacugggaacuuagcuccuguuguccuaccccuuauuacuuauaaaaaaaaaaaagugcaucaacagaacccaggcugggugacacacaucuggaucccugcacucagaaagcugaggcugaggcacaaggaucugaggucaguccaugcuuccaggugagaaucagucucaaggaaguuggcaggguggcuccgugcuaaaggcgcuugucaccgauccucacuaccugagaucaaucccugaacccuugugucugaaggggagaauagacucuggaaguugacuuaugacaacacauacauuaaauuaaugagauuugaaaggguuuggguuuuuguuuuguuuuauuuuguuuuguuuuuaaguucagugagcuagguauggugguguaugccuuuuuuuuuuuucagauuuauuuauuuauuauauguaacuacacuauagcugucuucaaacacuccaggguaucagaucucguuauggaugguugugagccaccauguggaugcugggauuugaacuaaggaccuucggaagagcagucagugcucuuaaucacuaagccaucucuccugcccugguguaugccuuuaacuccagcaaucagaagguagagucaggugaaucuuuguaagguugaggccagccuggucuacauaggaaguaaugggccagccaggacuacauagugagaccccaucuaaaaaaaaaaaaaaagucagucaguagcaguuccuuuuucuuuggaacagcugccuggguuugugugguuccaaaguccaguuccugcaaaacacaaaggcugcuggguaggagcgcacccuccuuaccugccuuuaacuuaucucuugcuuaugcuaauagcugcaaaucaguaucagcucuaagugcuuuccccugccuggcaacacuccucccuuuaaacuuuaucugaauauacaccuacaagccagaagauggggucagauccuauuguaggugguugugaaccaccuugguuacugggaauugaacucaggaccucugaaaaagcagccagugcccuucuuaacugcugagucaucucuccagccagccacuuuccucuuuaaauuuuuguuuguuuccuuuuuuguuuuugucugagacaugaccucacuguguaauucugguuguccuggaacuuacuauguagaccaggaucuaccgccucugccuuccaaguacuggaaugaaagucacacacuaccgagaggaacaacuucccccuuuguaaauuguuuuaaauuacauuucuuuauucuguguggguucaugcagguguguggguaacugccucccacaugacacugucucugccuaacaggauucacagucuuccauccucccuagugcuuggacauugggauuacaggugugugcaaccacgucggggucaggcucacuuugaccuuuugaguggacagggaucacauauuuguuuuaugaaguacacuguugcuuucuucauuggauuucaugguugugagccacuaugugguugcugggaauugaacucaggaccucuggaggagcagccagugcucuuaucggcugagccaucguuccagcccccagaacacacuaagaaagcgcagcuagaaauagagucagguggagcugagcacucaggagcgcuaugggaguuccuacucaaaucuuuaugucuccaggcacaccccacccuugccaagagcaauaguuaggcaagagcuugccagguaggcuaggcuugccuagccagcuagucccaagggccugucugcaccuccccaagacagggauuaaauuuggacccucaugcuuauauuuggacccucuugcucuuuaccaacugugccaccuuccuacccuggaguaaacuuuaaaggcagacacaucaguaaagugcuuccugcacaagcaugaaagccugaguucagaucagcagcagcgcauaaaagccaaguggaguagcacaggccuagagucccacgcuuguuauggagaugucaugccaggaaacguucaagaacuucaaaaagacaccaaggagcccagucagaugcaaucgcuuuagggucucuuuaaucaagcuuuagcuugggccacaggacacaccccuccccccagcccaguuucaggcaagcauuuauagaggcaagaaggggguauuuagccugguauauaucagacugggguccauuauggccuuuaacauaauuggcuaguguugggagucaaaccauaagcuuaacuucugcuuuucuucagauuggcgguuguuaggaagugaagugucaggggcgggcuuguaaccuggaggugcagauuuguugggggaauaaccuggaaacuggugcuagauacuggccuguuagauauuggccuguuaguuaacuugaguucaaccuugggucagauucucuaagauggagucugaacccaaaagauuuggucucucagagacaggccaaacacaaugaaacagguccccaaaaaauguguguguguagaauaauagaggaagacacuggauauugaucagguaaguagacccuaccccaacacacacaagcauacaccacuacacacaauaaaauaaguugacuaaugugcacacgcucagacacacuacucacauaugaaguauguguguguguguguauagcaagauauaauugcaauggaaauuacauaggaggacugggcuagcuccacugaccuaacuccaauccuuccauguacuccuaguucgcacugccuauaguccuccuuuuaggaaccagagaaaccauaguucuauugcucagucuuggucuccuuguugcugcagggauagaauccuagguaaguuuuucagccugcaagauuuggcaggcagcaccuuuaaucccaauacucaggaggcagggacagguggaucucugaguucaaggccagcuugaucuacauagagaguuccaggacagccaaggcuacacauagauagacccugucuaauauaugcacuagccuccacuacauaaggaaaccaacuagugaggccuuagcaaggcaucaagcuuugguaaaaagccauugauggagaguuugggaggugacccacaucuguaauccaagcaaacagaggcagaaaagucaaggaguucaaggucauccuaugcuacagagaccauucaagcugaggccugacuauguagcagacugucucaaaacaaaggaacaagacucaaaaauaaaaaguaauucuauuuugcauaauaaugccuucacugucucagaaaacauuuugggauacuuacccuaaaaauaauauucauuguuuaucuggaauucaaacuuacuugggugucuggcauuccucugacaaucccauaauccuacuggaacagaaagucagaucaggaaggguggagagugagagauaccaggccgaaguuuauuuccugaaugggaggaagccuaagggcugaugggggaggggaggguccagggagccugacaggagugaguaaggagugggaggcugggucuacacgguugugcugugcgcugcccacuccagaaucccuuccauagcucugugacugccuaggcagcuuuccuggaguuucccagcccugugaggcuuugcuguguaucagcuaccucacugaaggugcccuccucagagggcuuucccacuggagacgagccucuucccucuuuuccaucaccuguaggagcggaagugcccugcagcucuuugcugggacaggaagacaauugugaacuauacaagaggagagggaaggugggaguugggggaggacacagguccuuccuccuauaaaggagccuugugguguuuuguuuuguuuuguuuuguuuuuuaagauuuauuuauuuuauguaaguacacuguagcuguccucagauacuccagaagagggcaucagauuuuguuacggaugguugugagccaccaugugguuguugggauuugaacucgggaccuucagaagagcaaucggcacucuuaaccacugagccaucucgccaaccccaggagccuuguguuuuauucacaaaaaauacauuuaauccuggcagaagcaggcagaucucugagucugaggucagcauggucugaagagcaaguucuaagcagcugaguuacacagcaaaaccuugugguaguaggagagggguggagaaagaaagaaaugggaaaaaaaaagaaggaaggaaaggaaaaagcaguuauuauguuucaggcaguguuauaggguuuggacaucagggacaauuuaggugaaaaugugcauucuagcaagaaaacaacaggcauuugaugucaaaaccaauugauagaggucgcuccaucuugaacagaaaagagaaaaaauccuauugauaaaauauuggacuuuguuggguguagugguggaugucuuuaauccuuauccuccuggggaagcagauacagguggaucuccaucaguucaaggccagccuagucuuccuaacagaucccaggccagccaaagcuacauggugaggucuugucucaaaaacaauaauaaucagggcuguagagaugacucagugguuaagaacacugacugcucucccagagguccugaguucaauucucagcaagcacaugguggcucacaaccacccacaaugagaucugaugcccucuucuggugugucugaagacaccuacaguguacucauacgaauaaaguaaauaauuuaaaaaaaauuuuuuuaaagaaaaagacaugagugccauggaccaggcucagucagccccucucaacccauggggaaucaagguuccagacaggugggcaaggaguuggcgagaauugacagacccagacacaagggagugcugaaucuuaauguaauuuuucacaaagcaaacagcagucuuauauaauacagaaaacaaaggaguagggugucacagcaggcaagguacauuuaaacugucuuacacaagacaaggaauggcuucaaagggcugacaggaaccagguaguguuuacaguaaagauaaaacagcccugccuagcuagagucaauuaaugacugguaaggauuucacacccuagucacaauuuguccuucuccuuugagccuugugaaagcuagcaccaggggguucugcucuagcagaccuuaugaauaaugcaaauccacaacccccuuuuuccuaggccuugguaaauacuugcauaugaaaguaacuuggcaguucuuuuaaguaucuguagggaauuuucauuugucagaagaauucaccaauaugcaauguagucugcuauaccuggcuguaaugaagauucuaaguauacuuugcuaagcuugcccugagacuucuaucucuuagccaguaaaauacuguaagaaagcacgcaagaccuuccacaauauugcagggacaaaucuggggcaguuuagcuaugggaaugccaagguuccaggaggcuaaguuuccuugaaacucuuugccucgugacugcuuccagacuuuuaaaccugucugugacacgagucccuacuggaguggauguagcacauuaggaauaguccuguggugcuguguaaacagacccaacuagaaauggaagugagcuguggaauaaggaagcuggacccuaucuggcauccaccaaggcaaggccagggccaggguccccuguccagcuucucugaccaucggaaucauccgagaugcuugugaaaaaagugcaaaugcccugggggaauguuucccuccagacccgagggccagcuguaagcucaggccccaggggagccacuagccaacuccaaguuauaaucacugguggcugugggaccuuggggcugguccuuaacuacucugugccuugguggcugugucuguacaaagagagguaauaauagaauguguuuguaagguuuaaaaauaguaguugucaagugcuuggggcaaaguugaaaagucccuuguuacaggucuggagggagcccgcccagugacucagaugagcuugaucucaggaccuauugggaugaaguugccuaggccaggauucucagcaggguccggaucacgcugaauccuuauucccugcccagggccaccuuguaucuuggucucuugagccaucaggccuguuuggaguguucaggauugaguuugcccacccagccccugcuccuaugcuauggaugacuuccuccaucuuuuguuucucccuaccucagccucccaaucaggaagcucccuuuaacauucuucuuacauaucuaagaaauccaucucugagaaucaucaccacguacuggcuucucacucugaccuuacacaggcccugccuucccaggccugcacuguguuccaaguguuuaccagauuccuaccucuggcucccagcuuuccagcucugccucugacagugcugugaccacaucaggcucaacgauguauugaucuuagcacguuucccccuguguagggacugaagccggcgauuaaagccagggucgcacauaugucaggcaaguguucuacuguccagauaccaugaccucacugccucuuucuagucccacaaaaaguaauuugaucugaaauuagaaaaaaaauggaacaaaauuugguuuuacacuaaguauacuucaagucucaguaguccuaaguggguaguagcuaccauacagaacagcucuguggggcaagguguagaccauaguuaacccuuuaccucacuauaaggugccuagccuagccuggaccagacauuuuuaguuuuugagaccagcucacauguaacccaggcuggccuaagcuagccuugaauucuucauccucuuccuugcaccugcuaagugcuagaauuacaagcaugagcccccuagauccacucuguauuaguuugcuuucuuaucauaagcacccgaaucccauugacaucucaguaagagaaagacacagaucuaggcaugaccacuagauggcaugaucuggcuaccaaugcuugacaagaagguaggugccgacgauuuugcagagacacaguuggaagaacauucacucagugcucucaaugcuauguucaaaauagaggauccuagccagaacuaacaaauauaauaaaacagacuaaauaagguaggaaauauugcucagugcacuuccguuuccucuuuacuuacuguguaugucuaguguguggaucuaagucuaaaaugucauucccccuucaauccacgcuuuaucacagcaucagauuggggggagauuuauguuaaaaagccacaagggaucaccaacgagguucagcagguaaagagcuugcugccaaaccucaaacaaaguuggaucccugggaaucacaugguagguaaaggagagaacagacucccgcaggcacaugguucucucucucucucucucucucugccucucucucucucugccucucucccucucuguuucucucucugccucucucugucucugucucugucucucucucucucucacacacacacacacacacacacacacacacacauguguuugauuuuuuuguuuguuuguuuuguuuuuuguuuuuuuuguuuuucugagacaggguuucucuguguagcccugucuguccuggaacucacuuuguagaccaggcuggccucgaacucagaaaucugccugccucugccuccugagugcugggaucaaaggcgugcgccaccaugccuggcuguguuuuggccauuuuaaccccucucauauucaccccacuucccuaaaccaaacaacuuuguuuucuucaaaaaacaaaacaaacaaaaauccuaucaagugcaaucugcugcucacauucucuugaugcuugcacaggguuccacuggagugugcucagucuuccaggaacuaccuucuuuuuuucuuucuuucuuuuuuuuuuuuuuuuugguuucucaagacaggguuucucuguguagcccuggcuguccuggaacucacuuuguagaccaggcuggccucgaacucagaaaucugccugccucugccuccagagugcuucaggagcuacguucuuaaggaacaccgacucccuccuucagcugcucucaggugccaguagcuccccuccaggcgggauuugucugccucaaacuaauuaauguuuuaauuaaaguuccuggguggaguggagggaggauagcuuguaacguguauaaaauguguguuacugagauccauggccaaaauguuugagaauccccugaccuguuaccuguagaugaggcauuggagguaggcgguguguuuguaaaagucugcucaguuuuuuccugcuuuucugguuguuuguuuaaaacaccacagccaaaagcaacucugggaggaaagggaagucagggcaggaaccuggcuaggaacuggagcagagaccagcaaugaaugcugcuuacuggcuagcucucaaagaccacagcucagaaaagucagcuaccucauuuauacagccggacucaccugccuagggguggugcugcccacugugggcugggcccuccugcagcagguaacaaucaagaaauguuccucagaaaugccuacaggaugggcaucugaccgaggcaauuucucaauggcaauuccuucuuccugggugugucaaauugacaaccaagauuagcuucaguuuguuuuguguuuguguuauuucaagauaaagucucgcuaaacugccccagagugaccuugaacucaucuauagaccacauaggccuugaacuuguaauagucugcuucagcuuccucagaagaaucaggcagaaucaacauaauagcacgacuuaaugaugcacaacccaggaaucuggggcagggggauuccuggaagauggaaacugaccugagcuuccagugaguuccugucuucaaaauaaauucuccacuagguaugguagcacaucuuuaaucucuacauucgggagucagagucaguugaaccucuauaaguuggaaguuggcuugaucuacagauugaguucuaggucagccagggcuacuuguagugaguucugucuuucuuaucuaucuaucuaucuaucuaucuaucuaucuaucuaucuaucuaucuaucuauugugcauugguguuuugcugcauuucugucugggugaggaugucagauucccugggacuggaguugcagacaguugugagcugccaugugggugcugggaauugaaccuaagucaacuggaagagcagugcccuuaacugcugagccaucucuccaacccgagaacccuguuuuuaaggagaaaaaaaauccccauaauaaaaaguugcuuuaguggggcgauggugguguaucccuuuaauccuagcacucaagaggcaaaucucugugggucugagaccagccuugucuauagaacuaguucuaggacagccagggcuacauacaaagaaacccugucuggaaaaaccaaaaaaggcuggguggugcugacaagcaccuuuaaugcaaacacucuggaggcaaaaacagauggaucucugaguucaaggcgaaccugggcuacagagugauucccaggacagccagggcuacacagggaaaccaugucucaaaacaaaacaaacacaacaaagcuaauuuuaagagaaacugaagaaaaaugaacauaaguaaagugaggcaccucaucuagagaggcuucucagaggaaaccucuauuagacugaaggagagagagagagagagagagagagagagagaccucauccuugaggguaauagugagggaacaggauguggggaggugguggagauaacccccgaagcuagacaaccucugaguguuccagaaacuucaaagagagagggucaggcccuggacaugaggagacugggcagguggccagggucagcccuacggaccucaugggucuccuuagggagagguccuucaugugggacauaaacaugggccuaccucaggaaaaagccacucacugugaguguggguuaggaggcuagagccugagagcaagaauccaguuaagucagucacaggccacagggcagcgggagccagcccagcaccuguucugaagacucaaagcaugcccauuaccacuacaagccauaugugcagcccacccccaccccagcuacauuguaauuuuuauuuagggguuguguuguuuuguuugauguguguauucauuuauuuagguuuauuuaauuuuauguguaugguguuuuugccugcacauauguguguguaccacgugugugccagguacucagagaagccaaaagaaggcauuguauccccuggaacugggguaauugugaacuaccauguggaugguaggaaccauaccugaguucucuucaagaauaucaaguacagccuggugugguggcacacgccuuuaaucccagcacuugggaggcagaggcagguggauuucugaguucgaggccagccuguucuacacagugaguuccaggacagccagagcuauacagagaaacccugucucaaaaaacaaaacaaaacaaagcaaaaacaaaaacaaaaacaaacaaaaaaaagaagaauaucaaguacuuuuaaccccugagccaucuaucucuucaagccccuugguguucuuauuuugaaacagggacucauguaauccaagcuggccucaaaguuauuauguugcugagggugacucuugaacccaguauguuagagggucagaggcaaggugacugaucaagguuaggaagcagcauuucagaugguguugaagaacuugugcagguuuggcucccagcuacccauaugguggcucagcugucagcauagugugauugcaaaggccagauuucagguccaguaaaacaagagcugaguucauacucuacuuaccggcucugugauggagcaagucauuuagcucaucugagcuucagccugcccaucucuacaaaagaggaugcaauaguugucccuacagcauugccauggugaugaaugacaagugucucaugcaggucuucuguuuagcagagucuaaacucuuguuuucccuuucccacaacugaacauuuauuacacuccaacugcccagcagguguuaggggaugggggagggggagaggaaguggggaggggggaaguguguuggguaccaggaaagaagcaugcugcauugcuccugccuauggggagguaggcucccuuuaaauccugcauaaccucaaguacaaaaguagcacuuuuccaacaauuauucaccucugacucuggcauggcaccuuccccagggggagaugaagugcugaccaaacacuugugaccagaaacaccuucaaaggggaagucaaauuuacuauuuacuucgcagugcuggggaucagacccagggccuuccugugcccagcaagugugcugcugcuggcugagcaauauucuuagcuagcucaacuuguuuuuagcugcaaugggacugaagagaggcacaccagcuucccuaaggucugaacugcacacacuccagucuauuagguuucccagauuggaagcuggagccuuaauuaguuuuaauuccucccgggaguauaacauaucccaugggugggcugggcaggaggcaccugggaccugaggacauuuacuuuaaaggauuucuuagaugggcaagguggucacuccuggggucccagcacuuggguaggggaggcagggggauuagggguucaagguugucaucagcuacauaacggguuugcagcuacaugagagccaaccucaaggggcuggagagauggcucagcgguuaagagcacugacugcucuuccgaagguccugaguucaaaucccagcaaccacaugguggcucacaaccauccauaacaagaucuggugcccucuucuggagugucugaagacagcuacaguguacucucauaaaauaaauaaauaaauaaaucuaucuuuuaaaaaauuuuaaaaaaagagagagagagagagagccaaccucaaacaaaacaaagaugauuucuccagaagccauggggcagaggacacaggccagugagcagcacgggcuggcugaaggaagcacaugggggugcagcacuggaaaacugucuugagaccauauugcuaagccaagggaugugcccuugguuguauagagucugguuucagccuguggacucccagcaaggcuuccauacuacuugagguggauggguaugaaggagccagcagugggacagaugugaccuucuguggugacggugacagcaaugaggaauggaauuguagcucccugguauucuuuccucgcauguuugaguaccuugaggaccaaagguugguuucacaauaaugguacaaugaccugggccugaugcccagggaaauggcuccuugaguaaggccuugucuugcaggccugagggugugaguucaguccccuagaacucguguaaaaacuaggugcagugcuccuguggggagauggaaggcugagguucucaggcugguguaagcagcagcaaaccacaagaaagaccuugucucaaauaagguagccgugaggaccaacaccucaaguuguucucugaccauacccaggaggugcaauugcacccacauucauacaguacaacacacgcacacuucacucacaugcacacauauacacauacacaacauacauagcucccaaacacacauauacacagaacacauacacccacagaugaauaugcacacauagguacacccacacacacacacauacucacaaguacauacacacacagaagugcacacacaagccgcacagugguggugcaugccuuuaauccgagcacuuaggaggcagaggcaagaggauuucugaguuggaggccagccuggacuacaaagugaguuccaggacagccagggcuacacagagaaaccuugucuuggaaaaaaaaagugcacacacaagauuuuuuaaaauugucacuaugggcuagugagaugucucagugcuuaagagcacauacugugcuugaagaggaaacaggcuuaguucccagcauagcagcucauaacuguaugcauguaugcauguauguauguauguaacuccuguucuagcagaucugacacccucuucugaugucuaaagccaucaggaauauacacaguauacaugcacacauuagucaaacucuuauacacauaaaaauggaaaaaaauuaaaagaaagaaaaacaacccaccaaagaggagcccauggcuccagccgcauauauagcagaggauggccuuguugggcaucagugggaggagaugccccaguguagggaaaugccagggcagugaggugggagugggugggugggaggggcagcacucucauagaagcagggggagggggaggggaggggcguuccagaggggaaauagggaaaggagauaacauuugaaauguauuuuuuuaagauuuauuuauuuauuauauguaaguacacuguagcuguuuucagacagacacccuagaagagggugucagaucucauuacggaugguugugagccaccaugugguugcugggauuugaacucaggaccuuuggaagaggagucaguacucuuaaccgcugagccaucuuugcagccaacauuugaaauguaaauacauaaaauauucaagaaaaaaaaggaaagaaaaacacuauuuuaguugccagcagaguaggcaccaagugagaaguagagugaagaggggaugcagccuagcacccccuuccccauaaggaacuccaggugucccccacaaccugcugaggacaugacagagaagugcauguagcuaggggacaucaccuagaccagagucaggguagaggaggccucuucuaggaacuagccuguuaguccacagagaauaagugcccugcagcaucuuccagaggagaugggcacauuuagauucauggguuaggaagaucuggagcuagagagagccuccuaugggggaggggaggcuguggcgagggucccaaugaaagaagguaaaucuauaaaaacaaagccaaaagcaaugaguggggaacaggagagcaauucagucacuaggaagacuacaagauccccaggaaaagaaaacuaggcaggcgugguggcgcacgccuuuaaucccagcacucgggaggcagaggcagguggauuucugaguucgaggccagccuggucuacaaagugaguugcaggacagccagggcuacacagagagacccugucucgaaaaaccaaaaaccaaaaaaaaaaaaaaaaagaaaaaaaaaagaaaacuagcccagcauggggacaccaagguuucaggucuccuucccuucccuucccuucccuucccuucccuucccuucccuucccuucccuucccuucccuucccuucccuucccuucccuucccuucccuucccuccccuccccuccccuccccuccccuccccuccccuccccuccccuccccuccccuccccuccccuccccuuggacuuggagccaagacucuaaaauguauggccuuauaaaucccacucaugggacaaacaggaggaugcuuguggugguuugaaugagagcaaggccccauaggcucauauaucugaauguuugguuaccauugauagaaguguuugggaaggauuaggagguguggccuuguuggaggagguguguaggggcagguuuugagauuucaaaagcccaguccuuuccagacuuuucuuugccuccuauuugcugacaagaauguaaacucucagccacugccucagcaccguaccugccugccugcugccaugcuccccaucugacggucacagacugagcuccugcauggccauucucucuaaccacucccuaguuuuccuccuuaauuucuauuuugcccauucuucuuucaacagcucagccuuuagcuccucuccagcccuagugggugggucuugguuagacccaggaauucgaugcaguuccugccaugagauaauaauagcaaauauuuauauagcacacaugugccaggcacuguucucaguccuuuaaauagaagaacccuugacucucacaccaccccauaccgagagaucaauucaguggcugcaggucacauaucugguaagaagacaggagagagagacugggacuuucuugaaaaguuuccauuguccuuaaaaaggaccuagugcaucugcaguguucaucaugaagcaguuuaaaagaauauuccaggguggccaagguggcucaacugcuaacagcacuugcagggccagccugacaaucuaaauccaaucgcaggaucccauggagaagaacugacucccacaaguuguccucugaccuacacaugcauauucggauucacacuuauuuacaccaccaccgcugccaccaccaccaccaauaaugggauguuucagaacacuggggauggcagagcagaaaugaagacaaccugcaucucugaagaccucaugggagagggggcaugguggcucugcccgcugucuuagcauuugggaaggugagacagaaguggacccugauuuauaguccagccugggcuacacagacugucagucacaaccaaccaaccuagccuugaaguaacuauccaaguuuuccccucugucuuuuggcgugugcgugugugugugugugugugugugugugugugugugugugugugugugcguaggucugagcguaauccucaggaucacuuccuacuuccuuugagacagggucaccaagauuaauuccugccuugacuuccccaggacaacagacuauaaccugcaaaccuguaaccugagccaaagcgaacggaacccuuccuccccuagguugcuuuuugucaggguauuuaucagagcuauaggaaagucaagacagaaacuugguucauaggucacugggugucacuuacuuuguuucuuauaccuuuuaagucuccugugaccuuccacaguaugacguaucauaauuacuuuaugaagacagaagucuuuccauucauucucaguuccucaucugggcaugcucuauccucuccaucccagcaggcugugucccuugaaggucaagcccacuugucccugcucaguccuuguccccgaaccccaaggcaagaacugugacaggagagcaugccacuguucccuucuuguaacacccugucagucugcugaggcucuccucucaugcgucuggccaagugccucugccucccaaguuugggaugggaguagagguguaagcugccaugccuggcugaccuaugucugucuaguccuugugucuccagauuucaggugcugucuguauguucacugcuccaaagagaugugucuauaagaucccucaugaguggccagucucagugcccacccucuugcuggucaccuccaagaagcugcuccggggacuuucccacauuauguguccaaagcugaccucaccagucucacaucucacucucacugcauuugcuucuuugcugcccuugugaugcuugauuucaacuuauuggcuuucaacuuaacaggaucuaaaauuaauuaggagaugaagcucugggcagguuugugaggaaguuucuauacgggguuaagagaagagggaagugucauuccaugaacuagaguuuaaggcaggaagaaaaggaccgggcagggcaguaguacauguaguagguuggucuaaugcugcuuguauucuaaugcuggggcccccaagacuggcuaccccaaggacaagagaguccacacauaagacacugagugucccugccccaguuaauugugauugguuaauaaagaugccagcagucaauagcugggcagaagagacaaggugggguugagguuucaaggcgaggagggaagagaaagaaaaggcugcugcuauggaauagaagaaggacaugcaggagaggaaaaaggagagccaccaugggcuagcugagccauaaaaacauggcccucaagagcuggagagauggcucagagguuaagagcacugacugcucuuccagagguccugaguucaauucccagcaaccacaugguggcucauaaccaucuauaaugggaucuauaaugggaucagaugcccucuucuggugugucugaagagagggacaguguacucacauauauaagauaaauuaaaaauuauuuaaaaaaaacaaacaaaaaauauggcccucaaggcugcccaauuggagcuaagugcagccaagaugaaauauaguaaguaacaauucggguuaucauuaggaaaguagauccuaauagcauggaagguagacugcugcccagcaucugugcugcuuaaagcacauuaauaauauaaaggcuguguguguguguguguguguguguguuaaaucuggaaucucaauaaccaaaggcagggaagaagccuugcaucaggauuuuaauauuuuuuacuacaaguauacaccuuuaaucccagcacugcagauaugaagacaggugaaucuuugugaguuugagagagagagagagagagagagagagaacuaagaaucaguauucaugccuuucugcuucccgcucacuguuuacacacacagugugaccccagacucuuguuaccuucccuucugucaugauagacuguguacccucagaugagagcccagauaaaucuuccucaaguuacuguugucagauaguuugucauagcugugaggaaguuagcuaauacuguucccaucuuaagaaugucuuucuuuucuauugccaugaagaggcaccgugucuaagacaacuuauagaagaaaaagcucauugggacugagagcucauuagccaacggaaucugccaaguccauggucuaaaaaggagguaaaaaaggguaaucaguuucaacacgugaacacaauucuauuuguauaaguuuuauauuucuaaacucuuuguuugggaauaaucucagguuuucagaauuuguuuuguuuuauuuuugagacaggguuucucuguguagcccuggcuguccuggaacuugcuuuguagacuaggcuggccuagaacucacagagaucugcuugccucugucucccaagcacugggauuaaaggcgugcaccaccccagccagcagcagaguuuuuuuugaaaaaguacaggagagccuguacuuauuauggaguuuucuaaaauguccacauuuuucuuaacuauaauauuaguaugaaggccaggaaauuaacacugaccaagucuaacaauucauauagagccuggucccagguggauuuaggucccuuuccacaucuuuggagaagauuccauugagaagaaauacuuuuucuuuugcuuguuucuggggacagagucgagggccucucucauguuaagcauuugcucuugccacucaacaguauguucccgugccugcacagguguguguguaugugugugcacaugcugaggcaucuccaaaacuguaguuucaauuaaugaauggauuaauguacucgugcauguauguagcacuaggggcugauaaggccuuguauaugcuaggcuuuaccacugaacuacaucccuagcccuucagggauuuuauuuauuuguuuauuuauucacuuauuuauuuuugguuuuucaagguaggguuucucuguguagcucaggcuguccuggaacucacagagauucgccugccucugccuacuaaggguagauuaaaggcacacgccgggcggugguggcgcacuugggaggcagagagagguggauuucugaguuugaggcuaaccugaucuacaaagugaauuccaggacagccaaggcuacacagagaaacccugucuugaacaaaaacaagaaagaaagagagagagagagagagagagggagggagagagagagagaaagaggagauauuaaaggcacacagcaccaacaccugguuugagagaacuuuuuguugguugguuguuuuuguuguuguuuuuguuuuuuguguguguguuguuuguuuuuuuuuuuuuuugcuuuucgagacaggguuucucugcauagcuuuggcuguccuggaacucacuuuguagacccggcuggccucgaacucagaaauccaccugccucugccuccugagugcugggauuaaaggugugcaccaccaagcccggcuuuugagagaauuuuuuauuguuguuuuagacagggcauaaccuugaguuuugagauccuccugccucagcuuccugaguguugugauugauucaugcaccacugcaguagacuuuugagggaagcuuuaguuugaaucugcccuaaggggugagaaaaguggaugcuuugaguaccacuguuuaaacccgugcaggaggaucacagcacgcccucugaggaguccccaaaaacagcugcagaggagagggcugggcagccccaaagcuugggcucucgaaggccauuugcugacggcagaggaagugaaggggguugagaaugacaggagaguggugagacuguaaugggaauacaggagcucgacgcuugcagaugucgugagaggagacagaaauagaugcuugagaacuaggcuuuaaucagagagccaggagggugcauuaacauccuggaaaccuguuauccuccaguccacagccagcagauucuauaaggagaaagagugugguugcuugcuucuguuuguuuguuuguuuucucagcuugacacaagcuaggguccucuaggaagaagggacuucaaaugagaaaaugcuccuaacaggcaagucugaaaggcauuuucuugauuaauaacugacauaggaaggcccaucccccuauaguggcacugccccuguaccuauggcccugggagguauaagaaagcaggcugagcaagccauggggaacaagccugucuuaaguugcugcucucaacuucggugauggauucagugguaaaaugaaauaaauccuuuccuccccacguugcuuuugaucacgcgucugucacaucaauagaaaguuaacuagaacgggacagaggccaucaguuguucuuucccccucaggucagguggcuagcugcaguuuugaggcucauggucggcuuaucuuccccugcccacuucccucauucugugcaugcuugggcucaggcucucgaaccuccaagugaaguugcuuucccugguuucagccuuguacucuugcgggggcaucggggcugggagggauuaacucagaaugagcaaaccaugaauacagugggaaagacacacacacgcugacucucuuuuaugaucuagaguacacgugugcuaugcugauuaguugucuauacuagucuagaaccaccaguuuaacccgagaagggaugaauagaaccaggcuggaaaugaggcaaaaccuuugugcuugggguuggagugauggcucagcuguuaagagcacugacugcucuucugaagguccuaaguucaaaucccagcaaccacaugguggcucacaaccauccuuaaugagaucuggcgcccucuucuggagugucugaagacagcugcaguguacuuacauauaauaauaaguacaucuuuaaagagaagaaauaagaaaaccuugugcugauuaggaacagugcagcccagcaaagcccagagcugugacagggcagaaccuaccugguuggcuccccugcagaaggcagguuagugggugggcaggagagaaacagaaaacaugagguggauuaagucaagacaggggaaggcaaggcaaggcaauaccuccaagcagaccaagcuuucagaguaugcaacacaauggcucaggggaaggucacugugggcacaguaagcucuugauggcaaaagacggugggguuggccagagugucccagccaccacugugcauugggucaaugcuucuaaaccaaauugauguugccacuugguccaaugagacaccccuauucuuuuuguuuguuuuguuuagaccuggcuggccuugaacucagaaauccaccugccuuugccuccugagugcugggauuaaaggcaugagccaccacacccagcucuccaugguguucuugaugucaucauugcuaccaucaccaccgaugauauccuguaagucagcuaagcaccaggcaucuagcuugccauaauguaaaggugaagacaggcuguccuuccaagggacacagcuuuggcuggcagcuggaauaaggagcaggcaugagaacaucuaccuuuaccccuggaaccuggaaccugcucuguguguguguguaugucuuguuuuugguuugugguuuuaugugugcaagcuuuucuaucugcaucuaugucuaugcaccacuuucagaccuaguaucugcagaggcuagaagagaguguuggauucucuggaacugaaguuacaaacaguugugagcugcuacaugggugcugggaauccaauucugguucucuggaagagcaaccagugcucuuaaccauugagcuaucucuccaucccuguuuugugguuuguuuguuuguuuguguguguguuuguuuguuuguugaaacaggaucuugcuguguagacuuggcuagccuugaacucacagcaaucuuccugcuggacuuacuagugcuggaauuacuagugcuuaguugcccauuuguuguugcuguuuagggcaugcauuuguuuguuugcuuuugagacagcaucucacuauguagcucaggcuagccuugaacucaugaaucuugcaucagcuuucccauugcugagcucacaggcagcaccaucacacaggauugugcuucaaauuaugaaugggccuuuccuuggaaaguuacagagacaaacuuuagccuuggcagugcuucugaacugcuccagggaggaaggauuguguggccaaagaccucgagugugugagugcucagagacagcuagcucuccugcagccuuccagauguggacuguucugcccuccuaucuguguugccuuccauacagcuguucugcagggacagcaauaacauuuccauucagccuuucuuuucggcuuacaucccagugggagggacuaacgggagaaucacagacaauguccaguuauaaaaagugaaguuugaacucuucugcucccuucgccugucuugguuuuucuccuauugcugugaagagacaccaugacuaaggcaacuuacagaaccauaacuucagaagguuaguccaugaccauaggagauggcagccggcagcaggcaugggacugaagcaauagcugagagcuuacacacucaaauaacaaucacaaggcagagaaggagggagagaacuaacugggggugacgugaguuuuugaauuuucagaacccacccacagugacacaucuccuccaacaaggccacaccuacuaguccuucccaaacaguaccaccaaugggccaucuauucaaacacaugaccuacggggaccauucucauuagaaccauuacaguaguguaaguaguauaauagaauguugagggaccugcagaggccucugggaggaccgacuauuuuucucugacccuuacaccuuaaggaguuuacauuugcagaugcucccuucucagccucuauguuaucacaaucacuuggggcaacaauucuuuguugugggcuugcccuagguauuacaggcccugaagccuguacuugugaaugccauagcacccccucccuccccaaguagacagagugucacaauuaagguguagauuguuuuucaucuuccaaguggaaggagcaugugcaaagggccugucucaguuuccuuucccguuacugugauaaaaugccccgagaaaaguaacucaagggagaaaauggauuuuguuuuggcuuugagacaaggucucaacuacguagcccuugcuggcccagaacucacuauacagaccaagcuggcuucagacucacagagaucugccugucucuaucugggaccaaaacaguggaggggugucacuuuaacucacaguugaggacuacauugcaucacagcaaggaaguuaagauagcagaagccugcaagcagcuggucauaucucauucauaauuaggaaaaggggaucauuaaauuccuuuaaauacagaucagauugcagcccagggaauggugcugcccacaugaucucaccucaauuagccuaaugaaaacaaucccccacaggcaaagaggcccaccucucaggugauucuagaucuuaucaaguugacacagagauuaacuucauagggcccaaagugguaacaaccuugguacuuuugagggaccaagcgaccaacccaaagugauaagcagaagaauguugucauuugaggagguuggaaacauaggcucagcuauggagcagaggcccugugggcuguggaugggacuuugacauuucaaagaacauuuaguaaguauuuaauaugcagguggcaccaugccagccacuggcaagcugaagaagaauacauuaaauuauagucuccacucugaagaaggcuagugaagccugagauuacaugcugauacagugagcaagugggaaggcguggcaugaguauccuaccaaagggcacggaaugcacaagugcgugcuugcacaggagagcacaugagaucugaaucuauggaacaaagagugagcagcacuccagacagaacacaguguauacaaaggcacgggaaugcaaaacaauauggucaguucuagaaauugugagucguuagguaucacagggcagaaugcaggaagaaggugaauagcaucuagcuugcuagaacagcagauucucguggacaagggagagcuacggcagaugaggagcagucauggaguacccuccagaacacaccagagcaggagaggcuggcucccugagcuugcgugaguuugcacagacacugcccuucacucucuauccccagccccgcugugacuccaaggaguucauaaacaguaucuugaguuuauuaucuauaaaugagugguguguguauguguguguguguguguguguguguguguguguacacguguguguguguguacacgugugugugugugcaagcaccugcucaugguggggccggggcugagguuaaagauuaaauugugucuucugcagggucaugccugagccugcauuuccuguuucagauuacagggacugcacccuaaucucuccauauaauacugcuuuacagagcccucccugcagcaggcuauguucacaaugacccacaauccuucaacauugcauguacagagacagagagagacacaaacucuccuguacuggucaugccuucuguguuuuugcuuuuuggucuuccucucaucccccccccucaaucccccaggccuuggcagcuucacccuuuccugugccagggcacagagaaguaaaacuuuagggaagagacagggcaaguacagguugucccucccucagauguuccaacagaagagaaaccgagugccuggggcucucagguuaaagcaagaauuggguggacugcagugcaguuuagggagacuuuaauccaccccuuggcucuuuguuggggugugagggagggagaaugaaguagaaaauuauacauaggaaccuucagcugcacagugugcugugaccgacucugagaccacagauguggggugugauuaucuagggcucucaggcugagcacaacaagcagggugggaagcaagagcauuuccucaccugcuucccuccagcuuccucccagugggagugauggccagccugacuuagcagaguuuccuucacuuccugcagaaggcuaggcaaggcagacugcacacagcccagcccuggcuccuuugugccucaauuuggacauugagacacacuugcucucacacccaucuccacuccauuggccagaacagcuucuagaacucauuaggaaggcaguaguaauagggcgaggagccacagauguggaaaccagacugggcauggaacugaggaugucuaacugcuagaccuggcucucccacgcauggcugcauaaccuugauaaagucuccguggacuguggccucucuucugggugaaauaucacaugcccuccccaucuaaauugauccaauguguuccauauugauuccccuauucgcuucccuauacguaccacuguuucucaucgcauccauguuugugagcacauaacauaugcacauguguauacaugcaauuuuauuuguuugcccacuuauucuccuuacugcauucuauaguguagguuccaggaaugcacccaucuucccuguuagggauugagcccagggucuggcacaugcuacaccaucaaacuacuaccccagccugaauacaguguauuuguguggucucaggcaccauagcccuccacaacuugugggagugauuuucuccuuucaccaagcggguccaaggauucacacagggcagcagguuugguagcaaguguugauccucuaagcuaccucugggcucucuggucuuuugaccaccugaaaaccuggcacaaugccuucaauuuagugaaugaauaaaugaacaguagaagauccaacgaacuccagguugucuucuagcugguaaaguuuaggagucuaagguuucucuucaggaggaccacuccaaggucucuccccugcacaggaagaaggagggcuugucuucuguccucucacaagacucugccuauacggacacugguuagcacgcgguuaugcuagcuagagcuccgccuccagacccaccaguagggggaggagccagucuguacuuagccuagggauucgcagcgcgugccaggccguagcuggcgaggagccgggucugaacgcgauguagugggcggagccaagugccaucgcacccuagcgcgcaggugcugggagccccgccucuccgcaccaggggccggggcggggccgucgccuagcaacgccaagccccgcccccggucccggcccccagcauggcuuggcagggcuggcucgcgccuugguugugggucuccggcuguuggcugcuauucuucgccuucgugcugcuccugaguccccgcagcugccaagaacagcgggguuuccgcggccuccucaugacgcgcagccagcggcugcucuuccgaaucggguuagugcccaggcuccgaucugugcaggcucgggaaggugggcacacuaggagaaaggacgcagaaaggauaccggggugugugugugugugugugugugugugugugugugugugccggaugucuuggauuagggguuucuaaaccaccggccagaaggauggagaaacaagcugaguucguucugaguuaagaaagcaaagaguugaaggaccgaagaauuggaugggauggguaggaaaagaggauuaggggcacagaucugaauuaguagggcaggaagccagaagacucagggagaugagggccaaguaagaugcuggagcccagggagugcgggaacugguucagggaagagcucacccggccgcagggcagaggucagcaaauccggcucccuaucucaggugcaagaguaaaagcaugcccuagaugucuaacuuuacuccguaugcuccuguccuucugcgcaucauccaacacuccacaccucugggugggucauucuguccuccucauaguucaacucuuuaggucaaccuagcucugucucuuuuaccuuccacugcuggcacccaaagcccucggcugugaaauuugacccaacagccagccgaggaccucccgugucuuuccccuagccaacuaucuccucucugccccuagcaagagugauagucaucacuguucuucugcauucagaagcagggaagaaaccgggagacgagcuucugaggggcucuugggaaggaccucagaccacaguuuagggaaauugauguaaagacgggaaucuuggucugugcccagauuccugggaacaccuaagacagggaauuuccuuaguuucagagaagacacugugcaauucacccuuccucccuccccaggccacaccccccccccacugcuccccaaaacuucaggccuggagcuccauuuuauggucucuaaaguagaaauauaaaagccuagugggcugaaaaaacauucuagauaaugcucugaccaaaucgccauuacuuuguggguuuuguuuuuuguuuuuagcauuaaagucaugagguggcagaguuuuuguuuagcuggcuggcuugguaggacagucucacaauguaucccaagcucgucuugaacuugugguccuccagucuucuaggugcugucauuacagguguguaccaccauaccuaaccaagguuugugacuaucacugugcuuuguaccuggauuuuggaaccaggugugagguuuuauuuuguuugguuucuuuguaauuugguugguugguuggugcuggagacugaaccuagagccacaugaugauaugugcucuaucacucaucuacacacccauagucacuagauuuaugggccuugcguguauguauggauguguauguguauguaugguguuugcauguguaugcauuguguaugcauguguauguauaugugcauguguauaugccuaugcauaugccuguguacgugccuguguguauguauguguauacauaugugugugcauguaccugugugcccauuugcuuugguuuggguuuuuuuuuguuuuuguuuuuuuuuuuuuuaguuuuuaucacaaaauuucugggaauuauguaacucuauuuagagaagagauuuuaaaucuacuuuuagcauccaaaauugguaagcuugaagucacacaaaugucagaggaaguggaaaacgggaguuuccgugaggaacuagaaccagaauuccuaagaucagaaugccaguaaucacauuaucaaaaccacaagagucugggucuuccuagacuugagacuugggaguuuuucacaucccuuaaguuugauuucuugagggagcuucuucauaauucuuuuugggggagaagggggauauuuggggguugagauaggaucuuucugucucccaggcuggccucaaacuuugcagccauccugccuuagccccaugcucaauuagguacauacuaccacccaggcuuagaacucaguguucugagcuggagagauggcucagcugauuaaggacuggcugcucuugcagcgaacuccaacucaggucccagaacccacacgguagcucauaacuauucauaauuacaguuccaggggcucuaauauucaccuuugaccucuguugagggcaccagacacaaacaugccgcacagauacacaugcaggcaaaacacccauaaacaaaaaauaaaucuaaaagaauuuuuuuucucagaauucaguuguuccaugaggcuuuccuuugucuagauuuccagauugucuuagaaucgacuuuccaaacuugcagagcagaagggugugccugaaauaggauuuccagcuccugcuggucuguggucugggaaacaauuaguccagucccuugaggggagacacugcuaaccuucagaguggggcagggauaccggcaggaaacguggcagauguguaggugguauugugaggugccuccaggccugcaggaaggauggauacgggagcccaucccuacuccuuaagcugaagguguggccaggaggaccacagauggaucauuuuguuggggcuggaaaggaaagcauaguggaacuccucagcaaucuacccacagagaggaccuguucguguggucauuagucaugauaauuccacaaaauauuggcuucccucaauagccacuauuaucuggggaugaaaauaacgaggcucagcugagguuagauccagcagacgugggcugacauuaagcacuugcucuggggacucugagaaccagggcagagagcagcuaagcauuuagguuggacaggucaccuuuggaauucuggcucugcugcguauugaccaugugguguccugggcagauauuccuucugagccuggcucauuggcacuugcagaaugggggaugguguuagugucugcuuucagggcuccugugaagguuucaugaacccacauguaagugauccaggaaggagagcaauuguuuguguauagccugugauguacaggagggagaugcauguccuccuuaaguucucucauaacugucuucuaaguuuaucuagccacgguggagaaaugccaucucucucucucucucauuccauagcuccuaccugcccagggucaggacugugugaacccagggaacaggaucuggccaguguucucuacugcugaccuucagaaagaggugauaacucugucugaacucccgcagcagggauaugacacuuuauucuggccuccuugcauaacucacacauacacacacacauacagcaaacacuuuuuuuuuuaauuguuuuauuuuaugugcauuguuguuugccugccuguaccaggguaucggauccccuggaacuggaauuauagacagcuuugagcugcuauguuaguacugggaauugaacccaggaccucucgaaaagcagccagugcccuuaacuacugagccaucucuccagcaucucaggagauauuuuuugacccuugcuccagccaucugauaaaauuaugugaacagguccccuaggugagccuuaguuuuaccauuucugaaagaggaaaccucuugucugggccaacaggguccacugacccauugugcaggguggcaaaagcccuggcaugaggguccuugaggaagaauccuuuuguuuguggcuuagacgaagacccgguguugugagcugggcugucugcgacauagcuggcaguaucccuaagcauccucaauuggaauugcugauuuaagucagaaacaggacccacagagaagcccaagguuucaagucuggugccuggaguucaugacuccuacaaguccucugagcuccagcacuggggaggcagaggcaggaggaucucugaguucgaggccagccuggucuacagagugaguuccagaacagccaggacuauacagagaaacccugucaaaaacaaaaacaaaaacaaaaacaaaaaaaccaaccaaacaaaaacccagaaacagccaggcggugguggugcaugccuuuaaaccgagcacuggggaggcagaggcaggaggaucucugaguucaaggccagccuggucuacagagugaauuuuaggacaaccaggacuacacaaagaaacccugucuuggaaaaacaaacuaaccaaccaaauaaacaaaauaaaaccccagaaacuugucacuucucuguucagaccccucuggugggcagugucuccuggaagaggcaguguugacucugcccugcccaucccucagccacaggagcuggguuucugguuucuaagcgcugccagcaguccuuccucccagcccuucugucccuguccagaggcccugccugccccauauugugaccaccccaccugugcacagcagaguccccaucccugcuguuccaguccccgcugcccagcuuuauccucaguaauacaugacagugaugugaauggccuugucuguuuaccaguuuucuccuccugccugaauauggccacacaaagaacaaaacauagucacuacuguaucucagcuuccagagcagugcuuggcaaguagucagcccuuaucaaauguuuuugaauggagggagggagagaagaaugggaaggauagccuuggcccaagugccauguccuccugaagcuggcuuagccuccuuagcauaaacucccuuuugccucccuugggccuggccguguuguccuccuuagagcuuucaguguguucuccuguccugggcucaggcugccacaggucuagcagcucagcuggacucccacaggcuuugccaggguucugucaaagggccugugcugaagaugacugacaagggagaaacccaacggaagugaaucccagugauuuggccaagcggguggccugggggcucaggccuccuggcagagacucaccugaggggcugugauucuaauguguuucucaccuugccugagcgcuccuaggggucauauugucuccuauaaaagauggcugucugucgucugcagaggacuacagagauugggauggcugagaaaacccagacgggagcuugcaugcccgggccucuccugggcauguggacgugaccuccagauaugcuggaggcuaaaggaaagccuuacccaagagccucuucagcugccucauuagcuugguuuuuuguuuuuuuuuguuuguuuguuuuuguccguccccccccccccgcaccccgcccccccaaagcacacaacagggugugacuguuccuauggucuuaagccaguccuacuuaacagaacccugugaccugcuggcccucuaggucuagaccuucagcccucaggcauuacaaggugugucccauccuuggucauaugcaagccuggacaagcugagucuuggccagaaauacccaugaccaccagccucaccacccuggcugggccugucucacuacccugaaccugccucuuggguacaguagugucuugggucucacuguacucagggaacccacauauagggaggaccuaagcugggaaggggguaagggaggugacccuggcugccguuuguucuggagcuacgggauccccuucaucuugcacccuccuguccauacuggccugagauaggacccgggcccagacaaggccagacacuugucagccuccaguuccuucagggcugcccuggggaggaggacgggagaagagccagcauuguauguuuucucuguucaucagaagacuggcuggggaggggaugucaucuuacugucagcuguccccauggcuuccacgaccuuaggcucagauaacagagaagccaugcccuggcucagcaaggcaagggaggggugcacugugagcccaaacuagggacccggcacuguucccagcccuaaccccagggaggggagggcuggggggagggguguagcucugcagcacacacacacacacacacacacacacacacacacacacacacaccccgcacuuucucccaccugggucccaggggcccaauuaggaaacuugauuuucucucugauguggugauaguggguagaaacgcugaaccagauuucaggacuggggaaaagauugagcuuagcaggagaaugcgugcccaggcuguaccaggucuuagguucuaacucuagcacuucagauuguaggaggggauagaagaggucagaaucuuucuccuguuguuucguuuuggguguugguguuauuguuguuuugagacaaguucucacucuguaucucuggccagccuggaaacucauagagauccacccaccucugccucccgagugcugacauugaaggcugccacaucuggcccaagaugucaaaaucuuaauggacaaccaacccuaguagcuuguucugauauacugcugugagugcugugcuuguccuagaucccagcuugcugggccaugccuggggagcccaugcagagcguggcugucacccuauuaaucacauggauuuguagaagaagaauugaacaaaacagggaacaggcugcggaguaaguuccuccuuugugcacugagcauuaaaagaccagaggcugcguaucugguaaugacugaagaaaccaggggccaugggcuggggugcagcucagugguaggcugcuugucuuucaugcauugggccuggauuccuuccucaggccuuuccauagagccaugcaucccagucaugcuggcugugggacacagcuucugcagugacucuucacaguguccccuccacucacugccccuacauucuccucucccucuggcucccaaggcauccauggaaucacuggccugcccacuccacuucuagaaucauuaauuucaaaaguccuuauaccagauguccauccugacaaucccagggcucucuacaguugagugcaaaacauuugccaaugucaugaagaagacacagagcaguuaccagaucccaagguccccgaggccagauccugggccacagacccagcucuguguaaucacucugaccuaucguuuuccuccaaaaaggcccgcagaggaauugggguauccugucaucgcucaggccacucauccaguccaaucccugacuugggguuuggggaggauuuuagugguugaguggguugugggucaggguucuagggaaauaucucuacccacugucgcccguccugugaucugaccaugcgcggcccacccccacacuuccaggcuccgcuuccugccuguuagaugaggaugugaugcuugugggacuuagaugauccacgggagcccugggcucacggagcuugcucucaggcuuaggcaagaaaagcuugguauuggaaauuguuaaagacaaaggcggugagcuccagggaggagccagaacccugacccuguggaccucuugucuauccagcguccuuccauuuucucacucuucugccccucucucccuugccucccucacugaggcucuggaugcagccagccuacaagggcaagcaacuuuaggaucuuaugucccuugacacagcccccacccaugccauuggaucuaggugaccugcuuggcagaacacccugcucgcccgggucuguggagguaguagggcaagaggagggugcaaagguggagaggacuugaguugggcaagccacugccauuagguuuucugggcugccagcccuggccuugccugggauccagucuugccaggcacugugccagccuuuugugaaugccacuugcugugucgugccaguguaggcgucccuagggguggagggaaacaccagagucgcagggagccacacaaggggcagguggagccugcuggaccaugcaguccauaggcaccgggucuggggagcugggguugcugugugucccagaugaagcagagggaaguugucugaugacaucaucagugggcaccuccuaggagauaagaguggccuaagucugaaugguaguuaggucuucaguaaaugugggaagcuacaaaugccauuacaagguggcgcuggcuaccacuggccaccacgcauaagucuggguaaacaaccaauguguacauaugcaguaaaguuuuucaccaagucacugccuggcccgggcaugauaaugaggcucugcaagguacugagagagaauaaccaaucagaugagagacaugcaaaugagguaugauaaugaggcucagugaaguacugagagagagaauaaccaaucagaugagaaacaugcaaaugagguagaaugcauaaccaauccgggugugagacacgccucuccuaggccuauauaagcagcaccaguucugggcuggggggucuucuugccuacacaguaaaugcucucccaauaaauguguugcagaaggauccuguuauggcguguacuuugcuggcaagucgggcacucacaaguaaaaagagaagccuaggggcaaaaaaaaggggggaggggccagaggagaagaagguuugagacagggucucaguagccuaagcugcccucaaauuucugaucuuccugacuccauuaguauuauagccauguacaacuacacuuggcugauugaaaagucagagauuugaaccaaggcuucguguaugucagccaagcagucuaccaacuaagcuauguuuccagaccuguuuuauuuuuuauuuuuaacccuuuuuuuguggggaaggggacacaugaguuccaagcacaaauaugcucagaggacagcuugcaggagucaguucucuccuuccacugugugaaucccagaaauggaagugaggacauaugacuuagcugcagucaucucaauagccugcgugcacauaaaugcacacgcgcacaugcgugcacacacgaacaccacagaggcuauaguacucugguggaggucaaaggacaacuuuuuuuguuuuuuaguuuuuggguuuuuuuugagacagggcuucucuguguagcccuggcuguccuagaacucacucuguagaccagguuggccucaagcucagaaauccaccugccuccgucucccaagugcugggauuaaaggcaugcgccaccacugccccggaaaggacaacuuuuagaagucaguuuucaccuuccauuuugucuuaguuaggguuucuguugcugagacaaaacaccgugaucaaauaccuuggggagguuuauuuggcuuacacuuccacagcacuguucaucauugaaggaagucagggcaggaacucaaacaaggcaggaagugggaggcaggagcugaugcagcggccguggagaggugcugcuuacugucugugcucugcuccuuaacucaagacauagagcauugcagaugggcagaagguccacagccccaccaccgccccagggcugagugguaccgcuggcuaggauggugagcaucuucaacgucuuauccuuuaccaugugucugcauccugaaugggagcuggagugguuucugcgugcauuggcauuucaauaaaugucaggguguuuucuuggcaacuugucuuucagcauaaugauauauauuuggaaucuguguguguuaucuccugguucugaucauuuguuuugcuggcuguguaguuucccacagucuggguaugacuuggcuuauuuuuauauuuugcuguugauggacauguaggggguuuccaccauuucacucuggggagcacaggguugucaaugggaagggaggagagacugucagagggucaggucagggagcaagagucucuugggaacacugcgggccacaggaggcucugagcaggagcaagacucaaccagaggugguugagcuuuggccuugucuggaguuuggacuggaagccaaaauuagguaaaggaggcucuugcaagacucagggaugagccccguggaccacccccuguaugagcccacucagagcagcagaaggcagaacugagaaagauccucauuugaaagagagcaggcuagccaggcggugguggcacacgccuuuaaucccagcacuugggaggcagaggcagguggauuucugaguucaaggccagccuggucuacaaagugaguuccaggacagccagggcuauacagagaaacccugucucgcaaaaccaaaaagaaagagagcgggcuaaagaggagggggaguuaaguccauaaacccugugacuguggcacucugaagacgaaugguacccaagaugagucgcacucagcgucagagccauauaaaaucguugugguggcaguggggguguggggcugccaggccugacuggggagugucccugcacagcuaggaccucgggcccacccccagcccaggccccuguuccugcccuuugcccccugccccuccccccaggcuuccuggcaaaauccuuagagcauggcacauucccuccugcccaggccuuggcucuacaccacccagaacaccucacuacaggcuccaucucucaguucccaaccgcagccuccugacugagagaacaggucuugguucuucugcagucagggccccuucccuuccaguggcucagagcuggcuccaguuagcugggaguuaaugauccaucugcccuccaguuuaaugcaugcgaguuccccuguuuuugccacaacacaauaauggccagggcagggagccuuuggcuuucuucugugcuauccccacgguguccagcaagcacagcaaauauuuuccaaauuaaacgagcccgaaagacuggccccuugucuacagcauacauauuagcauuggacgaggaaggcaaggacaugucucagcuccucacagaggcuaucuuggucuggcuguccuguuggcaucugacaaaguuuggaaaggaaguggugauuucaaaaaccuuucuaccauccgguccugacugggcacuuuacauguguucucuuacuucgugcauucugaucuuuacgcggucccagcagggcaucacaguuaagggugaggaaccuuaucuguuaggccaaggacauagagcagcagaagccaugcuguuguaggagccacgacugcuguacuuucuaugagagaggacggggagagaugacagacugaugcucuauagaggaugggguaauuguauucauuguuuaacuuuucaguuugaaauaaucuaagauaugccaaaacacaaaaaaguuccuuguacaccuagcccagccucugggauguuaauguuucaugauuacagcacaguucucaaaagcaacaaauacguaucaauaagagacuguucccaccgucagaccguauucaaaugacaccagcugucucucugguccugauucugaucaaggguccugcacuguuccguuccucagcuggccaggugucucacagcggucccuccaccuggguuugccugaggcuuuucucaugaauaaauuaugguuguguauuuugggcauagaggccacagaagggaaguuguaccuuccuccauggucaaauaucuauuguuacagcugagauuagcauuuguuuucuggucugccgugguggggcuggaauaugcauuugcaagcugcgcaagaagagccuugcugcggccucccgccugucguuaucuucauuaguuucaggugaaguuagccaaggugccccgaugacuaauuagugucuuguaaagcagacaguuugagacuaugcaaaucucucuccauuugugccugcugacuugccccuuguccagguguuaggcugugcuccugugcauuaaaauuggaacuaguguuuguguguugcaugaaagcaagcugagagaaagagagcgaagucagagaaggccccuggagaagggcagagcugggacagaaucuagagcagcagagggaagaacaucccagguaggagaccugcccaggagaagguguguaguuaggauggcucggacuccgugcucucacuagugcuccaguguucucacuggugcuccaguggcucucacuaguccuccagugcucucacuagugcuccaguggcucucacuagugcuccagauaccccaccuucaccccacugcccucuuauccaggcagugcaccaccuugaacucagaaacaauggcuugacacuaggcugcugacacggguccaucugaguucagcccucuaguucagcccucuaggaaaggucgggcaugugguagcucacaaccaucuguaacaggaucugaugcccucuucuggggugcaugaagacuucauacucagauacauacauacauacauacauacucacauacauacauacauacauacauacucacauacauacauacauacauacauaaauguuuuuuaaaaagaggccguaaaaugcagaaggcaaagcuucucuuggcaugcagaguugccagggcugcggagaggcagagagcagaaguuggcuaggcugcagcugaaccgucacugccaaacucucuggggccuaccugguuuguccaaacuuugcaaauaaaacaucuaguauuucuuuaaggggcuagggagagucugagucugcccaucuuuauguacacugugagagauuuaggguccacauuccaugcccucuuagguucccaaguuuaggaugccuuuaguuuucugacugguuugauagauacuccaagcacccagugcccacuuacacugugccugccucagccucgguuuccugcacagcaaggcccaagccgucuccuucccauccugacaggccuagauacauaauuuauccuguccaguguaaugcaaaauccaggugcaaggugaggugguacagaccccagcuuuugagaggggauggcaggaagaucaugaauucaaggucguuauuggcaacuuaccaaguuugaggauagccugggcuacauaaggaccugucucaauuaacuaaauuaacuaguuaaaauaaagucacuuauucaaacaacaggaaaaaaaacuaucggucaggguacaaauguaauaaggccagcuuggucgugcauacuuacaauguagcacugagacagaggcaagagggucuuaaauuugaggacaccgugagccauacagccagauucuggggaaagagggggaggggagaagcaauaaaauccaaaguguuuccauucuuccaucucuuuccauguguguuuucaguuuucuauuuaaugucauucuaaauaaagaaaaguaagccaagcacggugacagggccacugugaucccagcacuugggaggcagaugugggaggaccgccgccagcuaguuagugcacagcuacauagugagggucuacaaauggaguuaggcuacauaaggcugugacucaaagggagaaagaaaggaagagaaggagggagggaaggaaggaaggaaggaaggaaggaaggaaggaaggaaggaaggaagaaaagaaaacuaaaucacuaggcagugguggcacaugccuuuaaucccagcacuugggaggcagaggcagguggauuucugaguucaaggccagccuggucuacagagugaguuccaggacagccagggcuacacagagaaacucuugucucaaaaaaaaaaaaaaaaaaaaaaaccaaaaaaacagaaaagaaagaaagaaagagaaaaaaaaaaaaaggacccguuuguuuuuauauugcacaaugccagucuugcuugcuugugguacugagcauugaacucaguaguugaacaagcuagguaagugcucuaccauuaagcuauaucuccagcccuuguuuguuuguuuguuuguuuguuuguuuaaauuugagacagggauccaccuucaggguauaaauuuauuauaugacaagaucugucucauaaaaaauauuaaagauuacaaaagucaagucauuaagaugacguuggcguguugagcccgaggggcccuucugaccugggcccuugguggccucacaggucucacguuuuguuuggagaacucuggcauccugguccacuuuccugaacuacauauaacugggauggcaguggggcaagggucaggcccuccagccucacugccggcugcuccucuaucugcuaaguagcuacagaauucucuauuuguuugagcaaaccugcugucugccaucuuugggccucagacuugcuuccucuacccuaguggcuuccaaaguuggucucuggaccagcagcagcagcagcagcaccugaaguggcuaaaaguguaauuuucaggguugagauguagcccguuugguaguguuugcuuagugagccugaagccauguaucccaccccuggcaccauaggaagcagccguggaaacuaaucucagcacuugagagguagagaggcuagagggccggaguacaugaucacccuugacuaccuagugagugugaggguagccugggguaugugagacuaaguaaagagcaaaacaaaacaugucgauggcaaagugcuugccuaaggguguccguggacacagagauccuagagaugugaggccuacagacauggaagaggauugaccugaccucagacccucucucugcccugcagguauagccuguacacccgaaccuggcuuggguaccucuucuaccgacagcagcuucggagggcucggaaucgcuaucccaaaggccacuccaaaacucagccccgccucuucaaugguaaucucugucugccccuggccagcaccccaccuuguucccuacgcucacacacacacaccccacccccgcgugcgccuacuucccuucucccccugaccccuucagugggcucccaccccgccccagccucucugucugccucucccaggagugaaggugcuucccaucccuguccucucggacaacuacagcuaccucaucaucgacacccaggcugggcuggcaguggcuguggaccccucagacccgagggcugugcaggugaggggacagggagcaggggcgcuggggguuacugcaggggacugccagcuuuugcugccagucugggguugguccugguuccucugacuaugggcuauguugcaucugggugagcauccaucucucauacagaaacaccacaccccuuagagcaugggggacgaguggguguccuaggccugcagaugagagaagagcagagccagagggugggugacuccuaggacuuggguccuggcaguuccagucugcaucuuacccucuuuuuuacccugguguacauucuuuuuucauucuuuuuuuuuaauauuuauuuauuuaauauucaugaguacauuguugcuguauucagacacaacagaagagggcaccggaucucauuacagaugguugugagccaccaugugguugcugggaauugaacucaggaccucugggagagcauucagugcucuuaaccacugagccaucucuccagccccuuuuuuuucauucuuauuuguauauuuauuuauuuugggggagggguguuuguccucucuucuguucuucucccccccaucccugccccagacauagucuuagggaguagccuuagcuggucuagaacuugcuauguugaucaggccccuuccuccccagugcugggauucaaggcauguaccaccgugccuagcauaacauuuuuucccauuauacauaugggcaugguguguguauguauggugugugugcuguagcaugcacggggaggucagaggucacccugugguuaucucuuuccacuauuaugaggauucugcugauugcugaugggauuuacccgcugagccaucucaccagcuuucuuuacucucugaccucugucaguaccugggcuucuucacuuuucccgucauguucauaaccgccccccccacacacacacacacaagacuuaggcaucucucccucuguauacuaccuccacccucagugucucuucucucccccaggcuuccauugaaaaggaaagaguuaacuugguugccauucucugcacccacaagcacugguaaggggcugggaauggugcggcaguuuuccuucacagguugggcucagagggaaccaccugggagauaucaggaagggugggaccuaccuucuccauaaagucaauuggguaccagcagagguagagagacagguugagucgccuauggcccuuagcaguuugagggcucagcaaugggcaggcauuguugugcuccauucacaggcagguaguaaguacccacagaaugagcaccuaguuagguaguggguggcugagcguacagagguggguguggucagauccacuugggggaaucugaggaugacaacuggagcugagaguccaaaagggucaugggagcauagcaaguugagggguggcguaaaaagggaaaaggcuugagccaggggguacuuuagggaaggaggggaguccagguacaguugcccuuugaagugccaucccacagggaugccuguccucaucucugccaucccacagggaccacaguggagggaaccgugaccucagccggcggcacagggacugucgaguguaugggagcccucaggaugguauccccuaccucacccaguaagucccccacccaaacauggauggacaucaccugccuccagccuucagcccuccagggugucagcagcuggaucucuggugacaccaugccuagccauuagacagcuagguagaaccccuguaagaauaagaagacugcaugagccagcuauggucagaagaggaaggcugugaucucagccccugggcaccccugccuucucccuguuguagaagucccccuccuauaaguuacccagccuggcauggugccagagaccaacaugacagaggcuugaaugccucuuuucccuguuguuuugugccccagcccccugugucaucaagauguggucagcgugggacgacuucagauucgagcccuagccaccccuggccacacucaaggccaucuggucuaccugcuggauggggagcccuacaaagguccuuccugccucuucucaggggaccugcucuuccucucuggcuguggugaguuucugcaaaagagaggggaacagggacaagagggagagacaaaggccagaguggccacuguuccaugucacauuuggaaguguuguuuuccaucauuaaauggcucaguagcaggccucucugcucguguugccugacuguucuccagauucucagaggggaaggaccuaaggagagggcacuuuaggcaaagacccuauggggcacgaauuuccacugggugggaccuguuucccuaagacagugacugggaagaagagagcaugggaaguggaggauucuuaagugagaagaaaguaacccuggguggauucccagagagccgccaaggcuaaggcugucuuggagaaaggagcaugucugcccaccaagucuggaccacaggagcucagccuggagacucggcagccuugcccugcacucgggcacugugugugucugugucugugugugugugugugugugugugugugugugugucugugugugugucugugugugugugugugugugugugugugugugugugucugugucugugucugugucugugugugugugucggggggugggguggggaagggggaucacaccagcucugccagagaguaacugggcugagcucccaugaagagggaguaggaaagcugcccuaucugguucuuaacccugccuuuguguaccuuauaccauacuguguccuccuugaugaucccacaugaucccaauguaggacggaccuucgaaggcacagcggagaccaugcugagcucacuggacacuguguuagaccugggggaugacacccugcuguggccuggugaggugccccuccuccuccucucaggcccuuguuuugccugguaccugaacccucccagucccucacuuuccuagagacuggcaagcucagcucauggccuaaaggucacgcagccgauccacggggcaguguugggggagcagacacugaccucccuccugggacguuagacuggcugugugauguccaugccucacacacuacugucccauuccccagacagaccuuggcugcuugugaccccugagcacccagaguccuggagagauaucuaauuguucagauaacuauggucagcuccccaaacagaaaguagcauuugcuuaucggagaaaacuguaaaucugguccacauguacugauuggccugaauuugauacagaauaugcacacaccccauaucucccccaaauccaucuccccuccccuaaccauccaacuucuuuuuuuuucuuucuuucuuuuauuuuuuuuuucugacguguuauugucuucuccguuugcuaaaugacaaaacuguggcuuaggcgggugccagucauaaaugaaguaugcugggcagaguuaagaagcuaaccauggccucacagcucuaaagcuagugauuuuccccaugaacccuaaccacugcccaaacugccucugccucccccucucccccagcaaaaauguccgugguuggaaaucaccuuugguguugggguuuuccaagagccucgcccccaacccccaccccacccccccauugcuggauagcugugggucugggccuuggaguagaaaggcuauaugaccucaccacccaucucuuuccccgugguuuuggcuagggcaugaauacgcagaagagaaccugggcuuugcaggcgugguggagcccgagaacuuggcucgugagaggaagaugcaguggguacagaggcaacggauggaacgcaagagcacagugagaccugggggaugggcgggguggggugggaugggguaggcagacaucccugcauuuccaguuucuauccacccacccaucccugugccucuugcucugcagugcccauccacccugggagaggaacgcgccuacaacccauuccugagaacccauugccuggaacuacaggaggcucuggggccagggccaggccccaccagugaugacggcugcucccgggcccagcuccuggaggagcugcgccgccugaaggacaugcauaaaagcaagugaauaauaacccucgcccaccccaauccagggucucccagcagaggggaggccacccaccacccacacuucaccauccucuucaucacuaauaccaccaccaccaccaccauuggugcccuaggcagcacuaauccuccagacuggccagggagggcagagcccaggcaaugggaccuagaggaggaagcacugggaggcugagaccccacacaguacaggugguguuuaggguaagaggaaggaagcaacugaaacgucuccagacuuugcuaccuuggagggucugccuccccucccccacucauggaccaaucgccagaucaugaaggcugcauuuggcuccugcuccagaggccacaccaccacuagagcccuagaacccaggagaagagaguccugaccaggcuagucuaucuuccaccuucccccaugcaggguuguaggggaagcucaccccaaaaaugaucuaacguguggugccugggaaaguggucaucaaccagggcagccagacucugggugacugagacucuaagucccacccuaccuaccuugcuaagacauugccaggcagagccauuccuaagaacaccuaaggacuggaagccugguucuggcccaucccugccucaguggauguccugaaggccagagagagagguuccugguugccaaggaaucuucugcuucaggccagggagucaaaggaugauggcacacagagccacacaccacgcacaucuguucugggucugccauugucccgggucauaagggccugccugccuucccaggggagagugaacuguggucugccucagagaccugcuucuccuuuccgcccuuguucuuaggaauuccugccugccugcugucucacuuaaccucucuugcucuaucuucacccccuuuccucucugagucauuaaaggcugacuuucuuccagccugguacucauccggcucuuugcaguuugccaaaaaccuucauucccacgucauuucccacuggaucccagggcccucuuguugucagugugcagauagcagaggucugggaauaggaagcuccagugaguggcagcuuccaggaccucaggccuggccauaccccacugcucaucccccuccagaucugcuuguccucuggucucaggucaagggcccuuuguggccacaggagcacuauggucguuuugcaagcacaccuuaggugaguuagccaggagccacaucuuucugugucagagccuuccacugggcugugcagugcccucuguuguuccucugagaugccccugccucaguuuccccucucauuuggcuucggcugcccucuccaggcacagccuuuggaacucacucuagcaauaccaccggacuaguuagccuucccggccccaagacacucgcaguuucaugccuuugugccuuucgcucaugcgguuucuucagcuggaaugccuucccgcuccugccgccuccucugccuggcaaacaccuguuagccucucccaggccccucccccaggaaggcacccuucaccccucucuuccaggcuaccucugcaccuguaaaugcuucucucguggcaccuaucacaccguacuuuacuuguuuacauguuugucuccccuucuagacugugaauccuuaagggcauggacuguaucuuaugcaucucuguauuucugcgccuagcacggugccuggcacacaguaggcgcucaauaaauguugaaugaaugauuuaaccaaggucu

SEQ ID NO: 223 - RNA, 321 nt, Mus musculus
cuguguucccagauggcugacggagccacggcaagccuaggagcaggcucuggagacccaagucuuagagccacuaguuaggaggguagcuacccauugcagcugaaacugguuaaaauuagucaggcguacugguuaaaauuagucaggcguggacaucuuuaaucucagcacucaggaagcagaggcagguggaucucugaguuugaggccaggguuccaagacagccagagcaaaauaauaaagagaccuugcccccccaaacaaaagaaaccaaaaaucaaauguagcauucaggauguggaagaaaauuuaaaauu

SEQ ID NO: 224 - RNA, 17378 nt, Mus musculus
ggaagccagucuucuagugacuuucagaugaagacuuagaacucucagcuccuccugcaccacgccugccuggaugccgccuugaugauaauugccugaaccucugaaccuguaagucagcuccaauuaaaugcuguccuuauaagagcugccuuggucaugguguuuguuuacagcaauaaaacccuaauuaagaugacuuuccaaccuccucaaaacuucaccaaacgauucccauguuggaacacagacuuuuggauaaccuauauugguuuucucugaccauggccacauauuuggcuccucuuaaccucuuugagguaaguuauuuuauuauuaacauucccaaaauaucuggcauuacgggcacaugccacuuccacuguuuaugcagugcuggagauggaacccaggacugcucgcacccuaagccagcauacugccaacugcuauaagauuauuuuuacuucccagucacacauagugagcuguuaguguaaacacaccaugagguuugcaaaacagaaauuuccuaaccuagcacaucccugucauuaagugacacaugacugauuccaagcauagcuucggagucucaugccuguguuugaaguuuuacauuugaaaagggcgguuagcuuacaagcacagaauucuuagucaccacagacuuuuuugugacuuaaauuuuucuuuucuuuuuuuuucuuucuuuuuuuugugacuuaaauuuuuuuuucacgaaauaagaaguuuuaagaaugaauugauauaaacauagcauagccaugugauacaauauugugcaucauugaaacuauucuuuuguuguuugguuuuccuggcauggggaugaaacccagcugggucucucacauggaaagccagagaucuaccacugaccuacgccccuagaccgaaagugcugaagaucaguuagugacaaaaaagaaaaagagggaaaaaaaaucagugaaaucugacuaugugaaaccagggucaguaauugcaacacuugggcugaggccgggugacaagugcuggagaccagccugagguacauagcgacaucgcucuuuuacccagaauacaaacaaacaaaaaaacaaacccaauaacaacuuuuaagacaacaggauuagcucuaaagccccuagcgcaaaucgcugauauguaggcacugaugacgcauaaauagcacuucuuacugggguggagucuggaauucauggaaagaaguuauuuuuuucccagugaguuuggguuuucgcugcgaaccggcguugcuuccaguaaaugugaaccacucacaccugggucgugguugaggucuggaggggaccccagcgcucccuggaggucucggggugccgggcggcuccuccccacuggcggcggagagagacggggcggggcacggagccccaguccagcccggcccagcccaguccucgccagcgcccggaggcccaggcggaucucacgguccggaacagcgcaggcaagugagggggcugcggccguuggagguggggacccgagaccggcggggaauggaaguggccuggggcggcgcugcgcccaggcgcccgaacuuuucuggcacgcgcgggccgacuccggucgugcuccggagccaggcuaggguccuuucguucugccuguuccggucuucacuuuccaugugcgcccgggcaggacauauggcccgggcuuguggcgcaaccgcauucggugcgcacccgcgagcugacccgcuucuuguagggugcuccucucaguggcugaguggcuuguuugucugaggacgugucccccacuccggggccccagaguggccgugcagcaagugagaauggaggcggucaugguccucagcugguggggagagggagggagggagccagccagaggcuuggaacccacccggggcuguucgagcuugcccuggcgucaccaggcugcguaaaaacuggugaugagaaucugucuaagguggggggugggaggagggagcccuagcucagagaagccagcgggccaaccuaaggucuaaagaagaagccauuccuacuccuaaccuggccugcuccuguuccuuugcucuguaauucagaagccuaccagaaaguacagucaagcugaugaacugugguugguugguugguugguugguugguugguugguuuauuuauuuauuuauuuauuuauuuauuuauuuauuugagacaguuucacucaguagcccagucaagccuugaacuuguugccucagauccuuaagugcugggaguauuacaggugaaagcugucuugccuggcccuggugaccucuuuaggucagaauaaaaaauaaaaaaaaaaaaaaaaaaaaaaaagaaacagggaaaugggaaaagggaaagcagguuugggagggccaggagggaaccagaaaaggaggaaggaauggaaggcucucugccaaggcagagccuggacugucuucaccaggucuuguuccccggggcauccuuccccagucacucacuccacuguggccuauggguggugguacccauggggcugagggucaaccuaaacaccggauaaguggggagagcugucauggaaggucuggcaggugucugguucucugagacucugaaauauuuaucucaguggugagcuuugguuucaaagcuggugucuuuggccuggccagugguggcugggcaagccaggugcuucuuugugcugcuuugucugccuuaaacaggccaccauacucccucuccucuucacuugccuguucuuaccucuccagucauggggcccuggucuugcuuuauaguuucaagggaggugagaccauugcuucaaggguccugauuuccugucugacuucagggcugcucauguaaaacugggcagaucaaagagguaauaaaauauuaguuggcaaguaguuggagaagcucaugggcuaggguaauaggcacuuaggcucagcuuccucgguaagaaugggggauccucagauagaagccaucuauagcagagcaccucccaacccaagaccucucaccaugggcccuuaagacagaguaaaagcaccgggacugagggacugagugugugguggaguggccugaguuauagggcaagugccugccucacaaaacaguaacaacacuggggcacggcaccucauccuucucagaagaaaggcaaaaggaggauugcaggccaggcugcagaccuggagccaaccugggcugcagagugagaccguaucucaacaagccagcgucgaagcgagguacaaaucuucagagggccuucaguucucuuggcaaugcugaacaagagcugaccuugauagaaucuucuagccuuaaccuaacuaagauuuugggagucuaggccaaaacaggacuuguuuugaaguagaacuaggaacaagaugcacggguccacagaccucuacucgucguggacauaaugcauuggucagggaggaagguaagacuuccuuacauagacuggucaguacaugucuaugaccccgggggugauguuuagggaugcuacuuuccugguucugugcugccuagauuuccuccaugcuaugcuauaaaucuuaccauggaaguuccaguagcugcuggaccuaagggugggagcagacccugcaggggauccuggugcucagcuggcaugagaaugagggcaugucugguccuccuacccacacccacagguucuuauggcccugaacuugugaucuuccugcuugagcuaaccuagugcuaggguuacagguguauaucaccaugccccauucaggugugguucuuuuuaaaaauuauauuugcuuauuugugugugauggugacugcaugcauguggaaguccagaggacagcuccagggagucgguccucuccuuacaccaugugggcucuagggagccaacuuagguugucaggcuuggcagcaagugccuuaaucugcugguccacugagauuuuuuugcuugguuuuacugcaccuguuuugaggggacaggcugguggaaguguaggguuuuaagagcuggguagaagcauguuuuuuuccuuaggguuagguccuuguguaauaaacagguugcccaggucagcaucacacaggcugugaagaguggaaacaucuuaggaggagagaguguuaauggccacucuugccuagaacaugccaugugccucuguauauguccuacacauuacuguaugccuaccgacuagaggcauccagucaguguguagauucccagguaugugggggugagauggggaugagguggcuaugucauucugcucugaagcuuccuguccuguuagccuguuuauacagaaucaaacuggcagggcugcaguggauuuugaucuuucagccuagaauauacccaucuuacagauguaaaaauggagccuggaagugggaagugaccuaccccaauucauguacuggggucaguaccaacaccaggacaagaauuaggucccugcuccuacacuggaguccugggcaaagauggcaaaaggaauccauauccacugugcacuuaacuccgcuggucuuuaccaucucacccucagcccugugcuccccuaaccaggugagggugcuucagguguccucccuggcagacaagcacccaaaaucagucaucaaguucaaaucugucccugcugcuugcaaacugccuuccauggaugcuuaaauccuaaagccuccaugcauccuccugauaauuucaacugacuguuguaagauaggccguugccuuagccuuggcuggccuugugcucacuguguagcucaagcugacuuugaacgugaagcaauccugcuuuagccuccugagugcucacauuauaggugugucccacuauuccuggcucucaaauguagcauuuuuauugaaggugugaucuuuugugagcauaagaaauaccuugguugcuuacuaaguacugaucuuaccacucuuccguggcgcucuuccuuccccaccccugugauuuuccacuuuggucugauuaauacuccuguucuccuacuugucuccccuccuaacccagagacaauacaaacggggcagggcaggccuuugugucaaaaauagcagcagcccugauaauggcuuccuuuuuuucuuucuuuuaauuuugagacagucucacuuauguagcucugacugucuagaaacucacuuuguagacuaggcuggacuccaucuaagagaucugccugccuuugccucccaggcacugggauuaaaggccugagccacuacaccuggcauguucucuuccucucuuccucucuuccucucucucucucucucucucucucucucucucucucucucucucuuucucuuucucucccucccucccucuucuuuucuucuucuucuuuuguuuaauggcuuuuucaagauaggguuucucuguguagcccuggcuguccuggaacucacucuguagaccaggcuagccucgaacucagaaauccgccugccucugccuccccagugcugggauuaaaggcaugcgccaccacugcccagccccucuuucuuuauaagcacaccaaggccacccugacuggucaugcggcugggcucucugauauuacaaccucacgaugcaaaucugcccucugagauuagggugauggagaagcugcuggauggggccccuccauauucucuaggacuuggcccucuguuucuguggauacagagagagacacucuagagguaggagcuggggaguggccuggagccuaggaggaaaguaacagguuggcaggaugagcaagaaauaaugaggggacuggagaggguucuuugccuggcaucuguggcucuuuugcugagcuuuugauacugggcgaggcugggaaggaaaguucuaaaguccuuaacacacacccccucccccaagauagcaucucauuaucauuuccuggcuggccuggaacuugcuauguaguagaauaggcuggccuugaacucacagagauuuauuuccccugccacugcuagaauuagaggcaugagguacaauaccuggcccagaaguuccaaauucuuggccaggagggccuguccugggcuggugcuuuagggcuuccugguucuacugacaccucaguauuuggauccccucuauuucaccuccgaauccugaggccaggccaccggagaguacuauguucauucugggcuccuggcugcuucugucacuucucugucccaguggcuaugugcuggggagggagguguuuucuuggggagaauggagggaagaagcuaggcauggagaccuuggugugggguggggcuuccugagacgcaugcugagcacuucuuuccauucuggucugggcauuggcuccuggcauucaggagggcaagcugcccgggcugcucuuuucuguccuucccuccagacacacccucuugcuuguaaccccaguagcucagccuucuggcuacagauuccauaaucuuaacacuucuuaugccacaggagaguuagagccagaguucgaccucggcagaccagggacagaguugaccuccugagacaacccaggguuuuguggggcagucuccccagauucuacacugaaaagcuuggccaccaacaaaucccgcugugugggcccaguacccaguccugcugugacugagucagggagagguucuggguuuuuucugacauggaugcauuaccugagaaagguacaggcugaaacauggaagugccgggacggggcaaaggccuucucagcuuaggaaaaugaucccaguucucuguaaccccugcagucugugaagcccucacagcccugggugaacccggaagaaccucggugucuccaggucucuucucuguccuuguccuucuuccuacucguuuccuucucuuguccccaugccucagccuggcuaggagaaugaaugaccacugccccuagggcagugcuagcccagaccucagcccugguggaagccuugguggaggccaggcaggagcugaggccugcuuagaagccauguuggguauucuggguuccugaaguucucucuggucugacaaauaucgcccaugccauggcucaguggagaguguggcagaggcuggcugguacaaaacaaggguuuuacucuccugcaccagggucagacagccaggauuguauuguagccuaggaucagcuugucuuaagugggugggugucuagauucugacauguugagucuccuugugcugguggaugggacuggggugcacuguggaggggcugaaucgucaggcauccacuucugugugagccugcuauuauuacuggaggauuugaggccaaagccaugggagauggcugagaaauugggauagauagacuauccaaauaagggacucaaaagggacaccagagucagccagccuuggggguaagccuugacuuuguuauagccuggugaggugucccuggccaccuuucuucauucugcuaagccucggugucucuguaauagcacuguucaccugcugucauacuuuacggaguuaggaguuagucaguucacagcugaaaacagccagaguguaucccugguuaggcugggcauuguucuaagagcuccgaccuuccuuccucucuuuccuuuucuuuuuaaauuaacuuauuuuuauuuuaugugcacugguguucugcccgccuguaugucugugugagggugucagauccccuggaacuagaguuacagacaguugugagcugccauguggaugccaggacuugaacccagguccuaugggagagcagccaguguucuuaacugcugaaccaucucuccacccacucaguguguauauucugucuuaauuuugacgguuccuugggagguacuguuaagugguguugaacccaucuuccagguggggacacugacgcaugacaucaucucugguucaaaagggcaggugguggaggacucagagaacuaugcugggaucaggcagguccacuggcaaauuccucccagcacgaccgggcagggaggacaggggggaggccugugagucagcagcugagccacccuagacccuggagccacaccccagacagugagucacugcagccccucucuugggaagagggagggggcccugcauggucaguuuccugggucacagucagcucuuagagcugucauugagcccugagaucacucaaccaccccauuucccacauacccugugaaagugaagggccaggucauugggacaucauggcuugguagcacuguugggacucuaacaacagggccuuuccuggcagugccuuuuaggacuguuuagccaucagccagcacccccucuccccccauggaggauuucauauagaccuagauuacugagauaaaagccauaauggaaugucaggcaccucuauaccaaagguaaccugcuuugcccucuucccauccaccaggaugucguucuuucuguggacucagaaggcggcuuggagagggaaagaguaggguuuaggggaacaaggcuuuugcuccaaaggcuggggcaggaaaaacuugcuucuuuuaucuugcuugugauuacucuguccuuucauagacucgagacucuccaaaccaguuccaguggcugaucuuagacucacucuccacucugggagucccacuucuccaguagcucugcccugcgcagugccugacucccaagcuucccugcccggcucacuucucauaccccuccucucuagaaaggcuuucuucucucuggcuugacacauucuugcucuggggagauggagaacagcuuuccucagugugaccugcucagagaccuggccuguuacucgauccucacugguuuuccuugugaaucacucccguuguccugagaggagccgugcauguccucuaucugaucucugagcugcacuggugcccugaaagagaagcugggacucuccugcuuccagcagcggcccugaagguguggcugaccuggaucugccagucuuuccuguagggcaggggguaacucugucacagggugugcaugggaaggggugguucugugaaagaaauaaagacaccauuuccuugguuugucucuguccucaucucugccauaucuggaugugccugccauuucauuauggguccacaggcugugaugagcuuggcagaggaggccuagaaaguacagcaaagcaugaaggacucauaacaccagacccacucagggugugcuccuaacagcuggcuccaggacugugggagcuacuuuacuaaaaugggccucacugcuccccugagcaucaguguggcaccuggagcuucggcaagcugcagggcucuccugucagaggcauuccauccugugcccucacuucucugcuugcuuuccuugaccuuccccgccacugcugcugggaagacuccagagacccccuuccagggagcucuggagcacuguuuacucccuggcaagaccagcgaagggagcaacaggcacaggcugccacaugccccgugacgggaugggaacuggagaguccugucugcugccagcccugccccucccucuggggccuggccauucuggcacaguggcaggauuguuuucuuccuccucuuuccugcucagcuucuagcuuggcuccacccuguaucuggcccucaagccugcugcuccagccagcugcugugggggcuggguugagcccucuaaagggucccagcuggccagcccugugacucaccaggaagcgcuucuagggccauccagcuucuucccugguucugcugucaggacagcacugcaagguucccuuaaaggcgaacagggaguucccaggcugccagucucuuguguuguucugauccucagcugugacgcuggucgucugacuaauccccaccccuacucuccuguggccagggcaggggaggccccagauaaaggcugcugugagagauuauaaaacccaagggcugguguccugugggcggugaauggcauguguaagcuacagacauagccuagaaaggagcaaggguggagugggcagccaggaacucaugacugauugcuuguuuccuauugcaggacccagaagcugggguuuccccucagcccuugaguggccauguccaaucccagugccccaccucccuaugaggaccacaacccccuguacccuggcucuccaccuccugguggcuacgggcagccaucuguccugccaggugguuaucccgccuacccugccuacccucaaccugguuacggucauccugcuggcuacccacagccgguuccucccguccauccaaugcccaugaacuacggugagucauggaggguggcugggguuggugggacaagguagagcuuggcacugaggaacccuuacauucccuuccuccuaccauccccuuugauaccauuuucucuuccugucucaccuuccccuuaaccuccuggucuucccuccagccacuugcuggccuauauauucaguaagaagacugaggccuuaagacugaacuuacacccagagauggcagcugggugaaguaauggcuucuaagugguugcccuaaggaaccauuucuguuucucaacaagucuguugccacugugugugggcaccauuccuuccuuaggaacccuaagcacuuuuuaauauccuagggcugacacaucuccugccaacagccaaaaugucaugguuguccagugaaggugauguuagacuagaguaagccucuucuccuggggguggauuuugcauauauauaugcacacauauauacacccacccacccacccacauacacacacacacacacacacacacacacacacacacacacacacacacacauauuguuuguuuguuuguuuguuuuugguaugagagacugaacucaaggucauuaaacauuugcucugccuaugccuaugagcuguaccgcagcuccuucuggguagauuuuggaaguaguuccccaagaggcauccauggaauguugguggcugcaguagccucaguguccuagagccagugaguauauggccagcucuuauuuggacaugcauucugaggugaccacugugcauugugaagccugcuguagacacagcccaugcccuccuguaccuacuuccuguguagucuucccucuuacucucuggcacuccacucccaaggccacugcucugccagccaguuccacucccuaaaugccagcugcuuccuagauggcgaugccacuagccugucuccaaauaggugggcuggacacacagcccgcagcagcugccugcugacagcacagcucuuucucaccugagccaagcugggguuacacugaggaagccuagagaacccaagcuuaauaagagucugaguuacaagggugucuuuuggacagaggcaccugagccuugguuugagucagggaggucaggggugcuuugagauggaggcuauguguccuagguccccaguugguugaugugaucugccucugguccuaggccaugacuauaaugaagaggagagagcaggaagugacagcuuucguccuggagaaugggaugaccggaaaguucgacauuccuucauccaaaagguaagaacuggguuggggcuuaggggaggucuagguuuagauagacauucccacguacgugucuuagcugccuaccugugcaccguccucagaggagacuccccucucugugauucccauugcccugacuuuguuuugggaugacagagucacucugggcuuggauucugcacuuccccuuccuguucuguccuguuagacagcaagcaacugggagcugaaguaaacauguugucucuaaaccaccacacauccuuucuuucaacccuugucacagaaaacugcuguuaggacaggagcaggcagagcaagugagcaguaagcgcuauacuauaagcuggaugcuggguagguggaaaggggccaagaaacggcuggaguggcagaggggucccuuucaggccagacugcagucagggaagacucucugaggacuggaaaaguggagccuuccaaauuacagucauuguuuaucuuuucaagacagauuuauuuuuaauugagugugugagugaguguguguguguguguaugcauguauauguguaugcacacaugugaguguaguauccaaggaauccagaagaaagcaucagacccccugaagcuagaguuggauacaaguaauuaugaguugccugaugcuguuucugggaucugaacucagguccaugagcaauauauguucuuaaccacugagccuuucaaacuaaaaggaggccccuuguaccacuagcauguugggggugagguaggugggcagaggccuuggcacugacuguuuuucagggagaggcuuguaugaggcgggagcuauaccccuggcucuuuguucuagguguauugcaucauuucuguccagcugcucaucacuguggccaucauugcaaucuucaccuuugugugagucucuccucucucagccuggguuacugcugggcugccuaugcagggguggcucuccgcuggaggcggacagccacaggaugauucuuuucuugguguccucuguuuuacagggaaccagucggcaaauacgugaggaacaauguggcuguguacuacguguccuagugagugcaggcuguugcugcugggaugggagggggacaggaggcagcugaccggcguuguucagggcagaacuaugcccuaagagagagggcuucccagaaacugugccagucuccaggcaggggcagaagagcaaccugaggaggaguaacaucacggagugcugggacaggacaggagcaggcagacacguggugauggaaugaagguuucauggugcugcccaggcucucuaugaucaccuugcauugccuucaggucauacugggcuaggagcaggccggggggugucguguccuauagcuaugucccaucucuucccucagugcugucuuccuugucaccuaccugacccuugccugcugccagggacccaggugaguguuggagacccugacaagaggagggcagaaagugggacaggggcagagcauuguaagaggaaaaggguuugcacagugaagagagccuacaaggaguauugaugaggaacaagaggccagcuguguuacagaguagugugcaaugcccaccuauaugcuauaucuaucuuacaagauauggaagaaucauauauacaagauauguaccaugucgagcauuuaauaaacaguaaagaaaaucaaaaagggaggaaguagcaagaugucucaacagguaaagguacuuuccaccacgccuaaugaucugaguuugaggcccgagacccacauguuggaaagaaaaugauuccuacaagcuguccucugaucuccacaugugugcuguggugcaugcacacacacacacacacacaccaacguaauaaaaaauuacaaacauaaaagggaaaguuacugcaucucuaucaggaagaacucaggguucagaggcgccaagggauuuugucacagucacacaggagacaugcagguucuaaacaagucccagccaugcuggcuccacaggaaaggacugucucggguuauccuuguguaaauaucugaguacccucccuaaggagaaggcuuauuucucaggacuucugcuaaaggagcugcugagacuugauggcccaggcagguaaccagggucuuccucccucucccucugucuccaggcgccgauucccauggaacaucaucuugcucaccaucuuuguaagucuagaagggaaauggaagaccuacacucggggaaggguuggggacacccuuguccuuggcuggcccugcucuugcuuuccucuguggcuguucuucccaauacaguuacccccagcuccugcagggucauggcgaccaguguugaggcuguucuguguugagccauacucaauagcccaugcuguucuuaaccauuggccucauucucuccugcccgcagacuuuggcuuugggcuuugugacaggcacuauuuccagguauguucagggacaauccuccaugcucuuggggagggaaugucauggaaggcuggauggacuaugggcacaauccugaacauagggagucuauuuauggcuucugccucuggcccaucucaacgcugcuuccuuuuccccaguauguaugaaaccaaagcugucaucauagcaaugaucaucaccgcugugguauccaucucugucaccaucuucugcuuucagacuaaggugaggauggggaaggccuuucucugaccauccugcccucuuacacacacacacacacacacacacacacacacacacacacacacacacacacacaccuuuggguucagcacuugggcaggcauggaaggguucagacccuugcagacuagggacuucccuagccuaaucuccugcucccaugucuguacuugacaaauugcuuccuguaugauauauguccuuagcauaucacugucacugccauguccccaagagcagcacugggacuccccaacuggggcucagggucaguccucugggaugcuaaggauggcaguuaucgacgugccucuuucucccuuucugcuagguggacuucaccucguguacaggccucuucugugugcugggaauagugcugauggugaccggaauugucacaagcauagugcugaucuuuaaauaugugaguguccugccagaaggguaggcagaacccaggcagcagacuuccuguggagcaggggcgggcucuggcucacacaccucuccacuggccagugcaggcaccaacacaauaccauccuuuuggguuaggguauaacagauuucucucaggcaggugauaaaccacagcccccuuaagcccuggauagcaccacuugguuccuacaggaacugauagguuagccgagaccagguuucgugaaggacuaaguugggccuggauggaaguggccccgagauugcugguucugcugcguucuuugcuuccagucagcuaaggcgggaacacaggguuggaggggaaggaucaaaacaagaggugcugccccccccucaccauggcugguccuggucuguguacaggcacuuggcaggaguguugagugggguggcagguugccaacaggcuucucuaaacuguaucuaaggugggcuguaggagccagugagcugcauccaugggcuggcuccugggagcucacugucacaggcucuucaaacagcaugcacugggcuugucuuguuuccaugaccuccaguagacauuccuggacuucacuagcuuucaguugggcugaugggcuaacguggacauugugggacagccuuuggcagauaaauuacaaucucaguuucucccaggaucuagaggcaagauggggauccuggagagguagcuucccuaccugccucucuagcuggagucccagggucagcugggucuccaaggccugcuuuggcuaugcucugcguggcucccuaaugccauacugugcuauuuuacagauuuacuggcuccacauggucuaugcagcucugggggccaucuguuucacccugguaaguuaguucccucuucugggaggggagcugagaugguggcuuuuaggcagcuugggagguggggaggagccauggacaauuguucucuucuuauguagguguuuuacaaguuucugacaucccuguuuugcucuguucacauugcuggcuggguaacagaugugugccagucucugguagacaagugaacugcucaauggcagaaaccauguaaaaagcacacuccucccuagugacugacuccauuagugagcuauauggcuggcccagggcucucaggacaucgugcugacaggaagugaacccuggacacugagcuccuuggcacucaugucugguuucccugcaguuccuggcuuaugacacacagcugguccuggggaaccggaagcacaccaucagcccggaggacuacaucacaggcgcccuacagaucuacacagauauagucuauaucuucacguucgugcuccagcucguaggaaguagagacugagagaaagagagaugucccuuucacuggccugggacucacccuuuccuauugggcugggcccuaggucccgucuccccucaaguaaucugcucaguuuccucuccguccuggggaugggaggaccucuggcuguguucagugagagccaugaugcugggaucacuggcaccucuuagcccuuggugggcuugguaagaacuagucugaagguguaucuccuucccuuuacccaugacgaguaugcaccaaacucuguguguguguguggguggguguguguggguguguguaggggaguagggagccugugaacacaggagcucugaggggaagaggcuccccucccaccucggccacaggguucuaggcuaggagcuggagcugucucccuccuggauccaauaaagccagaugcuuugccuccagcuccagugcucauaggccacuuaugcugucugaacucuuuaggcuuggcaucucuuagcuuuagaagcuagaagagaucugugcccuggggucucucuguuccaaccccaucuuccaguaacauguaucaguuauuuaucuggcuaggggaaaaaagacagugagcagaguuucaucaguaugggggcuaaaccagaauggcauccacccugccuggcgcccagccuggcuaccauccagacccaaagugccuuggggccuucugaggcuuuuaaaaucggaccuagagggaccuccuauuuugcucugacacacagagguggauugugggauucuggguguggcugggaagcagucugggugagagauaaguggggacagggaaagcgccuugggugcccucucuggucugagaaacacugaagucuacucugguacacaaguucaaucuguucuguauucccauugggagauuucagacuaaaacccccucuucaagccagcugcugcuuucuauguaauccaagugccuccuccggcugguaccaggaugggaacagaagccgguuuaucaggugggguagaaaccuuacuagcccaaggacauaguuagagcuauucuguccaguacuugauucugaauauaucacagagggacacaacuagaaauguaauaaaguuuuauguuuggcaggaagac

SEQ ID NO: 225 - RNA, 7216 nt, Mus musculus
uagcuuucugguugccauggagacuacuagucacagacugacuagccucaauaaaaugucuuccaaaguuucccccacuggugaggaauggacuucuggucuguggguggagggagaagggguauuugucccuugcaaacccaccaaaguguggucuucgcaaauuuaacuuuuggggauggggaucagaaccagguaucccuaccuacucuacccuuuucucuagagucugacuuauuagcuuuuucuuccucuuguaguuuccaaagccaaggaccagcaucacuuaggccagcugcagcaacagcagcagcagcggcagcagcagcagccauucccagaagccaaugcugaagccaucagcuuucucaacuccuucugugagccagaugguggggcaggcguggggaggagagguacaagucucucucuccacccgauccucuugagauucagaaaagaccuguuugcuaaugaacauggagggacaagccugucggggagagcuuuaccagcuggcaccgagugaugacaaggaggagugacggggcugguuaggagaugggagacgugacaaggggugagugggugguguggggucuagaggcugggccuggagagacagcuucucugcaccacccagggcuggaggauaugcuccuguucuucccggagacucuggccauccucucagacacaggggaaccucagggagaacugaccauugaggugcagagggggaaguacaaggacgacauagggauccugacccacugucuacugguccacgccucuagccgcggcuuccuagacaaaucgcugugugggagcucccuccuagguacagcccugacugcugccugucccucacaucuucucuccacgccccacccccauuccaauccauagguccuuaauugggaccugccccuugacuuaccugggagaggguaaagccugggggaggggaagaagaggaagggggagaggagagggaggaggaggggaggucauucccagucacauacccaggacaagaacaguguugaccacccugucauuuucccauggccacguugccccagccugggccagcccguucccuagcguccauccuaugacaucagugccucccuguaccccaggcuaccuaaacaacaaucuggagcugauggaacagcacagucaggaguucaucaagguauuuacucccagccucccccagccuugccccugcuccaggguaagccagaacaugggcuuuacgagggugggagggaccucuggagaauaucacacucccauaucccaccagcccgaaccugcaccacacacgguugguuugauaaccagucaccuccauuacugcugcugauguugucuggaugcacaaaccgagcccagcccacuggccuccuccggccugaaagccugguccacuucccagagccacgugaccugaccuuucccagagccugucacuauuuagccuccaaaucuggcucuauccucuucacccagucccuucagaaacuuccucuguggggccaugcccugucuaaacaugggagaugacuugggccuaacagccuucucagagaaucuguucccagcuuccagccuguguuccguucugagguuuacagcuguucaucuuuccuauuacauacuaugggccuauuucugacuuccaccauaaauggaagaucuccuuuccucccucuccuccccuuccuuccuauuuugaggcagucucauaacuagacuggccucagacaugguguguagcugagggugauuuggaaccccugaccccccucccaagugcuggaccaccacaccaggcuaugaggaccaccacaccaggcuaugaggcuuuuuguucaucuuuuugucugcuugcccgccugccugccugucuuauuuuaucuuuuuuauuuaucaagacagggacuuuugucuuauuuuguuuauaaaaaacuaagauugacugcauuugccuauaaucccagugcuuaggaggcugaggcaggagaauuguugcaaguacaaggcuauccugagcuacauagggaguuccaggccauucugaacuauuuuuuuuucucucagaaaaacaaaccacagacaaacagcgucgaagauaggaugggagguagccucucaagggcgagcacgugauugucucuccugugugcucugcucuucaguucccuguccuucccauggagaggaagaugagcguccugaagcaggauggccaguuuguugugaccagaagugucaaggagggugagguaagagugaaagccaagugggaaccccucccacauccucagaaccacagcagggacgagcugugcgaggucaggugcuuacauaaccaacacccugcuccaacaccuccugccucuucugagcuccaagaucugccccaaacaggaaacgaagaccggagucucuguuuuccccuauaaaacauucaagggcuuugucuccagugcagccaauguggugcugcugagagugauggccuggcagcagucggugcccaguggggcucgcuuccuagccuuagacucggagggcaagcucugccauugcaccuacgugaguacugucucugggcaaaggaaucaaccuggggagaacuagaagggucaugaaggccacugaggugggaaacacagaugugaugugggagggugguaagcaagguggguugggucuagguccugagggcaaaaugaaguacacuggagcaacagcaguuagacaaacgugguaggaagaagagugagaacagagcacccgggauaagugggaacgaaaaggugggaagcaaccuucuguacauaaaggucacuacacagaaaagacucauggaagccugcuuucuaaacaccugccuucuaaggcuggagagacguucaguggggcaugaugaggcucugacuuugauccccaagcccauguaaaugcugcacacauauaaucccagaacugcagcaguaaagacagccugagugcaucaggcugccucagggcccagugagagagagagccugucucaaaaccaaggugagggcagagagaugucucagugguugcgagcacuuacugguuuugcagaagacacaagaucagcucacagcacccacauggcagcuuacaaccuucuguaacccaagucccaagagguauacaucuacaucuacaucacaucuacaucuacaucacaucuacaucuacaucuacaucuacaucuacaucacaucuaccaucacaucuacaucuacaucacaucuacaucuacaucacaucuacaucuacaucacaucuacaucuauaucacaucuacaucuauaucacaucuacauuuacaucacaucuacaucuacaucacaucuacaucuacaucacaucuaccaucacaucuacaucuacaucacaucuacaucuacaucacaucuacaucuacaucacaucuacaucacaucuacaucuacaucacaucuacaucacaucuacaucacaucuacaucuacaucacaucuacaucuacaucacaucuacaucuacaucacaucuacaucuacaucacaucuacaucuacaucacaucuacaucuccaucuacaucacaucuacaucuacaucuacacacauauauauguauacacauauauagcgcuucucggccuuuuggcuaagaucaaguguauguauacacauauauacguguauguagguaaaacauucauacacauaaagauaaaaauuucaaauaaaacaaaauaguuucugaagaacccacauacaugcaugcuaaacacccacacacaugugcaccuacgaacacauauaccaguuuguuguggcccaaacuggucuuaccccacuucucugacagaguuucacuguguagcccuguccauccuggaacucaaucuguagaccaggcuggccucgaacucacagagaacugguugccucugccucccgagugccgagauuaaagauauguaccaccagcuccugggcuuuaggcucucaacccucaugccuuaacuccccaaaugcaauuacaugugugcaccaccacacuaggcacucuugcaaaugugcauacagguuugugcagguagaggacggaggucggccucagguuuuuuuucuaaagcacuguccaccugguuuuagagacaaggucucucauuguauagcaccuccauccccauacugguccucccuguaacaaaaugugcaacuagcagugcuccuccauugagauggcuugagaagaggguggcgggagcugacuauuagagucugaaacauauccugagaauucaaacuuugugucauauaaggaacugaauagcuaagcuucaguucccaguggugagcugggaugaagacccgaggagaaggaaacaccuucaccucuaggagaaggggacacaaagggggacaucgccucacugugcucuccacuuugguugcuguagaaaucccuggguuuccagacaauccaagugggcaaccagcaggcuaaaauguucaucguggagcaaaccauacacucugaagagggcauccccuucuccugccaguacuacuugcucccugaugggugagccacuugugggaagguccaacgugaccaugucaugugguggcugggagcucugaaugugaagaaaagauguucaugggguggcauagggcacgggagucacucuuauccccaggaugcugccaggaaaagcucucagugagacccgggugcuccuuugcuuuccccaucucauuugcuuaaaaaaaaaaaaaagaagaagaagaagaagaagagagcucagguuggccucaaauucacagcccuccugccuuaguacccuaggugcugggauuacagauguguuuugggcaaggcaugaugcuugcuguuaucugggacaggccccaagaacuacaaagauaaagagagaaagcagugcucaaggggacacuguagugucuuaccucagcugccaugacaaaauaccacaagaugagucagcaaccuggggauggggagggagguucacaccugucuucccagcauuuaggaagcugacacaggaggauggcuccaggucugagggccaucuauaguaguaagauauucccucaaaagggugcacacaaguuaaaggauggcucagcuggagagguggggagggaguuugcugccaaauuggaugcccugaguucaauuccuggaacccacuuagcauaaagagagaaccaacuccuacaaguuguccucugaccuccacacaagcaugugugugaaugguguguguguguacaugcaugcacacaggaaaaaauuaauguugaaggaaaaaagaucacuggauguuuuaaacaauggccagcaggguugguuucugaugagcucucugguuguuuucagugccccaggggggagacggcucuguagacugcuuucucugcauucucuuccuguucugaggaugcuaauccuuucugacugaaaccccaccaucaugcuggucaauugaccuuagucauuucccagaaggcuuucauuacacuggggucagaagugggagccacuaccgcugcccuguccuauagaaagacucuuccccaauuucuguauugcccugcaggcaccuggcuaagagaguccaggugggcucuccaggauguuguaucaucaccaagaugccccucauaagagaggaggguaaguggcccagggcaggauggggcagugaagggaagaugggugaagcauguccucugguucgguuuggaaaggaaccagcguccuaggggugggacaggauucuugaaucagguagagaggcggcagguuuccaggcccugacucaaaggguuaggguggaccucugacgcuagucccucucagcaacucugccaguacuugaagguuccugggaucuucccguuugccaagggagggguaagcaauucccuugcucucucuacucagaugugaucgagucuccgcccacguuugauaagaagccccugguguggggggaagacuuggagcuuuacucgaaauuccuggaccggaaggugagaaguggcuguggccuggggguccaucugcuguccuacuguggaccaggagugccgaaaugcgcgaaucagggagauaauugggggaguaggaggugucccaggcgcuccuggccaaucggagcugugcucagcucuggugauggaccgcccuaugcccccgcuaggagcagcugcgccucagccacgcgaguuaucugcggcaucaccccgaggcccaagcccuagucuccgacuuccugcuguuccugcugcuccgccggccagaggacguggucacuuucgcugccgagcacuucaggcccuuugcagcgcugcgcucgccuaucccagcccugcgauccucacaccagcccagcccuuuccgcacucuggagaaugaggaagaagaggaggcgaaggaggaggaggagaaagaggaagaggaggaagaggaggaggaaauagcgggggagauagagggggaggaagaagaagaggagauagaagagggugaugacuacuuguacauggacgaggaugaagacaucgaggacuacaccuacuaugagaauuacuauuacaacuacgaugaagaaguugacaguuacgaugaugucaacaacuacgaugaugacgacauugccaauguugacgacaaugacgauauugacaauuacgaugaugacaacgacgaugacgaugaugacgacgacaacgaugacgaagaugauguugacgacaaugaugacgaugaugucgacaaaguccgagccaaagucgacaaccucagugucgacaaugaugacaacgauguugucaacagugacaacguugaugucgacaaugacaacaacaaccaggguuagacucucgaaaaagacuaggugggcggcuagaauccggagacugggccuggcuggggcugcggcuucagugggagauaagcaggguccuuucccaguucuacucugucagaagggacugcauuuggccagcucuucuugucaaaaaagggaagcuuuauuuucguuuacccagcaaguuucauguuuucuuccuagagucuauuuucauaguuauggccauuucagagaaaauaaaauuaaggccugugg

SEQ ID NO: 226 - RNA, 7652 nt, Mus musculus
uguuuccgguuccggccaagagccggagaagacauggcggcgucugcgucgacagcugcuggggaagaggacugguaacuuugggucauagguuuuggcuggcugccuggaucuggugccgggaacuagcaacagcuucggaccguccgaaccacgggcauaaaggguggaucaaggggcgagggauagaagagacauccuuucguaggcgagcuacuggaccgggaacggagggaggagggacgcugaucugagaagggacugggucuacggcggccuugccagcugggcccacgccuuaucgaccccauugcucccuacuacgggccuaccccuccccacuucucccugaugugauuuuucugggcccuggaggauggcuucucaucacaccucccgccucucggaacggacgcccuccucgugccccuaggauccugccccuuggaccaguccauuucugccuacgcguuccucaaucuucccauauuccugauagcacuaauaacuauugucagaaaagccuuacuccccucauaagcucuccuauucucucgagcauucuuaauaagaaaccaaaagccuuuaaagacuuuggguuuuggacauaagauaaaaaugugcucacuccauauuuaauuagcuugaugugaugcugaccaaaccagcuagcuccugcgagucagugucagcuauuaaaaaaaaaaaaaaguggguguggcauuaccucauagaguaguugggaagauggaucaccauggauucguaauauccauaggccugcuuuucauuaauugcugaaguauaaaaccucaagagaccaaaggacaucugucugaguuaaggccuuauacuguuaguauuaggacagccuauuucggacccccauccccaccccacccccaccuccaccuguaaccuaugaccuuauuuacauuuaggucuguaucuuacauccaaggcucaggugaccuaaggugggcaaaguacugaaggaagucuuaacugagacugcaccucuguguuccguugguuuagggagcccagccagacuagugcuuuucacuguugugagugacuucuaagauuaugaagggacaccugagccaugacagaguagcaguggcugcauuggucuauagcagccagaaugucuuuuaguaguaguaguaguaguaguaguaguaguaguaguaguaguaguaguaguaaaauaagcuuuaagaagaaugcuaauaauaaccaucacuauagaaaugauacuggggugugcuuccucuagauggagaggaaauguauaagaaaguggauacagguuucauaucaccuggguagggcuguggacaaucacucuucuuggaugucauuacagcuguuuuuucuauguuuaaaugugaacccucugauuuauaucggggccaugaacucugaucagggcuaacuaggcauccaggguuaugugcacacucaguccucagacugcccuucucgguuuccuuuuaaagggaggggguagaucaccuagacuagauacugugucucagacauuugugcacuuuauauaaacaaaucauuuaucucuuacaguagcccuagugaguaugcucuauuaucacuaggugguagacaguguaacucagguuucuaaauauaaguaaccugaccacauagcuugguaaguaguuucugcucuacuauuagcuacaaggcuuaugacucuuucuaaugcaauauagcuuuuauacuaccuagaccuguucaaccugauauguccuuugaggaugcuuagacuggcuggugcuggcaagguuauuggcaguacucagaacacagggauccaugcuaaacaguuguauagguaggcagcaguaguauugauaaccuuguuaauaaugaaugggugucauauauguaggacagagggaaacccacuaaaggauaacuuaagcuguagaaauuuaagcagggaaccaggaccuggcucugauuggucccauuccuccuggguuaagguuugguuaguuuuaacucucugagaauguguuuucucaaguuagcagugugaucucuaaaaauuuaauucccaugcuuucuaccuggccagucaacuacuugaagaaauauuuccccauguuaaaaaauaauuuggccagagaauguauucaggcagauuuuuuuuuuaagucagacuucaucaaccuuggcagcuucagcaggaagagcugcaauggugacucagucucccccuuacucuccaggguccuucccucugaaguugaaguauuagagucuaucuaucuggaugagcuacaggugaugaaagggaauggcagguacguauucagcuaggggugggcaggggucucagccgugagagaguucugcacagaaucuggacuuaggauacgaugagccuccccucacagaggugaaguuuaacuacuauuccuuuaauugccccccccacgccccccgccgccgccaccaccacagagaaacaaguccagcgugcauuccucuaccugcuuuacugucucgcccccuccuccuuagcucucaagccccugccuagucacauccuucguuuucacuucaucccccugcagaucaccaugggagaucuuuaucacucugcacccugccaccgcagagguccaagauucgcaguuugucugcuuuacucugguucuucggaucccaguccaggugauucuucuuccacacaguagcagauggaggcgaggggagagucccuagagcgggcaucacuuugauggcuguuuguugcuuuucugcaucaguauccccacgagguuccacagaucuccauccguaacccucgaggacuuucagaugagcagauccacaaguaaguaaggcuaguuggagcagggacaauucagaauucagcucugccuguggaaggaagggggucgcuuuaauauugaccucuccgguuuuuuccaggaucucacaggcccugggccauguggccaaggaaggacuaggcacugccaugcucuaugaacucauugagguaaagugugacggccugguaaaauguccuuccuuccaggcaacauuauaucuauagccaguacauuuaguguuuguuugcauaaggccucaauuagucuagaaagauaacucucauguaucuaaaaaagaauauauauauauauauauauauauauauacauacauacauacauauauauagagggggggggggagacagacagcagagacagagacagagaguuacaguugaguagcuccccuuggguuguugguucuaagcaucuugaugaaaaaguacuucuccucuuugaccuuguuguaggguuuuuguuauuuuauuuaguuaguucuuuucuuucucuuuuuguuguuuauuuauuuuuggucuuaguuaggguuucuauugcugugauaaaaacacuaugaucaaaaguaacuuagggaagaaagcauuuauuucaucuuauacuuccaaagaacaguccaugacugagggaagucagagcaguagcuggaggcaggaaccugaaggcaggaagaagccauggagggugcuacuuccugacuugcucagccugcuuucuuauagcucccaggaccaccaacucaagggauggcccacccacaauggucugagcccuccccccucagucaucaauuaagaaaaugccuuacauugugcuaggcauuugccauaggcaauggcuugccuacaggccauuuuuauggagguauuuucucagaugauucuaguuaaccaaggcugggucucacuguguggcucuggcuggccugaaagagagaacccucccaacugcugggauuaagguguguguccccaugcccugcguuuucucugcuucaauuucaguacuuuuucuuuuuucucuacugagguuccaaccuaaggcuuuacaaauauuagacaagugcucuacuacugagcuauaucuguaacauuuuuaaaauuuuguaauucugagaaugaguuacaagguggucaagcaagccugaaacuggugacguccugucccugucucccugguaguugguauuauaagccaaggcauagugguugggagguggaagcaagagaauccauaaguucagagcaccuuuagcuacacagcaaguucaaggauggcuugggcuaccucagacucuaucuuuagaaaagagaaagaaaauuguauauucuuucuaguuaaguaaacaacucacauaacacaaaggcagaguaacaaaauauauagguaacuuuucuuguuugagguuaaaaacacacaagcagccgggcagugguggcacacgccuuuaaucccagcacuugggaggcagaggcaggcggauuacugaguucgaggccagccuggucuacagagugaguuccaggacagccagggcuacacagagaaacccugucucgaagaagaaaaaaaaaaaaaaaguaaaaacacacaagcauggucacccuuauuuccuacugggguucaugaaggaaaauguucagaguaaggugaagaugggugggggcacauaccuguccugggucagaccccagugcaucuucugaaacucgauaguguuagcugugcaaaugcacguuucauagagcaacuugaugcuuuuaauuugcuguccauuuggguugucuauuugaacaaaugcauugccccaugggggaauuuucccugaagaauguuaagaaggccucugaggcccagcucaguggugagugcuaauaaggcuagcauagggaaaucugaaggaaaaggaucucuggagccugacuccugguucaaacaaaaacaaaagaggcaaacaaaaguggaaaugaggugugcuuguuuaguuuuguacuuuugagacagucucacuguguaacccaagcuggccucacacucaaagcaguccuccuaccucagcugccuggguguuggagcugaagcuaccaugucacgcgucagugacgaugagucuuggguauuuuuuuuuuuuuuuaaagauuuauuuauuuauuauauguaaguacacuguagcugucuucagacacuccagaagagggcaucagaucucauuacgggugguugugagccaccaugugguugcugggauuugaacuuuggaccuucggaagagcagucgggugcucuuacccacugagccaucucaccagccccgagucuuggguauuuuuuaucucuaagguauauuauuuuuuaucucuaaguauauuaaaugugacuuagcgagagaaguaauugacuuagauauugaaaccaggaaggccaaaugaagagguggcggagaggauccuugcaggaaaaacauuaggcuuggugacauccgucauguccagccagcuaguccuggaagaaguguguggggcgcgugcgcaguuucccgccuccguguuucagcaccucuucucuccuuccagaaagggaaggagauucucacggauaacaacauuccccauggccagugugucaucugccucuaugguuuccagguggguuucucagcugggaucugggaggaguaggagcagacggggaagggcuagggagcggacacuaacgcaggaccgugcgucugucuuccuacaggagaaggaggccuuuaccaaaacacccuguuaccacuacuuccacugccauugccuugccagguacauccagcacauggaacaagagcugacuacacaggaacaggaacaggagcgacagcacguugucaccaagcagguagacaucaccagacccacugucucuccuggucccccuagacuuucaucuccaucccuccagucugguggccuuucaucguuuuaguucgagauucuuacccuuugagauucuuaccccuguccaggaagaacggcauccauguguauagugacauauauauugcaugcagcuuugcagcauuuccacgccucuccuuaggcagcucuuuccuccuuuguucugccacauugcugagcaucagcuaacgcuugugcccuuugaccccagcccuccaaagacugggcuggcugacagggagcaggaugugauuucuccucuuguuuuagaaggcagucggugugcaguguccugugugcagggagccccuuguguaugaucuugccucgcugaaagcagccccugaaccccaacaacccaugguaagggacuuccuucugcucuaagccgggcuuucucuaaggaaagagaaauggcaucuugucucugcugaauucucuggaguuggguuugauuugcuuaagacuacucugcaaagccacagcuucccccuccccccucccccaggagccuaaggcuucagaaguccaacucugaggaacaaaaccaagaacucaauauugggaauguggcucauuugguagugcacuuggcuaacacacauaaagcccuagguuugguccccagcacugcauuaaaaaaaccugguauggugguacacucacauaaucacggcacucaggaaggauaaagcaguucaaggucaaguuugagagcauucugggcuauaugaaauucuugucuaaaacaaaacaaaaaaaccaggaaccuugugcaguucccuacgacaauguuagaaggguuaggguucagucaucugucugucuuucucacacuguuucuuuuucuccucccauuugcuuccuuuccucuaaggagcuguaccaacccagugcagagagcuugcgccaacaggaagagcucaaacugcuguaucagaggcagcaggaaaagggugguaucauugaccuugaggcugaacggaaccgauacuucauuagccuucagcaggugaggaaaggggaggguuuccccuuuagccucaaacgccuccuaugaaugccguggcccuagggugugcuucccucggcuagcaagguugcugaugguugcugauaguagagaagggugccccgugaugcaucagcucugccucucuucucuccagccuccugcugcucuugagccggagucagcuguagaugucuccagagaaccccagccaccuaaugcccuuucugcagaacaaucuacuucccuagcugaccaaucaacucugccaacuucucuacccaugacaacccaguauacguaugagaagacuucgggggcugggccaaaucaacagaggccgggugagacccagaaauccgugcuagauccuccacgacauggucguggcuccuggcgacaguaugaucggaggcacccaaaaggaggggagugcugcaccccaaaagguaccagugaaauccaugaacugccaccuccugagaagccucucaaggagacuguagacuuaaaggcagaaccccguaacaaagggcucacaggucauccucaggagaaggggccugguagcuggcagggccccucagcucgcaggacucgggacugugcucgcugggaacgcuccaaaaaccguacaccggguucuugcuauccccaccuaccucggggccagggagcauaccggucugguacucgcagggagccccugggcuuggaaucugaggaagguuccuagcaguacuguugggggacagggaauuggggugggagggaggcaauaaagagaauugaccuuugcuuaacagcaucuag

SEQ ID NO: 227 - RNA, 7428 nt, Mus musculus
cagucuaaccugccacagggcuggagagcuccuccaggcugcagucugucuccaagucccagccauaauagagucuccuucggauucgagcacuuagcuuuugguguccuggaaggaccugaaacagggccaggaguaguggagggugaagggcagggaagguuugguggaaauccuggguacugacccgggccuauacucuacccagcccagaguucccaagaucauuuguuaauggcagccuagucuuguccacagugggagaaagacaauaagcccgcuucugacaucacugagggcucccaauagaagacuagacaacuagaaaccagaugggaccccagucuaaucacuagcaguuccccucuuauaaccugaggcuuugccuucaggcccaaguggcauugcucucaacaauagcccacuccagggcauaacaaguaagagagcucccauuccgcucgggucuggaggagaacgccugggaguucugacucccagaggcagagaacaggcggaccucucaccaugaagucuuggaaaccggugagggagaaggcgccuucuucguccagcaggagcccagucagguccaucgcacugucagccgccacccugcgaagguggagggaaagggaaggaaucguaagugaccccagagccgugcucacccguuggcccaccucucccgaaagggccaccgcccgacugcgcgcagccuccucccuucucgcaggcggccgugggacgccucuuccuguuccgcgugcgacugggccucccggcgcccgacgacaggcgcggcgcucaccaggcgaaccaggagguacgagggccagcaguguucucagcccgugccgcguucgcuaggcguuuauaagcugcgggagugagugucaccgacgagucugcgcgcccggcaggaagugccuccugccuugcccaaccugagagcuccgggucuccggagcuaugagcaccgggggcaauuguaauacgguucccaggggaccgcgacacaccaagggugaacgcgcugaccaggcuuuguagucgugguacagauaguaacgagccuaacacaaaggcaacgcggcgaguuguuuccuggguuuuagggaagacgcacucaaucagcaaugcccaggaaagaugaacaagaaacuuaccguaggugggagaacugugaacaaggugggagggaaucuguugaaucuuuaugccccuuagaaguuugaaacuguaacacucgaauacauacuguauucuguaugguuacuccagcaauuaaaugaucucaaaagauauaaagccucaauguacgauguuaaacaggucuccccaaagcaaacagcgccuggauguuuuauuuccaaacacuccuuccacacaauuugcggcugagagauuuugggaagagagagggccgacgcuccaagaaggaagaaacaacuuuucgaaguuggugaagcugcuuugaagucauuaaagucacgcgcugguguuuguuuauccgcugaggggaggggacuggaggcgaagaggguugaguaauggggauggcaccgcccuucccgaucccaagcagauuguagucaagauccugggggccugaaagcccacucacugccucugggcagugccucacgcgacaaagaggucuccagccgcccuguaaacaccgggagaagaccucaggccucgcagccucaacgcccgccccggaucaccccuccagcacccuggaagcacaccuucgugggugcaggaucacgacagcggccaacgcgcacgcgcgggcgucccauccgggcuguuagggcacgucacguggcaucgcgcuucaucacgugacgcuugaccgcagguuuuuuugcucgcccgugcgugcgcccccuuccgucugacgcgcccccggcggcggccgcgcagcccuggcuccucgcgggcucgggcagcggcugcggcgcggugauggcgagcagcgguggcgguaacaccggcgcggguggcaccucggggcugggccugggccuggggcugagccucggcaugggugaggccacuggcgacgcggaggaggaggcggccgcagccgaggcagugggacguuuagcuacgucccuguggcugcggcuccgcggcugggaggcggugcuggcggccgcacagcgacugcugguuugggagaagccgcugcacagccuggucacggcggccacacucaacggccucuucugguaacggccacggaggagggggcggggccgggcugcgcgggagagcgggggcgggaggaccgggugcucccucccuuggagggcugucagcgucuggggcggugauccugcaccagguggccccauuuuuuagucucuuagugacugggugaggcuuagagggccaucuccccauccaugggucuuucugugauuuucgauggauuugggagccucaacugagaugccugucucccuaagguuguugucuucgucgucccuccggcccuucuuccugcucagcaucucacuuuugaccuauuuucuacuggaucucuggcauccucgcuuucucccugacguuucaggugaguuucuucauuccacaugcacuguaugcaccugcuccgugcaucacccugcuacuugaggggaggcacaggaaggccauuuaucuccuaaggcauccuguaugcccuuccaucguuuuuuuuuuuuuuuuuuuuuuuuuuaagaaaauugccugaaaugagaauuguuucuuuuccaaaauuaauguucuugugaguuuaguagucaaaacuauauagcauuuaaagcuggguucagaaacagcauaucguacaccuuguaguugguggguaaagggaaugcucuggacuucacauagugguucaggccuggaagcgagagacagagggauuacugaaaaauugagaccaagaauguuaaagagaggcagcucuuucugacuuuggaucugucucuaagugcuucuuguauucuuaacuuaccccacacccuuuucuccauagcaccacccccugaagaaccacacucugacaggugaguauaggccaccuuuuaaagaagaugcccaaauguggucugcuugcugugcucagcucaaagaggagcagggcuguggcuugugcaggcauaggcccaguguaaugaagggacuuacagcaagcaaaaguaugccuggcucuaggcuucuuuguaugcaaacgcuguguuccuucucccguggagguagaggguugaguacccugggaauuuacaucccaggaugaggaugccuuccuuugggggagguggggccuccagagugagaucucaucagcagucucaaagugacuugagugucuuagcugguuucugaggccuccaggggucaugucaugucuccccagugagggugcggggucaggcgcccagccgcaccugcugagugugcccgaguugugcagauaccuggcugagagcuggcucaccuuccagauucaccugcaagagcuguugcaguacaagaggcagaauccagcucagguaaaccccauccugaaaugguugcaggagucgggcugggagagagugacgcgugcagugacuguuguaaauuuccucaacugguucccauuuuuuuccaccacaugaauaguuucuccccuggugacugugcacaugguguaagccuguguucuucacugcuccugugcucuucccugcaguucugcgcucggggcugcgcugccugugcugugcuggcuguguugggacacuauguuccgggaguuaugauuuccuacauugucugugaguggagcucauuccugcucuuuccaaagcccugucuagucuucuuuuccuggguugacccaaaggaaagacuguguuuucuuuguuaguuacucaccugggaggaggauagcagaugggggaagaggguaucacugccuugagaaaggaucccgucuuuguucagaccuaccuguucaggggacaguuuggaugaaggcuccugagaaaguggccaacugagcucugagugcacuuucuuaacccguagugcugaguauccugcuguggccccugguggucuaucacgaguugauccagaggauguauacucgccuggagcccuugcucaugcagcuggacuacagcaugaaagcugaagcugaugcccugcaccacaaacaugacaagagaaguaagggauucucuuaaccuggauggggagaggcagggagaaccuguaguguauggcucaugguguguccuggaauugaaaucauuucuacuuccuuagccauauuugucaccaccguuaucuccgcucauuauugccugauugcccuucucuagagcgccaagggaagagugcacccccagcaggagaugagccacuggcggaaacagagagugaaagcgaggcagaguuggcuggcuucucuccaguggugagguccagggaagaugggaugucaaauagaaggccgaagggaaguuggguauuguggugcacacauguaauccuauuugagaggaggaagcagaaggaucaagaauucaaaaucagccugguuuuuguuaugagcuugacaucagccuggaccacauaagaccuccuauguccaaaaaaaaaaaaaaugaaaaaggcaaaggggucaagaaugugucugcuuuagaguuagagcuaccaguucucaaguaguugggaaccagaaggcuuggggguaaagugugcuuaucccaguauguuggauucauccugguucucuugcagguggaugugaagaaaacagcccuggccuuggcuauuacagacucugagcugucagaugaggaggccucuaucuuagagagcggcgguuucucuguaucucgggccaccacuccacaacugacagauguuucugaagguaugagcagucuuuugccucucuuuuaucuuccugcuccccaauacuggguuguugacagcuguguucucugaguuccaaaaaugcuuccugaguuccuguauucucuaauucuacccuaagcacccaagaaccuuaguuccauccucuugcuuugcuuuguaguauuuuuagaucuuuuuauuuuauguguaugaguauuuggccugcauaauguguguacaccauaugcaugccuggugccugcagaagucagacgagggcaucugauccccuggaacuggaguugcgguugguugugagccaccauauaggugcugggaauugaaccuggguccucugcaggagcagcaagugcucuuaaccacuaagccaucucuucagcucugcuuugcuuuuugagaaaggcucuuagucuaggcuugcuucgaacucucuuuguagcagaagaugaccagaacuccuggucccuccucccuacaccuuccaaaugcugggauuacaauagauaugugccacagggccuggccucccaaguuauguacaugaacuuacugacuuuuguggccaguuagagaaaagagcucauucuuaacccucuauucucugcacagauuuggaccagcagagccugccaagugagccagaagaggcucugaaccgagagcugggggagggggaagagacagagcuggccucuccugaagaccugcuaagugcgccuccagcccucucaaagcaagcuuuggacaccgaagaggagggggcugcagacaaggaagccuugcuucagcucucauccccucuucacuuugugaauacgcacuucaauggggcaggguccccccaagauggagugaaaugcccuccuggugcaccagugaagacccugagcccagaggcagugaguggugaccuaauggcuccauccagcacccucucaccccaacuuugccuugcugaaagugguccaguuaccccccucucucccucugugcucccaucccuuccccaggacucaccucaaccccuggcugcuccugaggaggaagaggcacucacaacugaggacuuugaguugcuggaucagggggagcuggagcaacugaaugcagagcugggcuugggaccagagaugccuccaaagcccccugauguucugccuccuccuccccugggggcagacagccauucccugguacagucagaccaagaggcucaugcagagguugagccaugagccauggcagaaugagcugcaggcauacuagggcuuccuaacuaggcaugucacauuuucuccucucccugucacucuggggagaggcacuauguggaaaagcuggcugucagauggaagccagcccacucugccugccugccugccugccugccugcuguccugggaccugguauaguaccugugccuaggauugguuuuaugucuguaaauacuuuuccaucugaguuaguggaugugaugaaggcuaggggcauccuuccguagccugcaguugcuucccugccucaucccuugucauucuacuguguccuaagcccugguggucgaccuuuucuuuuucuuccuauccucagggaccugugcugcuccacccucgugucccacuugguuguuuaguugaggcacuuuauaauuuucucuacugucccacacucccguuggcuuuauuucccugcugucuccuguccuuugcagcgugacccccacucuuugccaacuccuccuucccacaggcacuggccaagcuuuagggcagguucucuucugagggaacuggguggugucaggccagcagugcugugcuugggucacugucgccuugaaccuacacuguacccuuguccagcucagcacucaugaugcaggacagcaggguccccuagcacuuugccagcacugaggauggcauguucucuucucuuuuggaggcgagggacuucccuucuguauuaggggagaagaacagaaccuacucgucuggaccacaguugagacucccugcuaggguguaaaguggauaguaagaucuguguagguguuaacuggaaaaauaaacuguugauuggcuagaacugcugccugucugccugcuugucucccugugagccaccucccauacugcacucuguccccuccucacccagcacugccucucuuggcuauuuuccuuguaaacagccagaggcagggauuauccugacaacccuaccugcuucucggucauacaaagugagauuuagcaugugugaauacauuacaugcaggaggaaauugcccugucuucccagucagugggacauggagucaugauaaccgugccuuuaauacuguuucuguaagucauguaucuacaugcucacaacucaaucuuaauugucuguaguaggacaacuaaccagcagugguuauauaaguugguuaaauauuuauauaaacugguuaaaggccaagagacuaguauccaagauuuuuuaaaagu

SEQ ID NO: 228 - RNA, 2989 nt, Mus musculus
uacaucuuacugauugccagucuuuacucuucccggcccucucccugucugcuacauguggcagccccagggaaaagggaguaacaugaugaaaaaggcuguagggauugagucugguuagcaccuaccaaggccccaaccagagagcacuucccggccacccucuucugcagcagcagagcuagcuuagcugcaugaguguccuuccucuccgggcuccauggagcguccuccacgucacuccugcuuggcacugcuguccaggcuucucugugcuuccuuucccuguggacccuggagaugugagggucacaguccuugggugagccucucuccccaagcccagggcccuagcacaggcugcaguuggacggcuucaagcuacgacucugcgccuggagcaaggagaggagaaggaggagauggugugaugucaaagaccagaggggacaggcuuccuuucagggcucagggugagcuggagucacuggaaggaagcaaagggacgauccccaccccacagcaauacuacccacagcugggcaggaccaacacaggacccagcccacacaguccucuuaccugcugcuguugguauucugccucacuggcugacagugccugugcuaacgccaagucgucuuccuccugagaacuggaaaggaagagcuuaucaugguacugaguacuuuagagugugaccuccaucuuuacuuucuauagucaacaugguauuuaucagaauuacugccauugguauggccuuuggggauauaugguucaucuaauuuugaaaucaaauuuuuagcuauuguggguugguguggucccaccuucauccuuccaaacagaucuuguucucauucagaguagguaccuuagaaccugggguuuagccuccgcaagggacaguuccagggcacgcugcagggccucauccucacucugcaaaaggagacagaaagaccagucucccuggacuuuagucuguguagaauuacuucagucuauccaaccuuuccccaacucaccaagccauucugcaaagcaauaacaggagaggcuguccugguuggaagcugggguguagcucuauggaagacauuaaaacaggcuguggucagaagugugaagggguuaaaauggggagaggagaaauggguaggccuaccugcuuggggaggaugaugaaggcaagguccggcuuggacugggggcggugcuuguagaagccagaccuugugcucuagaaauagcagcaagccugaagggaagaaaagaaaaccauucuaauaaaucuuccagcacaggcuuugggugucaggaggguagucaguaauuucagcuaccuggaaaguucagacugaaaaacugaaaauuguacagggcacagugaguucaaugacagccggggcaacuuuguggacucuugucuccaaggaauaaagggagcuggaaguaauguaugcuguaauuucagcacuggagggucugaggcaggaggacugccacaaguuugaagccagccugggcuaagaagugaaaccucucaaaacaacaaaagggccaaggcaguaccucaggggcagagugcuugcuugccuaguuucaguccacagcacugcaagcaaaauggagcaaaaagcauaaagacugccuuggucaaggaagacauggcugaagcaaagcaaguuggcuauuuggugguaauuacccugcccugcuggucugaugaccuuccccagagcauucaugguccaggggaugacggugcuugaugcagaaguuucggccacagcgaucacaagucaguuucaucaucucccgcugccggcagccagaacguucacacuuauuggugaagaucugagaugaaacaggguuuguuauuuaggaaacucaucuucuccucuggcccccauggagcuagccuuuuggguuugcagauguccguauacuacgcuggguugucucacuaaccccuccauuauuuauuuaccuugcguuuuugcugugcugggucagaacgacagucucugucaaugugcucucccacagcacggucaggaggcucuccucuggccaccggcacaggcacauuacagagagggcacacagguaccuggauauccuauagucaagggucaggagucaguaugagagccaagcaaucucuuaaagaacccggauauaccacucacaaauacacaaaaaacaaaguuacccagugcugggcuuagaaacacaauaacuaagaggggaaaacauaaaauagacagauccugaaagcaucugcacccgcucuccucuccauacaccaaccccugccacccucacgaucgcccccucaccuuuugguaagcugauccacagugaugcugggcguaggccacauggucugcgcagaagaugcccgagcaggcaucgcacuugaguggcaaaaaaucuacagagaaugggucagauugcggguucaaaggaaacuuagauguccuuuccucuugcgcaaagcugcuacucagguaggaaaaacucugcccuauuugcaacacacuguaccucuuucacaguacacgaucaauuuggccacgccccuagucuccgcccacaacuucgagccccgcccuccuggccuuuccagcuccagugcucacccuccuggcccuaccugcaguccccagccccagccguccggccccgccucccgcgugcuccgccccucacccaagcgcugacagcucggcucggaacagugagccccgagguccggaaacuccaucgccuggccgugcggggccugcugcggggaagaaacgagagcugagcgugccaaggacucccgcuccgggccccguccgcaacacagcaacuccggggggcuccccgccccgccccuuccucucccccgcccagcacagguuaccgaagccugagcguccgccggcccgcagccccuacuccuccucccgagggcucgcgcgcucugacg

SEQ ID NO: 229 - RNA, 11780 nt, Mus musculus
ccagaucaaagucccuucuuuauuaaggguuaucaagcuguacagggcucccacccugucugcuguggccugcgacaguagaguccgccaccuucagcuuaaguuuaccucccacagcugagcugagcagaacuggggaagggagugcaggaaggguaggagcuggaucccagcaugcaaugucgaagcccuaggcuagggugaguccauuaucccuccauucuccucuugguaagugagggauacugggcagagcugggauguauauauaacugaggucacacuucugcccugccagccccucugugcaggugguaggacuacauagaagcagccaggaaggccucacacucccaagugcucguccuaaaaguugaagaggguaauaaagaauuuucauccuguuccugcaacuuaguaaccuuccaucuuagugucaaaagauagugaggggagcugggagcuagggcucucaccccaacaaaaagccaaagccaaacagaaggggggcaggugaacagaaggggggguggucaagcagcacacaugccagugaugugcaggggggagggaggcugcagcgcagguugaggugaggacuggagguaagggccacagccugagcugcucagcuauuccagguucuggaggguggggaggcuaggcugcagggauugaggguucaggcccugccuccccacuccacaguuggcacagguucuucugcuuggcagcacuucuguggcaggaagcccucuggagacuugcagggguggaugcaaagauggcaguacugggacugggcuggggaccaguuucuagcaccacacucugagccaagggaguccuggagacgaagcuagacucuugugugccccuaguccucauauucuuccuggacuaugguaagcccagcauuggcaccucccuuggccaggcaggaacacacaaaacaccacacguggggccaggcgacacucagagagucccucucauggcagacagaagggauggcagggcagcugccaccuccauccuggagcaugggaaccagcuaccgccuugccuauaccuguggaggaaaggaaagaccgguaguacagauagucuucagcuaucgucuugccccagaggaaucuagaaauaaaggaaagaaaacgcuggaagcuagggaaguuaagucuugaacuucagagcaguaaaaagaagaaaguggguuuuuugcuuuucaaaaauguauuugugcaugaguguuuugucugcaucgaagucugaaucagccggcugugguggcucacgccuuuaaucccagcccucaguaggcagaagcagguggauuucugaguucaaggccagccuggucuacaaagugaguuccaggacagccagggcuacacagagaaacacugucuagauaaaccaaaaaaaaaaaaaaaaaaaaaaaaaagucugaaucaugugugugugcaguacuuuugaagaccagaagauggcaucugacccccuggggcugggguuacagacgguggugagccacugugugggugcuggaaaacgaaccuggguccucuggaagagcccccaguguucuuaggcacugagccaucccuccagccgucuggagaguagacaagagcauggaggagugggagacacgcuccuucacaggaggagcuggucuucacuggaagucaccacuucuggcagugguucuuggccucacagccuuuaccuugugcacuugaggggggaguucauccucugagcccuccucuggcaccggcucugggugccuugaugcuggcuggccaucuucugcccauccucccaggggcagccuggagaagugagaggggccacggggcacugugccaggaucuacagagagaaacaagaacacaaggcacagugggaagguucugaggaccacuuggaggcuuagucuccuugcaccccauccugauggucucuugcgucuuagagagaaccguccuuccccgaaaccuguuugcuacuguguucccagcuggauaccugugaugcccccguagcgccucuggaagcccccaugcagggcgguggucucaggugcuccaggccgggguguagcacagggauagcuggccgagcgggggauggguuggggggcccgggcacccucuccccccucuucaggggcacucucuccacucucaucacucucccggcggugccacacaugccgcucgggcucagccugggucugcugcuuguggagcuggagaaguggggggcugauuagucgggggcagaaggaugucugucugaaacagcugcgaccacugaagcaucuucaauucccacucacaaacccucaccuaggaaccuagacucacugcaucucagauguuaguaguguacauuagcugugugcugcucuauggaucucauucucaggagaccccuggaaaagcuuccgaguagcucaggcugacccugaacucaauggguaguugagaaugaccuugaauuucugaucugacuucaucuccccugggauuacagauguuuagguaguucugggaauggaccccaggguccuguacauacagggcaagcagucuacuaagugaccuacaucucuggcccucauuuuacccacuccuugaaucaaagaacaaguuaacagagggucucggugccggguauuauuuuagguacucagaacacagcaaugaacaaauagaauugccagucuuugugaggcuuuuacacuagugguggugguuguaaggaaaaauagaccauaaacuauuaaaugaagacaaagccccaaaaugucagauagcaccagaugcuauggauaaaaacagaacaagaaaagucaguaggcagcugugugugacacugaaacaugagguagcaggacugaggccagccuggcuuacauagucaagagucagacucuguuuuaaaaagccaagguggguggggaagaaagggagggagaaaggagaggagaagggaaaggaagggaagggucaaggucugaggcagggcuggaucuggaggcacaugccugcaaccccagcuguuuggaagugggaucacauguucaaacccagccuggcuacacaguaaguucaaggucagccuagguaacuaagugaaaauaguucucagaauaauaagcaaaggaaggcuguggagauaacuuagggcuuaccuaacaugcccaaggccuuaucugcucaauccucaguacuggaaaaaaauaaauucaggagaguggagacaggagauuuuacugagucuuggagagagcaggaggaggagaaaaaaguagggaacaugggaguacucuuggcuaaagaugccacuaagaggacauaugugacggcccgguaaggugaugugugucuuuaauuccagcacucagggggcagaggcagguggaucucuguaaguucaaggccagccuggucuacagagugaguuccagaaauagccagggcuacacagagaagcccugucuuaaccccagcuccugaguaaaggaguucuguggaaccacagaggcagagaagggcugacacccgccccucggcugcacucaccuggugcauguacagggcgugcaggcucaucucgguggacgcguauucggacagcaccaggcucugcagcuguccuucccacacgcuacucccagagcuggcuguccuggcauccacucugucccucccagcacagacagacagcaggcaucaacauuugcaagaucuagaccagguuuugugggcuccugccacgcccucccacgcugacccacguccacucacucacucacccagagccugucaugguacugggaacccggccuugaggggccgcuccaggcugcagaggggagaaggaucgaagggcagaagcaacaucagcccugugccuggagcccugcaggucucuggacagugaggguccucggcaggaugagccugcuaccacauuugcaauaaggcucaguggcuguaggaggaaaaaaugggguaagcagaagucucagggcaggggaggccucuagguccuccaauguccugacccucaggacccaaccgcucagacugaagggaggaaaccuggcacccugugucccaugccguuccccacacugcaguccacugcccaccaucccccaggccccagagccacaccucggacucagacuguaaggacuggauggaugugaagagggcauucucggggagcaggccacccugggccaggccagcagcugcuccaucucgcugcaccugcuccuugaggaagcccaggaaagcugugcucucacgagggggcugccagccgggauuggugauggcaaagugcaugagcgacaacucggucuucccguccucggcuugcugguacacugaggccucugucugcccuccagacagccacuaugcaagggagaugacagggaucaggcccgagcacucacagcagcccuuccggcaggacagugauagcagggcauugucauaucugucaaagcccugaugcccaccccaggaguggccacauacugggucagucacuugaacuguacuuuuuucucaaaggagugugacugaugguucaaaucagggcuggaauccagucagauuccuggugacuaaacagugucucuggugcagggaugcccacaaguggggcuacccuuuuuguguuuguuggcuuggaaagggcagcuuuuugcaguuuucccaagguuacugugugccagcauugucccuggccaucugcccugcccucucccaguaccugaggauggccaugcuggcgaacguccaucugagcaaaggagcaggugucucccacacccacgaccucgaccguaaaguugcggaagaagucuaugaucuccagggcccgagggcggaggcagaagaugagaaugaggggugugacgaugggacucagcaacuccuccaagaugaacaccuaagagggagggggccgagguuacccgcaagcaggacacagcccagcccguaucaccaagauaccagccagucucuagcaggcccuaacuccagcuccacucacugccuuguacuggaagagcugggcaaacucgucccgggucugcgagcggugggcauuacccugccaguggucaggcauguaguggaugugugcaagaaucacucggagcagcugcucggggcagaacaccaugugcuggucugggaugaaggaccuagugggauugggcgcauggugagacagaaagaagccuuucccagaaugccacucugcuauucccacccgccgcccuggcacaccugcacacagucaccgugacucccaggagggugaccguggugaggacguguuccacagcuaacacaucuucaucauagauggugagggcaauaagcacagccaggauagagccagcgaagaaggcaccauucuuggccagcagagucagcagcggugacaagaagcaauucauguacuuggaggcgggcuuguagccucgguugaggcgggacugcagcucaugcuccagcucauugaaguggcggagguaacaacggccauagagugaccagcaacgcgcucccagggcccccggcucucucuucagcaccucggcauagcugaagaaggcauagaggaucugccagaugaggaugaggggacacagcaggaaguuggcgaugccaauccacaagaugcgguugcugagacgcugggccagcucuagccguugcccuccacguuuguacucggccuugaggcuccacucauugagaaacagagagccggguccccagaagaggaugagcucaaaguuguacuugaggccacgggugaagaagacaaccucuccgaggccgggcagacggaagcgcagaggcaggagggauuuguucaccagggccaccauguaguucuggaaacguaggaugcgaugguagauguccaacucugucagcucacgcuuguggaugcagaucugaugcucuuucugcgucugcacaauccgggccugaacuuccugccaugugcaguauggaagggcagacugccaggauaggguggacaagagacaaguauaggagauguauaaaguauagcuaaacccuuuguucaacacagauguaggacuuugccuacacagauauaagucguaugcuuaaagauacuuccugcgggcagugauggcgcacgccuuuaaucccaucacuugggaggcaaaugcaggcagauuucugaguuugaggccaggcuacagagugaguuccaggacagccagggcuacacugagaaacccugucucaaaaaaaaaaaaaaaauuaauaauagcaaagauauuuccugaccugcuguuccaguucagaucugggaugcagcucaaaagcccauguguuaagggcuugguccuuugccaauaaggggcugcucuuagaugagauuaauuggggcuuuggaucccaccccuuccugccuuccuccacuuccugguggccaugaagugaacagacuuccuuuguuguaugcucuuacugugauguacuuccucaccacaggccccuaagcaaccagaucaaccaauauuaucaaccaauuauaggcuuggaucuccaaaacugugaaaauccuuucucuuuaaauaugcugaucaucucagauuuuuuuuuuugcauauuaacagaacucugacuaucauaccugccaaugagagcuauagacaugugaugcucaggaauacauaucauccuucuaggauugcuugggcuguguugcuaaugguucaacuucuggucuuaccauugggauccgaagagcauguagguagaaggaguggaucucccaauagcagcaaauguuauagauaaacuugauaagccgguggauccagaagacaccagcaaugaccaggauggugauaagagagccauuuuccugaauccugguauggaaaaaggagauaaaguagggucccugaggauggagucuuagcaacacguucuagaguauggauugcugcuucauaccccacucuccucucuccucaggaccauccuuaccuggcacuacagacuugggcaggcaaaaaggcaucuggcagagugaccuugacaggcucaguaggauggagacugugguucaccaucuuguuggcaaagaggaugucauaguccacacagcuaaccaggaagguggugaaggcaaccacaaagaggaacugccuggggagguggaaagaagggaugcaggccaugagucagagaggcgcuggugaaaucaaguggggugagcaaagaggcuggagacagcugaacaagauaggaaauuaaaggggcuggaguguucuuaauagccucugcuaccacuucaucuaauaagaccuuaagggcauagauugcuccugcguuuuuucucuuagguucaggugcugcagaagcagccugccucagcaugauaagcugccacaacuugauuuucagagguuugaugauuauggccucuggucucugacuggggauccaccucaugucaacaggauagacacagugccuuuuucugagccaucucaauggccccaacuuuuuuuguuuguuugguuguuuuuuuguuuuguuuuguuuuguuuuuguuuuuuucgagacaggguuucucuguauaccccuggcuguccuggaccucacucuauagaccaggcuggucucaaacucagaaauccgccugccucugccucacaagugcuaggauuaaaggcgugugucaugaccgccccagcaauggccccaacuuuuagcaaucuuuuguuuguuuguuuggcuuuguuuuuuccagacagggcuucucuguguaccuucuggcuguccuggaauucucugggucuggccuugaacucacagagaucuacuugccugugccuccuagugcugggauuaaaggucugcaccagcaggcccagucauaaauucuuuucuuaucaccaagaacucuuuuccugcugggugugggggcucaugccuuuaauucuagcacuaaugcagguggaugucuuugaguuugugguuauccugauuuacaaagguaguucuaggacagccaggguuacauggagaaacucuugucucaaaaacccaaaaguaaaaacaaacaaaacuaugaacaacaaacaaauaaccuucccuuuccaaguccaccccucuagcaacaccagauuauuucucccacuccagcagggcuaaugugcagucaggcagaauacaggcuccaagaccuccugacugaaccauauauaucuaucuuccuauagucuuggugaaaugacuaaguuguaaacucuuguuaugaaagagauagggcgcugggcguggugguauacaccuuuaaucccagcacucaaucccaggcagaggaagguggaucucugaguucaaggccagccugguguacagagugaguuccaggacagccagggcuacacagagaaacccugucucaaaaaaccaaaagagauaagaccuagguaguucuuacaagaggcaaggcuauagguuuaaauguuauaccugggccugagacauaaaggucugcagaguuuagggccuaggauuguguugccuuggcaggugcaaaaagaaagaccagaaggauucuuuuaccacagcaugaaucccuucguauacuuacaugaguucaaacaucucuccaaugagcauacaugugaagccauucuucugguggagauuauaaacguguaaguguuaagaaaaaguggccgguaagcaaaagacaccuaagaauacagacuuugauguccucacacucccaagcugaaguccuggcucuagaacucuccggagugugaucuuuaacaggucacuucccuaagcuuugcccacaguggcaaacugauaauagccauugcuaccucuuaggguuauugggucuaggagcaugcauucaaaguauucagcacugaaaugacagagucgaaaggcauuauuaccauuaacaacuuacacccuuagaaaagcucuucauaaaguaacacaaguacauagagcucucagcuaauaugagguaucacuacuuuuagcaaucguuauuucaauaugaguuucauuucccuuuccauggaccggaguggaacgcaucccuguuucccaucagagaccucccucgcucagagacaggcuaaaagguggaagagcuccaaagcagagacacaaaggauauucgagagaagaagaggucaagguuuucaauguggugccaaggugcuguggacacaggagcagagaugucagcucccugaaguggcuauucuccccccccagccuccccccuccgcuugcccugcucacucaggguuccuccagcaacuuccgcccaugccccugcucuagcugucaugucccaaaacucacauuugcuccccucggccacaugcaccaacagguccucuuccccggggggcgaaucgcuauaggaggccucuaggcgcugguauucagugucaaacugugccaucaccacagcccccuguccaccuuguuaaccugccagugaagagaacccggaucagauccaggcacugucuccuugcuguccugcccaccaggccagagggaaugagaaagggauuuguuuuuucccacuagcauccuugacucagaagcaguacagggauaauauagcccaagaagcacagcuaagcuugggacuuaagggggccuucacccugguccugaaucccagaaccuuuugcuggcuuagcuacuaugccagaaucugccccucugguauggggugaguuguuucauuuucuguccaaugaagagaaaguuuccuccccugccccuccuggaaacccuggucucucuagagacuaacaguuugaaagcauguuuuuguaaacaaagguuuaagauaagcacaugguccuaccagcuccauggacaguuucugcuacacgucaguccugggugcccugguuggacagcugcuggaggaaaaggugucaggcuucaaagaauggagaguugggacagaaaaaaauccaacccucccaccgguccaagcccccacuaaggagggcagagagauggggaagagacacuuugccaguugugucagauguccccuguuguucuauguagaaccauucaucuacuuugaggauaccagggaguaacuaaacucucugacccagugcagagugagucaguacagguccgaauccaaacagcccuuugggacuguuuuaccucuggucuaccucaacuuuagaaaucagacaugcuuuucgggguccagaaaaccccgaaugggagucuucucaagauuuuucuggacaaucccuucugcuucccuagcaucagagacguaggcaggcauggcuuuuggaucagaauuuuccaguccauguagacuccggaucccgcuugaauaaguggguucccugggugccuagugccagguggggucaaggugguaugguauacucccaaucaguaaagacucuggggaugguggaucuugguccgaccuggucccagagggagucccuugguuaauaauaagaggugugugccucuggaaacacacucaccuggucaguguagacccagggcccauggaucuccccaggaagggccugugcccaggggugucuguggaugguggaggggucgagccagaucuacagcugaaaucccuggugggcugggaugccuccccaaucccagccaccuagaccugagcacagggcgccccagggucgcccggccccaggccgggggcuaggcucccaacagcggacaacccggcgcgcggccccggcgcacgcgcgcuccccuggccgcgcgcgcccucuaucaaaacauucuagcugcgcgcccccggcccgcccgccgcuccccugcccccguuacgcauuacaagcucacuuggggcucagugggcaucccuggccagcuugggccugggucuggagauuccaguuaccagccucgcgugucaccgcaggaaccgggauccaggggauuccagaagccgggucuguucugcugggcucugccagacccggagcucuaggcccuccgucugucauucacugucacccgcagccagucuggccaaugaaaaaaguggguggagacaugguggccaauucuuagcccagggggcaggacggaaggcugaaggcgggucuuggagagcagaagaccaauagugugcucuacgugaugaggggcugggcuacgggcgcggcaguguguccccuucgccucuccguagccgccgaauuguugugguguugcagaaauccaguuuucgaacguggucuugcguguggcucggcucucgggacauuaggggaggcuucugagggagggucgagugacgaggcuuggugucggugcuaguaguuccguuggguagacucugacugguaacuccuggacucgaauugggucuuggugcucuccauuucacuccugaagauccucacguauuuaccgcagaacugauuugugggagcggguaaaggcugaagggcauuucugcguggggauggccaaaccggcuggcgaugcggcaguaggaucucguucuggagaguuguuucugcccuccguuucuucuucagccacgucgccagcuccaagugcagccucagccccugccuccguuucccuguugucccucaacgggggaagcuccacucauucggggccugagccuggugagccaagcuccug

SEQ ID NO: 230 - RNA, 11780 nt, Mus musculus
caggagcuuggcucaccaggcucaggccccgaaugaguggagcuucccccguugagggacaacagggaaacggaggcaggggcugaggcugcacuuggagcuggcgacguggcugaagaagaaacggagggcagaaacaacucuccagaacgagauccuacugccgcaucgccagccgguuuggccauccccacgcagaaaugcccuucagccuuuacccgcucccacaaaucaguucugcgguaaauacgugaggaucuucaggagugaaauggagagcaccaagacccaauucgaguccaggaguuaccagucagagucuacccaacggaacuacuagcaccgacaccaagccucgucacucgacccucccucagaagccuccccuaaugucccgagagccgagccacacgcaagaccacguucgaaaacuggauuucugcaacaccacaacaauucggcggcuacggagaggcgaaggggacacacugccgcgcccguagcccagccccucaucacguagagcacacuauuggucuucugcucuccaagacccgccuucagccuuccguccugcccccugggcuaagaauuggccaccaugucuccacccacuuuuuucauuggccagacuggcugcgggugacagugaaugacagacggagggccuagagcuccgggucuggcagagcccagcagaacagacccggcuucuggaauccccuggaucccgguuccugcggugacacgcgaggcugguaacuggaaucuccagacccaggcccaagcuggccagggaugcccacugagccccaagugagcuuguaaugcguaacgggggcaggggagcggcgggcgggccgggggcgcgcagcuagaauguuuugauagagggcgcgcgcggccaggggagcgcgcgugcgccggggccgcgcgccggguuguccgcuguugggagccuagcccccggccuggggccgggcgacccuggggcgcccugugcucaggucuagguggcugggauuggggaggcaucccagcccaccagggauuucagcuguagaucuggcucgaccccuccaccauccacagacaccccugggcacaggcccuuccuggggagauccaugggcccugggucuacacugaccaggugaguguguuuccagaggcacacaccucuuauuauuaaccaagggacucccucugggaccaggucggaccaagauccaccauccccagagucuuuacugauugggaguauaccauaccaccuugaccccaccuggcacuaggcacccagggaacccacuuauucaagcgggauccggagucuacauggacuggaaaauucugauccaaaagccaugccugccuacgucucugaugcuagggaagcagaagggauuguccagaaaaaucuugagaagacucccauucgggguuuucuggaccccgaaaagcaugucugauuucuaaaguugagguagaccagagguaaaacagucccaaagggcuguuuggauucggaccuguacugacucacucugcacugggucagagaguuuaguuacucccugguauccucaaaguagaugaaugguucuacauagaacaacaggggacaucugacacaacuggcaaagugucucuuccccaucucucugcccuccuuagugggggcuuggaccggugggaggguuggauuuuuuucugucccaacucuccauucuuugaagccugacaccuuuuccuccagcagcuguccaaccagggcacccaggacugacguguagcagaaacuguccauggagcugguaggaccaugugcuuaucuuaaaccuuuguuuacaaaaacaugcuuucaaacuguuagucucuagagagaccaggguuuccaggaggggcaggggaggaaacuuucucuucauuggacagaaaaugaaacaacucaccccauaccagaggggcagauucuggcauaguagcuaagccagcaaaagguucugggauucaggaccagggugaaggcccccuuaagucccaagcuuagcugugcuucuugggcuauauuaucccuguacugcuucugagucaaggaugcuagugggaaaaaacaaaucccuuucucauucccucuggccuggugggcaggacagcaaggagacagugccuggaucugauccggguucucuucacuggcagguuaacaagguggacagggggcuguggugauggcacaguuugacacugaauaccagcgccuagaggccuccuauagcgauucgccccccggggaagaggaccuguuggugcauguggccgaggggagcaaaugugaguuuugggacaugacagcuagagcaggggcaugggcggaaguugcuggaggaacccugagugagcagggcaagcggaggggggaggcuggggggggagaauagccacuucagggagcugacaucucugcuccuguguccacagcaccuuggcaccacauugaaaaccuugaccucuucuucucucgaauauccuuugugucucugcuuuggagcucuuccaccuuuuagccugucucugagcgagggaggucucugaugggaaacagggaugcguuccacuccgguccauggaaagggaaaugaaacucauauugaaauaacgauugcuaaaaguagugauaccucauauuagcugagagcucuauguacuuguguuacuuuaugaagagcuuuucuaaggguguaaguuguuaaugguaauaaugccuuucgacucugucauuucagugcugaauacuuugaaugcaugcuccuagacccaauaacccuaagagguagcaauggcuauuaucaguuugccacugugggcaaagcuuagggaagugaccuguuaaagaucacacuccggagaguucuagagccaggacuucagcuugggagugugaggacaucaaagucuguauucuuaggugucuuuugcuuaccggccacuuuuucuuaacacuuacacguuuauaaucuccaccagaagaauggcuucacauguaugcucauuggagagauguuugaacucauguaaguauacgaagggauucaugcugugguaaaagaauccuucuggucuuucuuuuugcaccugccaaggcaacacaauccuaggcccuaaacucugcagaccuuuaugucucaggcccagguauaacauuuaaaccuauagccuugccucuuguaagaacuaccuaggucuuaucucuuuugguuuuuugagacaggguuucucuguguagcccuggcuguccuggaacucacucuguacaccaggcuggccuugaacucagagauccaccuuccucugccugggauugagugcugggauuaaagguguauaccaccacgcccagcgcccuaucucuuucauaacaagaguuuacaacuuagucauuucaccaagacuauaggaagauagauauauaugguucagucaggaggucuuggagccuguauucugccugacugcacauuagcccugcuggagugggagaaauaaucugguguugcuagagggguggacuuggaaagggaagguuauuuguuuguuguucauaguuuuguuuguuuuuacuuuuggguuuuugagacaagaguuucuccauguaacccuggcuguccuagaacuaccuuuguaaaucaggauaaccacaaacucaaagacauccaccugcauuagugcuagaauuaaaggcaugagcccccacacccagcaggaaaagaguucuuggugauaagaaaagaauuuaugacugggccugcuggugcagaccuuuaaucccagcacuaggaggcacaggcaaguagaucucugugaguucaaggccagacccagagaauuccaggacagccagaagguacacagagaagcccugucuggaaaaaacaaagccaaacaaacaaacaaaagauugcuaaaaguuggggccauugcuggggcggucaugacacacgccuuuaauccuagcacuugugaggcagaggcaggcggauuucugaguuugagaccagccuggucuauagagugagguccaggacagccagggguauacagagaaacccugucucgaaaaaaacaaaaacaaaacaaaacaaaacaaaaaaacaaccaaacaaacaaaaaaaguuggggccauugagauggcucagaaaaaggcacugugucuauccuguugacaugagguggauccccagucagagaccagaggccauaaucaucaaaccucugaaaaucaaguuguggcagcuuaucaugcugaggcaggcugcuucugcagcaccugaaccuaagagaaaaaacgcaggagcaaucuaugcccuuaaggucuuauuagaugaagugguagcagaggcuauuaagaacacuccagccccuuuaauuuccuaucuuguucagcugucuccagccucuuugcucaccccacuugauuucaccagcgccucucugacucauggccugcaucccuucuuuccaccuccccaggcaguuccucuuugugguugccuucaccaccuuccugguuagcuguguggacuaugacauccucuuugccaacaagauggugaaccacagucuccauccuacugagccugucaaggucacucugccagaugccuuuuugccugcccaagucuguagugccagguaaggaugguccugaggagagaggagagugggguaugaagcagcaauccauacucuagaacguguugcuaagacuccauccucagggacccuacuuuaucuccuuuuuccauaccaggauucaggaaaauggcucucuuaucaccauccuggucauugcuggugucuucuggauccaccggcuuaucaaguuuaucuauaacauuugcugcuauugggagauccacuccuucuaccuacaugcucuucggaucccaaugguaagaccagaaguugaaccauuagcaacacagcccaagcaauccuagaaggaugauauguauuccugagcaucacaugucuauagcucucauuggcagguaugauagucagaguucuguuaauaugcaaaaaaaaaaaucugagaugaucagcauauuuaaagagaaaggauuuucacaguuuuggagauccaagccuauaauugguugauaauauugguugaucugguugcuuaggggccuguggugaggaaguacaucacaguaagagcauacaacaaaggaagucuguucacuucauggccaccaggaaguggaggaaggcaggaaggggugggauccaaagccccaauuaaucucaucuaagagcagccccuuauuggcaaaggaccaagcccuuaacacaugggcuuuugagcugcaucccagaucugaacuggaacagcaggucaggaaauaucuuugcuauuauuaauuuuuuuuuuuuuuuugagacaggguuucucaguguagcccuggcuguccuggaacucacucuguagccuggccucaaacucagaaaucugccugcauuugccucccaagugaugggauuaaaggcgugcgccaucacugcccgcaggaaguaucuuuaagcauacgacuuauaucuguguaggcaaaguccuacaucuguguugaacaaaggguuuagcuauacuuuauacaucuccuauacuugucucuuguccacccuauccuggcagucugcccuuccauacugcacauggcaggaaguucaggcccggauugugcagacgcagaaagagcaucagaucugcauccacaagcgugagcugacagaguuggacaucuaccaucgcauccuacguuuccagaacuacaugguggcccuggugaacaaaucccuccugccucugcgcuuccgucugcccggccucggagagguugucuucuucacccguggccucaaguacaacuuugagcucauccucuucuggggacccggcucucuguuucucaaugaguggagccucaaggccgaguacaaacguggagggcaacggcuagagcuggcccagcgucucagcaaccgcaucuuguggauuggcaucgccaacuuccugcuguguccccucauccucaucuggcagauccucuaugccuucuucagcuaugccgaggugcugaagagagagccgggggcccugggagcgcguugcuggucacucuauggccguuguuaccuccgccacuucaaugagcuggagcaugagcugcagucccgccucaaccgaggcuacaagcccgccuccaaguacaugaauugcuucuugucaccgcugcugacucugcuggccaagaauggugccuucuucgcuggcucuauccuggcugugcuuauugcccucaccaucuaugaugaagauguguuagcuguggaacacguccucaccacggucacccuccugggagucacggugacugugugcaggugugccagggcggcgggugggaauagcagaguggcauucugggaaaggcuucuuucugucucaccaugcgcccaaucccacuagguccuucaucccagaccagcacaugguguucugccccgagcagcugcuccgagugauucuugcacacauccacuacaugccugaccacuggcaggguaaugcccaccgcucgcagacccgggacgaguuugcccagcucuuccaguacaaggcagugaguggagcuggaguuagggccugcuagagacuggcugguaucuuggugauacgggcugggcuguguccugcuugcggguaaccucggcccccucccucuuagguguucaucuuggaggaguugcugagucccaucgucacaccccucauucucaucuucugccuccgcccucgggcccuggagaucauagacuucuuccgcaacuuuacggucgaggucgugggugugggagacaccugcuccuuugcucagauggacguucgccagcauggccauccucagguacugggagagggcagggcagauggccagggacaaugcuggcacacaguaaccuugggaaaacugcaaaaagcugcccuuuccaagccaacaaacacaaaaaggguagccccacuugugggcaucccugcaccagagacacuguuuagucaccaggaaucugacuggauuccagcccugauuugaaccaucagucacacuccuuugagaaaaaaguacaguucaagugacugacccaguauguggccacuccuggggugggcaucagggcuuugacagauaugacaaugcccugcuaucacuguccugccggaagggcugcugugagugcucgggccugaucccugucaucucccuugcauaguggcugucuggagggcagacagaggccucaguguaccagcaagccgaggacgggaagaccgaguugucgcucaugcacuuugccaucaccaaucccggcuggcagcccccucgugagagcacagcuuuccugggcuuccucaaggagcaggugcagcgagauggagcagcugcuggccuggcccaggguggccugcuccccgagaaugcccucuucacauccauccaguccuuacagucugaguccgagguguggcucuggggccugggggauggugggcaguggacugcaguguggggaacggcaugggacacagggugccagguuuccucccuucagucugagcgguuggguccugagggucaggacauuggaggaccuagaggccuccccugcccugagacuucugcuuaccccauuuuuuccuccuacagccacugagccuuauugcaaaugugguagcaggcucauccugccgaggacccucacuguccagagaccugcagggcuccaggcacagggcugauguugcuucugcccuucgauccuucuccccucugcagccuggagcggccccucaaggccggguucccaguaccaugacaggcucugggugagugagugaguggacgugggucagcgugggagggcguggcaggagcccacaaaaccuggucuagaucuugcaaauguugaugccugcugucugucugugcugggagggacagaguggaugccaggacagccagcucugggaguagcgugugggaaggacagcugcagagccuggugcuguccgaauacgcguccaccgagaugagccugcacgcccuguacaugcaccaggugagugcagccgaggggcgggugucagcccuucucugccucugugguuccacagaacuccuuuacucaggagcugggguuaagacagggcuucucuguguagcccuggcuauuucuggaacucacucuguagaccaggcuggccuugaacuuacagagauccaccugccucugcccccugagugcuggaauuaaagacacacaucaccuuaccgggccgucacauauguccucuuaguggcaucuuuagccaagaguacucccauguucccuacuuuuuucuccuccuccugcucucuccaagacucaguaaaaucuccugucuccacucuccugaauuuauuuuuuuccaguacugaggauugagcagauaaggccuugggcauguuagguaagcccuaaguuaucuccacagccuuccuuugcuuauuauucugagaacuauuuucacuuaguuaccuaggcugaccuugaacuuacuguguagccaggcuggguuugaacaugugaucccacuuccaaacagcugggguugcaggcaugugccuccagauccagcccugccucagaccuugacccuucccuuccuuucccuucuccucuccuuucucccucccuuucuuccccacccaccuuggcuuuuuaaaacagagucugacucuugacuauguaagccaggcuggccucaguccugcuaccucauguuucagugucacacacagcugccuacugacuuuucuuguucuguuuuuauccauagcaucuggugcuaucugacauuuuggggcuuugucuucauuuaauaguuuauggucuauuuuuccuuacaaccaccaccacuaguguaaaagccucacaaagacuggcaauucuauuuguucauugcuguguucugaguaccuaaaauaauacccggcaccgagacccucuguuaacuuguucuuugauucaaggaguggguaaaaugagggccagagauguaggucacuuaguagacugcuugcccuguauguacaggacccugggguccauucccagaacuaccuaaacaucuguaaucccaggggagaugaagucagaucagaaauucaaggucauucucaacuacccauugaguucagggucagccugagcuacucggaagcuuuuccaggggucuccugagaaugagauccauagagcagcacacagcuaauguacacuacuaacaucugagaugcagugagucuagguuccuaggugaggguuugugagugggaauugaagaugcuucaguggucgcagcuguuucagacagacauccuucugcccccgacuaaucagccccccacuucuccagcuccacaagcagcagacccaggcugagcccgagcggcauguguggcaccgccgggagagugaugagaguggagagagugccccugaagaggggggagagggugcccgggccccccaacccaucccccgcucggccagcuaucccugugcuacaccccggccuggagcaccugagaccaccgcccugcaugggggcuuccagaggcgcuacgggggcaucacagguauccagcugggaacacaguagcaaacagguuucggggaaggacgguucucucuaagacgcaagagaccaucaggauggggugcaaggagacuaagccuccaagugguccucagaaccuucccacugugccuuguguucuuguuucucucuguagauccuggcacagugccccguggccccucucacuucuccaggcugccccugggaggaugggcagaagauggccagccagcaucaaggcacccagagccggugccagaggagggcucagaggaugaacuccccccucaagugcacaagguaaaggcugugaggccaagaaccacugccagaaguggugacuuccagugaagaccagcuccuccugugaaggagcgugucucccacuccuccaugcucuugucuacucuccagacggcuggagggauggcucagugccuaagaacacugggggcucuuccagaggacccagguucguuuuccagcacccacacaguggcucaccaccgucuguaaccccagccccagggggucagaugccaucuucuggucuucaaaaguacugcacacacacaugauucagacuuuuuuuuuuuuuuuuuuuuuuuuuugguuuaucuagacaguguuucucuguguagcccuggcuguccuggaacucacuuuguagaccaggcuggccuugaacucagaaauccaccugcuucugccuacugagggcugggauuaaaggcgugagccaccacagccggcugauucagacuucgaugcagacaaaacacucaugcacaaauacauuuuugaaaagcaaaaaacccacuuucuucuuuuuacugcucugaaguucaagacuuaacuucccuagcuuccagcguuuucuuuccuuuauuucuagauuccucuggggcaagacgauagcugaagacuaucuguacuaccggucuuuccuuuccuccacagguauaggcaaggcgguagcugguucccaugcuccaggauggagguggcagcugcccugccaucccuucugucugccaugagagggacucucugagugucgccuggccccacgugugguguuuuguguguuccugccuggccaagggaggugccaaugcugggcuuaccauaguccaggaagaauaugaggacuaggggcacacaagagucuagcuucgucuccaggacucccuuggcucagaguguggugcuagaaacugguccccagcccagucccaguacugccaucuuugcauccaccccugcaagucuccagagggcuuccugccacagaagugcugccaagcagaagaaccugugccaacuguggaguggggaggcagggccugaacccucaaucccugcagccuagccuccccacccuccagaaccuggaauagcugagcagcucaggcuguggcccuuaccuccaguccucaccucaaccugcgcugcagccucccuccccccugcacaucacuggcaugugugcugcuugaccacccccccuucuguucaccugccccccuucuguuuggcuuuggcuuuuuguuggggugagagcccuagcucccagcuccccucacuaucuuuugacacuaagauggaagguuacuaaguugcaggaacaggaugaaaauucuuuauuacccucuucaacuuuuaggacgagcacuugggagugugaggccuuccuggcugcuucuauguaguccuaccaccugcacagaggggcuggcagggcagaagugugaccucaguuauauauacaucccagcucugcccaguaucccucacuuaccaagaggagaauggagggauaauggacucacccuagccuagggcuucgacauugcaugcugggauccagcuccuacccuuccugcacucccuuccccaguucugcucagcucagcugugggagguaaacuuaagcugaagguggcggacucuacugucgcaggccacagcagacagggugggagcccuguacagcuugauaacccuuaauaaagaagggacuuugaucugg

SEQ ID NO: 231 - RNA, 5350 nt, Mus musculus
uucugccuuucguucacacauuuaacugucuauugacaagcugauccacacagcccuagcuucgauguggggagaguggggugugcaccuggcacaccucgaguauguccaagguuugggaaugagcauccguguccuagugcuugaaaagaauuugcaaugugcaugucccaugccccaaccaccucucagcacugcaguccuuuuccaccguccgcccuaagcuccgugucuggcucccggcagaauugagucugcagagauugacugcuguacuggcaggcuauggaguagagcugcgucaguugaccccggagcaguuuucuacccucuugacccugcugcaguugcugcccaagggcacaggaagaaaucuuggugaguguccagucagggaggccagcagcucgcaucuccacggagguuauuguagaggagaguuuggggguuuucuucuucuugauauggggucuugcuguagucuaggaugcucugaaaacccauguuccugccucuaccuccagaguuuaggauacaggcaugguccagcagccuggcuggaaagagaguucuuuugaggacagggagcaagaggguaagcaggggaggugaagcauuagaccaggaaagggacuagagagugggaagcucauggaggcggugggugagugggagccugggcagaggggguggcaucuggguuguuaauaggacagaggucacacagauagaacagguucaagagugcugguccuuuuggccuugacuauugcuuuuuguguuucuacagaaggggcuguaaauguuggaggagccgaugucaagaaagugaguuccuagcaccuagcugccacacacacauauacacacauacacacacauacauacacauacacacacacauacacacacacauacauacacauacacacauacauacacacacacacauacacauacauacacacacauacauacacacauacauacacauacacacauacauacacacaaauacauacacacacacacacacacacauacacacacauacaaacacauacacacauacacacacauacacacacauacauacacauacacacauacauacacacacauacauauacacacauacauacacauacacacacacacacacacacacacacacacacaccuuugcuuugagaucauggcucggaaucuauccucuggucccucacuuuaaggccuagagacuucaaauaaucaccugcggccucacuuaaagucaacagcacuagaagccagaaucuuuaauccgcuccucuuuugaccacaauccauucagagucccauguuuccuacaguggggucuuugguggagguuccauccugcuguagcuagauaagcuuugucucuguguuuuagguguaggcuucuaacuauugccacagaacaaaagccuaaaaaccgcugccuuucuguuuaucuuucccaauuauugggcucagcuccccaucaccaccccaccccacagaauggaagccccauucugugguuuacagaccauauuucacucacuaaaccuuauacucccacauucauacauucgauucacacuccauggaugcgcucucuguuagccauugugugggcuuuggggguuaaaaaguuaaaccguuccuaaacuccacuguaaagaguuuagagcccaaagugugaccgccccuccuccccagcccuuccacucuagaagucacgccugcauccugucuuauaacagacaauacaacagaugcagagaggagacccagcagaagcucugccccccacacccucgcuuccuggguaccucacugccagcccugccuccagcgaaguucagcaggugcugagcccugguuucccugaaccuccccacacacccagcccucugggcuccuccucaguccuucuggagaagaaaagucccuugggccagagccagcccacaguggugggacggccaucagcucgaccaucggccgaggaguauggcuauaucgucacugaccagaagugagugcugcauccuggggaagcccuccagucccuaugggauuggguuagccugucuggcaagaagcaaagagcaagaauccagugcuauuuaaaaaaaaaaaaaaaagguugggaggaguggggcuggagagauggcucagcgguuaagggcacugacugcucuuccgaagguccugaguucaaaucucagcaaccacauggugacucacaacccuccguaauaagaucugaugcccucuccuggugugucuaaagacagcuacaauguacuuagauagaauaauaaauaaaucuuuaaaaaaaaaaaaagagguagaggggggagggguaguucuacacgucuugagguggccugucucaaaagagugccugagagucaccacuucccucucugccugcuccccuccugcagaccccugagccugguggcuggagugaggcugcuggagauucuggcugagcacgugcauauguccuccgguagcuuuaucaacaucaggugggguugccauuguggugggacagcguggggugggggugggggcgucuagccugagugaggugggaagacagcucuggggucagagaccccccccccaacuugucaaagcaggggagccacacguaggccugcugcuagccucauccugaaucugccugucauuagacacacucgugggaaucccugaucugccuugccggccucuuuauuuagaaucuggagucuccgguggguaagggaguaacauauuuccuauuuggcaguguggugggaccagcugucaccuuccgaauccggcacaaugagcagaaccugucuuuggcagaugugacccagcaagcugguaaauagcacccugucuucgaauccaggcuccgcaugaccccagccuugauuccugugcugauccuucccuaaacuauuuccagcccacauagggcugaaaagagccuggcuugcacccuuccugcagggcuggugaagucugaacuggaagcgcagacagggcuccagauuuugcagacaggggugggacagguaagcacuaacuguagaaucugucaaagcccucguaggucugacucugcacacaagagaggaggcaagaacaggaacuuaaaggguugaaaguucacuaggcucaccagccuucuuuccccaugcagcccgucucuguguaguucucauuuugaccaacagauggcgcaguggcgcuuuccugaaggaccauucuuaaagcuauaucauccuuuucaugacaucuuuuuuucuguuucuauggaaauccuucuggugggaucacccaaagucucuagcucuugaauugguccauuguggauuuggaaggaagcuguaugcccuucugccuguuaccuucauaccccugccugucacagcuuugucccuagagguggccuaaguaggagucaaggcccagucuccccgcaaccaucccucugauucugguuuuguucccacagagggaggaagcagcugaaguccuuccccgacaagcccauggcauaucucccaugcgcucagugcugcuuacucuaguggcccuggcaggcgucgcugggcugcuaguggcuuuggcaguggccuuguguaugcgccaucauucgagacagcgggauaaggagcgccuggcagcgcuggggccggagggggcccauggugacacuacuuuugaguaccaggugugaaacuauagaagcucauggagggaaggaccuacaaggggcucgagugacccagucuuguguggaguaaggaugugggcagaaugagagguccugucuggguaaaggauggaaagguccuggaagggguguugggacauacuuuuuagaugaauaugggcugggaauaguuggcucuggagaugccucccaggaauaugauucugggauucuacuuugugguaucugagguugucauaugcaccaaggcagaaaagaaugagggcgaaagacagaucuuacucaucccguugaucagagacaaagccuaaggcauuguuuguuuggagagcugggaacugaacuccgcacauugggcaagcgcuaagccugcaggaccacuaagcuccagccuguggcuuagaaaccuuguagagggauucuaaggacccccacccucacccaauccuuccucugcaggaccugugucgccagcacauggccacaaagucccuguuuaaccgggcggagggucagccagagccuucuagggugagcaguguguccucccaguucagcgacgcggcccaggccagccccaguucccacagcagcacaccaucuuggugcgaggagcccgcccaggccaacauggacaucuccacaggacacaugauucuggucaggaaagggcccaggccuaaaguggggagggaacagcauagcaggagaggcaggacgggcaguguggcccagagccgggcuguggugcccccuacaggcauacauggaggaucaccuucggaaccgggaccgguuggccaaggaguggcaggcucugugcgccuaccaagcagagccaaacaccugugccgccgcacaggaugagagcaacaucaagaagaaccgccauccugacuuccuacccuguaagcgagucgugggccaacuuggccccacacucugcuaggagcaguucgaggcugggggugggagguggaggguggggaguaggggauggggaggaguggggcuccugguucgggcuggguggcagaguccuggggccagaaggucauuugugaguucugugcagaugaccaugcccgaaucaagcugaaaguggagagcagcccuucucggagugauuacaucaacgccagccccaucgugagcagcuccgauucccacacugauucugcccaucagcacugcuccucuuuauuccaucccccguagucaucucuuacuccagccaagcccugaaacuguagagcccauguccucgaacuuaggcaucucagccucccccacacccuggcccacucuugaccaagccucacuccaagcuggcccuucucauucuggcucaugacauauccucucugcccuuagaucgagcaugacccucggaugccggccuacauagccacacagggaccacugucccacaccaucgcggacuucuggcaggugcacgcuuggagagggguuuuccugaggccccugaagccugccagagccagggaacguagagggccgcuuaccuggaucucuguccuuagauggugugggagaguggcugcacugucaucguuaugcugaccccguugguggagg

SEQ ID NO: 232 - RNA, 10097 nt, Mus musculus
cggcuucgaggccgcugacaaaggaaagggcggaggggggggggucaacgccuggaggacucgacuugauggaggcggggcgagagaggcaucaggggcggggccugccaaggaagcccggacagcggagacaaggucuggagaguaggcgugacggggcggagcuaguggcgcaaugagggcgggucaugagacguggcuccuaacggggcaaagcuaguggaacaguggggcggggcgcggugugacuggagcugacuaguccacgugguuagaacgcagccugauuggaggaaggcgggucggugaggcgggagcggaaccggaacgcguccugacaggggcggagcucucggaguagugagggcgggacgcggccugacuggcacagagcagucagcguguuuggaaccaggccugacgggagcugagcgaguagcgggagggggcggaacccgaccgaggccugacaggggcggagcucgcggagcagcgggggcggggcgaggccugguagaggcggagucccggugcggccugacgagaggcggagcccacagcucggcgaaggcgaggccugauccgggagggaggagcggagcgucaggggcgggccggaguccggcuccuggagcggagugcgguggggcuaugcagguguguugcuguugccggucccgccuccacuucggcucgguggcaggccgcgcgcccuuucggagcuaagcuuaaggcggcgcugacacgggcguacuccgguuucaaaguaaaacugaaacccuccgagguggccugaccuucccggagccggaagggcugucuagugacugacggggcuaagggacagguguaguggugcuuugauuccggacacgguggcgcgccggcuaguggccuuuccagcuuugagguccucuuggaggcgggauuuccuagcugggcggggcguggauuaucugauuagggggcgggccuuuccgauccuguacuccagggacaaaacuggguggagguccucuugcccugggacugaaccuuugagccgagagcgaucgagcuaggaauccacaucugucgccagugaaguccucggaagcagagguugagccuuggggcucucauuucuagggggcugaaagagggauccuagacccggcagccaccugaacucuccacuucucccuguagauggcuaugaacggcagggcucggaaagaggccauccaggccacagcccgagagcuccugaaguucgugaaccggagucccucuccuuuccacgguaggugaccaggguuagggaggcuaggagugggagugacuugaccaacuuccaucgcugagagagcccuuuuccuacagucguggcugagugccgcagccgccuccuccaggcuggcuuccgugaacucaaggaaacagagggcugggauaucguaccagaaaacaagguacuaagggauagcgugggggcagacacuauugcaaaggccugugucccggaucauaaagcaacucacgccccugucuuucaacucucucccccaguacuucuuaaccagaaacuccuccuccaucauugcuuuugcuguggggggccaguauguuccuggcaauggcuucagccucauuggggcccacacggacagucccugucucaggguaagaaguuaggacuuguuuggacugaagggaggugugggggggggcgguugggaagaagagauccuggagguagaguuugcaaggcccuaucccaaggucccgggaagaagguagacccgccccaugcucucauguuccccacauacacuuucagcugucaacugaugugcuaucugcucuguauaacuuacugccugagucucccuuccagauguugucuuucagacauucccuuuuuucucauucuuacgcucaggugaaacgcaaaucgcgccgaagccaggugggcuaccaccaggucgguguugagaccuacggcggugggaucuggagcacaugguucgaccgggaccugaccuuggcuggacgcgucauuaucaaggugguaucgaggggcuaggaacuggggaggcucucacuuccggcagccugaagcuugaaugucuucccauuucuuaaguguaccagugaagaguccucguggggaagaggggacaugauuauucuggguuuaguaagggauuuuaucagcuggauuugggaggugcccaguucugaccuggccgguuggccacagugcccuaccucaggccggcuggagcagaggcucguccauauagaacggcccauccugcgcaucccacaucuggccauccaucugcagcgaaauaucaaugagaacuuugggcccaacacagagauccaccugugaguccacauucgagccaggguugugauggcugugagggugggauauggcacuggggaacagaggaccaccccuuaguggucaaguuccacguuuggaaaccaguucuauccauuuggggagugcgcugggaaucagucggaggacuagaaguucauggcugucccucucccuucucucaacccauuuccccacagagucccuauucuugccacagcaguucaggaagagcuggagaaagggacuccugaaccagggccucucggugccacuguaagaagcuccccuggcccggagagggugggcagaggggagcagaccaguccccuagaggggcaaaggaugagcagguccaccuuccaacauccccugccuuacaggaugagcggcaccacucgguccucaugucccugcucuguacccaucugggccugaguccugacagcaucauggagauggagcucugccuggcagacacccagccugcaguaaggaguggcuguaggcccucguggugggguccuccagggucccugucagccauagcauauccccgaagcuccucaguuagucucauccuuguucuucccaguugguggcacuuccucugcuuucaguaguucccagauaagcagagcaucuccccagaagaccguccuacugagacugggggugaugugugacauggccccugucugcucugaaccucugagggcaagaggccuggugccuuccaagugcuaaguagggagcugcuagucuuuggcuccuugguccuauguuuguguuagcuguuuucuuccuuuuagucggcauuguuuuguuuuuauuagacaggguuucucuguguagcccuggcuaugcuggaacuauguagaccaggcuggccuccaacuuagagguccgccugccucugccacccaagugcugggauuaaaggugugccccaccaucgcuggcugcuuuucuuuuuuuuggugacugaccacuuagcccuccuuuggccugccccucugagacaagucagaugcuguaggaugcccuuuccuggccuucauucucugcugaacagcaagaauaguuuccugagccaacagucaagaguugcucuggcccuugggaacagggagaaguggugagggcccgggcacuuagguguuccuccugucuuucuagguccuggguggagccuaugaagaguucaucuucgcuccucgacuggacaaucugcacagcugcuucugugcccugcaggugagaagccagagcagcccaggcagcacgagagcuggggagacauggcugcuuagccaggccuucacccuguuggcacugggaagggcccaugcacuguagccuugacaucacuauuacugugcugcucugggaccaggagcugacaguguucagggugccauggugucuuuuacuuuuccuuaaugaccucugucugaaaacaggccuugccaccaugaaaaacaauucucacuuucuucugcuucucucauucugccucugacuuaaagcuccuccuuguccccugccagccuucuuugggauccuugggaccucaguagggcugucuguaccucuuggucaccuucauguucuucacugucucucucccccagucaggcuguuucucagcuuucuacccuuugccccuccucugcuuucuaaccugccuuucccugccugucugugacuggagauaggcuuugggugguaacuguagcuccggggccugugucugcuucugagccagccagcuggguuguucauggacaugucuagagcuguuaacagaagcccaucaguuugacugaucuucauaaucauuggccucccaggacuuauaguuucagucugucuucaacauuauccuccugccuucugcaugggaguguaugagagcaaaugcucagagaauggauuuacuuaucccacuagaaagguccuacuccaccugccaggcaggacccuaagagaaagguugcgagagcccagcccacuucccuggcagggcagcaugucccucccagguccuggcagacaaaguuguaagaagcaaaggucagggauaaugagccugucuccuccccaucuaggcauugauugauuccugugcauccccugccucucuggccagggauccacaugugcgcauggucacacucuacgacaaugaagagguauguggagggcuggggcagaggucccucaguggaguagucaguaacugccugguggcccacacucagagcgagccagggcauucuagaggccccaaagagggaggaaggagagcugccagugcucccauagcacuuguucccuccuggcccugcauagauuuuuauaauggauuccauagccuguauucuauguguaccuugcugcauuccuaccccaaggauggggccacuacacaggucauccuuucaggucuguggcuuggcacauagcggguugucagcuauguuguuuagcuguaaucuugagaugcuauaguggagcuugacagguagauguucucuuucauguaacucccugggucagcuagugguuuggauaggucucuggucuauuaugcuaguuggcuauuccaucucuggcuaucaugucuauacccagucagcaguaaaggagagggcagagagaauagaugccuuugucuucaagaguguggucuggaaauggaauucauuauugcucacauucacagaacccaguguggccacauucaguuacaaaggaaacugggaaugcugucucuagcuggguaguuaguuauauagcuuuaacaccugccuagcccuggguguaaaugugggggaccaguguggaaaccuccaucaguaaaugcuauuucuaguccaugaaugacugggaauuagucuggcccuagucuacugucauauguucagaaaggagagucucuaaggauacuucucucuaccaagugacucagguggaucccgggccauccugaacacuuuuacaguccaggcgcauguccagauucccacagucaaaucucugccaucuccagguggggucagagagugcacaaggagcacagucccugcugacggagcugauacuacggcgcaucucagccucaccucagcgucugacugccuucgaggaagccauaccuaaguccuucaugaucagugcagacauggcccaugcugugcacccaaacuacucgugagucuucauaccagacaguacuuaugcuagagacgcggcauagcccacuugcaggcuaguuccugggccugccuuucuccaucugcugggagguucaggagucuuccauuugauuauuccaaggccagacuuaugcaaagccauguguugccuaagccggguguauauauuaaguaagcuuugucugugaccuugcuuccuuucauggcuagaaucugccugaaucguuuguucugaugcccuugaggacacgcagggcuaggugggaaagagugccaugauccauuagugccaucugccuuggaagggguaguggcuguugacagcccccaccacagugugccauccugaucuuuaucaccucucacagggacaagcaugaagaaaaccaccggccuuuguuccauaagguaagaugcugcuucucaaagauguggcggccuggccgacucuggccucugugguucacacaggccucacaucaucucuguucugggacuuuugccaggguccugugaucaaggugaacagcaagcagcgcuacgccucuaaugcagugucugaguccaugauucgagagguggcuggccaaguuggggugccccugcaggugagugugcaucuuuucuaggaaggcuugguggagggagcagaauaaagacauaaacugaugagcucccaguaagugaggagcauaggagagagacuuuaguggagggagucccagugaaugagaagaucugggguuuggggugcagagcuagaugcagugcuggcuuuguuguggugacuuuggccuaguuugcuaagcugucuugaguuuuugugugcccauugguaaagugagggugauaaugagcccuacccugcugaucucuguaaggauuacuccugccaccugguagguuaguccugccccuuuuccuucuauaaccccaugucucugugucuuucuuuacuuuuacuucaacccagaaggaagauucaggacuggugagccuagaaccccaaguguucauuuucccucuggccugagaucacccaucacuguccuuagggcacuacaugaguacacacacuccacaucagagacuuggcccaggccaguccaucgauggacaacacccaaguucugggagaggcaggaccagacaagggccgucucugcaucagugucuccaucuugucccauguaaugucugaucauuccacucacagagaggucucugggaggaagugagaggcagcugcugagaaacaaauaccauggggagguccagagggcgaacaucucagccagagggaacaaacagaaagauccccagggggaaaaggaaugaguuagucuaguagcagaagagaaggcccaaguugagagcaagagggacaggagaagagacucaccuagaccaguuugcuucugaagcucuucuggugcugggccgggccucaacuucuuugcaugaccccuucaguccugaaccuucaacugccacugaggcugcaccuucaccagucaccuucaccaguggccucucagugccucuuaguuccaagccucagcugcucuccacgaccccuucaugccuucacaaccaguaccaccugggugacucuuacacauuaucaaguccgccugcagcacaaaguacaaccuuggccaccucugaaacauagcuucccugugcucucagaaaacacuucccagaagauuucaccucagggauggucucuuccuaaucacuacuaauuucuuagcuccagcugaccagcaucaguuguccuuguaauguaaaaguuucacuaucagucccagcaaaccagaaccacagaaucuuaaaauagcagauggcccugauagagucuacucuucccucugaaguuucauaagccaggccuccaucuucugcacucucucaacauucuuaucuuccaagcuccuacagaacuucccacugaggucuuaacacucacuggcucuucuagcccaaaguuccaaaguccuuccacaauuauccccaaaacauggucaggucugucacaacgauaccuugcuuagucaggguuucuauugcugcaacaaaacaccaugaccaaaaagcaagcugggcaggaaaagguuaauucagcuuacacugaaggaaggcaggacagggacucaagcgggacuggaaccggaaggcaagaacugacauagagaccauggaaggguguugcuuacugaccugcuucacguggcuugcucagccugcuuuccuacagaacucugaaccaccaggccaggauggcaccacccacaauggucugggcccuuccccauugaucacuaagagaaaaugccuuacagcuggaucucauggaggcauuuccucaacugaggcuccuuucucucugaugacuguagcugugaugacugacagacaaaccagccaguacaauggguuaauacuguaauucucaccugacaaaaguuugacuuuuauauuucuguuuuacacuuacagaucuuaaaaucuagcuccauauuaggacuuccuugguguuuuguuuugagauagggucuuauguagcuucaaacucaguaugaagcagaauauagccuuaagcuccugauuccuccaucuccaagucuugggauuacaaaugugcaccaccauugcccagguggggaucaaacccagggcuucauuuauacuaggcaagcccucaaccaagugaacuauacccccagcccagcaggaacuuuuagaacauuaaaacuacuaaguuuguuuuccuuuguguauugggguuucacguugugugugagaguaacaaagagguagaagacauugaacuagaugcucugccagcccugaggcucuaggguagcuuccuccuugaucuuagugagcgcaucuaggguuuagcuuaugaccucuccuccucucaccaggaccucauggucaggaaugacuccccgugugguaccaccauuggaccuaucuuggcuucucgacuggggcuucgggugcuggacuuaggcagcccccaacuggcuaugcacucuauccgggagacagccuguaccacuggaguucuccagacccucacccuuuucaagguaacucccaccuggcccucugcuccaccaguaaguggcuagucacugcggggggcugauugcuguggacuacaaaauagaaaacggccccugugucagcuuccaucacugacacaugugagguaagcaguucauaagaagucagcguuucggaggcuuuagucuguggccagcuggcuguugacuugaggccagugauaaagcaggauaucauggcgagagcuugugcuagaggaaucugcugccgggagaggcgacagggaagagggaguuguggggaagaggagggagaaaauggguucaguguccaucacagguaugcuucaucccgggugaccugacuucuucccuucagaccccaacagugccuaccaagccuuuaacaccggccauaccauuccucguuuucaaggccucagaggaaagugguuggcuggagagggccgagggaugaggagucaggccagugcaugaggcauagaagccucggugcuucuguuacuagacuuggaggagauggaaggugcgugguggggcacugccgucugcucacucacuaauuccugguucccucugccucgcauuuuagggcuucuuugagcuguucccuucuguaagccggaaccucuuaguggacugaggccucucgccaagaguugucuuccaccccuucaauugagaggggaggaucucaguuucgcugauguugguuauuaaaguagauuuucacuccagcucucugugcuuuuucugaagcggcagggugagccuggccugacccucuggaaccagaccagaggugaaggucaggugcagguaaaagguugucccucccugcaucgcaccugaaccagaagccccuguucacaagggacuugacaccacuugucauuuuauuagauuuauuuuauguguaugaguguuuugcccgcuuguauguauguaugugccuggugccaauagagaucagaagacauugguuccuuuggaacuguaguuaugagucaccaugugaaugcugggaacugagcccugguccucugcaagaauaacaaaugaauaacacuaagccaccccuccagcccagcgugaguggcaguucauugugauuuugaucucccagacuuucaggaggccagacagauggcucagugguaagaacacuggcugcucuugcagaagaugcaaguucaaguucccagcaccuacaagguggcucauaaccuucuaaguccaguugcaggggauccagugccccucugcuggccuccauggacacugcauguacacccaugucaugcacaaacauacaugcagcaaaacacucauacacauaaaaaucuaaaaaaaagaugguucaacaaaaccauuguguguaugcuguauaaacagauuuauuaacca

SEQ ID NO: 233 - RNA, 6805 nt, Mus musculus
agugcaaagacaagacuuuuuacuugggugaaaaacagcucggcacucuuaagagaaugucaagccacccucuauccauaagcaguuccaauggaauuuagucucaauuaaaauaccagagggagccagggccggugugcugccuguaauccuaacaggggcucaagagguugggaccagaagacuucagguucaaagccagccucugcuuccuaaugaggcccuguauaagaaacaaaacaaaacaaauacaaacaacaacacccaagaacaaacagaaggaaaauuugagguaguuaggggaaauggaaggguauaggaguuauugaagaaaagaaaagagaaaucaauugaauaaaauauguauauguauuaugaggccaugauaacauagaucagugauucucaacuuuccuaacgcugcgacccuuuaauacaguuccuuacgugguggagaucccccaaccauaaacuuauuuuucgcugcuacuucauaacugcaguuuugcuacuguuaagaaucauaaggucaaaaaccaaccaaacaacaacaacaacaacaacaacaacaacaaaaacgaacaaacaaacaaaaacgaccgggcaguguuggcgcacaccuuuaaucccagcacucaggaggcagaggcaggcggauuucugaguucgaggccagccuggucuacagagugaguuucaggacagccagggcuacacagagaaacccugucucaaaagaaaaaaacaaaaacaaaaaagaaucauaaggucaauaucuaauauuugacccccacagauugacaacugcugacuuagaaaguuuuguugaugaaaaggaaccgccuaagacauugaugggauaaaacaagcgucacgcauguaugggaugcuggagcguguuuaaggaggccuuucagucuagggggagacacuuagcgacagagaacuuagcgacaagugaggagccuaaaggucugggggcggagcauaaaguuaucucucuucccaauucuuccuaagaaagguuucaggucaaagaaagauuuaaggaacaugauaauccuuugguccugaggauccauauugcucccugccccauaucuaaaugacuaaaggaguauggaagaagauaaaaaucaaaaugaugaugaagucacacauacaggugcaggcgaaugaaucuaaugaggcuuuaaagucucugucggucauccuacacuagcucucuugggcagugcagucugucuuuccccucuuuuuggaugcaccucuguuuucacaaauccccacuuucuugaagcagguccacugcgaggauccacccaaguucccaccacugccaccugugaccucacccccacccccgucauuuccgccucccacacgcucuaagagucagcauuauagacgaacucucgcagaacgcgaauuagaaugccggccagugccuuuacacggucagugccuuuacacgggacuagaacaggcaguacgagcgagcaaggugcuaccuaccuuugaaacugccuaccuuugaacucgugcgcugacugcuccgagaaaccccagcgcugagggcguggccuugguggauaaggcugcaguaucaggggucugaaagaaguuucuagagucccgcuguuucuccuucucccugagugaaucguguguacucauccgcuccacacagggcaaaaggacacauaggucggcgggagggggacacauagccucacuguccuaaaauaacagaucagacuaguccuuaggguugagggagcugggguucccagauucaaucagggaauccccuucccagccucaucucggugcccccuuuguggcagcucucuggagaccccuccaauuagggaaugcucagaaggaaagccuuuccuucauguaccugucaccuggaacuacaccugccuuuccucaggcaggaggccagugccgcccuccacacccaacgggaacauuuugugugcagcuuuucugagccugcucccaugagcuagcggugacccagggaaugcaggaaacaaaccguggaagguucacggcucccaugauuauguagcuccggagucagcucuuccagugugcuuuagcucccuauggcuucccuggcaaaaccucuccuggccccuugagaugcugcgggauuuccuacgagacuauacaucaagaaaggaacagacuguuaaaggcuucccauaguccaggggccagucucaggcuagccgaguucucucugaggagggagugggaaggacugcagaggcauuucuaucccaguaggcacucuccuaucccaucuguccacucuggcuggacuccagcccuggccucugaggucacuccuccuccccccucccuuccucucugcacagcucgccggggauauguaugcaaacgagccagugaccuuugauucaauaaggaaaaaugucagcugcccaaagacaguuuuuaucuguuuaauucacuacuauauuugucggaccccaaagaguaguugguacccaguagauacucguuaaauauuuaaauacuucuugaaugaauacccacuggacacauuuguuuacuuuucucuauauuaaauauucacuaggaagagcugguaacacccacuccuucaccaacucaauggacauuuacugaguuucccuuccaccuauaugcacagcagaugucauuaagacuuaggacuugaaagauggcucagcacuugagaacacuggcugcucaggaggaggauucagguuugauucccagcacccacagagaagaucacaaccaucuauaauucuaaucccagagcauccaaugccuuguuugagccucuguggguacugcaugcacauacauuuacgcagacauacauuuacaaauacucauacacguaaacaaaaauaaaauaaaaauaaauaaaaucucaaaaaaaaaaaaaucuuuuuaaagucucagaggagccaggcacaaugguuccuagcagcugggagucugaggggcaucaugaauuuaagaccugacugugcuacauaacaacuuccaaguuuacuucucaaaacaaacaaacaaaacagcuuaggucaaauguuccuuggcccagcgucagggcaugaucugccaaggucacacagucaucuauagcaaaggaagacagggccucuggggcccagcuaucuuuccaugacaccacagacuuaugaucacaagacagggcaaccggcagcacacacacccagccuggagccagaauacagggcaccaugagccccaggcugagggacaaacaccuuagagccaacugucuugagcaacuggccuggcagcagccugaccuuuccaguuguccgcuggucccgccuaguccaggagagggcgccagccaccagcaggggucugagccuuuaucccaugcccauaaacccuugggagcaagucaagguauaccucugaauggacauaguaagcagcauacaagccggguuccaggcuccaugccagggccuuuuaaauaguuaauauuuguuuuaauauuuaauauaauuuaauaccaucacaacauaggucagaccguguaaugcuucuccucagaauccagagaugccuccccaugucgcugagaaugaaagcaccgcgaccugagagaugcugggccaucuggccuuugcaaacuauccgauccauuuuacccugaugcuguguucauccuccuagccuggcuggccuucuggcucuccccagcuuccgccaggugcaucccacaugggcugaaaugguccuguguguucaucccuuccucaucccuuuaagacuggcucuagaguugcuguggaggcgacuccagucacccuguuuugguuuuuaauuuuauuuguuugcuugcuguuuaauuuauuuuagagacaggccuucacuguauagcuaagacugaucucaaacucccaaucuuccugccucaaugcugggauuacuggcauguaccaccacacugauccaaccacccuaucuuucuuucuuucuuuuuuuuuuuuuuuuaaagauuuauuuauuuauuuaauguguaugaauacaccgcagcugucuucagacacacaccagaagagggaauuggguccuauuacagaugguugugagccaccaugugguugcuaggaauugaacucaggaccucuggaagagaagucugugcucuuaacugcugagccaucucuccagccccaaccacccuaucuuaaaguacaccccuaccacauuuguaacccccagcacuugcugagucaucuacacuaaaguauuucucucugucucuguccuuacacuuucuuuuuugcucugucaaaugucugucuucuccaguauaagcauccccagggacuggccucuaugucuguguugcucguggcucuguuccuggucaaugaaauggugccagccucauaggacgaacucaagaauguuugcugaaagaacagaugcaccccauguguggcuacucccaugcauagaugaggaaacugagguucagagaugcuaagugauuuguucaagggcacaugguucauuuauuuaacccaccaacuugucaaugagccaacauuuccagacccuccgcugcauucccugugauggugaggcacaauguuauuuaaaugguuuugcgugaugagcuuugugugugugugugugugugugugugugugugugagagagagagagagagagagagagagagagagagagagagaguuaauagggggaggugugcugguguacccacccaugcaugcauauguagaggccggaaguugauguggagucucuucucuauugcucuucaacuuagacuuuaagacaggaucauucaccgagucuggaacauucuaacucagguaggcuggcuaccuggccagaagccucuagcauucauccgucucugcuccugaacacugagguuacccaccaggauuuuuuauguggcuucuggggacccaaauacuggcccuccugcuugcacaaugagcaauuuaccauggagucccuccucagccugacugugagcuuaaaaacaaaacaguagcucuuccuuuguucuugguguucugagucuuaugccuucucccacauuuuuuuuuuaaaccuuuuuagaauucaacuuacauuguagaauucaauucaucauuggcgguugccagggacugguagacaagguguggcugacuccaaagaggaugcacacgugaauauuuagggugauggaacugcuuugaauguuccugggguggaaaauacacaauuucaugcauuugucaaaaaccggaggccugcacaucacaaagagucagcuuuaauguaugcaaacuacaugaaaagacauccccuaaggcucuuaaucuuuauggacauaauucaguguuuaaauuguuucuucuguacugugcaccugggaaugcaugcccaugcucucaagcacacacacacacacacacacacacacacacacacacacacacacacacacacacgcaugcacauuuugacuuaaguaucccagaaugaaugugguucuuuuauuuaaccaaccaaaaaaaaaaaaaaaaaucaagaauacucucuucaucucugaaugacccuggcuuucagccuuuccuaauguuuaucccuuagcucaaggucaguucuagaucuguaaaggugugugugugugugugugugugugugugugugugugugugugugugcaaauggaacugaugaccucaggaauccuaugaaagucccuugaaauguaaauucauauucuguauaugcaguugucagauauaacaaagaagagauagauagauccuguggucauuucccaguggugacaucuuguaugacuacuaagaaagugacuuugggauggaauauccagaucaucagauuuaacaguuuuauaugcauucaugugccuguguguacaugcgugcuugugugugcgugugugugugugugugugugugugcgcgcgugcgcaugugugugugugcguguguguguguguguguccaucccccagggacuucucucuacgggaaagaagagcuucugcgcuaucauccaagaagucugugugggucccuggcugaccuuugaccuccaaccuucacgugcaaagccucugucaccuugauucuuucccugccuuucccuguugaucuguccuucagagugagcacagcugagaaaagugggcaccugggaagacggugagggacugcaaccuaugucgaguggccuggacaccccugcauuuaccccauguguguguauccaaccuccacaaguugggcaaagaaaucccccaggcuugaaaucaggcacagcgcucccugccuggagaauggaauccucaccaacccaaccuguuguccucauucacacuucaagccuuccaaaccccucuuuuaccgcguuguccucaugccauccgugucuccccuugaggcuauuauugcugauugcaauccuagccaacuucccuuucuauaggugaaggcaaauugagagaggguuaggggucaccuggcuggugaagguaguaggguggugguguagugagcacaggaccugcugggagcugaaaauccaccagaacuccaggcuuugggucuuggugcuuaccagcuguuacggaggugcugggagaggccauugguccggucugcucaccuccacuggggccugucucuccaugugccucucaucucuggaccuuuccucuuccucuccaaccagccuagugagacua

SEQ ID NO: 234 - RNA, 100 nt, Mus musculus
cggcacagagcgugguaaagguaaagggugugggaagaaggugcauggcuguaggaugcagggcuuccagcuacugccaggaguuaucgugauggaacgu

SEQ ID NO: 235 - RNA, 7252 nt, Mus musculus
agcucucgcggguuguaaggagacacguacgcggaaggagcaagcaguggcaggcggcagagcuggcguaaagggagcuagugguaaaaggaucuacaugguggaggggguggugggcaggguaagguguagcagacggacccuggacguagggagggcucacagggccugucuuucucuccucaugcccacgcuuguguugguucuauaaccaauggcuacgagaaacugacgucuauuggacugacucaguugugggguccaggucagcaaucaaucuuuggaauccagagauuccgcaccaguggucgguaugcgcacggcuggaguaguaggcucagcguuugacaugucaacggaaccugucuuuugauucgagcacauguagguaguuguagaauucacagucagcaccuagagguguuaggguuggugcucaucaaaugcagauugauguuaguucuguacuuggggcgcauucauaggauuaaaauuaaauacccagagcucacucaagguuugugguuccauauucaccgcugggauucggaguugaacagcuagaaggaggaagcagucauuugcaaggcacugggacuagagguuucaggguuuugagaucuggggucagagaaggggguccguugaguacccguguuuacauaauuuguucacggccaaagagaagucauuagagauaaaagggagggcugcaggguuuugaagccaucugaguucuggauugggaugaauuucgugauugugugcccaaggagggacuauacugaacuuuuguguuuacauccuaggaaaggacuauguguuguaauuauucuguugugguuugagguuuagguaauagcgcucaucaugcucaaagcugugauucucauuggaggcccccagaagggugaggagaugggggacaggggagcggguaggcuggagaggucggugggguugggacacaaggaaauaggaagcuaaaacguucuccuguccucucagggacucgcuucaggccuuugucuuuugaggugcccaaaccucuguuuccuguggcaggcguucccaugauccagcaccauauagaagccugugcccagguaaccccacacuuccugccccucuccuucauggugugugucugucuuccauuucccagcugccaucuuuucccaccaacuacggcuccacgggcugccauucacaggcgucugagcacugcuuugggcagccaguccuggugacuucccugccucuugcugcugcucagauuucacacuuaguuuuacaguauggaaugugaagccaggcagggaucuuaaagaauaagcuagagccauagcagggggaaucagugauaaagcgcagagcaccuaugcuguagcuccuuuucuuuauugcuccauuauugggauagacaagguuugagucugaguccugucuuccugcugggaccuggagcaagccaaauuucaaccucuuucagcucuaguuuucuuaucuguaaaggagauuaaaccucccgugcagaguguugaagcuguaaaaugccuaauucaaugcagaccccugauaaaugacccugucaucuuaggcuggaaccaaacuuagaauaauauauaaugggagaugguuugguggguaagugcuugcuugcacaaaugugaggcugugaguuugaucccugucaucacccuuuuaaagagccaguguuggugauagguuugccaucuuaggacugagaagguagaucacuggggcuuccuggccagccaggcuagccuaaucauuaggucccagaccccagugagcgcugacccugagaaggugggcuacuccugaggacagagccauguagagauccaagauugaccuuuggcuuccaugugguuguuuacacaggggcuuguguacccccacauaugcaugggcacacuuacacgagcuacacauacaacucagagacacugcgugugucuaguaugcgugaggucuuggguucaauucccagugcugggugugggaagaggugacaaagaaggaaaggcagaaaagaugacuggauuauacaugacuguggcuugguggacaagguucguucuaguccagguacaugggagacuauaaaaaaagguggaaaggucacagcugagaguucuaacuuccucacuguccaaaagaaaagcgggguagaaaggcugauuacccaggauacacaccagaguucaaccuuuauccucuagacuucuggaccaguacccagaucuucccaguucccaucagagguuucucuggcaaccucuuccuuuguccuaggucccagggaugcaggagauucuucucauuggcuucuaccagccugaugaggcccucacccaguuccuggaagcugcccagcaggaguuuaaccuuccagucagguguuugaacaugcgagugugugugugugugugugugugugugugugugugugggucugagucucaaagcucuugggaauggguugagucaccaggguucaccccauacccaaaagguacuuauuuugggcaucagaauuacuuuuuuuuuaaaaaaaagauuuauuuacuuuaugaaagcgaguacacugucacuuucuucagacacaccaaagagggcaucguaucccauuacaucugugguugugagccaccaugugcuugcugggauuugaacucaggaccuuuggaaaagcagucagugcucuuagccgcugagcggccucuccagccccagaauuacuuacagaauuacuuaauaugcgguuuccuugcagacccagggcagaaguacugcugacaaggguggagguauggugggggggcaggucaggugcccuccugacucauggugucucacugagcuggcuggggcuccuggggacagguaccugcaggaguuugccccccucggcacaggggguggccucuaccauuuucgggaccagauccuggcuggggcaccugaggccuucuucgugcucaaugcugacgucugcucugacuuccccuugagcgccauguuggaggcucacaggcgccagcgccacccuuucuuacuccuuggcaccacggugagagggcuggaggcuguagagacuggggccacucuaggucuuggguagggguggaguugggagggagaugugcuacuccagcaguuacagaggugucauuggcaacccugagcccuuugguugcuggaaaguagaggggcggggggggggggggggggggggagggcggcugucagcucucagcucugcugaaggccugucagugucagcgcugcaugccaggugcuaacggugaagggaaggaagggagagaaaacagccucagccgccccggaggaggcaggucacugucuuggauaugucugucucgcaggcuaacaggacacaaucccucaacuacggcugcaucguugagaauccacagacucaugaggugagagcaggauggggcguaccuggcaucucuaggggaugcugagaacgcuuucaggagggguccaucauaucaaacagauaggacaguuugugugccaucccccucccccucucuaguaaaucaucuuguagcucuuuaagagagaaagacagggggaaggggcgccagcucguuucuguaggagugauguuuuaauaaauguauucacggggcacuaccggaacacagagagaagcccagcaagagucugacgugaggggucagggcuuccuucaggaaacagguagagaugaaggagacugcuggcagagagaacgguuugugcaaagacaggcaggaaguccacagugacccauaauuacugagguaggagcauagucgcuagggcaagaagagccuugucccuguuuaugaaaaucccugcccgugagucuuaaggacuuagacacacaagccauuuuacuuguucauaguuuaauauauauaaacucuacauggaauauauauguguaggcuuacaugcguaugcaguuuuguggcaggcaccaguuagacaugaaagaaaaagaaccacagaauaaacacauuccccaccucucaggaaaccccagucuaguaggaagaacagucaaaagccaauccuuagcacaauggccugggugagguauaaccagaggcuaggggugucaggugugaagagcuaaguggaguugauagccgagugacaaagaguaacaaugucaacuugguuccaaacggaggguuucccagaggaagaggcagagaaggacaucccaguggccaguuauuuccaguuauuuuccuggaauaccaaugguuagggaggauugagcacagguagcccccuggggauguaaagccaagguaugaacuagcccauucgggcguugcucuuggcgguagaggggccugagggugauguaguaugagguggugguguggaggucugcccuccgcuaugaacucugccuucacuuccuuagguucugcacuauguggagaaacccagcaccuuuaucagugacaucaucaacuguggcaucuaccuuuucuccccagaagcccugaagccucuccgggauguuuuccagcguaaccaacaggaugggcaacugugaggcaggcuccaugacccugugaccuaaccccaagcaucccugacccagacccguguccccugccaggcucuguaggucccauggucacccugcucccuggcuuucuccccucgcccuuucccacugucaucuguagucugccucccuaagucccuccccuccuaacccauucugucccucuuccuuauacaccccagcuccuccucugucaccaccugcccauuccgcuucugguccauuucucuccagcccugcuugucccacagacaucuuuugagaacagaaggcaacacacacuugagugcacaugcacucaagugcagacaugcacacacacgcgcgcgcacacacacucuugcucgggcugcccagagccuugccagcuaaugucagguuugucccucccaagccugaaagcuggcuacuaggucucccccuccacacccagcucccaucucacgccucauucaucugcugacaacauuucucaccccaccaugucucugcuucucuccaucucuccuggccucucuaucucuguuuccucugagcuggcaucucuaccaucucuacccccccucccucucucugugacugucucugcccucaccagcugccuugcucuggggugaguuugguuuuuuuuguuuuuguuuuuguuuuugugccauccagugagggaggggaauuagcugggugaauggggggagggugggcauaagcagggauaggaggaguggggucuaggccugggcccccccagugagagcagucaaggggaguagaagagauaccuaggauuugaauagaccuugguaaagcagcuaagcgaaaggaguggcaaaaaccccuuccacuccuucccggagagacuccauauuuggacuuaccuagggaucugaguaaggucucccccuuucccggccagggaggaguccccaggcucguggccuggcgcagggaccauccgacuagaacaggacguguucucagcccuggcugggcagggccaaaucuacgugcaccucaccgaugguaucuggagccagaucaagucugcaggguacgugggggcuggggaagaccccguaccacggaucuugagacuuaagaauguggcauuuggggugguaggcacaggcccugcuggacccugagcgccccucucccuuuugguccccagcucagcccuuuaugccucccgccucuaucuggggcgauaccagaucacucacccagaacggcuagccagacacacuccagggggcccacgcaucagagguaccuaccccgucccauuacuacccuuuacucucccacauccuugggccuacacucuucaccucagguguggaggugaaggcucagucuccuccccucccuauccagauguguuuugggguaucugccccccccagguuguuucuucugcuuuuaggaaauguuuacauccauccaaccgcuaaaguggccccaucagcugugguaaguaagcuguggccccaacuucagggagaggcuguugggauccguggggagaacaagggaccaagcucaggugccggucugucccccugcuuuggaauaccugcuguauccccaagucccuucacucucaaaguaugaugaucuucacagcugggccccaaugucuccauugggaagggggugaccauaggcgagggugugcgucugcgagagagcauuguccuccauggagccacuuugcagguaggaaccaggcacacagccaagaggcugggggggaaaaggggaggggucagguaugccuuccagaucaagaggagugagccucaccccaggcccugcaucucccuuccacaccuuccugugccugccaccuguccacucacccugagccauucuaucccaacaggaacacaccugcguccuucacagcauugugggcugggggagcacuguggggcgcugggcccguguagaggggacucccaaugaccccaauccgaaugacccccgagcucgcauggacagugagagccucuucaaagauggaaagcugcuuccugccaucacuauccuggguaugguuuguuggggccuggggggcggguugaggguuagcaagcuccacaggugaaggcuggagucugcaggggacguuuguucuugugugcauugugcgugugugugcaugaguguguguauguauuccuuaagcaaacauuuaccaagauccugccauguacccagccugagggaaucacugggggaugaggcuggagcacagaugggcaggccuggccauggccccagcucccugccucaucaccucucucgaccuguuccuggugcccucauccacgcuccaggcugccguguucggaucccugccgaggugcucaucuugaacucaauuguucuaccacauaaggagcuaagucgaagcuucaccaaccaaaucauccugugaggaugcugccaaaaggcccccaggacucccgcccacacuccuuugggcugcugccugccuggcuagcucuguccagauaggaccugaggaagccaccuuguagggagccuuguguguggccagggacaccuggcuucccucccuacugccaaauaaaccccuaugaaccuuggagccag

SEQ ID NO: 236 - RNA, 2194 nt, Mus musculus
gggugguggaugagcugcagcucaggagaaccauggaaagauggaguucauuuuacccauacugacauccagcaauguauuuuuccuagggcucagggagaagucauuuuacuuccucugaguaagaggcagggguagggaguugcggaggagagaagagagaauguugacugggagaacagagaugggcuccacucccaguccugguuuucuguagcaucuccauggucugccaucacuuaccgaguaucugaagcuauagaagccauuaggacccacccccaccucccucugagauaugaacagagcucaacuucagcaagaccucuccaggacagacuggaaggagaagugauaagacacaggagaugagcacacagaggggugaggaaugaugagaggcagggaaagggaaggcagcacacacccaguguguggucggcacauucaauguagauauuuggugggcagauggucucguugccugaaaggagagaagaacaguucugagaucuacaguccuuucccuucucccucaccacacaccuguguagacaucuacauguaugcauguuuacacauaugcauaacaguucaauguauauacacacacacacgcauaaaaacaguaaaaaugcauacauacacauaugcagguaauugcacauuugcuuacacaaucauguuacagucuucgggucaugcacacagccccaaaacacauacccacgaauauauauuagcaugcacgcaagcaugcacaucuaugcgcucccaaguauacgaacccauguguaaguauccagacauacacaugagcacacgcucaugcguguagaugcguguacaugugguacgcaugcaucucugccuccuggaaguucgggagcucagaagaguggcaccaaagacuggcuggaggugcccaccuggcaugugcaccauccggcaguggcagcgcugaagcacggccuccuucucacagcgcagucggcaggcagacacacuauaggcugaguagcccugaagcucaggcucccugagcucgcuuuccgcccggcaguugccccaaggcuggggcagauaaguuagcugcagagauggggcaugacaaggucaaggccaagcguguccaucagggccaguccuccagugucaauagccccagccagggccauggggcuggcagacugaguaucugccaggcagauguggccagcaucccuuuaagcagugaguugcccugugcccagccuaggccuagcuggggaugcucacccgcuguuccuggcaggacacaaaagucuggaagccuggggacacgccaaaccccagcugguggauguagggcggcuccuccuggcuguggaucugcacccggaucccugccucgaaugacgucucgucugcacagcagagaugagaggcuucagaccccccuucagggguagagccgagcccaggccccaucccugagcuggcccuuauccccuucccgccugcauacuugucucccuccauauggguagguauuccuccugcuggaugucuagcaugaucuccaggccacuacccaugccgccugcccuacugggcagugaacucugaggaucugcauuaaagguguaacacuucccauagcgaguauagaccuggagggagaaagaacacagcagacacagaacucuuaauauuuuuuuggcagguuuuuacuguguaguugagauuggaucugcuccuccccagggccuugcaguaacccagaaauuccccugcccaagauuugcuacacuguguagcuacaagaacucccuguguagccggccuugaauucccaauccuccugcuuuaaccacccaagagcugggaguacagagauucaccaccacaccaggcucagaacucuugcuauccuaucaauccugcucucccuuuccugaguaaaggguccuccuauugcuacuuagggucuuuugaguaaggauccuuaaagucugcaucucccccacucccaaaacaauucuaaaauggucuaccuccucgggcucccuucauccauuccuuuccucuguuuuccacacagcagucaaaacacucaaaccaaccaaguccccugccagauucuagucucuguagugcacacaucauguuguaaaacucaaguauacacaauaaagcuuauuuuauucuuugu

SEQ ID NO: 237 - RNA, 6649 nt, Mus musculus
cacgggccccgcgggccgcagcacggacagcagcagcgacgcccgcauggcgucccgacagcggguccccggcccccgcguagcccgaggcggcuccgagggggcgggaccgaagagggggcggauccggagggcccaggcccagcaggcgggcccgcucccuccccgccgagcagagguaggagcucaagcccggaauccccgggcgggucggccgcccuuagagcagcacugcgcgcccgggccuccaaggcggccgcuguccgacgugucaccgacagggccccgcccccgagguggggucuagccgucagcuagcggagagggacgaaggggaggagguuaaaggggaaggacccccggaagugcccccuccucagcgccggagaggcagacgccgggggcggaguccccugucuccccccugcgugguuggugcgucccggaugacgucagaagcagcccgccccugccaggauggugcacccugagugacgucaggagcagaggccggagcuguccaucagcaccaaaggccgccagcgggcucagggcauggggccgcggcuccgggacagcccgagcuccugcuccuuucccuuccccgagccgggcgcgagucuguggagcugcagugccagccggugucggagguggggcgacgacgccgucgcacagagacccgucucuccggcccagcagcccccuucgcacggcagacuuugcccggaccccagucagucagagccucugguguccuacaaccccggcuccuccggccccugcacacccuccuuugcucggaagcuccggucaccuccggcccagguagaucuuggacaauuccaaauugagccucccacagauggugcucaggcugccucuuuuugccagcggcacccucccucuccucgucuagccccaucuagucccucuuuuaaguccaucccagccgccucuagccaggcacuuguuucccuuugucucugcuccccguuccagagaugcuucuagagcugccugaugugggcaaccauuccuuuguccacugugcccuugcugaauucccccacucgcacuguuauuguaguggagacccacaacugacucuugaccccaauuuccucccugucagguuguccugggagggugacccccuuccauucccggcgcuaugccggguacuauggaaacucugcgguuucagcugcugcccccggagccggaugacaccuucuggggugcaccuugugaacagccucuggagcgcagguaucaggcacugccggcccucgucugcaucaugugcuguuuguuuggagucgucuacugcuucuuuggugagaucccccucguuccucaccuguggccuucuacuguuucccuaaaguuccuuuuucuggugucucgagaaucauuuccaccccaucccacccccacccccaccccacccucauggcgguaucauucucuugcugaucacaaguauauuuguagaucauugacucuagauucuacagagagcagguuuugaauuaggcucuuugaguuugaaccgggcucuguauguuagucacugugauguaaugggcauguuaaccugggucucagcuuuuucacuuggacaaagacaacaguguuugucucauauagacaagaauuaguagguggucaaagaauaaugacuaucguagcgaagauauguuuggaucacuuaggauaagcagacuaaaauaaaauaauaaaaacucuuagcaugguuccuuaccacagggcauauugcauggugggggcgagaccuggaauauucacacuugugauacauaucagagugggcuggaugguagucauacaaauggagaucgccuacaaggcagauucccauaagaaugguuacugugaagaguuguaugggggagggcgugguaugccuguaaucccagcauccaggaagccaaagcaagggaagggaggcucaaggccagcauggauuacauaguucagugagguugggugggugagcacuaacugccgcucagucgaacagguguguggggguccauuugacaacucucaaggucuuggaccaaggcuggcuucucuacaaaacaguaugccuuuuucucauuuucacaaaggugaccuaugggcuagugucagcuuugaguaaauaaacgcccaguggauucuucaggaaguuacagaacuucacaguggagagagccuucuaugaguagggacccaaaggcagccuucaagauuauauguaucagaaccaguuugggcagagaggcuggggugguuugccagaaguguguuagaauaguugggaauauaggguguggaauaugggaucagauggucuuucucuuacauuuugcagagugggcagggaaaaugucccccacaaggauuuaggauauguauggguguccaaagauuccccccuccugcucuggguaccuccucccucugcauggugcucuggauagcuucaucccuugcccucagcucuaguaaucauccuacccaucuuggaugccccuaccagggauucagagccucuuucuaaacucugcuccucucugacuucagaaccuucuggggucugauacccccauucuuggaaccaaaucucuuuuucucuuuaucaucaucuuucucuuuggcucucccugccucuccuugacuccuaacucuuucuuccagcuucccaauuguuugugauccaccucacccccccuuccucuuucaaacaccacucaugucucucaagucccuucaauuccccaccccccacccccaccccccauucuccauguaguccucuuggguuuccugcagccccacauagcuccuaguacccucccucugguucucucugaucccuguaacuccagucaguagauugauccuccgcauggugguuucuagugcuccuauuucucugcccucaguguuccccuuugucuuuaauaaucuuaaugacacuacucuugcccaguccccugaccugcaaagaccucaucucccccccaagcucuguccucucugugacuuuccagcacugcuuuaccucggaagccccugacagucuuucuaaaccuaggugaccucaccccauucauuuucuucugauuuccagacucuucauuucugaguaguccuccucagaggcccagagacuccagugcugaucccuuugggacuccagugaucucucuggacccugugauccuaaagacccuauugccccauggccaauuuacucaacuucgaccuucaaaggcucauaacaugauuuuaauaauuacgugccuucacaacgauucucagcaaacaucugcacgaucuccccugaccuccauggcccaccuugagcccucaugaccucuaauucuuccuuuagcacccaugucuccgaugcucuugugccuccaugaccccaaccccucugacuucuaaccugguaaccucauuuuggccccucccuggcccuguuccccuccagguuaccgcugcuucaaggcaguacucuuccucacuggguugcuguuuggcucaguggucaucuuccugcugugcuaccgagagcggguucuggagacgcagcugagugcuggggcaagcgcgggcaucgcacuaggcaucgggcugcucugcgggcugguagccaugcugguacgcagugugggccucuuccugguggggcugcugcucggucugcugcucgcugcugcugcccuacuaggcucugcacccuauuaccagccgggcuccguguggggcccgcugggacugcuacugggaggcggccugcucugugcccugcucacgcugcgcuggccccgaccacucaccacccuggccacugccgugacgggcgcugcccucaucgccacugccgcagacuauuuugcugaacugcuacugcuggggcgcuacgugguggagcgacugcgggcugcaccugugccuccccucugcuggcggagcugggcccugcuggcacucuggccucuacuuagccugaugggcguccuggugcaguggagggugacaaccgagagggacucccacacagaaggugagaggacacaggcuaggguggacaugggaaggagggguggacggagaugggugguuagugagaagggacagaaaccacacacaaaaagucggggccuugauggguuagagaguugacuugaucagggucuaggagaacagggccaagaaacaaucccaaaagaaugugcggggcaccggcucuaggucaaguccauuccaggcgcugggguaauagugaugaaauaaaagcagagcagaggauguagcucagagguagcaugcuuacccaacaugagcuggggucugagcuugacuacagacaggacaacaaauaaacaaaggcuaccagagaagguuccugcucucaugaaggguguacauucaagguagccgagaaacagauaacagaugugugaagaagcaacuaaguuaacuucucuugugcagcguguuauggagaaauacaaggugaucugaaacgguaacuuuauggagcccacuguacuuaggguggucaaggaaggcugcuuggugcaggugcaguucaugagcuuugcugacaggauggacccucuaggcugaaaucuguuacaaggacagugcgaugcccauggagggcuuggaguaggagagggaagaacauggguuaaugucugaggaugcagaaugcaguagagcagcaguucucaaccuuccugacgcugugacccuuugauacucuuccucaugguguggugagccccacccauagauuauauucauugcuacaucacaauucuaauuugcugcugcuaugaaucauaauguaaauauugguguuuucugguagucuuaggcaaccucugugaagaguuguucaccaccccaaagggguugggaccuccagguuaagaacugcucuaguagagagagacaaguggauggagagaggacauagugaagaaggagcuguccaguuaaaugaugaugggauggugucuggggggggggguggcgggaaucggaacagcaacaacaguuggggaggcaauuuugcgcauacaggccacugcaagaauagaaaaacugugggaagucccaucuuggagguaggaagucaggaaaggaaguaacaggguggacgggggugauggucgugggcaagggacuguggaagccuaaagccucugaggggaagggaggaagagggcuccgugaagaacuauguggaccugagucucuucugugcccauccaucccucuacagucgucaucagccggcagagaaggcgagugcagcugaugcggauccggcagcaggaagaacgcaaggagaagcggcggaagaagagacccccucgggccccucccagagguccccgggcaccuccaaggccuggucccccugacccugcuuauagacgcaggccagugcccaucaaacgcuucaauggagauguccucuccccggugaggccccaggacuccuccagccccgaggugggaggaauguguaguuugagcaugcaggacugagucuccuuacgggacuggauguauuuguccacccaucagaaccuccguaccugggcucugacagauccaucuuuggagguagggacaggugucccaaguacugauaucaaauggauaugguauaugguggguuuuagggccugggugguauagggagaggugggucuguggcaggacucagaccuguucuuauuuccccacagaguuacauccagagcuuccgggaccggcagacugggagcucucugaguuccuucauggccuccccuacagacacggacuaugaguaugggucccggggaccacugacagccugcucgggacccccuguacggguguagucauguccccauugucuggacucugcagucaccagcucugccaccuucgagacuccugccaggccacuacugaagcugcaaggcccuguggccucuggcugucucgccuccuuggaaaggguuggccagccaccagaagggaggcugugucucagguuagguaggccuggccugagggagaaguucccguccaagcucccgagggacucggggugugagccccacugggaagugcucaggguuguguguugcccauacaugugugugaagggguaggccuggaggggacacugggacccuugcuuuagauuugauuggcagggcuucuucagggcuagccccgccuccuguccugcugcuggggucccaugggccacucuccugcaugucuguggugggggaggccugccugccuccccuauugcucuaucuuccaaucauucaucuaaggguucuugucacuguccauggaacuaaugacggcaccccucacccugguccccuggccucugcaaagccaccagccagagggcaguggcagaggaugggggugggagggugcuguccuggguuggguuugggaggaggguggagggaaaagggcuuaaaugcacggugcaugucuggugucugcuaugucaccguaagacaccucaugcuucugucuccucccgcccuguuuuacaucuuuuauaaaugugccaaacgauguggucucugcc

SEQ ID NO: 238 - RNA, 15809 nt, Mus musculus
cuuugccuuccggggcgggacuuccugcccuaaaagagcccggcugccaaagugauuggagugcgaauuacgcgggcccaugggcucccgaggcccaaugcuuuuuggaaaaggggucagagagaucguucuuuuuagcugaugcuuacuuuuuacauugcgcgacgccuccauuugcacgaaagcucugggcuuuuguugcccaccugaggcucuuccgcuuccccuuuccccaggcuccgcccccagcgucccguggcuaugacgaccgcuccgcgggauucaguaguguggaagcuggcgggacuuuugcgggagucgggugaguggacuucuggcuuauuugguugggaguucuagguguguucgauacuguccagaaacgccgggaaucaccgagucauugccggcggggucacgaggugccggcgucuucuggguguguuccuugugacgcguuguuuacagucaugccuuugacagucuaaacucuauccaucucucauagcacuuaacucuccagaggaaagggaucauuaauagauuaaacacuugcagacaagaacauaaucacuuguaccgaaagccaaguauaagcaccuuagacaccagagauuuggagacccacauagguuagucccaacccucuaucagacuuggauaaguuuuuagacccucaguauucuucucagauagguuagcauagggauuguauugaacgcaaaagauagcgggauuuuaguuagcuuauuuagugcagugcaugcaugcauaauaaguguucaaaagauaguguuacuauaguugcugccccagugccugggcauggcaaagaucacuguguuguuugguuuuuguuuuuuuuuuuguuuuguuuuguuuuuuuguuuuguuuuuuuuuuuuuuuugagacaggguuucucuguguaguccuggcuguccuggaacucacuuuguagaccaggcuggccucgaacucagaaauccgccugccucugccucccaagugcugggauuaaaggcaugugccaccacgccuggcacuauguuguuuguuaugugguugccaucaucagcuaaaugaucacaaucaugauucuuugagagcuggggauauaguucaguagcagagcauauguuuagcauguacaaaacuuugacuuauaaucccuagcauccuccccacacacacagaaaggagagauucuucuuugagccccggcuuuccuaucuguaaggugggguuaauggaugucuuuaggagauaaggaugagaucuagaugaagcagcugucauuuggaaugugugaccucgauggcauuagugcuccauaucuauauacucccaccauggcauccuuggagucucuugauggcaguucauuuucugguuuguguuaauaauuacucccaugcugugccuuuucuagacuuccaggggacaccuugaauuaugugcaugucuauacucagugucuaguacauagaaaaaucucuuuguaaggcuguaagauuuauuauucagcaaagaucugacuuggcucccaggcucggaaucguagaguucauauaugauuguggggauggaaucacuuugugucuugauuaugguggugguugucauaaucuacacuaacagaauagaacugacacuauauuuuaucaacaccuaauuuccugguuuugauaauuguacuauaauucuguaagucaauuugggggaagcugagugaagggugugggagaucucugcuauuucuugguaucccaagccagccuugaaauuaugaucuuucugcuuuagugacucauccuauggaauuauauauaggcauaugauguuccuccaccugacuucugcaauauucuuugacuucuugauuuuucuccccccaucccccugagacagggccucacuuuguugcacuggucuggaauucacagagauucaccugccucugucucucacauucugggauuaaaggugugcaccaccacaccugguuucagaauauauuaaaaaaauguccacaguuauuauaacuguacuuuccugauagagugcuaaguggggaauauaucugaaagacgaccucacagggcugauagucuuauuagguacaacagcuuuauagaagugcuguaauggacaacgacaugcauuucaauauuguuugagaauuucuauaaaugugcaugucauucuugcaaccagaaaaagacagaaagaucaaauacagucggccuuuguguaaagugggugguugcaguguggaagcgcagggguguuauuucuuuaaauauuuuuauuuuguguguggagagcaucuuugggucaaggccagaggacagcuaggggccucauguuucagaagcugucuuccuuguucucugagcaggggucuccacugagaccuggggcuugcugauuaaguaggcuggcuaaccagugagccucagggaucuuucugugacugccucgucaguucccaccacuaugugggcgguggaggucagcuucagauucaccagcuuuuucagcuggaccuuuauugagucaucugcacagcccccagagguauugcuuugcgaaggcuugcugggugaaguuggucuccaccuuggcaguagaaagggauguaucaugaugagagagagcugugagccaagugggcuauguuuccaacucuguaaguagccuaggcuucuuucuuucuuucuuuuuuuuuuuuucuuucgagacaggguuucucuguguagcccuggcuguccuggaacucacucuguagaccaggcuggccucgaacucagagauccgccugccucugccucccaagugcugggauuaaaggcgugcaccaccacgcccgacccuaggcuacuuucuacagaguagaaagcaaaagcauuuggaaaagucucugggagucuuauaguaaaacaaauuucugguaucaggcugaaaggcuaggauuuuugcucgguugcuuguuuaaaugggggaacuguagaagauguuugagcuggggaggagguagacaguuugaucucucaguggaauaucucaaguacagaggagagugggugcauuuugggggcccagaaggaaagaccuuucauuuuguccucguccccguuuguccuucuuccugcaggcgaugcgguucucucuggcuguagcacacugagccugcugacagccacacugcagcagcugaacagaguguuugaacuguaccuggggccauggggcccaggccagacaggcuuuguggcucuucccucccacccugcagacucacccgucauccuccagcuucaguuccucuucgaugugcugcagaaaacacugucacucaaggucccaggaggggcauggggacaggaugcgcagagagcccuagggagugaugaaggcagggcuugggauggggugugagagggcucugaggcugagagccagaugaugucagugaugccugcuggugcuuaugcugaggaaguggcgcagaagcaggggaggcugcccugccucgcuaaccugaauguuccuuuuucagcugguccauaucccugguguuggccuuccagggccuaucaagauuuuccccuucaagucccuacggcagcuggaggugagggaguguuagaacguauaggugggcagaaacuguugcgaaggagccucuugggcugaggacagagagauggccucuuuuggugggagguggugucugaaugucccauugcuccucagugauguuuuccauuaaaacuuccuuccuuaccuguagcugggcuuuggaugguuucccuccuccccaucagaaguuagggaugaggccuuugccaucuuugaagcuuugcuugccucccuccuuuucuucuuagcuucgaggagucccuauccacagccuguguggccuccguggcaucuacucacagcuggagucccugguuugcaacagaagcauccaggcacuggagguaaggaggaugagcgcuggcccugaugucuuguccugauagauugagaagaccaagcuucaugugcuucccuccucuguccugugugacaccacagcccucuacaccugucugcguguuuacagucacaccaagcuguguaucggcuagugucugucucccuauggucugcauaugguccccguagucugcucuuuagggacagagccuugagcuuucuucagagcugcggagucuccagguagagccuggucuaugugagugggggacuggaagauagagcaugcauggggagaaggcagagagugacauguaguugugccuguucccuauccaggagcucuugucagccugugguggggaucucugcucugcccuccccuggcuagccuugcuuucugccgacuucagcuacaaugcgcucaggagcuuagacagcucccuggugagugucccccaagggaaggugccuuuggggugagaagaaggguccuuuggagggaaugccaucugucugucagauacccuugugugaagaacuuuucugugcuugcuuugucaaucuccuucagcgucuccuguccgcucuccgcuuccucaaccugagccacaaucaucuccaggacugcaaaggcuuccugaugguaagaccgagcugccugauugcugauggacuuggcccuuacauggcuccacucucacucacucucagauuagcuagugcuccacauggcucuugggccuagguggaggcacaucugcgagcugguacuguacuguguggguuucuccucuagcacacaacaagguuuggaauaccuggaugaauugggggagucaguuaguuucuugcuucauucaccugucagguauacaucauagcaguaccugugaagaguaccuauguuacuuagccuaguguguggcccagaagugauagauuccaugauggugacaaacccuuucccuguggccuuucuguccuccauuaaagauaaauggggcugaguacuuguuaaagugguaggaacuuucuucagugaggagucacauccuaggcugaggaggauucaaagugcagugacuggagagugaaggaguggcaauggcuugggugucaucagcacucagggaacugggaauucucaagucaggaaggggcgggagcuggguccacacugaagugcauggguuuucucacugacuguacugacuggcuagguaggccccccuugucccucagaggcugggagacagaccccguggcccaaacagaggaucuccuugguugcgcuaaguguuccucagauccuugucuuuuuccaggugggaacuuaaagacggaguuaccaucuagggguguagccugggacuguuagggacaugcuaguguuuguucaggucuuucagugcaggauggaggaagucaucuguguugacauugcaguuucuguaggccaauguggauuugagaggauagcacagagggcccugccuagagcuuuguugaguugagaaccuuuguccccucacccacugccaggauuuaugugagcuguaccauuuggacaucuccuauaaccaccugcgcuuggugccaagagugggaccaucaggggcugcgcuggggacuuugauacugagggccaaugagcuccgcagccuucagggugaguagggaguguauugggguggcucagguuggccgucuagagccucaugaggacuuagagguagggcuguggugaacaauuucuccuucugccucuguccugggcacacagaauaccauaucccuuacccacaccauguccucgcaaggccucuuccuucucuccucugccguaggccuggagcagcuaaagaaccugcggcaucucgauguggccuauaaccuucuagaaggacacacagagcuugcgccauuauggcugcuggccgagcuccguaaggugagccacgagugccuaacgggucugggagccaccuucaggucuggcucuccuugugccuucacauagggggcauccgaugccuacgucgucucuuuucugcccucagcucuaucuggaagguaacccuuugugguuccacccugcacaccgugcagccaccgcccaguacuugucaccacgggccagggaugcugcucauggcgugagugauuauccucugucugucccugagugagaggccaaagucccagucacucuauggugcugugaguucuuggagucacuagugaugggcuccaucuccagccuguccucuccuuugucuuguacaguuccugcuugauggcaagguuuugucccugaaggaucuucaggucagucgagugggggugggaggacaugaagggaggacaggguaggaaagucuuuuggucaguggaaacuaggguccuccucuugguuagcuccaucaugcagaccccuuccugucaucacacagcaaacuucagacucuucagggcuuggucccgugauccagccucuguccuggccaguggggaguaccacugaaaccucagguggcccugaguugagugauagccucuccucagggggcauuguggcccaggccccgcuucguaagguuaaggugagugaguggcuucugcugguuugugccugggcuugcguggucucuuuauggcacuguggguaacucgguagacuagcaacagcaaggccuuguccuuguuaggacuuggcauuuuuuugguaaguuagguaaguggccauggauggccaggcuggcuuuuguagaucuccaucucuauccaaaccagagccgaguccgugugaggcgggcuagcaucucugagcccagugacacagacccagagcuccgaacucuggaccccuccccagcugguaaguugacccucccugcucacucccuucccaccuccuuccagaccucucuaaucucgauguugccuuacauuuuggcaucggaggagaaacuugauuuuggggugguguggauuauugcggagggccccucagucuguugucuuuuuaguuuagcccaaagagagaucugcuuccaggcagcguucuccuaaggaacauggauuuuaaagggugcuaaagauucuguaauaaagagauuuauggccacagccauuuggggagcacgggcugcagcaaugugaagcagguuucuuccuacagcucgucuuagaccugagauguguggccgugguugggaagcgccacacauuuaguuuugugugugguccagacuggcuugugggcacaguauuccauaggacgcuccugaggacauucugcggaggggaggccuauugaagaggagccagagaaagaggcuggggucagccagggucuggguguggccucagcucuacauccuccuccaucucagggugguuugugcaacaacaccgggaacuggagcugcuggccagcuuccgggagcgguuuggcugugacuggcugcaguacaggagccaccuggagaccauggggagcuccccucuuagcaccaccaagacuccugcccuuagcaccccuccucuggauguccagaaccuggagacuguaugcagcccuccagccauagaggacgacacuaaggaaucgccagagaaggugucagaggaaggcaggguggagccagagccccaggaagaagagagggaagaacaggauaaagaagagggaucgagagaggaccuggaggaggaggaggagcaggagcagaaggcaguggaaggugagaggccugugaccguagagcuuuggggucaugggugucgauugggauguuagagggacugcagagaggccaggcuggguaggacacucacucccugaggcccuggacccuuuguucacuccaguucucucuuggucucuccgcagcugagcucugucgccccauguugguaugucccuugcagggacuugggggugugcaaggcaaggagugcuuucuccgggucacuucugcccacuuguuugaaguggaacuccaagcagcucggacucuggagcggcuggagcuacagagucugguggcagcugagcuagaguccgagacugaaacccaaggagaaccagugucugagguaaguuguggggucaggugccugggaagggguucucggcuuuuccggagucaucguugggaaccuguuggcucuugugugccaugcauugggccuggguauuuuccaucuucucucaugagaacuccgugucaaggaggggugugugcagggcuguugugugugacuagggagggugcuaaaggauggacucuaugcaagggcuuugugucagaccagcauugugggguccagaguuccuguuuuucuccgagcucuguguagcccagaccccuuuuccucugcccacugcuguguucuccuuucuuccugcacagggcucagguccauuccccggggcuccaguucuuguucuucgcuuuucuuacauuugucccgaccggcagcuacgucgauaugcugugcuggagccggaggcccgugaagccguccaggugauggaggccagaggcaggcggggagguuggagggagcagguccaggcuggaggggucagaggucggccaaguggguccaccugugcccagcuagcugccuucuggcccaccucccucaggagcugcuugcaguacugaccccauucaccagugugaaagaacagcagccuggggcaaacaaggacccacagggggccagauuccagugucugcguuguagcugugaguucaagccagaggaguccagauugggacuggagagugaugaaggcuggaagccucuguuucaaaauacagguaccagcuguggccuuggccucucuggccaccuagcucucccacugcagggaaggugucucugagaggaguguggagagggagcccaggggaagaaggucuuaggagagugggggcaacuguuuggcauagggaagaaauacgaaugccugccugcugcauuuaacagcagaaaugguccaguaagagucuggaagugcuguucugugaguguacguaaaccugcucuucagguuuucaucacuugauggcuuauggugguuguggguaacaucucaggaauaacaaagccuacugagcacuuagugcagcgccggguugccaugugccugcccucuguugggugagcugcuuugcugguuggcacaaguuccuuccuugacugaccuuguaagcacuugguaggaugcgccaccuuauggucucucuuuguguucugaucuugggauuguuccacuauaggccagucaaacaauagggcuuuggagaugcugaagaaggaagggagacucuggauaauagcuaugugaaauguacaauuuugaucagccauacuucuuggcagcagacagagcaggaccaaguuauuuuuuuuccagaacaauaccccugugccauugucuauugugagccugcccuggcaggccuagucacauaggcagugggacaucacagcucuuucuggauccuggcuaucuccauagguacuguggcuucugcauugguagaauuucucuuuaaagguuucgauguuucaagaacaagucuuggccucaaacuugaauguaccugaagcuguccuucucccucccucagccucuugaaugcugggauuacugaugugugcuaccuugcccagcuuucuugugagauuuaaauaugacaauaaagcaccaagcauagcuccuggcacaaaacaaagguccuucauauaugguagcuacuguuauuaucuccaacuacauaggugugggcaggguguguaagcuaauuuaguuauuucuuuauuugcaaaaugggguaugaaaaguuuuaauggagcugccacauaauaauaacauugaugugggggcuaguacaugccuagaguguuguagccacauagugucucuccccucauuguugauccacauccuucauucuuuaccugcauccacucacccauccugccgacuccuugagguagacgugauuuuucaucuuacagauaguagucaggcucagagcacagguccacgauuauccaucuauaguuaaucugcugauuuuggucuuaauuuuuguuauuauuauauguuuguuccuguagcuguguguguguguguguguguguguguguguaugcgugugcacacacacauguguggaggucagggaccaacuuuaguguccuccucagucauuuuccaccagaguuuuuggcauaaucucucacuaaaccuggagugcaucaguuugucuagacugccuggccaaugaacucuagggaucggccucucucuuccccagaacacugggaggcucacauacaugacaccacacugcuuuuaccuggggccuggggaucugaacucugauccccacgcguguguaggauguacaguguggauugaaccaucuuccuagcucuugauuuugguuuuucaggaauuucuaguaaagcgcugcuaugcuugauaaagccaaggcuaugggaggggaccagagcaggaccuggaaguuagaagaugggauguauuuuuaggaggcuguuggccaugggcuaacuugacucuuggggauggggagaggcaaauuagagacuaugcuuagauaugggugagggugggaugcugcgaaugcuggcugugacuggagcuagagauuggaucugaggaagcuggaugguggcagggaguauugugaacuucaugcuuuuaggaggcuuauggggugucugucugucccuccagaaucuccuguuguauguccaaacugugggagugaccacgugguucuccuagcugugucuggggaagucccgaauagagagcagaaccaggaagagcagucagcagauucugccugugaccucgcugaccacgguggcugucccagcaggccugauggcaucccaccucagacauccauaucccaugaccguagcagcuggagucucagcccaugugaguauggguggaacaaaguggaagcgugcuugggggagggaugggcaccguguuaaguuggagcuguggccucccggagccaggcgaugaccccuugauugcucauagccccuggaugcucugguuuucgcucuguggaccaccgacuccggcucuuccuggaugucgagguguucagugacuccgaggaggaguuccagugcuguaucaaggucugugccacccacugacccauggcccugggcagcgagucagaugcuuggguuucagcugcagcuguggauaguugcuguguuucaugugggcauguuuauucauccuugcaguucaguugucuccauccagguagggauaaugguccuugaccucgagcagaggcugagagcaggcaccugucccugcaccuggcacuuggugaauggguccuccugucagcacagauacgugcugucacuuccuccugucagggacacucaggcccaaccgugcagcuggcuugcccuuagucacaaagaagcaggguuaugcaacgugaagcugcuguaucaggacaaggcccuagaggggcuguuuaaucuagccuguguggguccaugcucuaggagacugaagcuauagauguauagaggcccaagagaagguagcuugugggaaagaugggacaacuagugucccggccuagaggcagguuccucgggggagucuaggaggcuggggaaagcugcucaggagcaaccugcugugucugccuggaacauggaugggaucuagggaccacccagaggaugugaaucagugggguaaugguuaaguuguuaaguaagauagucuuggcugaguguggaagagagguuggagauggggagaggaugcugaggaggccugcuaagaggugcugggguggugggagggcgagugcagggccacagauagugaagagguugaucaugcgaggaaccgugguuagaaugcagcuuuuggucuggcuacugucugcuuggcuuuauuuucugcuuucucaucaacuuucccuucccuuaggugccagugguguuagcaggccacacggaggaguuuccgugccuugugguugugucuaaccacaugcuuuaccuguugaaggugcuaggggccaucuggugagugugccagguguagagcuggggccgugucacaguccugccaaccucaucccguccuccucuuaaucuugguuccuuugcucucuccacagcgggccuccugcuagcuggcuccagcccacccuggccauugcucugcaggaccugaguggcauggagcucggccucgcaggccagagccuucgucuggagugggcagcuggcacuggcagcuguguacuacugccccgagaugcuaggcagugccgagccuuccuugaggagcucacuggugagggagggagggagggagggagggagggacagacagacaagggagucgagcuuucagucauggcugcucaguuugaugcucaccaguaguagaugguccuggaacuuccuguucugucaacgcccagugguagaaguuucugagggccagaguuaauggagcuuagccagggucgaggcugagguggaggacugcagaggccucugaggguuucugucucuggcuggcuuuauccagguguauugcagucucugccucguacccaaaggaacugcaucagugccacagaggaggaggugaccccgcagcaucggcucuggugagucagcaggagguuaggguuagguggugcccaggccuacucuugacaagacugcagacauagucccauccucgugcccacaucuccccagcugcucccuuccuacccuggcugauucucuuccucugucugcugugaucuccacaggccauugcugggaaaagacccuucugcagaggugccccaguuuuucuaccuucgggccuuccuggcugaagguaaggccaagucugcaggcgcuucccugguuucuauagcccauguuguccuuggcuugcccacuauugccucuguagugcccguggaguaaugcuuaguuucuggcauccagacuucuugcccuugcagguauauccacacuacaggguggguguuuucagaagguccuuagagccucagcuggccagagacuauagcuuuggcauucagucuuucagugggugauuggcuagauauguuccacucauccugucaagaggccccgggccauugcuuggcuggugugcuggcucccuuaguauagcacugcagggcuuuuggcuguuaguggucccuggaguuuguggaaauacagugcugaucuguggccaacucuuuuuuuuuuuuuuuaaaugucucaaaauguuuaauaaauauuuccucucaguagcaauguuacaugaguuuuauauagauauagacagccuuacuuacaaugcuuuguguuuuuuuuuucuuuuucuuuuuuuuuuuaauuagguauuuuccucauuuacauuuucaaugcuaucccaaaggucccccauacccacaccccuguggccaacucuuaaguguggcucacaccucuucuccaggacagcacugggacacuaguccuggggaucuagguccagcauagccuuucacuguaggcaucaucuugucucucucucucugcaggcuccucuaccuguccugugucccuguugcugacguuguccacccuguaccuauuagaugaagacccuggagggucccaugcagagucuccucucccaguggugucugaugaaaccucagagcagccugcuucucuggggccagguccuucccugcaggucagggagcagcaaccacucagcugucugaguucugugcagcuguaucgcacaagcccuuuggaccugcggcugaucuucuaugaugagguguguguguguguguguguguguguguguguguguacacaguguacagugcaucuccgaaggauggggauagauugggauggugcuaaggaaggcgcagguguauaguggggacagaguccugaugugaggacguggguuuggauaagcagcagguguagaaagcagcagucaacuguggcaguguccuggccuuggagcccgguacugaaauaccuagcuggugugaguuggugugaucagccuacccacacuguaugccaacugguugaccuucacaacuccaacaugaggaggaggugcuguuguugauccugucuuacagaugauggaacuaaggcucagagacaugaaacuugugcaggucacaagaguagagucaggaguugaaccugcacaguucuuggaauugacguuagaacucacguucccuacagcauggaagauagagacggaacugugaacaccaguccucuagagcccucagacagugcgcuuuaaggcucagagucgcccuuuaaugcagugucacacagaccugaggcaggggaggagggggaagagccuuuaaaagccgaggguguggugucuuuuccuaagauucuggacucuugguaugucucucacuguguuucccuugccugcugcucaaucuaccaggugucucgacuggagaguuucugggcccuucauguuguguguggggagcagcugacagcccugcuggccuggauucgggagcccugggaagaguuguucuccauuggacuccggacaguaacccaggaggcucuggaccuggaccgaugaggccucuucacugacuucgcugccucccccuggaguugcacugccgaugcgaugcccuuuuuccuagucucuaggucuggcugcuugccuggcugcuguuggccauuggcuugggaagcuccaaugaccacagcuuaagagaaggacaagagaauccaucuggcccuugggugaccugccuaauagagcaggcuaaguggucagugcaaacauuucuccagcacuuacucucagguaucaauaaaguuguugccaggugucauggguaguauguagaaaugucucccagcaagccugccauccccuaaucucuucccggaagcaaccuuguuugcacugagaccuguccccagcccuucucuagcaaaguaggauuacugacccugauguacccaguccccaagcagguugcgaccuauccaguggccuugcaugggaucacugccagucaauuaguugggucccuuaagauuuuucauuauucuuuuugagacagggucucacuguguaaccuuggcuagccuggaacuuucuguguagaccaggcuggccuugaacucauggagaccugccuaccucugccuucuaaguguugagauuaauggcgugagccaccaauugugaaaaaguugugaacuuccccucuucccaaaguuuacauuuuauguaaagaccugcaauaaaaagugagauccugucauugcugacucuggaagucaccucuugagcgaagcacuguaccuguccagaaauuucaaugcauauacacgcacaugugcauauccccccccacacacccccccccccccacauucccaaaaagaguagcuaguucagcuaucaauggagagacgauucuugggguugguuucucccaggcgaugcccugucuggucugcugggagggugagggggaaaugcuaagucuuaggacuggcuggccaaugggaagugcccuuggaauagcuguccucugguacugccugcaggggacccagacaggccuguucagaggcucucaaaguaaucucaccuacuucuguuuuguucaacgcugcccugaauuuuuaauugaaguaaauuaaaacuuccccaaaguau

SEQ ID NO: 239 - RNA, 148046 nt, Mus musculus
cuccuaacuuaagcauuuauuccacugggauagaagcggcaggagcagcguuggcaccggcgaaccauggcugggauuuucuauuucauccucuuuucguuucucuuuggaauuugcgacgcugucaccgguucuaggguauaccccgcgaaugaagguaagagcccggcagcccuuaugcgguccgggacccggagggggugauucacugaugaauggucuucuggagcucagaaccaguuaggguggggggcgggggguggagagcgcggcaugagccucgcguucccacuccggagaagagugccgaacagaggggauccucuuaaguggggacugaggaggaucaggcugucugaacugagaagggugaccgaugcaagcugccacucugcccaaguuuguagcgaaaggccaaaguuuaucagcauccgccugcagggccggcucaaggcgccccgaggggauacaccgggauuugaaaacaaaacaaaaaaacgugugagcaaaguccucuacaucagcagcacaggcgagaagggaaacccaaacguagagcgcagagcgcccggccucuuguccaagccuugcgagcccggguuuuugcaaaguuuucccagcgcagcgcuucccgggacccggcugcuuggucuccggagcgcgcagcggugguggcgccgcuugucgggcgccggugaccugauuucuagcaccgggccucagacaccuuuuucuccaucgggccgcgcacccuggagguugcaaucucaggccuaccucuccccuaccccagauccuuagcucauccagcaaaacuaggggaccagucagcgaauuaaacauaccccacuguaagcuucucucuccaguaugggguacuggacuagucuagaaggacaggcaugaccgacgggacccauucgugugccguuuucuguuugucuauugcgacguucuggaaggauuguuugucuguuuuucuguccgaggugaggggagagguggugaccauuuaguuugugaugggccuagggggaaaggaacacucucugugucuauuucuguccuuaugugucccugucucucuaucucugucugucucucucccccuccucucguguguguguguguguguguguguguguguguguguguguguguguguguguguuugagggcaaaugugugccuggcgcgggugucugcaggaaccuggacguuuugugccggguaagcgagugcgcacagugugugaacgugggcuccggccuguguucguguuccaaccugcgcgcauuagcugugcaucugucucaucgauucuucccacuccguacauccaucuaucuauccauccagccagccagccuccgucuccccaggcaucaguccaucuagcuauuccugugcaauccacuaucauuuuuucuguuccgaaggagggagccaaaaaccaacuuaggcuuggcuagacagaggguacccggagcucuccaggcagagguuuggaccuugucguacaccugcccacaggcagugccggggcggaggaggggacaguggggguagaagaguggucucuccccuacuccgucacauuccagggguuguggcuucgauuuagcaccucggcaguucccggggcuuuuccucugagcggaaccgcguaccucgcauucuccuggcuauggcuacuuacuuuacacacuuguuaaguguccccagagaccucucucgccccagaccuagagguaguuagaguuaggauucuuuuuuuuuuuuuuucuuuaccuuuaauuuccccucuuuuuuucuuugggaagcaagacugggcgcccuagaccaaaaaaaaaaaaaaaaaaaaaggcgcucgauggaaccguaggcuaauguugaaagcggggggggggcgcggggggggcgcugcacccccuugccccuccuucccuuaaaaauuaauucauuuuguugcuuuuuauuccugucacguuuccuuuucucccuuuuacccucccuuucuacucccucccuuuuuuuguaaauugggucuuauuguucccuuugugucccuaauccaccuuacauaaauccaaguggauguagcgggcuuuucucugggguccgggaggagaagggagcacagcuccaggcgggaacgacccgggcaaggcucuacauuuuagaauaauuaauagaccccaggaauaaggaucuuucggagagcuagggcaaagggguugguuuuuagcuuccuggauuugagggauagaaugagaggaggugggcagaauuccagguccugggggugagacagagaguugggguacucgggccgccaggacaggggccucccauucccaccccucccccagccugaagagccagccucccugaucaaauuaauaacccacagggugucuuuuagaugggccuuucgacccccaagccugaagaucgugcugggaaaggcaguguggauagguuucgaauucauugccccucuuucaaugucguaggcaccugagaaggguaccgcagcucuagaggcgucuucucccuuccccccuagcuuggaggccgaauguuagguguagcgcaagcauacuaaauccauuaggcagcacuccauaccuaaaauucaaaccagccauuuccuggagguggaggucucaucucgcuuguccuccaaaggaccuacgaaaaaagagacugcuucagugcguuuuugcauuuuaaccuuacccuucuggcaggccuccuugcuggaacucaagauauuuaaaaagcagagggugcauacagugggucuguauuuauuuggggagggggggcauaaggggaggggggagagccuuuucucugacccuucggguccuucgauagcauucacuugugggucugucaccaccacuggugaguuauguggucaucugaggcuugcaaaaacaaauacaucuaguagauagcagacauagaugaaugcagacuuugcucucugguguugcuguccuacauugauagauuuguuuuguuugaauugugcuugagauaccucccuauucauccuuuuuagggggaaaaaacugaaucaauuggguccucggguggaauuuuaaaugcuaagcaaguuaaauaaauaagaaccugcagacuuaaagaggggagaggaucaugugaggagugguuauuuacauaagugggcccgaguuucgguuuugaucagauuggcuauucgcacccucaacacauauggaaacgcucaggcaaaugguuuuuguauuauuggcuuuuugcgauuggaaauuaaucuauuuuccuuuguuuuuuuuuauauuuuuuuucugcaguuacuuuauuggauuccagaucuguucagggagagcuuggguggauagcaagcccucuggaaggagggguaaguucugaggccuucucugaggcaagaggggggaaaaagugauuagccacuuucugagagucuaauggcuugauucuuggugauguggugagggggucagauuuccgauguggccuaugaagugaauuacgcuuuguuggagaaaucuaauacucccuuuggagaguucugucauggaagagcuagaaaccaaaagggcagaaaggggcuucaaaauuaggagauugguggaaguauagacuuagaugccuauuuaaaacuaaaauaccgacaagaaauacgaucuggagaccaaauuagaauuuaugccuauuacucugguggucauggaguccuggcgggguuaauuuuagagcaauuguucugcuuccagcugaagaaggagaauaaaaaagauagcagaaagaaaacaucuccaauuauacacaccaaagcagaggggaggcuggccuccuuaacuugugguccuaaucugaaaucagcugcuggcuaaggagguuucugccaggggcuuguaaaucuagaguccuccaggaucugggcauucaauuugaaaguuuaagcauuuggagccugggucucaguacacugggguugcauccuccuucauaucucagcuagggaaauuggagaacuccccaugaccaauuccagcagaagaguuccgugcuuggcugccacacccuccucccuucuucccccugaguagcaggucacaaaugaaucgguuacagaaagaagucaggacagcuuguaucacugacgaugggccccgcauugaaauaacucacauccuuuaagaaaauauuaagcaagccaucugacccugacaugugagauaguuuaugacugagucaacugaucaaaaacaaugaagaagcaaagauuaggagucuugcuaggcaaacauugugaugccggcaccccagggugguguuccacacccuugaagaaagaauuaacaaacaaagcaucaaaaagauucauagacacuauuauacaauauguguuucagaacuaagaaugggcaauuaaauaaucauuaaaaaaaaacugagaaaucaaagcaggcccugcaauucaucagaaauaaaauggagauugcccugcguuccugucucuuugccugaacuugacugcccuguguuuguuggcuugcucuuugacaaaaaaauucuauucugucucccaaaccaauuuuuuuuuuuaaaccuaagagagggaaagcgauuggcaggccucugguaguguagacaggcuguauucagugcugagugcaggcaauugcccucauccuuugaaugugaagaaagaugcagcuuuaucuugcuccgagucagacucaguguugauccuagacucuggacccuucacugggccacaggaagcuuucccagacuccaccaggaguuuuccucccuggguugcaguguaugacaaugacaacuacuagccaacacagcugaggauggagagccgaggauggagagccugaggauggagagccugaguuguagaagccuccuuucucuuucucccugccccaagcaugaagagaggagacagcuaagaccauuuucaaucuagccuguuucacuaaguacacacuuggccucuguaaaaccaaggagugacauauuugaaaguacagucuaugaucuaucugguuuccagaaaacauuuguuggaaugcagacauuuuuucuccucucucuguagaauugcugaaagaguacuuagucacauuuucuagacacaaaacguuuaguuguuuugaagucucuguuuaaaaaaaacuaaaaacaccaaaaccacuaugcauaguuuaaugugcacaacccagaacuuucuauggacuuggguacucaguuuuucuccugcaucauuaugaggugugugccauuucagcuauuauuauaauuauuauuauuauuauuauuaugaggucagacauguaguuuaaugagcauacaucagaauuggucauucuggaggaacaagagagggggugaugagaaagaaaggcccaaugucacaugcuaucuuucccaugcagaaccuacucacagacauguaauauucauacauacauacauacauacauacauacauacaugugugugugugugugugugugagugugaaugagacaugaaaguagauugagcaggaaagagaucagcaaggggaggugucaucagggguugcagagcaaaguuccuuggcacauauguguaaaaaugagaugauaaaaccuuuauuuuauacacuaaccaacaaaacaaaacaaaacccuuaauuuaaaaguuguuuaaagauagagccaccauugagaaaacuugucagcguugaaaguucaguuaaucucuguuuuuaucauugaaauccuuuucagguuuagaaugaaaguaaauucugaggcuccacuaacuagaaguggauuuucuugggaaaauccaagucaaggguacagacauggggucuucuugcuuguucaggacuccguccuugcagacagaauauuuuccugucuuuguuggaaacuggaggguugucuaccaauggcauucacuuggaacauagucuuuuagaaacucuuaaaagaacccaacuucccagcaaccccaaguaacacaagagaugcagucugagauggcucagacagcaaucaggaagaacaggaugaugguggaaagggaaggcuggcuccugcuggcagcuccucuccggcacuccuuucugacagugcucauauaacugggugugcuguguucuguggugauuaugaaauaagcaacuaaggggagauuccugacugccacgggucacagagcaauguauuaauacacugcagugcaggauaaauguucaccccucucugcacuuucauuacaagaaugaacgcacuuucccaggucaucuugguucugagaugagaagcaugcugaauaggcauuuuugaugcaaaaucaauuuuuagauuugcaugaguucucaaacaaguaaacuacugauaauguauuaccuacuagauuaauaauaaugaugaugauaaucaccacaggacacucaacaccccaagccccgacuuucacaacaagagcagaagaaucaaacacagaauuucaugcauuagggcccuucauaaauagccuuucuucccauuaagaguuuccccugcaaggauggggaccuguugaacgauacauuaggauacuccauagagggaaugugcuauuggggaauacacauuuuucaaaacucuccuuuuucggcucuaauuauauuucuguuagguacuuaagcugauuuaugccagaucuauaucaaucugcauuauuuuaaauguuagugaagaauuggaggccggcucaaagucuagaaggagcuaggguuuagguguaucccaaacugccucucugauuuuaggauuuguuuuuuuuuaaacucuaggagagggugagacuuguacuuugcucagaaugagccccucagcauggccauugcccaccauuagagucggagcgagggucaggaaguagauacaaccaaagcagcccagucuccuuuuuacuuucuugccugggcuuuccaucauagacgccucuuacaauuuuacuuuaacuggcagugacuaauugcaagugaagcacucauucauugacucuguuuacuugugugugugugugcguguguguguguguguguguguaugugugugugugucuuguaaaaauaagaaaaugugcacacuuagcaauucagugugggcucugaaaaaaaguuuucuauucccgugauaguauauuugagaaacacagucaggaaaugcacuauuuacccagguuugcugaaaccaggugggauuuucuuucuuuuuucccuuuuuaaagacuaggaauguuuuaaaaaaaaaaaaaagucauuuaaaaaaaagucuuaaggagcaaagcucugacaggaacccaccacuaauuaacugauaacugucuuccuuuggcaaguucaacucuuccugcccuuaauuugcagguuucuucuuuagugguugaaacaaauacacauacagguuuuuuucacuuaugaguaaauguugccacuuguagcuggagcucuuguaauaggcgaauuugaaguugcuggacuacagcaagaacugcugagaacacacaagcaguaaauccacuguggcugccuuucuguuucaggcggaaaagugaagcaaugugggagggggaggaagaggagggucacagugaggugcgggaagcugggggagggcuuucuuaauaaaauagcaaaauaguccauaagauacucccgcccguggaugggggggggguggggggcgcacaguaauuuucuucuucacucuugaaaggauaacuguccucagagugugaaauagauuggaugaaucucugaugagacguucucauugauaacguuuuccucuggaucuuugcagugggaggaagugagcauuauggaugagaaaaauacaccgauccgaaccuaccaggugugcaacgugauggaagccagccagaacaacuggcugcgaacugacuggaucacccgcgaaggggcgcagaggguguacauugaaauuaaguucacucuaagggacugcaacagucuuccgggcgucauggggacuugcaaggagacguuuaaccucuacuacuaugagucggacaacgacaaggagcgcuucaucagagagagccaguuuggcaagaucgacaccaucgcagcugaugagagcuucacgcagguggacauuggugaccgaaucaugaaacucaacacugagauccgggauguagggccacugagcaagaaaggguuuuaccuggcuuuucaggaugugggugcuugcaucgcccuggugucuguccguguguucuacaagaaguguccacucaccguucgaaaucuagcccaguuuccugauaccauuacuggggcugauaccucuucccugguggaaguucgaggcuccugugucaacaacucagaagagaaggaugugccaaaaauguacuguggggcagauggugaauggcugguacccauuggcaacugccuaugcaacgcugggcacgaggagcagaauggugaaugccaagguaagaacagccauacuguacuuuucauuagggcuuagugcacguaauuaaaucagagaugagacugaauggaguaaagccaguaauuagcagccccugugggauguacugggacagagggaucuaaugaguaagcgcuguagcuccagguggcaaggcuaagacauuucuaauacggagaaaacaaacgaugcugcuguaaucagcagaaggccaagcacauuugcuaacaggcacuuagaucccagccggcuugaugccccuucugaaaugcaaaugaacaagcugaaggacccggcuugcuugauccuugcuuaaagagggcagaaaaccuuuuugagccagucucccgacucagugaaaauagcaggacgugugcgagcgugaaggaguuaaacgggaaccgcacguugacucaccaggugcccgcccacugauuacaauuaaucuguauagagagaguacuuuaauuuuuuuucugcuucauggaccaguggagaagugguccaacagaguaaaguaggcggugcuucaagugccucuguuccaccuaacaccccuugaaggguuugaaagcaaaauuaaucuugacaaaagaccucuucauuucuuuuaggagaucauaaugcgguuagugggagucuccugauuugaucuguggucagaggcagugaugauaguaaucugcgauccauuuugguuaugggguuuuggaaaaagaguguauuuuuuuuuuacugcauuaauuacaauucguuauauuacuaaagugauuuucacccaucucacacaaaggagcaugggaauuucguuccugacuuccucugucugucagagcagagacgggcagcuuagcauuuacauuggaguuaaggaugagagcaacccauuuuauagcucuugcuuguaucguguauggauugagauguccaaacaagccaguuauccuaugucuucugucuugcuugguagcagccacagucugcucccuacuccgcaguggccauagcuaaguagugucuccagguuccagcuauggaacagagcaggugaaucuccuauuaguuaggccucgggguucaccugauuuggugauuaaagagccuguaguaaaugacugccaaacaauuugucuggcaucucaggcauccuaaugacagggugggaucaacuguaaggcauuccacuugcuagaccuugagucugugggcaucgccgcaagaaaaaguacaggauggucauugugguguuauccggucacgugauuccgcuuugagagguuuuucuacugauuugcuauaguuauuucuagaaguggcugucacugauaauguucuuuuauuucuuuaucaauaaaagauaaagauugauugucuuauuucccaagcuaaagugucaacuugaaacuaugcaagucacacuggaaaguuaucuguaaggacacgucacagugcugugugacuugcuuuugacuuagagaguacuugguaaacuuggacagaguagaaagccugcaguauauccugguauuugcaugagaaaagaaggguuucccuugucacgugggcaagaaccacaccagcuauagcagacagccaaauugcccaggacagaaccacaccagcuacagcagacagccaaaugcccaggacagaaccacaccagcuacagcagacagccaaaugcccaggacagaaccacaccagcuacagcagacagccaaauguccaggguggugacacuuucuagaaaagaugcuucucuguuugauuuuuuuguaaacugugacuuuacaucuuccagaggucccuguaugugauuguugguccuccacuuccugcuaacaugcucucugccagccuuagcucaucucggucuaccuaaugccauugauuuucaguugucauagauccugguaacucauauauugcucuaucuccaacuccuugacaucuuuacaagccaaguuagagggggaaaggagaaaaagagaggggaugaagucaauggaacauuuuugugguucacuuuauggaacuaauguguguguuuguguguguguauguguguguucauucugugauauauggaagggacagaaccaggagcugaacucugcagacccuguccauuucugagcaagcugucuacaaagguaguuuaaaaauuaaugaaaggggcuggcuggugugugugugugugugugugugugugugugugugugugugugugugauuuuguaagggccagaggcagacuuacuuacugucccugccgcauucucuuaacacaaggucuugaggaacccagagcuagcuaggcuggcagcuagcaagucccagagagccucuugucuccacucucucuccucagagcuggggucacaguucugggugugcuauaccuagcuguccuauguggaugcagaggauuuugaacccuagccccugguuuggcgaauuagagaacagggacucucgagugcuucauucgguguuuugagacaaaucgugcugagauggcuucagauugacugagaauggcauugcacuccagagccuccugucuuccauuuccaaaugcuaggccuaugugugcgcagcaccgcccccagcagcugagucauguuuugagaacuugguguuuucaucugagcuggggaaagggacuguguaaguuagauuugaauuugcuuuuuccccacacuaaguggauaacucucaaggagaugcuucaagcacgaaagucagucauuuguuuuuccgugucugcuaagcaagagucucugguaaauuuagaaaagaaagaaaaacuugaaaaagggauuucugaaauucuaaacuugagcaagacuuuaaaaguagauacagcacuguaaaacucccaggagaagaaaaacaguugaccuugguugacaaccuaacugggcccugagcauccccagauaggucagacagguguggggacuagggacugucucucaguuugauaguuuggcgauacgaccuugaucauauuuccuaagccuugguuuguucagccauaaaaccgaacgauggacucauuauacuaaacuuacaaacuugccaaaggacuccaggcaucagaaguccccuugcagaucagaaacacuaaguugguuggacguguuacuaucacugucacuugcucuucccaaggucaaagcuuuugacuugggaguuggguuagcauaauuaaucuguuucccagccacuaucugcagucaaggcuaaagauggaaaccagcccuaaauccuucaugaaacccccuuuucacaucucagaucgaaaaucauuuaaaggguguccuucccuucucccccaaccuuuuuucucuauuucuauagcaaagaacuuuucuuugaaugaaagaccagugauuugggggugggacaagaaggggaauguaaagagagcuuaaggagaagcauaaaggagaccaggccagcuccucacaagccuggcagcaggguccuccccauugucuuuucaaugaguccacugcagcaggacaaauagaaggacaggugaaaggucaccaacuuccucauccaucuuccucggggucugagaggucagagcgaagauugauuaagauuuuaaauguuugacaaaggcuccuugggugaaaauggccagggcgggugggggccugggguguaguguugucucgagucuaacccuggucauccucuagaguccucaagagaccuuggugacagugcuacacuuccucuugccguucuuagagccaacaguacaugcugauguaagagggaugcggucugccuggaaggugucaagagccccgggagaugcuaagcugacugaagcagcugcgaguccauugugcuguggacuagcgcgaucuaaaacgauuugguuugguuucacuaggacaaugaagagugucagccacuugucuguccucaaggagagagacuaacuauaugacccaguuagcccaggcugagggccucaaugcagaggauaaaccuacucccuuaguuggcuucccaggguuaguaggauuucaaagaaaaaucaagauauaauguggucucuuucugugucuggggagcaaagacauguucacacuugccugguguuuagggcacaguuccuguuagcucagaaaacugagcagaccaaaagacuuauaauauuuuucaaaagaugaaaagagagacccagauuuacucuuugagaaguacuaauaaaaauauuuucagaauguacauauaaaaaaauuaguaaaaaagaaaagauucuuuaagaggcaaagaauuauagaagugacaaaauuaaguuaggcagaaaucuaguggccugggaguauaagucagggcuagagcauuuuccuagagcagaggagauugugggguucaacccuagcaauaaaaacaaauauacuaacaaaccaguaugcaaaggcauauaaauagcaacuaugaacuaaauuauugauguauauuauaucauaucacauguguugucccgaacuguaucguucuauauuguucuauagcauucaucaagaaugaaugguauagaaaugacauggcggcuaugaaauugaaauauuguaaauguauccucugcaaaggagaaaaccguaccacaaagggcagauagcuguguuuuucugauacgugauaggacugucagagaaagaagcgguggacagaaggguuucaaauauaguucagagagccaccccccgaaacccuuucguuuuugaaaauuuuucuuucuaccuuugaaucgugucuuuaagaaucaauugcuugacucacgaagcggcuuuuaucugcagcuuugaagcgugucugugaucacucacagaccuaauucuuuaucucagaggagcaagguuuaauuauuguccuuuuucuuccauaguccuuuuuuuuuuaauguuuuuccccuucauugugugacuagguuucuuuucugagcaggggauccugagcuggucucuauuuuggguucagcaaagcgucaccugggaauuaucucagucagggauuuuugaaauacguuauuugagauuugaugacuuauuuuauucuaacugagcuuccuugagccuuucaaacgugaauuaagacgucauuauuuuuauuaauacuugagcugcuaggaaaaaggcugauuaaaugguuuugugguugccacuguguggagcaaauguggcccugccugguacaacuggcuuucacguccuugaacuucacugcgcuuagcuuuuuuuuuucccccucuuuugcuuuuaguugaugaauucaaaauuaccaaagaauugcacacuugucagaaaaauucccaguguaggcuugugcaaaguaaaaagggagaacugcuccccccacacacacauacacagagucacucagguuucaaaccuacuccagagccaccaucuucacuguguggguagcccuggcuaauuugguacucuauguagaucaggcuagcugcaaacucaugaagaccuaugugucucucucugccucccgaauacuguuuaaaaacgccuguagcaccaugccagaccaauaucuuuaagcugacacuuuaacuuguacguuauccuuacaguuuuuacuuagaaacaguugaugaaccacgcuuuguuaguuuucugguuuugucuugaacagguaaauuuaguaaaacucuuugaggauguaaguggaugagugggguuagugaagucuauccaagucacugccauggugacaaucaauggagcagaaggaaucucauuaaauguucauugaaugaauuaauaaguaaacaaacgaguacaggauucuggccugugucguauuaaacauuuaucugggagaauuauauuucaugggguacuuggugugcgggcuaaugcaucaauaaauuccuaguuuauguguuuguacuucaguuacauccucagucuuuuugcaaacgcgccaguuuuuucauuugcuugcauuuggagaucucuuccacgccauccuuugccuuaaccacuacuacacaacuaccaccaaccaccaucauuucuacagaugcccagguucaacguuaauuaggucaauuuggugccuccacagcucuacaggccuagaggcucaucccaaucagacgcaaggacagauggguguggugcuagucuaaggcuuuggaagcgccaugaauuccuugggcuuggucaucauggaugagcuugcccuucugcagccccuccuggaaggcagugucagugcgcacaccuccagagucgcuucuuuccucagccaccacaguggagaauggaugagggcgagccauuaccucugggagacucccgcaguggugugggagaaaagcuuaggccuuaaccuuuuguauccuuaauaucucugccagaacguggcaugcagcgcaugacguuagcacggaccuagcauaauaaacugauucaaaacuaucucgagagguugcggguugggugggauuucucucuuugacuuuagcuggauauguaauuaugggcaauaacucaacucuucucaccugguguucauguguguacauuggugauacucagccauaugccauuaaguaugaucuguacauaugagcauuauguguggagcgcuuaucaccagucaucacaggaaaauacuuauuagcacgcgcaugugcacgccuaggcacugugcguacagugcucaaggaaaccagagagcacugaaucccuuggagcuagaguuacagguaguuauaaacuguccaccauggguguagggaaccuuggaagagcagcuaacuagcgaagucucugucuagcuccaaugguagaaaccuuuacuccugguguauguggcuccugguguauguuauugcuguauccgcccaauaacacuuaggucucagcauagagauuuguuuguuuugaaaggucaauggcuucuuuuccagggaggaguagugguuaguugaguuacuacugcugugaugaaaugccaugauccacucuacuggggaaggaaaggguuuauuucagucacaguugcuuaugacagcucauuaucaaaagcagugaaggcaggaaccugaaggcaggagcugauacagacgccaugaugggugggggcuuacucagucagccugcuuucauauagcacucuugacccucagcccagggauggcaccacucacaauggucugggccugccccauugaucacuaagagaguaccuuacaucugcaucucauuuuauggagacauuuuucaauugaggcuucauaaguuauaacuuuaaggcucacccugccugccuccucucuuucuucucuuucuuucuuucucccucucucucucucuuucucucucucucucucucucuuucuuucuuucuuucuuucuuucuuucuuucuuucuuccuuucuuccuuucuuucuuucuuucuuucuuucuuucuuucuuucuuucuuugcuugcuugcuugcuugcucuuugagacaggauuucuuuguguagcccuggcugucuuggaauucucccuguagaccaggcuggacuugaauuuauagaucucugccugcuucugccucugagggcuggauaaagggagugcaccaccaucaccacaucacugggaauucucuuacuuagugaugacucuagcuuguauugguguguauguaugacauaagcuagcuaaaauaacacagcagaguaguaaaguuuccuucuaauuuuauagauaugaauuauuucuuacauguauguacaucaugugaauacuugaugcuugaaggggccagaagaggguguugggccccucaaacuugaguuagggagaguuugagagucauguggguuaaguguugguaauugaaccugagaccucuggaagaacagucaguggccuuaccaacccugagccauuaucucuccagccacaaggcugcuuuuuaccuacguugauaacaucacacauacccucuuucuaagucauugguuuggaaaugugauccguauggauucauaugcaguaagacccuuucacuuucuucauucuaagauauugcuccugccacucauacucuugggagagcaauagaguugucuggcaugcuaucugauugaguugauuauagagccagauuaaaaauccaggugucuagcacuaagucuggcauuugaagagauacaaaagaggaaaacagauuaagaaaguuaugucccauuuucucuguaaucuuuuuauuugagacacacagguuuuguuuugggguguauuuauuuuguuuucauuaaaauauguuguuugucuuaacucgaagugggcuuauuugcuuccuuucccuccacccuuuugagaccugguaucacuauacagccuuggcuguccuugaacucacuaaguaagcuuugaacuuguggcaagccuucuuccucuacuuucuaagagcugagauuauugauauacaccaccgagucccacuuguuauuuuucagugauuaaaaaucacaaaacacugggggucagggaaggcaguugcugucaagucugauagccugaguucgauuuccacauaguggaaaaagacaauugacucccacaacauuguucucugacccucacaaggcaugaaagcccugcauacacauaaauaauuaaauuuaauuuuaaaaaugcuuuccaaauuucuguuugccuuuucuagagguagauacagacagcuguaacucaucaauugaagugccuuggcauccuaaauagcuuuuaagaggagagacgguuccaaggccaagaaguuggagaaccaaugcaggagucaguccaugagccuuuuuauuugggcagucagacaaucuggagugcacuucugucucccgguggcuguugagacauguuacugauuuaaauggauuugggaaggucuggcauggcuaggggguggcgaucuuuuccauaauuuggaagauuaugguaguuuguuuggaagaguggcauuucggucaaccuuauagaugcuuccauaaaauuaggcagcaauuuauagcucuucgcuucuuaaaaacugguugucuguguccaauaacauggcucaguguucucuuuagauuuauuauaagaagcgaugauugaggaagacccagggaagcuggaucuuuuucucuuggauuuuuaaacuccucucauccuauuguguugacagcagguaccucugagcuggaaagggaaggaaaagcaggugaggucacuugguuccaugaucuagaggguaauuaauaggccccuaacuaaauggacauccuaugaauauucagggucuauuuugccuuccugggaaacaggcauguuggaauggcuuucuacuccccuuggagacacccggcguuuucggggugaaugcgggucgucagcugucugccuggcucugccuuuccaggcagcaaauucucauuugcauauucuguaugcgccuucaugcaaaacagcacacccauuucccccuuccacaaaggcaacuagggcuugccucuggaaaccccagccagacucgcagucuguuuaugcagaacccagugaguuagacaccaugcaaaugaauucggcuuccauuugauuugaaugcuuccagagacuaggggguuggaggccagaguggacuguuugcacugggcgcuuugugugcggagccccuccuccagggccaugguugucaacucucuagcucccccugccccaugcaaaauaaccaaagccccugcugcucauuucauuuugaccuuugggaaaaggaccccagcucuggugaauccugagacuuguccuuagugacagcuccaguguggaaucuugcuguuccuucugaggugggaggagaugguuauuuagauuaugcuaggaauguuuagaaguguucccacagagagcuucagaaauuucugaaggaaaagauaaaaauucuuuguaagaguggucaggucccaggaaguuccaaaaauaagcuuuaggccacugauugguccauucacucauucaacaaauagaaguguaucggagacaaaucuuuuaucugcaguucuguaucuaugaaugaacaccccaguccuugagucuagaaauguuuacuuauuuucccaguaacauucuccugacaaaaguauauucaccgcacaguauauucucugcacuccuguuuguaggcugucuuugcauucaguccuuuucuuauuuuccccaaaucuucaaauaggcccaaguuuuaccuuauucuuucuaaaacagggaccaaggcccauugcuuguuuuacccagcaaucgucauccacauuuauauagaggaggacuuuuguaugaaguaguuucugaaguucaacuagucucgaguuccguuaauuucacaggguagaaaaucagguccagccauucuccagcauccucauuaaaguggaggaaaggucagccaacaagauguaaacgggguaggggaggaggggggagagagcuuuggggaagcucgucugcggucugacagaauuuggugaugcugugcaaaguccauuugggauggauuaguaggacuaaaguucgaggagugccgugcacuugguguguucucuggugucaugauggguugagaaaguucagcugcuggucuggcucuuguuucugagcaaggguuuaaacagaccugcauuucucaaaggugaucuucccaaccuguucauaauaaguuacagagcucaaagugcucaaaauccuuaaaacauguauaugaagucaguugauugauaacgaucauuucccgcacaaguacagauauuucccacaccaguacaaagccaugguacaguuuccuaauuacccugauaauccuguuugcuuguauuuuuuaaacuaugaagugcuggguaauuauucaauucuuaauagaaggcaaauggcaauguaaacaauaauuaggauguuagacagacuaaugcgcuucaaagcaaauuggauuuuuuuuuucauaguguucagcaugaagucccauaaaacuaacaauuuagaauggaggcagaaaagguccuguuuuguucauauuuuauggcgguaucucuucguggcuuguuucuaugaauagcaguuugccccacugaagccggcugugcccaagccaaucucacaauugcuucccugcuguuugacauuuggcuacuuuagcccaggggcuccagcuugggccuuugucugucugggauccaggggucagagguuaacagaauacugauuuucucccauaauaccauggcagguaaauauggcccaaccucaugauuagggaagacccagccagccaggaaugcuuuucucuaaagccuuugucccugagaacguccgugauuuaagaugcccaguuucccaccauugcucccaagcagagcccuacauucucuugugugugacgucacugucacccucuaaaucccauucauaacuaacaaaacccccaagacacgugaccugaaaucucccagcagaaaaguauugguuuugaagaauuaauuucuacaaauugaauaaugcacuacuacuuaauagucuuagauauucacguuuauuggagucuuaucuguacuagguuuuaaugauuaugcauuuaacugaaaaccaagacaaggcaauaaacaaauauuuuaauaauuugguuaauucuccaaccccucccccccccuuuuuuuuuuugacuagccuucucaaugugugaacaguuacagguucaguuaaacaaagaauugguuuuauuuuguuuucuacaucccuucucuaaggaaauacccaaauguuuaucauuaucaauguuacuaauguuuuacauuauuguaaucuuauuagcuuuagagcaucaacuuuucuccccaagauuaauggcauucacuagguugcaccuucuuugguucugaggcacaggaggcuggagauguuuaaaacauuuccaacugggcaggagaguugguucaguguuugaaagcacuuguuccugcaaaggaccauguucugauucccaguaccugaggggagauuggccacuuccucgggcaccuccgcaugugugcgguaccuaugugcaggcaaaguacucaugaauaaaauacaucuaaaaauaauuuuaauaguuuaaacuuacacacacacaccacacacacaccaccuuucucugucuugccuuuucuguuugaccaaccucuuucacacugaacugugaacuugguccuuagaugcauuuguuuucaguuuugaguguuugaaaaagacaucuccagucugaaaaacaguuuccuuuugaaguguccguccuggcagugacugaagcagccucaggcaaauuagcauguuaaaagaauggaucaauaacuucucuggcuccuccacccuucuugcucucuuccaagggagaguuuugaagaacucuaggaggcccuugacagaugugccaagaggacgaggauagccaaguaggggguagggguggggggacauugacagcuugaucuagugcccagcccacgucugcgcuggccauuuggaaauggaugcaggaggaauugacagcuccagaaagcccuugcaguuuauguaauuauggagaggauuagaaggaaaguguugggagagauaaacggucgauagcuggcgcuccucaugugagcucaccugcaucacuccgauuuguugcguuuagucuugggcuuugagaagaauauuucacaggguuguuuuuccuuaaggguuguggaagccugugcaugaaaaauguagauaggccagcagccccuacuggguuugaaaagcagucuggaagguagcuaacacaaucaugcuaugucuuuuuaccauccagaggugcugagaagaauugaaaguuuauuacuguuuuuuuuuuucacaguaauuccuagaucccucuaaaccaaugguucucagucuuccuccuuuaaugcaguuccucauguuguagugacccccccccaaccauaaaaugacuuuauugcuacuucauaacuguaauuuugcuacugcgaugaaucauaaaguaaguaucugauaggcaggaucucugauagguugagaaccacugcucuaaaccccuucuuugggaaacuguccuuguuuucaucccagaguuuaagaaacuagcaucaaugcaguccuauacgagguucuguggauuuucaaucagaggaacuugugggaggaacaagauaggccuugucuuuuugcaaaggcaggaauagcauuuuaaauggccucaaguagaagaggauagugaaugggugaaauucuucauagggcaaacaugguggcuauacuaacuauaguagcccucagcaccuaauuuauuguccugauaaaggauuugaagaccuguuuugauaagauuuuggugcuauaacuauuuccauagcuuuuacacugucgcuauagaucuguguaccuggacuucggaugaagugugugugcauuuggaugaaaacgugguaaaaaguguguuagcgaucuuagcuuuccagccucccuccuaaagagacagaggucaacuuuuaagacuuacaagcugcucuucuagagaacccacauggggucucacaaugcuccugaacucuaguuucaggggauuaauguccuccucaggcuuccauggcuaugaaagccaccaggcacacaaaguagugcauaggugcaagcaaaacaccccuaugcauaaaauaauagaaauacauauuuaaaaauuaauaacacuaucauguuuacaaagauacacugaaagagcuccuacauccccgaaaggauuacuuaugucugcuauagauaaugaagaaggaacacaagcccacugaguuuuuccaauauuuuccauuauaucuucuagcugguuaucauagaucuacaggaaagcuaucgauuuuuguaugucuuuaucuuacauccaaucucuuuauugagcucucacgugaauacuaaucgggucucaguuaauacuccaggguucuuagagaacaaauagucuuuauugcaagugauuguacuuauauuucuucuucccuauucccaaaauuuagaccuuauuuuuaccuuaaaauauucgucagaauugcugggcuauuaaucaacaauaaugaagacaaagaacacuuguucuuuucuuucgauuuaauggauauaguuaaacugugccaaauuauuuucuuacuauuauuguauuuuuacguuuuuguuuuguguuuguucauguauguuuucuugagacaaagccacacuuuauagcccagacuagcguagaacuuuccacuuacccauccugucaucauugaugccacuguuacaugaguagauccuuaaguuuuaagaggaagaagauaaccagguuguuaaacccaggggcagaucacaggccaaacuagucagagccagaaauguaaauaaugauagauaggcaugcgcuugaaaaaauauuuaauaucccaucaggcugagguacugccugcugcaugcacagugggggguggggugggugcaaccucucugauugugacacccucuuauuaaaggagggagaggagauggggagaaagcagagagagacugagaacagagggugacuguagaaacacuggggcgccuucagcagcagcuuugacaaagugauuuguggauuuugaggacuuggagguuucacuuagcuaaacaaauuacuccguaggccacagugagugcagagauccccagaagauagcauccacugccacacagggaaggaaaggggauuuauuuuuggcacugaggauugauugaauccagaacuuucuacacucuaggcaagucaucuacccuugagcuauaucugcaucccccuuuuuaagccuuuugagucauggucuaguuacuaaauuacccagaaugaucuuagaaucacucugcaguccagguaagcuuuggauuugugugcaggccccugaauagcugggauugauugcaggccuggaccacuaaguuuagcuaugucacuauuucuaauuaaccaagaguacagcucaaucugccugucuuuuguuugugcacacauucacacuggcuagaugacccuugccacccaacgguuucugugaauagggacccggagaccucuguuucucagugggcaccacugacaaauggggcaggacccacuuuacuagguaauucucaacuaagaauuaaaugaagaucuaccugugggaaacuccguacuuccaguagucacugauaacucagggugucaucccauagucacuguaauaggccaguaaaacccccuccccauauacacacacaugcacacacaauuccuaguucccagggauacauauucaucugacauauauacuuauagacagaccuaaaaucuagaagaaccuuuauaacucuaagauucuaagaugaauguuuggggcacucagcucuaaacauauccuguuucucagaguagggaucuugguccagggucuuguuauuuagaaaagaaagagaagaugcucuucugucgaugccagcaagaaagcuguuauuauuuuccaaaaaccaaauggugcuccacugggaguuuccacaauaaacacacauuaauagagcuggaaaauguuguuguaagaaauuauuacccugugcucuuccagucuuagcuuuuuuaguccugaaacacuccuagaugacagguacuguauguauccccagauaaaaagcagaggcacagaaagguccccugggccaggcagacucuucuaggaggcuugcagaaaggggcagcccagccuccaggcuccaaguucuccaacugccuaccaugcuuucucuggguaugaucugcuauucugucucccuuccaucaucuaccucuguaugugugugcaugcaugcgagcuguguggaggguauugaugcaugcccaugugugugugguggcccgagaaggcuguuuuaagugucuuauucuaucaccauaacaccuuauucuuccaaaacaggaucucucacugaaccuagggcuagcuagaagccgacaaaugccaacaauccucuggucucagcccuacgcagcgcugagguuauagguaugugcaugaccacgcccagcuucuuacauaggugcuaguaggugcuaggauccaacucaguucuuuaugcuugcccagcaagccacuaagacauuucuccucccccaaccccacccccagagaaaguucuucccaucuuaacauuuguaucgcagaguaaagggaugauagguuucccuugaauuugccuacugguuggaaauuucuguucauggucuagaaaaaaagacaaagaagcucaaggaagggugguuaacuaaaugauuuuuuucuucguuauagauuaugaccuauaaauauuaccuaaauaaaguaccuguuccucccccaaguuguuuuuaaucagauuaucuuauuauaggaacagaaaacuaaauagaauaaaaggguuuccauauugugugucuccccacaugccugggacuucuucagugguuuuauguauacuucuucaugccugcaccagcagucugagaccucuauacauguauguauguauguauguauguauguauguauguauguauuuuuaagugugcagucuuaacacuuuauauauacauuguauguauuuauauguguaugaagucauugaacaaaauaauuuaguuuucaucucucaaucaaugaucuauuucaacugauuaauauuuaaguagacuauaacagauuuaauuauacucuuguuuuauuguguuagcauagcauggaaaacucuccugucuaaauauagccgaaagccacguucaggggagcauaugaaucacacaguuauuggguuugaaaacaaaucacaaauuccugugguuuguuaaaauguggaacacccgacaaauguaaaaauggcgaagucaucaccacucuuagcacagugaaggaccgagcauguccacugguuucugucugggcuuccagacuuuacauacacuuuguauuugaacgcacauacaagcacgugugcacucuuaaauuuguauuauuuucacauguaaugaucauaaaaucuuuccugaucaauaaguauaacuauugcauaguauuuuauagcuguaguaaguuuucugugauuuggccuuucuuccacuucucuuuuuuuuuguauuuuuuuuaccuuuuaauuugugugugugugugugugugugugugugugugugugugugugugugaauaagagauguuuuucuguguauucauguguguauaugaguguguuaucuguuaucugucucuccgccuuaguuuugagucagugucucuuaaagaaccuggagcucagcaguugagcgaaagucgauuuuaaucagcucugagccuccuaauacccccaccacuaccaccgaauaccuguuuguuuguuuguuguuuguuuuacaugggugacucaaaccaaccuuguuuuuauuuagucacugauuauuuuuuccccccaauuugaggcuagcccucccuggcuccuucaguauccucagaaaaccaugaacuaguuuuuacuauuuucaaauaaucugaacuauuugauuuaaauauguuuauuguaaaggcuuucauauauaccaaaaaaaauuugagaugcauguuuaucuuggauugagacaaauguagugagaaauagcauaaauauugggucaucacauguuaauuugcaugcacgaguuauuaacaaagagaacuccaaaguaaaggagcucuuuuuuuuuuuuuuaacucauuagcgcuugcuuaugagaaaaguucuucuaagucuuuacuuuuucaagauauuuagcaucaaagccuuuauucccuuucuaaaaauaagaagaucaauuaauuuuuaaagcuuguuuuaaacaaagguaggauuccucgucuaccugugacaguuguuggcagcuaccuuuuaauauaauggauuauauguauuuuaaguugccugaugcaaaucauugcuucugacucuuggagcuuuccccgccuaaccaagaugcccugaaaguucagaaacgucagcccuucuccaagccauucuucucacucgaugaggcagauuguuuucauacaauagcuugggccuuguggccuaacaguuuuacaaaaugccugcaaggguuucaccaaugagagagaaaaaugacuucauggcuuaaguaugaacuuaaaaauacccacucuguagaaaaugggacuggagaugucucugacuugcguaacucuccuuccuuccuucuucccugacuuaagugcuauuauuacuuuguuaucuguuguuucugugaccucagcaucuauccucuuccccuccggagcaucacugccuugaaacugggucagccaugugcccauaccacguuagcacacaccugucccaguuccgcucgcucggcaugcuaaugauccaguuaagccacgcacuucuccuuuuuaaaacuucuugggcuucgcacaagauguguuuccaauugugcaaacaaaauauagaaaaaugccucuccuuuucucucaccauccucgacucucucugacugaggccuuggucuugaaagcccuugccauuuaacgaugaugaagagagcucccaccccacuccaccccaguuccuugaaucugaaacauucauuuauccuucauuuauccucugcauucucagucaugguagaaaagcauauuguuuuaaauuuguuucuacuaaacacaugaacaaauuguaucaucagaguuaauaguguugagcauggaacagagcagagaaagaaauagcucccaacauacaacauacaaacuaaaccuaacggcacgauccuuuuccugguguuaggggugugaagggucccugcugcaggagccucucaguaugaagucucugcuuggaugguggcauuuaucuuuuccucugaugccccugaaggcaaccgccaguggcuugcuggugacguuggcguuucccacccacucacccacugggcagugaauuaauuucaucacugaggcuuucacuaauguuuugcugaggacaagcaguggcuccuaccugcacauggauauucagcuucucacacacucggaaacugcaaccacgcuguccucgggaugcaacacucuuguuccucauuggguccauaacuucugacuguaacccugaaaugcucuguuaauaaucucaucaucccagagccuuguucugaaccacaaagaaacuagaaugugguuugucuugaguuuugggauggcgccuuuauaagaccccaaaagcuuauguucuuuacccucugguagaaguuucaagacuuuaaaggcccucaggguggugguggcgcacgccuuuaaucccagcauucaggaagcagaggcaaguggaucucugugaguucaaggccugcuuaaucuacagagcaaguucuaggauagcuagggauuuaaaaaauaaauuaaguaaauaaaucacaagcucuguaaccacauuagcaaauuaaucaaaucacaguaaaaggguuuucaagaaaacaaccuugaacuugaaaaaacaaaacaaaacaaaaaccaacaaaauaaaacaaauaguuugaagacccccccccccaaccaucuuuccaacauuuugcaaacagacuuggccuuucaucagggucuuuagggucuuuaggucuccugauucuagauuuuucuccaucuucugccgccaucaggaaggauucuggacagcaaacuuaucaaagagguggacuaagcuuuugccacgggaguccgggcuuauacuagaagggagucucuagcaaaggaaagcuuuagagagggauggggcaacuaacugcccugccccuuaucccucagagguuauugccauucagugaugcucauccacuuaacagauucaauuaaaaaaaaaaaaaagcuguauucucaauucugaacucuccucucuggaaaagugagucuagcuuuuuaaaguucuuguuccacacucaugguauguaaauucaacugucauaaaggucacaucaauagaaagaaaaaagguugaucaaaacgggcguguuugaucauuuaaaugguaucgaccagguuauuuaaauuacauauugauccuguuccuuuucccuuucuuuucuugaugcgcucucucucucucucucucucucucucucucucucucucuuucucucuugcccagauaggcuuccuacucacuggcugugugguagcucaggcuaacuuucaccuuaggaucauccugcuucagcauccucacuguuuggauuauaggcaugccccaagaagcuagaccugcuccuguugcuuucggcaaauggcaugucaguaguuagggauagguuggagauaguagggcagugagugucccucuucugucugcugcuauccagcuuucacugaagagcugacaccaacccuucccuacacauauuugcacacaguagccuccacgcaucaugcuugcuugcacacaugaauauaaggcguacaauacaugcaagucuuuuuaccuaaacaaacaugguauauccaccccuucccccuccugcaugcauauacacacacaugcauacacauagaggcgugcauggaagcacugauuacauggucacuucaacacagaaagccccaugcucggagcccugccaaggcuaccucaguauccguucuccccuucaguguucucugauuccugggcuguaccaguccuccuuucauucaguguuaaaugccuuuucuccuaccaggguuguagagugcugcucccuccuuccuccuucuucaaaguauuuugauugcauuccuuaaugucaccuaaauuuccucauaacguuuuaugucacuucucaggacccacaguauuacuuagagaguaagugcacuccauuuauuagcuggcagaguucaggcaagucagagaauuucccugugcuuaguuuacucauaggggaacagcagagacuccaucagacuaguguggagagaaccuaagucaguguguggaguaacugcggucugccugagauagcaaucauucaguacccaucagcucuuacugaucuaccaccacuuccgggcugcugugacucugcacccuucugagaaauuaggcucccaguuagaucucuuuccccuucagcuggacauucuuguccagugaugagccugcacuguagacugagucuacucucuucugggguaucugacucuuacuugucuuugcaucuacuggggugauuaaagcugcaguacacagaguccaagaacucccgagcaaucacugcgauacacagaugggugaaugaggaagggaaagcggggagaugucagugugguuguguuuauuuguaggcaggcgucugcuuggcuuuuguagcauauucaagggcauggcacauaaccugcauguguuacccucuugcuacaauacugaauguuaauaaauuugaaguguaauugaggcugaauuuucuguggguuuauuuaucagaucaaagacuaacuuugacauccagcauuuauuuuaucugccaaauguaaacuuacagguuuaguccauugccaagaaagggaaaaaccaucuaaaauuacauggauucuguccaauugcucucucuuaaagggauaagagggaggacucuugguuuucaucuuucuucagcaaaucuaacugaucacugcaguuaggauaaaaaaaacucuaguaauuaauacaagcucauagggcagugauguauuccggagaaaugacauuacccagaauauacugcuuaccuuuauugaaugucauugauaaauaauucaauugauuuucacacuuuuuacauucggauaugauauacaccuuuugucaugucacuagauuggaauucuuugacaauacauuaacaugccaaaaauaauauugcacauaagaauaauguggaaauaaauuacagguagggcuguaucccuaaggagauuuucauucgugucucaggacagaagacuuacgacccagcucgcacauggcugcuccaucccaggguguuugaggcucuuaguucaagccaauaaaucacucauuuugugcuuacugcauaaccaguuaguucccugucggcuuuccagaugauacaguuuuacccaggaaucuguugacacgauucuagcuuuaaaaagagaagaaugcagagacuuuucuugcaaauaaaucuuuaaaggaagaguuugcagcuuauggcaauggugcuacuauuucuuagagccuggcuggaccugccuucaaauuaucuguaccuuuucuuuucuuuucuuucuuucuuuuuucuuuucuuuuuuuugccaggugguagcagcucacacauuuaaucccaaaauuccaaagacagaagcagauagaucucugaguucaggaccggauuggccuacagaaagaauuccaggacagccagggcuacauagagaggcugucuguggacuaucuauaucuuuuauuuuuaaauauauauauauauauauauauauauauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccggauuaaagguguguuccaccacaccuuuaaucccagaugaaaggcauagcccagauuaaagguguguuccuuaacucggagauucaaucuucuggaauccauagccacuacggcucaagaucuucaaaccaagauccagauaaggaucuccaagccuccagauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccuuuuuccaccccuugauuccuggacccaugaauccuggcuaugggugaaacuguaccauauaucgagcgcugauucaaagcauauacugccuucugaagaacucuaccccagccuuccaagcuguuaccaccuaauuggcgcuguaacugcgucuucaaaaggccauuccaucuuucuaucagaccagcugcuucaggaugauggggaaugugguaagaccagugaauuccaugaucgugggcccacugucguacuucucuggcugugaaaugaguuccuuggucagaagcaauacuguguggaauaccaugacgauagauaaggcauucugucaguccgugaauggugguuuuagcagaagcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaagucagcuuuggugaguggaagcccguguugcugagcccaagcauaaccuccaucucgaccaccguggccacuuuguucaugugcccauugagcaaugacagggauggcuggggagagagacugacuguccacagaacgggucaucuuauccacuugauuauugaacuccuccucggcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucagugaauaaucguacaucuggccauuucuucuuacaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggcuugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaaggaaacuacaucugguacagcagcugcaauuggaguuaccaccugauuuaguuuucgauaaucaacugucauucuccaugauccaucuguuuucugcacuggccagauaggagaguuaaauggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagaggaaccuggccaccccuucauucaagggguuccggaucugcaaacugucucaagucuggaaauugauucacuggccgagauugcuguuuaccacgaucuaauguagccuuucuuucauuuguuugagaauuuuucugcuuauacagaucaaacaaauaugcaguaggcuuccuauguauuucauuccuggaaacaccaugauugauuagccaguaccaaagguccaagcgagucaugccauuauaaauuucaccucuccugugcugaccauuacuggguauguuauuauaaacauucuuuugucuacgcuguccauuauaauaacuaggaucaccuugucuccggugauucaaugcugccaccuggcccuuguuaccucgggauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuauacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauaguugaaagugcugguggaucaacaagccaauuccaguauuuuaaaagauucauccuuguacuucuguuacucuagaaccacuccugguaccaacuucuguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccggauuaaagguguguuccaccacaccuuuaaucccagaugaaaggcauagcccagauuaaagguguguuccuuaacucggagauucaaucuucuggaauccauagccacuacggcucaagaucuucaaaccaagauccagauaaggaucuccaagccuccagauaagggucacuggugagccuuccaauuccggauuguaguucauuccaaauauugucaaguugacaaccaggaauagccacuacaauauauauauauauauuuuuuuuuaagugauuuuuacauuuugagacagaguuuugcuauauauagcucugguugucuuggaucucacucuguagaccagacuggccuugaacucagagaucugccuaucuuuuuccccagugcuagaauuaaaggcaucugccacugcauccaucguacuuuauuuuuaguuauauauagguacaugucuauauguguguguaucuucagugcuugagaauucuacagaaggcuaucagcuacaccccccccccaauaugggugcugcuaacuuagguccccugcaagggcagcccaugcuuuuaaggccugagccaucucucuaggcccagcuuuguguugucauugcuuuguacuucuggguuucccuauauuuuaccacaagaaucucaguguagugccauaauuauguagcccaggcuggccauaaacgcccauucaucuugccuuggccucuugagugcugggaguguaaaugugaaccacccaccauccucaagaaaucaguguuaugguguuuacuuaucugcuuauuuauuucuuuaaagucuuuuucuucagugcuagggaccaaacccugggauucaggugcucuaggcaagucauucucugaugcugagcuaauuuggaaauugaugagucagucucucuguccagaaagcucugguagaauggcugccuaggguuugagacgccauagcuggaacuccucucccaagcucucaacgugacugcagucuacuuccgagaguccugauuauuuacaaccuuuucucaaucaaacaccaaguuccccacuugucucucuaaucuugccugagauucagaaagccacuagguaucugcccuugaacaaguuucuccacucucucuccucggggcccagugaaauacuuagaaugggucaacugccaaugccuuauagcucaaaagaugugguaagagcuuuguauacacuguaggguaagaucaagagacacuagaaauguccucauggacuggagucaucuagaaagacucccaaagggaagaagacuugauaacaaggcagauaaaugcccuagguaacuggaaccagaguuaccugugccacccuggacucuguccuaaaggacuuugaagaacaaggagugagaauuuggucuuuucucucugccaacuuaucagauauucugugguuguuuucuaucucccagccacugagagcuauugauucuaggagguucuuucuguacucuagucagcagugggagaucuuuuuacuccaccagagggaaggccccacugauaugaggauuugcacuguuuaccagaaucuuuguucccguccuuugagcaggccaagaaaagauaagaaaaccuucugagcaaaguugacuugaggguuaaauguaagggauguuuggcuuuuuuuaaacaaaaggagaaaacaacaggucacuguuugaagaggaagaaaaggacuugcccuugguuuagcaugauugaugcuuuauugccuuguaggugagucuguaaggccaguggacaauguuuacugagaucuggaguuuggaacuguuguagaaagucaauaagagcugcuaccuuuucugggugaaaacauaagauaaguuagugggaggaucaucuuaacugaugaucuacuuuucuccagucgcagcgaucugaacuuuucugaaaaagagcaugguaccugguguuucuuuuauccuguuaguaauagaaaagucugugaacccaggggccaugaaaaaaagaacagcauuuuuuuauaucccugucccaagaagcugacuuggacaaucucuucgaagacagaauuugccagugucaugcguguuuagauuagcucuucucucugguaaggaugguaguuaagguugaauuuuaguugaagcuuuaacuacaaggguaaaguuucaagccuucuugguaugcuuaagaucuugaguucauacgcuagcauggaguagaaaagaagggaggggaaauucauuuucaugcaccccuaaaugaagggcaguucucucuccuggggaaggagaguuacagacaacuuaccucaggagacuuaacuguugcuugaggaacagauaauuggaaguaggcugcacagauaagaaaggcugcucaguuugauuauagauauaaaauuaaauuaucaaguaaauguagagcuacuggaggaacagaaguuauggacuguugagagcuuuagagugugcuggcaccuugacuaaggcuauggcagccuccaagugguuguuugccuccuuguaaaaggugaggaggaaggaacacaaccucagccacugagcaggaccagggcaggaccagggcagcaguggauuguuuaccugcucucugaaguguauacguuccucuggggaggaaaacuguggaggcacaugaucaaagacagagucagcacaguguuccguuucggagaaaaacuuguuuagagguaggcugguuguggauuagccccccaaaacuaauagaagccauuaacguuaggagccaaggcagacacaacuuauccaaaccauuguggacaaccagauugcccaccauuuguugauugcugguuagcuuuuguacaaauccauuagguucuacagucauucucuuaggcauccuuaugucuagauggccugacacgaucucuuaccugacaccagguaagagacauaacauggcuggauugcuuucuguaugcaguuaaauucucugcuuacccaggcuggacagaacaaaugagaauugccagcagaaaugcugauuaaaugugcaugugauuuacuucaguauaaaccacagggcgugccacggagaaacugcaggagacccaagucuaccuaucuccauuauacagauagauagauauaggaguagccauggcucugcugaagguguguauggaguuuugcuagugaugaaaauuuuuuccaacucuacaaaucuugcaguuuuuguuguauugcucuuucuauuuuaauacaguaaucacagaggugaaagcagguauuuaaaaucaggaugacuuccuuggaaggggccaggccucugguuccauuuuauauauauaggauagaacuacaaguuggagaccauucagugugcccuggucuauguaucuagaagcagcauugaucuuaggagucacagguggguguagaccagaguuuuggccuuuuccuuucccaagacacaccuuugaacuucugcuuugaagaaauuuccuccucccuugaugucaguuaccagguaccucggcucagugcacaucugugcccuugacugaugcccacuuggggcgggguacggggcgggggugggggguggugaggaggaguguguaauugcuacugccuccgguuuccucauucacacaguacuaaaaggccggagaggcuguggggaagacaagaugcaaggaagccagccugugguccugaugggcuguaacggagguugaaucucacagcaggaagagugcgggugcuuagagaugcagagcugcuggacagcaaaauaaacacucugcuguuaacugugacaagccacauuuuauaugccaagaccauucaguggcaggguguuguuguugagaugguugcuuguucuugauuucucuuaugaucucuuaaguguuccaagucucaaaaaaaaaaaaaaaaaucacuaauuauucacuaaagagaucaaggcaaccagccccagagaaagcaggguccuuucccaagugccaaagcucaggcaacuguaggaaaagcugcuccaguuacggaggccuuucacaaacaucaaagagcagaacagguaaccaugugagaccugucuguccugagucaggaggcaaaugugccucuuuggauaggaaugcgcuuugcauauuucuguaagaggucccgugugccaagugcugugaccagcauguauaacuguuccuuucauacgccacuaagaccugauaccaucugucucuuaagggcucaccuuguaagguuucuuuccacuguagccaggugcuuugaaagcaguccugagcccugcaaugguuguagaucugucacugguuguauugacucgaccuucuagauguucaucaguagcaccagggugccucuuugggcaggaacuagaaaucuguugucuguccuuaugcugccuaguaaucugguauuggauuggugcauggccagcaggcagaucuagagccauaaauccaaguaccaaacaucucauuuguuagacuugucuuuguggguugccugugugcuucccagagagcucugcuguuccccugguaaaggaauggagucaaccauauacaccguggcccaugauguugauugaagacuguguccagcaaccauuugugguucaagacucuuugcuuuaaaagaaaaucaaaggccuuuagaucuauuauuauuauuuaguucagcuauacuguuaggauuaaaaccgacaucuauauaucuaugcuauagguaaguggguagaacuuuuaaccuauuuaaaguuauuuuuuuuuuaaagaaucuuuuauauacaucagugaacaaacaaguuaguauaaaaacuagcccuaauuuagaaggugacuuguccuguguuaccuaggagauaggcuugcuugauuucccuuucugugcugguggagccuugaauuagaauagccuuuguuuuucuauuugcauuucugauaacugagacuccugccuggggcacugcuaacugugcuaaaguucuuuggaaguagguuuugagcugcugcaugauggcccugaccucaagaaaaaagcggaccgggcuuucucaaguagaaacagguuuaaugcuuugaaggaugcaaaacaacuaugcauacacacacacacacacacacacacacacacacacacacacacacacacacauaucauguauauaucauaucacacacacacauaucugauccauauauauauggaucagaucagagguaugcagugguuaaucuauuaauaucuuguagaacuauaaaccucagguguaagcaauuuuucuggcuaguguguagaauuccucccacagaaacuuaacauugccuucccacuuucaguacuguggggcuuugugguuuugguguguuugcugugaucaaguacugugauucuuuucugaacuugauggugacuggguacauggagcugauccuggaccucaccaaaugacccauuguguaggauguucacccuucccuuccuucccuucccuuccuucccuuccuucccuuccuucccuucccucccuuccuucccuucccucccuccuuccucucuuccuugagacaggguuuuucuguauagaccuggcuguccuggaauucacuauguagaccaggcuagcuucaaacucagaucuuaagcugucuuuaguggcuccuaauuauacaugcacuuucugaguacuuggagcaagaaggagugggacuuacaagcaucacacuuagaucccaugaaucuguacagucuugaggguuuuggggggguagguugucuuauuuuugauagucuuuuuauguaguucuggcugucuggacagcuuacuuuuuagaccaagcuggucuugaacucagagauuguccugucucugcuccccaagugcugggauuaauuaaaggcaugggccauuacaucugacauauguacaguuuugacauuuuacaugaauguauaagaauuuaaaaauguaagggaauuaaguaacaacaaccaaauaaucauacccgcccacuguacaguggagaguuggaaucugggucucugguuuguuuggagauucaggaaugcacugcagaccacaugggcugcuauaauucuucauucucuuggcugaggcagaugcccagaucggccugagaagcugcagaacagacguccaucccuguguuccuaauucccagaucacacauacacaaagccuguagcccccaguuaccaauuccaagccuaacacuuagcccagccguucagacucugagaacgauaauugacauaccccacacauacuacuagggacuuagaacaggacagagaaccugugaccccuaucucucuaagucccuucagagaacuguguauugaugcuguuuugcucuagaauuugcuucuuggcacacacucacguguuucacguuacagauguuaacugccacccccucuggaauggauaaugcugaacaugacuacagaugaaaguuaacagcgagcucccauccuuucucuuccuguucccaggcaugagucagucugcucgccuuaauguuuauacagagccuugcuaacaaagagcagcugauugugacuuguauagacauguacccguauaggaaagaagaaguucaggcuuuguaccaaaguguuuucuuuuguuuuuuguuuuuuguuuuuuuuuugagaaagaauauucaaaucuuguuguacuaauuguuuguguacaacaauccccuucugcccaaggaacaucaugaaauugaacccccaugaguauuuaugguuuauaaccccaaugggcuguuuccuuuguguaucuaucauuuugagacucaguucacagaacacugaacaauuuugcauucugaguuggaguuuucuuucuugucauugaguguaaagucaaguuuucugguaugaaaacgguauccauauuaaaauaccaucuugauugaucaccaguguuuaugccuuuaugugaagaaaaguaggggagaagcuggucugugucuauaccguccauccacgaugaggcacugggaggcucugcagcauugggguuggaguuugauauccugugucauguccuaaggccagugggauguuggcaguaagcugcagcauccacaguuuuguuguuaagucccgggcuucccgugucaugaucugugaacuggagucagauuugcuacccuacaaaauguuggcuuuaccaauuaggucuggugcaguuuugaguugcacccacucugcccagauccagccaagcuuugaauuuggcauucugcaugguaccagucuggcauguugggugcgggaagggcaguggccccuaaaugguggcuguuuuccaacagucaccguuccuccuccugcaugagaagcagucaccuacucaguuccccaccagcauuacccaccccccccccacugcagcccuccccaggacuggcagggucagcccucuccauagggggucuccccaccccugcuccuuccccgagggacaugacauuuuccaagggcuuucauugcuuaacauuuuuaaaaaucauuuuuuucccacugaugucaaacaguguaauauauguuaauuauagacauuuaggaaguauagaauauugccuugaaggaaaucacaugcaauccugcuuucagagagaaccacuaguauauuauuauauuauauguauuguuagaggugauuucuuuuucuuucuuuuugaagggggaaaaagaggucuugaggcauguggauggauuauucuuuuagggacacaugcucuuaauuguuccgagacuccaaaugcuaauuugauuuuuaucugcuuguaucagaagugcauagcagguagaggcacaaagcaugccuuuauuuucaggagcauuuggagaauauuuaaauucugagauguagaauauuuggugacagaacagaagaccaugggacucagaaggguggggaagucauggugauguaggggguauggagucccagagcugcacuggacuagauacugacagauuaauuaccuccuucugcuauugguaacuuuccugaaacucaauuucuccaucuggaaaaugggagaacuccuacucuccugggguuuuuuugaugauucaguucauuaacugagagccgguuaggagaaugcuuugcaagcaaacuauguaggaguagguaaugcucuaauggaagagguguuccaacugggccuggccucuuccuggauucaaagggagccaggauaaguuaagcaagggguggcugggaguccuaugugggugagcaagagggggcucggagucuucugugggugaauagagaaaaaguuucaguggcuggggaauuuugguuguuguuguuuuugauccuucugaugguuaauguauccagcaugcaacuaggguuguuugugcaggagcguuuucuaccagcaaggcagguauuuguuuugauguggccgcucuuucuuuucugucuguguauuuugaaccuuggaguacauucuucaguaaagcuaauauguuugcucucuuaccugagagacucuuaucagagccuggcugugaauuacacgucucuccuaucaggaaucuccaugcauuuacacaggagggaccuggacuagcauaguagugccuuaaagaacagauaagguucaccugcuauaagugcagggggcgggggagggagcacucgagggguggggccugagaaagaacaccuuuaauauaugaaagaaugucuuugucucugcuacugagcuucaggaauuggggaaguaugaaagggaggggccuucagagcauuaucaggaaacuccucgggccagauugucucaguguaaacugucuucuugguuaaugaggguuaaguccccaaaucuuuuugcaucucaacuuccuuuucaaaacuggaaauagcaauaauguuuaccucagagcaauggugagauaaauauaggccacugauaggcuagagacagauccuugccaauuuuguguuaaguccuuuaaaggaucugagaagaugcccuaagaagucacagagauuucaccuaaguaucugcaauucugaauacagguggcucucccuugcugggagcccucagaccuagggaugagggaugagcuaggagggaugagggaugagcuaggaggacugagggaugagcuaggagggaugagggaugagcuaggagggaugagggaugagcucuuagggaugagggaugagcucuuagggaugagggaugagcuaggagggaugagggaugagcuaggagggcugagggaugagcuaggagggaugagggaugagugagcuaggagggaugagggaugagugagcuaggagggaugagggaugagugagcuaggagggaugagggaugagcucuuagggaugagcucuuagggaugagggaugagcgugagcaucuuaggcaucuucuccuguggggcuaaaugauuguccuaagccaggcaauuaugaaguuuuguaagccuugugagcuaugugccuuucggccauuccauauuaaucccuccuuuugcccauugcuucuaaugcuuuccagugacagacugggcaaagagacccaucuacacagaugcuagucaggggaaugggcagaggggcacaugcaugcguauguuaaagauacaagucacuuuaagggaggacuugauagugaaacagaagacggaagaugugggagaguugaauuuaguuuguacauuaugcuuuuauucucucaugccauucuaaaaacacggacucuccugguugugauuuuuaagugcaugugugaauguuuuucuugaucauaguuagacuccauuauguucugagcucauaagaguugagguaggcacguacugugccugucauucuagaacaauuccaguucuaagucugacacuccuuugccauguacagucaggccauggguaaacucggccugccucaguuuccuuaguuuaauuuaagcuggguguaauauuuuuuccuuacucauagggauguuaauaauugucacuguguaugcaaaaaggccaagccauaacccaucugcaaacauuaguaauacguauuuuuggaaugugcuaaaccucaaucugacucucauugugcccaguuaacuccuuggaaucuuugcugaaccuguuuucuuaccuagacaaugccaugggaaaaagccaagccuaauuugaaauugcaaaaggagaccuaccacuguggaggcccagccccucaggggacucaacagugacugguaucuuuuguguuuacccuuauucuuuuuucuuaauggcuuuuucucaaggacucucaguaacuggauguggagggcacugggaucgugaaggaagcugacacccaguaccuauuuugaguacauaucaaguauguccuuuguggcuguuuuguuuuuccuuccuuccuuccauuauucuuugcgugagugaaccccauuucgcugcugaggguugcauuucauguccugaugcucugacauggcagucccauccaucacucauuucaggugugccuggccacugaacauggccaucuuugcugauggaacacaggacuggugggaccaggagccugccgccgcuggaacuaacacacacacaaacacacacacacacacacacgcacacgcacacgcacgcacaaauaagggauuuaccucuugucuuaucuaacugagaagcaagcagggagcaucaggcaacuuguuuuccuccucaucucuaauauucagauccauagaucauaaaauuacccuuuaacuacacguguauguuacccauugagcccagugcccaugucauucgcccaaaugggcagcuuccugcacgcuaaaggccgucuguccucccugugcccacauuuuggggguguugacuuguagcugcuuugccuugaggccacuuaguugacagauuggccugauuuacagcaauucuuaucacauucuucuaugaaacaaauuccuaucaugggguguaauuugacaaguaccaaaugaagaguggcaggcucuucugagggcucuaacauauuuauaaaauuugccucuuuauccuccucccaucaccaucccucggguaaauaagacaauaggaagggcauauguuugagaauagagggauuuugaaaauaagaucuguugguauucugucuggacuccagaauaccaacaagaucauuguuugaagauuuuaacuuuaaauuaucucuauuagaaaauauaccugauguacauuuucauuauuaacaguagauauaaaaugugaaccaaucaagguuuuuggguuuuuuguuuuuuuuguuuuuuuuagcuugguugauuaguaaccuggauaaacauuggagauauaaagagacuccuuccacccacacauuaccuuuccggccuaagcaaagucauuaaggucucuaaacucuacauagauaguuaagaauuugggacauucuggucacugaguaccaauguccucccucauuuuucuaguguguguggguguccgaugggcaagguaacacacacuucuaaccauagcuucugugguuaucaugucagccagggcuacauagugagaccgggaaucaaguuuaaaagacuaagggacaaaggacauguuauaaagcuuauauugguaaguucuaacaacuuaaacguaaccccaagacauaaugcagagcagcguuuaccugcaugcuucuacuccuucauuucaacuuuaagacacuggaggaguuacgagacacaaacugcuggguuuuugcuguuguugcugcuguguuuugguugagaccaaggucuugcugugugggcacaccuuguacccuucuuccugagcuuccuuugcauugaagucuaccaacacacugggcuguuggacauuuaauuauccaccugucuuaugaucgauugccugcuaagugacgucccuuucuaaaguuucacuuucgucagaguuugcuuagucagaaugcaaugggcauugugcccugcugcuuagggcaguuacugugcuaggacuugcacuggcaggggugggugggagguagcacguagaaagaacuagaagccuuggcuaucuguaucugaacucuguucugccacaccauaaauagugcauugcccucugcaaaucucaugcuauuuaggugauuuagcuaaaaugaccuaaauuuggagccggggguggggugucauuaauguauuaaccccucaggguaucucaucaccugggauuuuugugugugugagucacuuuguuuccacuggccccuuucacuccaucaauguaaccaaugggauuuuaauauuugcaaauaugcuauacacgugcauauucaucauacauacauaugcaucauauacauauuaggaagcaggguagaggacugaauguaaugaugaaagaggagacauggagagcuccaggaacugcuuacacuggugcuggcaucucuaugacgcgugggaggcucgcacgcggugcugaaguuucugaauucaccacaggaucaaauuaaaaauaauucaauuaugagcauuguauuuguguugucuguuucaauuuaugccuaucucaaauaugauuuaacagaccagggccaugauuagaugguaaaacucggacaaacagagcagaguucuucaacauggcuaguucuuggacucaguaauugugauugugaaagguccugaucauugacaucagccaucuugaaagucucuucuagucuuuaccugccuuacuaacgaaccccuuguugaagugaagacagcaucucuuggggcuuccuucauguucccugguaguucuuaagugaauguagcaauggucuguagccuuggcucugaaauucuuaggauacuugucgggagagccauaugguagauaauggccaugugagaaaggcugaggucuagcugggaaggccugugcccugccagugcuaaguggguggaugcguguuccccccuuacucuguuucuugucuaucaaggauuuuuuuaaaaaauauuuuucuucauuuggcuuagaaaaaugagauugcaagacccugacucugagcuauaagcagauggguaugcugacuucugaucagaucuguauuaucacuuguaucuuaaacaucuugacuuaaauaucucaaacaaaucacacccuucuuuugaaaauaguuauauauauucuuacagucuuggcauuuggaaacccugagacaauuucaagccugcuuuuuaaaauagcuuguaacaucuaaacugaagagguguccauagaucuuggcuuuugcuuucuccuuguucuuaacacaaaguuuaaagggaaguugacugcuggaagucacagugguagacaagagagucggucugaaaagcccagaauagggaagggauuccuguaaaauaucucugggcuaagguuccauacaccaagaauuguugugaaauacuuaagaaauaauaaguuauuucaucaccccuccacccuuuuuaaaaguagcuuaagacaguuuaaaagaaaaaccaucaaagagugggauaugauaaaauaugagccauaggaaauuucaaaugaaugcagaugcugugaaaguuaauaaaaugcaaauauauuuuaaagagguauuaaaugugccaugguauauuucucaaagaaugcauacuaaaaguagaacugucaaggggguucaucaaaauguuaucaugucauuauaaaauaugaauuuuaaggaugauugauggcuuucuuucauuuguucagaaccauccaucaacuuauagggggaaaaagucagagauuacaugaacuuuuagaaacaagauuucaggagccagauaugagagcacagccuuguaauccuagggaugcaaggccgaggcaggagggucaugagcuuaaaggauagcuugggcuacacagugaggagcggucuuguggggaggggagguaaguagagaaagacugcauuggagcaucucagaacaauuagagagaauguaaagcuuucuguaagaagagagauggaggagagagaucuuauucuccaggccucucaaucggaugcugaauagugaaggaugcaaguggagugaagugagcacgugacuguuaaggcaggaaguggugcauaugcagguaugaauuugaauuauaauucccgagugcaguaaugcuugaugguugaggucaugccugccuuuagacuucaggaacgaguuaagacuuuagucauaugccauugcgaaugugugaaaaccaauccaaacaagaacaaacggugugcaggcugcuucuauggagcuuguaggugguaagggacaaauggggcugggugccaaaugggagucucgguuugacuuuucuuucuuugaauuguauagcauaagggguggggggugggggagcuuagggauuguggcauagucaucuaugaacauuucauuuauuacacaaaugaacacauauccuuuagauuuacauaauggcccacaaagagaaaaagggagagaaagagggcaguagguagacccuagaugauggaaaaagaaucaagaggcuggagcugggacccugccgguuguugguggagguagaacaccuuuuguuucuuuggguucugagacaaguguguagagcuguaugugaaucuuuauuuuguuuuuuugguuuuguuuuuguuuugauagaauacacuauacauuguucuuaccuguuccuuucuucugaacucuaggagggacuuccauuuccaaggcaaugauagggcugacaccuauacccucgaaggacaggagucuuaaacuaaguaggauuuuuuuuuauagcuggaacaaagagcagagagagagagagagagagagagauccuaauggauugaccugagaacagaaagaaggggcaugggguccacgacugucacuggucccuccucuccauccccuccuuucccucgauuccuguguuggaauaaccaucuaucugucuuccacuucaauacaaauugagacccucuguugucucugucgccuucucagagaguucaguggggaaccuuaacuucuucuguggccauacgagugucauggauuuuuucauuuaaaaaaaaaacauauuuuuuccccagaucuuuuggguaaaaauuuuuaaaaugauuuaaaacuaccuuucuaggcacccuggguguuuggacuguacugccuucuguuugaagcacgggccugcuuuguuagugagaguguuugccaagugaauuguguguaggagggugugacuaacccaguuggagccuuaucucccauccuaucugccugggcucccaagcuuuugcccaaguuaggguugaugucuuuccucaccaacuccaccccuuucaacauuuacugcaaucgcucuucagaaaauuauucauaucuaaguauuguaacucuucaaaaugaucccauccucugcauucauuuuugcugcauucguuuccugguggacaagcagagagagccacaggcucccuacaacccugaggugacaagcucuccuaacaagaggccauagaaaggccuuuuccccugccccucccagccugcaaggauuaucagcaauccuuucugccugccugggguggaauugucccugcuucccuuuuggcaacuuccaacagagucuguacuguuggcaggccauuugaggggggaaaugcaagucacaaaggcaauaggaacaaaaaagagaaccuaggggggggaaaaaaaacucuuuguagcuuguaacaagagguggguaguccaaguguccuuuuguccaggugcuaggggcucuccuugucauguagauacuaaguccagcaguggccucagucauuguacucggucagugugggcacuaucacuagacaggcagcagcuccacuuucaagaacugcuggaaacaccagagcucaaacaguaaacaagaaaaaggccgcuggcugcugcugagcuuggaguguguucugcagggggaccuguacuguggauaucuaaaagacugacugugcuuugcguuagaguuggaaaguucagacaggaagaucaggaguuccucccaagccugggcuacauaaauuccggucuuaaaacaaaauaaaguaaaacaaacaacaccagcccccccaaaucaacaagaaccaaaccaaacaacaacaaaaugguaagggaaaaguggucugcaaauaagacuuccuucuggccccucccuacuuagcuguaggcaucugggcaaagggccucacuuccuguaagcuugacugaaguuccugaagcaggggcaaucaaaaaaugaagguaugcggaacgaaauccgcaagcaggcaacuuuguuuuguagauaccagcuggcuggcuucuugcuaucucagagcuaggucagguuaccugucagaggcgaccagaaagaaauaccuuacacuaaaugcuagcacacugcccacaccaguugcuacuugaugccauuccaaaaacuguaauaacucuuccuucaguucuggcaacccuggcagguucucaccaacugcacuuaauuccgguuugaaucauauucaggaaucuggccgcuggugggaucccugggagucauggcacugucaugaggcugcuaucaagguguggcccuccuuaaguggucaggaccaggccugauucccaccucugaaaggcuacaggacagggaggcgucuugagccuaauuagcuguggaagugauagccccgcacagguggcucuagacaugacucacggugagagauagagccaaagggaaaucagaaaucacuccucugucacuugauuggaaucuccggucuacuuaaagaaauguuuacugagagugagguagaaggagguuggucuccucugucacugauauggaacuugacucuuagucccaucuccuccaccccaucccuugguuaccaccucagggguggcccacauuccaauagucagugaaccuuuucccagaguacugaagaucaaacccagggccuugugcauucaaagcaaguacucugccaccgaccuguaucuuuaauuccuaaugggaucuuugggaaaucccauugagauucuuaggguggcaccugagacucuuaggagcuguuaucuguaucugucucccaggcuccuagcuuuggcguuccucucaacuccaaauaaauagcaaaccuaugcuuucuguucugucuuccacacuuaccccagggugcaacauuccuggcccuuggccugcuuccuuacauauuuuuccuccuuccugccccuuucuuagcuuggguuccagcucaagcucacuucccagcucccacccucuccaccugcugacuucuaugcuugucacuagaaugcuuggcggugaacacacagacccuguccagcauccccuacccgaugcugagcccugcacagguauauuuaaugacuccauagcauaauguggaagcuuuuccuucauaauccucacauucaggacacugugacaggaggaucucugccccaccccccacccccacaaagugggguaagggugaaaucuuuucuaaauuauaaguucaugagucuugggaaucuuguaagauaaaguugacuuugaagaaugaucuuaaugggaacaaaguuguguuguagaugacgucacgacucaauuccuagacuacccuagggauguggccaaggucagaucgaggaauaaaccacacuggugagauaaguccugggaggaagacuaggguacugaagagcaagcuccugauccaagcuuaaaaugcuguaggcuacuucagacucacuggguuuauauaaguauauauaaaauaaguuggcaaauaccaaagcuggaauggaaaagucagcuucuccauuuuugcuuccuaauuccauaucugguguucacuucuguuucugacuuuugguuauguguaugacagcacuuagaauccauuuuguuuuuuccagacaggguaucucuguuuaguccuggcuguccugaaacucauacucuguagaccaggcuagccuugaacuuagagaaccauacuaaaggccucugcagucaccaccccaugaggaaucaugagaucuuaaccuuagaggacagcagcuucgagcugugcuuacuguggccaccuauuuacuuuacaacauugcuuacacacacacacacacacacacacacacacacacacacacacacacacacacacuccaaccccaggagaaggauuuaugacgccacuguuacuauuuucccuucaaaucugaaccugguuuagaaugauccaguuguugcuaggggggggggggaguaagaauuucuguugcaauaaaaugcaggacuuacuguuucagguuuuugaacaugcacaaagauguucuacuugcuaaguagucugagugaucggggcaccuuguaaguugcuuggggaugaauaagcacgagcuaucaguacugagcaugacaaacccccuccccccagcuccagguacacugcaucuugugaauaaacccucacaugcugucuccagucacuucucggagcuggucuaagggugucuuuggaugacuaaguaguuuguagcucaggggugaucucuaggcuuugucaaucuugcaaaagcuugcucuucccugggcaugguuucagucccuuucggucccucuccccuggccucucucucuuccuuauugcuccucuuccuccuuaucuuucuauucugccuuguucccucccuuccuucccacccuucccaggugcuccuuauuccucccuccccuuucuucuuccaugaccugacaagugggagcacuuacuuagcaccacgccccuguuuauuguugcauuuucauuccgguugcucugcuuugauauggggaauauuaaaugagaaugaacaaaucuguggcuugauagucccgguuugugauuuauuauuuacaucuggaugugaucuucugaccugacugauaauccuucccaacaaaagauaaucauguuuuaagucaucagcauaagaccuagguacuugaaagggaccaagaauucaccuguaagcacuucuggcaucuugcccucucccacgaauccaaucugaugucagaggaagcugggcugccagggguggcacuugcugaaccucacagggucccugaggaugggaccagcuccucuugucaccuuguaaugugcaucuagagaccagcucagcccuucauaccaucgcagcccuuccuccuuugcaagaggggaucugaaugcagcuccucuugcagcuccucuggggauguaguucaguagagagcucacagguaaauuccugguaggcugcuagguuagauugugcaaucuuaggacaaugacaacucgagcugaugaguuuauaaugcauaaaauucucugugcaugagcgcacacgcgucacaacacacacacacucuuucaggagugugacacggagggugagaugguaguuuaguacuaguacuaucuguguuauagcaagagcaucagugcugucccagguguuugggaugcugcucuuugcguugacccccuuguucugcucugcaucaaacugaaaacagacagugcagcuucuccauaaauuucucuuggucuagacgaggucucuucagggaacuccuggagagguuuuauuuuguucuucucaucagacauaaagcaaggcuggacuaguccaacacauauaacauuaaaugcuggcagauaguuauauaaaaucuuuaauccgcuaacauguaauaccaaaaccagauguuuagcaugaucguaucugcuuaacauaaaucacuuuuuaagacaucauguagacccagaacuuuaaaauucuccaaaaaaaaaaaagaaaaaaaaagaaaaaaaaaagauucacagcacacaauuguuugaaggacacaaaggugacagugaugauccaaaaccuccacggaggaagacacugcuaauuaccagcauggaguggggggauugaguucuuuuaaaccgccccacuccccacucccacugcugcccugaaauccccaagcuccaucaacauaacaacaacaaaaaaaaagaagcucagcccgcaguuaugacuccagucauuuccaggcauaaaucucggcuggugacaacucgggcuauaaagucuuuugggugacaaugacuagcuaugcugccugaguuaaucaaauaauuauuuaacacgugcuucucuugcucuggccccagcuuucuaacauaauucauccauugcaaagucuccauugcagcuuuaguuuuaaauaaacagagaaacuaaguaaacuguugguucuuuugccauuugccagcuuagucaaaccuucagugcccauccuacccuaucagggcuuuuuuuuuuuuuuuuuuuuuuuuuuuuuuuuuguuucucuccagcugauugguacuucaggguuuuaugucauucuuucccuacuguuacuuccaauguuuagugcauuugcaucaccuggcgaggugaauagaaagaauugcccccuccggaaagucugaaguccccucuaggagacaauaaccuuuaagaugugaaaguaagcuguggucugcuggugacaacuucauagucccggucucuuagcucuuagaaugugcucaauaaagucauccucaggauugcuaaugugaucguuaggaaaagguggaccacaugcuuguagaaagaaacacaggcuagcucucuggccucaccagcauucggugugugcagaugcagcuacagugaugcuaauccacacugauccaggcauuaaauggggguugguggagagcaugggugggugaggagcgagcagcugcccugaucuguugcuggugacugcgggucucuaaugagcaacuagucugaauguacccuaaauaucaaaggaggacaaagacaauagagccccaugcucucuguagugucuugggagaucagggucacuguuaaugucauguccuggcugugacagauggaaaguuuagaugguaacuuaguuaaggcuuucaaaaaagucucaccagauauuaucgguaauuuuacauucaaauuaaagguaggcauuuguuuaacaguguuuacagccuuuacuucauccuaaaguauuuggcuuucuucauauuucuuuauauuacuuauuuaguaacuuuuuuguaguaguaaauccagggucuugggcaugugaggaagugucucugccacugaguauaucccagauccuaauuuaaaaaaaaaauuuuuuuuuuaaacuuuuggagguuacuuauuuaaugugaauaaacauuuugauuacauguauguauguguaccacauguuugccuggugccugaagagaccagaagauguauccccuggaacuggguugggauggcuugugagcccaugugggccugggaauugaacccagguuuccuggcaggagcugccaauacuguuucuucugccccauccuuggguuucuuuuuucuuuuucuuuacaauguagccuuaaaaaacuucagucuuugaguaacacacacuucaguauacuaagcaaagggaugcuuccgucuuuuucuugaccuugaacuuuuuauagagucauucacucaaguucuguucauuuaugaaaucaguugaggaaaaucaaguuauuuucuuaaucucagaguuuaccacagaaaguuauaggguucucauguaagauuuagaaggaacaccaucauaaaaggggagaaauacauaaaauuugaagagcuuguacacuuuacgguacuagccugauaguuuuuuuggagugguauucaaauaugugauuugcuuuuuuuuauauagcaaaauuucaauuuccuaauugggaaaaugaggauaagauuagaguaggagugagagaucuuuauuuagcaaaauacauuguuucaaaauaacaaaggaaaaaaacaaaccuucacugugauuacagguugcuguugucugcuucuguuuuaaaauugguaccauguuaucaaguugaaauaauuuauccauuuguuucuacucccaccccaaaugugcauggaagauggcucaguuguuaaacugcuugccccuaaaauaugaggguuugauucccaacauccaggcaaaaaccagacauggaccccuaauacaguagagacagguagaucucugccaugagaaaggguuucuuucuaucaaagauagcuaggcuggucaagauucccuuuucgccauagagccagucccauaggaugugaguugagcuuccccaccaaggaggcauaaaagacaagagaguguuagccucggugcucaauagucugguuuggguuuggguuaggaugcauccuuuuugcaaagaugaauuucuugcccagcuucuuuguguaaaaccaaaauucuuacuacguuugugacaagaagccuuacaggccggcuugucccaauguaagaguuucagguaccagugugagagagaccuacugaaaaaccaaggcgugguagaucucucccagggaaccaguacgcuugcuuggccucugagugccuugaauguaaucuuggauuuuguuacagacacgggauaguugcuucuucagaguaaauggaacggccauacaaaacacuucaggaaccuuuaaaaaaaccuggccauuaagacaacaugcauuaacucuuugcuacagaagaauucuuccuuauaguccuuguggccagcguucagcaacuuucacggaguuaauuuaaaaugagcaagcucuguuugaauuuugcuccuugaggauuuacuacaccuugccugagaaccauccacagcugacauuuuggaauuacccaccucuuuaugggauucguuauccugccuucuguucaugaaagagcaaggcaauuuucagcauacuuucugucauuuccuccucuugucuguuuuuuuuuuuuuuuuuuggaacgccagcucuaaagagagaauguaaggacaugggaccacaaauaagucugggcuuguaggaagagagggagcucaauauugcuggaaagaaggaacccacaggaacccucacccagucacuuauccaauucaaacuuuuguuaaauagaaauuaccuguuuauuuugcaguuaaauaaguuguacuuacuauaugagcuuaauuuaauuauuguuguaaucucaguuuuuuuuuaaaugaggauagacuaaaaucacaauggauaaaaaucauauucaguguuauuuaauaagagcuaauauugagggaaauuuuucaguauggcuuaucccuauuuuugucucauucaggagacaaguaacugagugagcugcuuagucauaccccacacuacuucauuucuuugggguuuguuuuaugcagucucuaucacuucugcagaugggaaucagaauguggacaugucacaucguuuguucaagcucacauauccaauauggugcauugacuuagcuuggacccacagaggacaagaaagcaggguggaggccuucaucuuacuuccuucugucugccuccauacuuugccacugagauaaguccuuguuuuuuaaccuguccuccugagucaccuuggauuccaggaauccaggguuuuccauuguaggcaguuaucagugagggugggccccacccaaaaugcagaaguaccuacugagaccuuguuauuguaaaacagcaaagacuucuuugguccauuuaccuaucuauccaguauugaggaaaugaucgaccagaggauacccagggcaggacuuuuuucugccuacucuggccucaccucccuuuucuuccucucaaaguuccugucaauaucugcaaaauggacuugggaggagugucucuaggucauccccuuuucucuuccucuuucuuuaaggucacauugaggucccgccucuucaccugauauuauugaggccugguagcuaaacuugucagguaggccacuccaaguucaauagacuaagaaccaaaucuagaaccuauggguucuuuugcgugaaucgaauaguugcaguuuuaaaggaagguaaaggagauagaaucucuuauaagagauaauuucuuuuguccauggcauccuuuauauuaccuuccugcuguuauuguuuauauaacauuucugucccaaauauccucaacuuuuuaaagaagggagggucaggauuuguuagcaaacuugcuuaaagucuggaaccuagugucucuaccaccuccugacagccuuugaaaacaguguccugaggauccuguaccaagcuagggcuuucaaaacuacacaaugaaucuuauagauugcccaaauauuguuauaggaagaauauuuucuaugaguaguauaaacuuccuauauucuccagagugcacuagauaccccccaaacuauuaauguauuuagugaccuuuaaaaacuauuugguuuuaccuucuugaacuuauuaucaaagagccagaaauauguagaaggaaagaaggguuagguguccaggaacauaguguuaaaaggcaacagugauauccacaggguugauaucacagggugccgauuugauacugcacuaguuugguuagguugcuuaaauuuggguuuugagaugaggccucauuuuucggcuugguguucaacuucaggacccagaugguccuugaaacucugcucucaaguucuaggacugaagaccuucaccugguagcuuguauucuuugagcaugaccuucagcagguucagucuucuaaguauuaaggucauacuauuuauaugcagaauaaugugaucauugucaugcuucauuuguucaugcauuacaaaaaugucugacacgccccuuuccaaacuacaaagccuauuauuacuuguccucuagguuaaaaaauaaaaguguuuuugaaguuauuugcuaugaacuauguauugacuuuuucauucagagaugggucuggagcugaagugaaugcucaauucauuggauagacuggcaugaggaucuaguucaaguuucagcauccauguaaaagccgaaugugucuguccacuccaguacuauggagaccaggggugacaggguuugcugucugacaguuuagcuccuaguucagugagagacccugucucaaaagaauaaugcagaaagugauagagcagggcacgugaaguccacccccugucacacagacacaagaacacacauaaaaaucacacugucacacucacucacucacucauacauuaggagauggaccugguuauaauugagcaguucucagaaugggguaccugcuguagcagggguuuuauuuccuucagaauucgaaagaaauuaacauccuugggccccaccagacuauaguaaguguggagccugggguuugacuuaaucgucaguugcccaugucauuuggggaaggcugauuagaaaacucuaaacuaaagcuggaacuuccugagcuuuagcauccuaaaguccuucucugccugucugauuugggguuggaaugagccugucuccauagacacaaggcagagaaaacauuugucccuggaagucacuaauuguagguacagggaaucaaccagguccucuccacucccaccauuauugcuuuaaagauugaguuugauuuuaauuauguguguguuucugugugaccuuccagucuggugccuucccgagccagagaucucaguccccuggagauagaguuaccuacaggagugagcuccccaacuugggugaugggacuugaauucagguccuaugaaagaacaauaugcauucuucucuuaacagcugagcuaacuuuccuacuccugaaucucauuaccauccuuaucuugucuagcccagucuaccaguaguuagcuacuaccaaagcuugaucuugaacuuguguuuagagaauugcaaguugcauuuagagaucuaaggcguguaccuccaagccgggagccuaaucuuuuaugauguagaugaaccauuccuguucuggguagucaagaaaagaugugaauuucaaaguaauccacaggauuuugaaagaguuuaaaagaaacugaucauaaaauagaguagcaacaccccucucuacaugccccacccccccaaccuggucuggcuacgucauuugaucaaagaaagaaaaaucaauuuaaaggugguuauaacaguaaucaguguuuccaauaagauaagcugauaggaaguuuucuauuuugcagugacuguuagagugcucuucagucagacaaagagagcagggacuguagauucccauccuuucuaacaugcuccaaaaaggaaccuggggcgggcaaggcauucauuuuagaccagcucaaucauuggcugacgguguagagcccccugagcccaaugcagccugcuaccaguuuuucuaugaccugaaagcuaguaauguuuuuauggauggcauuugcaauugauuugguaauagaaaauggguuccuugaagaccaauuaagagaaauguuauaucuccaauaaagaauucuguucuccucauuaguaaauaucuaauacaaaaaagguaauuaaccauuccaauuaguucaaaucguaccacuaacaauuuguuuucuauuuuguuacauaguaucuuucagagauugccuggaaagccuaaguuacuuacuauuuggcucuauagaaggguuugcugacuucagugagagcuaaucuuuaaggucuucuuagugguccacuuucguuuauuaauauagcaacgugauuugaauacuauguauccagcagcauuagaccauguuuacuguuuaugagcggagcauagucuggguguccugaaacagccucuuuccuguaacagcugucagucaucaucaccacggggcuucaagaggauggggcagcagaagaugguagcaacauuagaucacauugcuuagaaaaggccaaccuuauuuguaguuauuauuauuuauuauuauuuugccucaguuucacaaucugugcugggaggaggguuauugccuaacgcuuccagcuuuuccaaauguuacuggggcgugcacauuuugacgaaaucuugaaugcagcaauccuuuaucauacagauuauuuuacacaucaauuauucuuauguuauaaauagaagcgaacaguuaauuagagaagugauuuauuggaauggucaguaaguggcuuugauguuuauacuacaaaauaaaacauugcgucugguacacagaaugcaggaagugugcaccucggucacauccagagaaaagggagagaggccuuugggccaagagccaaguacuccuuagggaccaguuugcauaaauggcucaaauucuccucagaggauuccuauuggaauuucuguucugaccuucuggaggcucuauuggaaauaacugguuuauuaccugggaagguaaccuuuaacugcuccccacccaaacacccacaucacuacuaauuuggacuguaauucaaauuagguuuuacaucaagauuagcuaccugaaaccucaguuuaaggaaauugaucagguuccuugagguagguucuggaagucuugacaaagguuccagggugcugcugguauagcucuguaucuuauaguacccacuucugcaaggguggguacacacacacacauuccagggucaauacuacuguuuguagagcaauguuauauaagagaaauaaaauggaagauuguagaguacgcuuaugguuuuuacuggucacacugaaaaaaauugcauguacauguauguccuuuguaucuuuuuuuuuuuuuuuuuuuccuuuguaucuuuacaugaugccaauauguauauguguuuauguguaugcacaaccgugcauggagaccagaggccuacacugaguguccacauuaguuuuugagacaugucucuuugagucuggagcuuucugauuuggcucccuugacuggugcugaagcuccaguauagccugucuccccagggcuggcauuaaaggcacaugguacaccugauauuuuuguuuagguauuggggaagcccaauucaggcccucuugcaagaaucaaucauugagugaucuccccaagcccugagaaauacuguaaaagaugaaauacaagguaauggcuuuuuaucugugauugcaauagauaauaauuauaaaaguaagcagauuuguguguguagggaggugggguuagaugcuuguggucugguagaccagcuucaccaguucucaguaggaaagugacaguccuagaggaucucaaaccaggcaguggaucacagaugacaaccauggcuggggaaggcagcagugagaaucuggaugagagcugugggacaucucuguacuuccccacccucuuagcuaucuaaaucagaauuucacugaaagguccauccucagcucacugugaugcaugcaaaccuugaguggggcauaagcucuggaguuagaugcuugucugacuuggaaguuuuccuuuuacaaccuuggauucuugcauaucugcaaaagagcauuaguaccucaaacacuugauucauuauggcaacuaauuaaauaauuuguuugacaucugccaccaaaauagcuguuacuaguuacuuuacaaauuaacuuauaaugaacuaugaagacaacuaggugcugugaaucuuuuuguaauucucaaaaguggccauaauuauccauaccagagagggcuguguguguguguguguguguguguguguguguguguguguguguguguauuuugaacucuggcuuggaacucaagauccccuagccuucagccuccugugugcucuuuacaggguauuuuuuaaagaguaggcacagccagcucguugguaucuauaaucaaaacagaacaaaaucuagacguuaaaaauucagaauuuacauuagcuuuuguuugauuugagacauggucucaguugcauaggccaggcugcuagaauucguggcucucuucuugucuuguauuccuguguccuaugauuucaaaguguagaccccuaaaagcucuauauuuauucugcuaccuuuggugaagacucuuaaguuaugcuugcagguaaacuaaggaaacaaaugucuccuuuugcuccucuguauuuuccuuuuucuucuuauuguucuccauuuuccuuuauuucauguuagcauaaagaagugauuaagcugacgcuaaaggguuggauggaaguuugcuguacugaguugaucuuuccaugagagacaggaguagaucauccauccugaccaucuuuacugggacaaacaggagaaagaugcuucuugagaaaacauguuggauuugcuuacaaagucauucgcuuacaaaaguacagagcagcaguucucaaucaacucaggggaaaaaaaaaaagaugagaaauaaguauuugucacuguguauugugccaagugcaucuuccacaggaauuauguuucgaauaaaaagaauggugagcaucucaagaugcuuaaguagaguggugaauagaugcaggaugcacuuaugcaucuaugggcuaaauucugaaaggcugaaccacacagagcaaagaaauguaccaaaccaucaauuuagcaggucauuuugaauguaggcagcaaaauggcugugugugugaaaagccacugcuauauuuugaaagagccuuucuaagaauccugaaauauuaauaacauggucuuaauguaguuaaggguggcaggggcugccgagaacagcacaaugacaauuuuguauuuuuuuugcuugugcuuguaaaagcgagaaguuaagagaugaaaauagccaauguguugaaagaacagcagcuuucaauuuucuaaauugguauaggacucuguauuuccccgaauaaacucauuuauccuugggaacauguugauaugaacauugaggaagaaacuauauaaacucaaaacacauuuucucuccccuuuaaauucacugaagaaguccauaguaaguuuugagcucuuaacaaauuagaagaaaccaauuagaagaaaccaucuuccaguagaauucaguguuuucauuaucauagugacccagccacugacuaauuucuaucaauuaucaccuacucucaucuugcaacauuaaauguugauguuugauaaaaaugaaagugugcuugaauuagccaguggucugguccccuaagaaaaaguuaaaaaaaaaaaaaaaaaaaaaaaaaagaaaguccuucuccccaggcauuuugacaaaagcccccauucccucauggggcuuaauagaaaguuccugcuugcuaaaaugaagucauucuccuuuucucugguuagaggaacucaguggcucaucauuaacaugacugggugccuauuaacuugucaaggucaaagguagccucuaggcucccucagucucugcacaccagccccaccucagcucacaagacauuaaaaucaguugugucuuguugguacuccuaaccugaguuucuaguuguuuuugucuuauguaacucuucugaguggcaggugagacccagagaguuugugcauuuguuuagggcucuugcugugugauuugggacuccaagaccuggcgggcuucuuuccaccaauguccggguugcagauuuuuccugaacacccuagggccaucuuaaacacgacccaaagcaccuugcaagcugaaccauaucuaauugugggaugcauaugaacuugggagacauaaaucacagcuaccaaagcaauuuguuuuucuaaagaugcuucgguccagugaaagacagaaaagcaaacaagggagagauugaucugggagcacauuuauuguuggugcuccacacgccauaaaguuuuggcucguuaagggaauuccauaaacaacuuuaguuaauaagagugaaguaacugugccuuuccgagcgccugcuaaaguccuuuuucccgcuugucauuaugggagacgaagaggaggcaaauucaugcagaccaggccauagggugaggaggcgggcuucaguggaugguguggggguggaugcguuuggacugauguggcagcucucuguggcuguccuaucuccacagcacauucagcauauguggaucacuacaucuauuccuuuuggagaagucccuggauggcuacuguggguggucuucuugcauguccggcuaguggacggauccguccucaacacagguuuugguaguaucgacacauucucagaccaugauaaaugaagcuaguguagagaaaaaucgcaccgaggaaauuguggguaacucauuuucuuucccaaccuccgaugcuauggaaccacuuaauuauccacguccuuaucugugaccuuaauacuugauggggccaguacaguuuuuauuuuagguuaagauagguuuagagaacaaucauaaaagguaugggaggaaaaagagggggagguugcaaagcccuauuaauuaauuuuuaugacgagguuucacagcagcauugaguuuuuccacuuuagugaaaguaguccucuguaucugugugauguuuauaaagcugagaucauggaaagccaucgcaggugcuuaaaaaccugcauucucugaauucaccucuguagggugcuccuugcagggggcagagggugugugcugaaaaugaaugaagguaggggaauccacacugcacuugugaauaaauaacauguuauuagcugguuuuuauuccagacucuuaucuuuaaguagccuucauuguacuguccggaaaggaaguggcuugugcagugcccaguccugccuucuugaaauguuuuuguuguguuuucuauuugagucuuuuuguaaccauaauuagggaauaacugcuaaccaauuuuguguuagcgucuggacacauuuucauucaguugauuaaaacagagaucaacacccugcccccaccccccacccccacauauguacacccucagauucaaaaguaagugguaguauguccaaguuaugggggacagaagacuuggaggucaaagcugacauguaacaaguugcaguuaucugcuggaagcugggauucuuccuuuuaaagacauugaugacagcaguguuuuggaaagggggacagaguaagguggaucaagauagugccucuuacccugagauauuccgguaaacuuugauugcgcucuacucgaucacaggaguuuuaaggcagugucuuuuggacacauaaucagauuuaccagugagccuugaagagaagcuaugaugcugggucuguggcugaguuggcagaaugcuuaccuagcaagcagaaggcucuggguuugauugauugccaucccuccauaaaccaggcaugguggcacaugcucgcaaucccagcacugaaggagauagaggcaggagggagaaguaugagaaauuaagacuacccuccucuacauagagaguuugccuggguugcauuaggaccuaucaguccaugucuuggguugauugaaccugcauuuuaagccaggugaucaccgccaccuccuuccugccaccccaccccgacuucugccagcaaggaaaugccuucacauuuugcccuauuguuccugcagugauucauguuugcuuuucuuuuucuccuucccuguagcuugcaaaauuggauauuacaaagcucuuuccacggacgccuccugugccaaguguccaccgcacagcuacucugucugggaaggagccacguccugcaccugugaccgaggcuuuuucagagcugacaacgaugcagccuccaugcccugcacccguaagugguuugcuugucuccugucuccugugaugccagcagcucucauuaccaccuagcagggugcugccaggacuuucucccaggauaaccuugcagggggcaaauuagauaucaagcacgcauccccuucuaucauagcaggcgaaaugcuuaugaagagaaagccucuuuccacuguuucugguugccuucaaaaugcacagcugccaacugacuacuuuguggagcagaaauugaguguucagguuguuugacaguguaauuacagcugagaauggaauuuauaaauggcuuuaccaucgcaucaagggcugggggcaauuugacaggcacaggagaacuagguagagggcaggguuuggaaauguuucgggccugaagaaacagcuuagaguacucugaggccauugcuuugguuuucauuauaccucuucuuucuucccucagaguuugguguccguaacacuuaggccgggucucuaauaaaugccuaauucagauuaggcacuuaauaagugauggauggaugaauagaugggguuggcaagccuggccugacuccagauaggaaagucucacacuuucuuuggacaguguucccaagguauuggcauagaccccacagugccugugaccuugaccaaggcaggaaugaugggcccugugcauuucccucauuuuguacaguugaagacugccuuuuagggcauagccugguaauguggcuuacagaacuucaaguuacagggcuuguuucucaguccaugguuuacuagcaaagugacuccuuagucugcgaagucguaguaauuuucccaucuguugaacagaacuaauaauaacauuugcuauauaucuuuguucuggaaagcauugcauuuugagauuuaggggauuuuugcaauaucugcguacacacaaauauuugaaaugaaacccagccauaaaccugaaucucauuuaugcuucauagcuugauggcaaguucacacaguacuuacacugugccucuauuuugauugcagccauucacgugacaucaaguaucccccuuacuacaucacuccugcauaaacaacaucacguucaagccgggcgugguggcacacgccuuuaaucccagcacucaggaggcagaggcaggcagauuucugaguuccaggccagccuggucuacaaagugaguuccaggacagccagggcuauacagagaaacccugucucgaaaaaccaaaccaaaccaaaacaacaacaacaaaaaacaaaaaaaccucucauucuagagcacuuuggaauuuggcgaggaauacuuccucucuaucucucugaggacuguaguuauuauauauccucauggugguuguauaucuauaaugugcgcaacaaacaauucuacuugacuuauuuuagauuuuacuauuauuauuuauaauuuugaucuugaaauacuauaaauuccagauggaccagcccgggccagcaucacugaacauagaagccauuccuaguuuuugagcacaaucaagaaccaccaauccuuacugggagaaaggagagagguuucauucagguccaucuuagacuugugcuggaauuaccaucuccucuggauuagcuuuuaugacaagagaaucuacuguggugacaaccuacaguggcaauauaaacugugauguaacacuauauguagauuaugccaggcacuuuggguaggugauauaaacacuauguagcugauugaugugcccggcacucuacacgguaaacuugaucaccugcucacgcagugacauguauuguaggucuccuugguuuaauaaacugggaaaccguuagcucucagaugccccugaccagcagaggaauggagcugcacuuccugaauacucaaguauauauuccugggcuguuguuucucuugccuggugucccagaucaagcauuaaacuucuagaauuaaggagugcaaagggaucuaaucuagccuuacaugaauccauagcaguaaaggucucuuaacuacuccccucccccccccccacacacacacacacuuuuuuuuaaaguaaccauccccaggcuaaguucuguuucugcauggucaccaccaucucuauccuguucccuuccugauuucucucucucucucucucucuuuuuuuuuuuuuuuuuuuuuuuuuuuugauuugguuugguuuuugguuuuuuaagacagggucucucuguguagccuuggcuguccucgaacucagaaauucgccugccucugccucccaagugcugggauuaaaggcgugcaccaccauacccugcuucuuauugcuuuguaaaccucuaucuugaguuuuuuagcuggaaaguagugguggugcacaccauuaaucccagggagagagucagagaguucaaggcuagccuggucuuuagaguaaguucuaucuaguacaccuagggcuacacggagaaacccugucucaaaaaaagaaaaaagaauccugagcuuuucaguauuuuuuauucuguguuaauuggugauuuaagaaugaaggcccugucucugucugcaggcacuaccaaacaacagucccugaguggugggaacucggcacaagagcaggcuuaagaggaaguauuucgggcugauguuuacauaauggcccuuuauuuguaugaggaaccccaccuacucucacagagacuccuuccuuccuucuggguaagguuugagagcagugaaugucaggaaacuuaaccaacauugaacggcuuuuuauccucuggauucugauuuguugucaagcauauucucuuaggcccugugccaacauagugacugucccucgugcuugggaguguagggcaucuccagagauugucauaugugcguuaugcugggcuguuugcaacugcaccauagcuaugugagaucuuauagugcugaagaaauaaauuguuaagauauaucccaaagacgcgaaugaaagcaaaaaaagaaguacugauuucuuuuuuuuaaccucauaaacugaaaccaaaauuuguuaaaaaauugauaugacuuuccugucccauccuuugccccucccuucacccccaacccccuagcccugagauuguguuccacaagauuaaggaaaaagaguugugagcuuucagagugaugaauaaagaccagcagggguucuucccaguccuuuaaauugccucuacuguucgcccugaggucuugugugucuugugugcccagcucagcuugcgggcugaccaucacuguauccugcuggcuugcuccccagggcuucuaugaagacaaaauagcucugaugacaggcucaccgaacuucccagccagccagagcuccuaacacuauccaagucgggguagugacaaagaguuuuuuuauguccuuaucugugaaaggauucucacucuuauucuuauggcuguuuuuuuuuuuuaaaaaacaauuaagaaaauauuugugaaggucugaccgacacacgguaggaaucugagaaguguuugucucucuuuuaucucuaguuggucucuuccuuggccaaaccaccucucagggaagggacaccacuuuacuuucucucuaugcuaacuugugauuauuguccugagugacuacacaauucaguuauucaguggcuacauugcaccucaggaucacugaggugggacacaaaaucugacuuuuagucucaugcagcuaagauggauaucccaucucuacagaguuagauguacucuaugaagagucuaugucugaggaucucucccuuucuguuggcuauaggcacacauaguguuaagauuuauacucagucgcucauuuuuccagaccugaguagccacaugagguugcugcagacacugcuagauacacaagagagacauagagauuucuaacuuugcagaaaaucccauucugccaugcgcuugaguagauggcucaguagaggaggaaauagugggaguuucucaaugaaccucuuguucgcauaucccacagacaaauccuccccauucccgacuuuuaucggcuucucuugacaagauguggcgauggaagggaacauaaacaucaggggauccuuucaaacggauuccagccgcuaaucaguucuucccaguugguuaagccaggugacgaacccaauucccuugugcugacagccaagauaaucaggcaccuucuuuguucauuaugcugucuuuaacccaagcauucuuaugcaggcccgcauuuagugaucgcucacugugacggcacucuaaugaagaaauaaaacacacucucugagacucauucuucuggccaaagugagacucugcuccacuggcuuguaaaaucagauuuuuguucacuuggggaacaauuagaccagguaaauacaagucguaccaacuaauuuugaaggagacaccuaaaaguucacacaauccacacaccuggaaaaaauuaagaguuuggaggacuuuugagggaaccaccaguguuagucuaauaugaguguaugugguucaugcagacugagauguuucagucugaguauuuaaaaaugaaguaguccauaucuguucaagagaaggaagaagccuaaugcuaaagguugacacuaguauuuauuacuauuauuguuguuguuauuguuguuauuccuuucuucuucuggggauugaaccucaggccuugcuaagcaagagcucuacuguugaaccagacauccagcucuuuguaauuuaauuagagaugagaaucuuguuaaauuauuugggcuagccucagucuccugaucuaccuacuucauccucccaguuaugauaauucaagaugggaggugggugccaccaggcccagccagagcaguguuacauacacuucacaucacuguggaagaagcccugggaaagccacuuauggguuuguagaacugaggccaggccugagauucugcaucucugacaauuuugcaggugaccaugugccuggugggugaaccagcuauccaugagucauagguucucugucugaagggcaggagcucggagaugcucuuucaugccuguaacuuucagcuaguggaaaacucuagaaggguauuucaaggacccagaacauuugcucuuaaugaaaaucaaauaguucauuuguccuccuucugaaaaauaacccaacccaguuggaggucauauaaccaaguccccucacugugcaugcuuuugguuuggauuuuugugguucuuucagacucccuauggauugaugucagagagcagaaauguaaaugcgucucccacauucccucacagaacuugaucagaggagacaagcacuguaguuuucuggcaauguugccuguagacagagagagauaggcacccaagaaagcagugaagcugagaauggaauuugcggucaucacuuuuuguuccaaacaggaauuaauuaauuauuuaauuauagcuuuuuuaaaauuuauuuacuuuuuuaagagagggugucagguagcccaggcuggccuuuaauucucucuauuggcugagaaugaccuucaauucuuucuuucuuucuuucuuucuuucuuucuuucuuucuuucuuucuuuuacuuuuuuuauuuuuauuuuuuuuuuuuuaguuuuucgagacaggguuucucuguauagcccuggcuguccuggaacucacuuuguagaccaggcuggucucgaacucagaaauccaccugccucugccuccugagugcuaaggauuaaaggcgugugccaccacacccggcuccuucaauucuuucuugauccucuaccucccaaauccugggauuauagcauagcaggagccacucccccuuccccaugguauggcuuaaaaaaauaauaauaacaauaauaaaugcacauucuguaacuacgaagcuaccuagcccccguuccccucgaauuucccuuucccuucuaaaaugcugucuggcuuucuucaagguuggaaggcucccacgcaagaacaggaaguccuuuaugaccuuuguguuuagcugguguucagugauuguacugaggaggcugagccaaugaauauuauguuuaaggaaacuguugcaauuucugauacacuucaaaauauguaagcaacauaccucaugaaggaagucauuagcuuuguauaagaaaaaaaaaucuaaaaccacaacugucauuuugcuucuuugcuuagcccuguucacagagugagucucuaucaucuucaccugaaauauaaauccuugcuuuucugcucuguuucacuuguugggugaaacuuaucaguguccaagaucagaggcgcuccgcagaugagaaaugguaacuuuuccauugccaacuugaagggucucugugcaucugucugugaguaaauggccuugaguaacuccaucagcuguuccaaacaaacaagaaugauugacacuuaguggcuuaaauagucccacccccaaaucgcagcuuuuaaggaggcagucuccacacuggaaaaccuuaaggcuaauaauaauaagcacaaauauacucagaucuaggcuaaaaggguccugaguugagaaugcuuucugcagguggagggcagacagcaguugaaauggccgagcuccaagcaagggaugauacugacuucgucucugcaugcauucauuccucuucuguaauugaauuuagcgugcugcuguauuuccucuagaaaguguauuguuuuaaaaucaccauuucaguucuauuacucaaagcccucacuucuaaugcugccuggcaguuaucaacauaaugagccauaaugaaaugaugagcaaucuucaguggaaaccgagcgccggucccaccggugcugugugacuguguuguuaaaaucagaaugcaaauuaaaauaacaucauccuuacuagcuuccaaggucagaaggaaacugucccuccccccuuucuuuuuuugaaaagugcucugauuuggagaaucucauauccauuuuuugaacaagcccuugaagaugccccugauguucaguucaguucuuccccuaccccagaguuuuaugcuuagcguguggcuuauggauuuggggagcuaugucuggaguaaggcuuugaugccuaaaccauaggauaaaaggcauccuucagcuucaaguaugcuacaucuuuuccuccccaucugaaacaaguauuucuuuuuacuuugggguugcaaauagcuaauacuguaauaaugggaggucauuguauggacaggucagggaagaugggucauaaccaguuugguaaaagaguaagaacaaaaucuugcaagugaccuuuaacuguuuuaucaucugugccaucagucccuuuauguucaagaaugcuugauuuccaagauuugcaggggaaagccuucauauuauauacuaaauagcauaauaauguaauuuguugauuaagguggaaaucaaagugagauacccguacuuuaccccaucagaauuggguuucaguucagugcauguucucacugcuugucacucagguaggacucuagggcagcaaccuaagacguuaggaugaaccagauacagaugccauccugucaaaaguucaaggucugacaugagcucaugguuaagccauguccuugucucucucuaauaacugccuuuuggcaucgugagaacaaauagagcaaguguagcauccuucuaugaagacaauuaggaauuaaggacuuugagagggaggcacugggcagguggcuuagugggcaaggugcuugccauucaggcuuugagaaccugaauucagucccuagaaccgaauguaaaaagcaagccaagggugacagcugugcacucccagcuuuggagagaugguaaggagcaaugauaaaggcauaucucuguucuucagagauuuuagcagugaccugagaccucccuauaaaacaaacaaggugcauaacccuugaggagcccugccugagauugaccucugacucugaccuccacacaagggcugacuguaagguacuaggugggugugucagucaagcccugugcucuaggguuauuuaaagaguuugaaaaugucaugcuauuccauaaaaauugcuuaccaucucaccgaauccuccccucugaccuacuuuucaaugcacaggaauaaacaauguacugcauauucaaggaggaaaugcagagcugugaggaacauugaucuuugcucgagagagggcuaggauaaucugccagugccauuuagcuaaguuauuacaauuucucuacccccaugaauaauuaggaguggcuugccaucaagcaagccccaucauuucugcauggcaucucugacaguccucacugaagccauacagugguuaugcacagcaugcuucuuugaaacagggucaauuauacauuuuucugagcuccccuggggugagaagugaggaucuuccuugcuaucagcauuuugauuucccucucagccuguuccccugcuccaccugcuaucaagugcccagcaaaguaggaguagaggauggagucucauugaggggcuauaauggcuccucucacccccuccugugaucuucuccagggaaggagucuuuaucagaaacuccuaguguccuguuggguggaagguaggagcugggcagagaggacagcucagagaagaccagagagagcacucuucccacuuugcuuuggagucugaauuucugauaaagcuggaaccaacuugcuguauuaauuugguugagguucuuagccugccugcucauucauucucugucucucugucucucugucucucucucugugugugugagagagagagagagagacagagacagagacagagacagagacagagagaagaggccaaagaucaauauaggcuuuauacaccuagagcucacuuuauuagcuaggcugguugaccaguaagcccccccaaggcgaacacuuguuuccacuucuuccacagcacugguguuacaguaucaccaugauggcuucuauguggcugcugaggaucugaacucagcuccccacacacagcuuuaccagcuaagccaucucccaccccgcuuagcuucuguucauagcaaucuucuguuaucagcuugcccugauauuuauuaaguuuguauucugggauuaaauuuaagauauaguaugcaaccguguuguaagaacauguacaggcaugacacacacaguucagcuaauucccgaaugaaguaccagucaguuuccuugcuccuguauauuuccaaguguucaugugcaacugagaauccauaaaguacuucagcuauacucuagucauuucauauacagaaacaaaacaucaggucaaaccaaggggaaaaaaaaaaaaaaaaggacaaagauuccuggagaggagaauggcagaauggaagaaguagagaaaggguagacccuggcagaaugucaggacacugaccucuaugggaaguuaagacuucuucaugacagcaacaagugauggauguguccaaaugguucagcuuugaaauuauggacagcucugccucggcacucuucauuguuaaaacacauaaacugcugugauaaaagguucugcaccguucauaaaucucaaacgugguaucccuggacagcagucuuuauguaaacuaacccagccgucagggucaagggaaagcaauuagugguggcaacauauacagcugucagggggggaaaacaggggcuucauuuugaagucuaaacuuacacacccccaacuguuuacucugucuuacagccugucuuucaaccagagagagauuaacaacaaaagcuuaucugaaggguugaagggcuuuccagcuaagacacugaaguauuauugacagcccccaaaguugugcaugcuccacgaagccuuaugaaauggaacuggagccccaaggugccucuuccucagaagauaaugucuuguaaccgguugccuuggcauuuuaucgggugacaguugcgcuuaaagaaauugaucauguuaagaguuauguuucugcccgggcuccugggauguuccuugcuacuuccagaauuaauuucauggcucaggcauugaauuuuaaaaugaugauuaaaaaucaguuaaguauuaaaaaucuguaaugggucuagauacuguggugccacaggagcccugauacugugacucuucugucaacuaagacuccuugguuacaaacuagauuuuuuuuaaauuuuaauaugagccuggcacuuaguauuuuuccugucagcuccccccaccccucucccucucucuguuucucucuguuucucucuguuucucucuuucucucucucucucucucucucucucucucucucucucucacacacacacacacacacacacacacacacacacacgcgcgcgcgcgcgcgcgcgcaggauauggcaauuaugguucugaugaagguagcuguacuauccagauaaaggaccuaucacuuacucagucagcagaccuaggcuguuaaauaccaccagagugcaggguauuaugggucuauaaacaaaccaugggcuauggacaaaguuuuuaguagguaaaguacuugucagcaagcaugaggauaggaguucaguucccaaaacccauuuuaaaaaaagauuuauuuauuuguauuuauucgaguacacuauagcugccuucagacacacaucagaagagggcuucagaccccauuacagaugguugugagccaccaugugguugcugggaauugaacucaggaccucuggaagaacagucagugcucugaaccacugagccagcucuccagcgcccucaaaaacccauuuuuaaaagucgaauaugguggcaugcuuuuguaaccccagcuggccagccugcuuacccuacuugucauaucuagauccaggcaaaaauaagggaccuuggcuggaaaucaaagugaacagccugagaggaaggguucuugauggucucuggcuugcacauguacaaauacacacacucaguucacagaugugaacacacucaaaaauaguaauaaaccaagaaagaagaauggaggcuaauauucucacaggaaggaaauaaaaagguuaugugaugggcugccucagggucuguuagcacuuugaugccaguugucacaagaaauugaauuuucagguuuuuuugcggaacuucacaccauaugucuauaguucuguuaaauccacauccaaauggaaucaucauauagcuaaagaauuagucuguuccuuuaagaauuaaauccauuuccaguucauaugggguugaguggaguccauuagcuacucuuaggcuggcuuuaccuuccuaugaaguaaguucacaugauagcuaaaccucauugaacacauuaauggccagagucaugguuagcuagugguuuuaaaguccuguauauaugugcaugugcaggagaugugccugugaguguaguaccagaggagaccaguagagagcuggagguauaggcaggugugagccucagguccucuguaugcgcugccauuucccaaaggagaaggcauauuuugugaaggaggaagaaaaucccguuugugauauaacaugcgauauuuuaugauacaacacuauguacugugauaaccuuuuguaucugccauaauuuggcuagaauuucuuacugucgaacucuugcccacugaguggaaguugacauuccacaugaaaacaauaauuacccguuguaacaccuuucacgagcaccugcuaggugauguggaaaucgguucacaccacuggaggaaaugaauguucauuuaaacuucuccacagaggcaagagaugcagugcugaucucuugucagagcugugggaagcaauguuccuugcaucacauuccucacucagacaaugacaucagguuuagaaaucagcaucacucauggcuugccagucugagcguccucuauugacuucugcugcacuuaauguacauagaaauauauucauauauggagguacuguauuuacugugcuauagcagaauaccugguuuauggaaagaaaagaugauuuauuguugcucggaguugagggggauacuaguccuuccugguagcaagucacaggaguggaucucugagguugcagcaaaaacagguguggcugguuacauuguugcaacagccagcaagcagggaacaaaggucauaaagccaucacuuuagcaucccucuuugucuaguaagguuuuaccccuuaaagguuccacaaccuccucaaauccccaaagaagacuaaguaugcaagcacacaaacuugugggugguaccauagugccacagaccuucuacgggggagaaagaacaucuauuccagugguucucaaccugugagucccgauccccacugguucaacuaacauuuucacaggacucucaccuaagaccauuggaaaacacagguacauuaugguucauaacaguagcaggaauuucaguuaggaaguaccaacgaaaauaauuuuauacuuccacaacaugaggaacuguguuagcaucaggaagguugagaaccacagauuaaucccuccaggaaucauugacaagcuauggccaauuucaacugccaucuacuuuugccaaguuuucuugggcagagccgugccucaugguggagauacuugcuguggcugcugaaugguuguugccaagagcauauggcccauaaagaauaaaauauuuacaauguggcuaugcaauaaaauguucuuacaaaggaagaaugcugaccccacucuauucauaaauuaaagguuauuacauuugccuuuuguuucugguaguauaguuauuaucugugccacuaaauuauauuaaaaacaagaaaggcauucaaaaugcgaaaacuuuaaaagcuuuucacaugccagccccacucuuggaaacgcuggggcgcagagacagagaagguugagcuuauaugugaaugccaugggaagauuuacaagugcgauucaaaaugaaaucggagugucuuccuucccuuacgagccuucggcauuugaucauuucauauuuaaaaaacggcuuaauuuggugauuaaaaauaaaauuaagugagagaggggaacucuuaaaauucuauuaaaggcaaauaugaggcuuccuucggaaauguuaaaguccacuucuuccggggagauuuuagcuaguuuuaugguaaaucaucacccgagaagaaagcagaagagggaccgcagccauucagaucugacuugacaaagcuuuaauuggacaaggcccuuuuuuaaacucccaggugcagugccuagucacuuagugcauaagaacagggcagggcagggugucuguuugccuauaaauccagugcauacacauacuuuguauuucuaugucuuuaaccucuguuuccucuauaaauccucuuucuacccaggaaucuaucacaaacgccuuaggaugaauugagguggguuuguugguuuguuuguuugcuguuuguuuuguuuuuuuuccucucuccccuccagcagaaggaaaugaggcaccugauaaacauuuguuggauauacaagcauucuauauccgccccccccccccaagcaucaguagccauugauagugggcacauagccuuuccuuccuuuuccagucugguuagucuaugggaaugaguuauucaaagacaguccuucacacccaggcuucgugcugaugauccuuaugggagaagccgaagccuguguucauccacacaauacaaggcuuacucaagcaccauguuugcuugcuauccauccaucuacucgcucaucaaacauguauugcacuuucucugaacuagauauuuggaaauagggguagacaaugggaaguaaugaguauaucgauucccuugaggaugccgucaacacaggugauagauggggacagauguggagcggaugucuggcauaggaagaaaccaucagcccuccuaugggaauugggccacagaagcaaggagcagcaaugggagugguacccuacucgcugccagccguguauucagacugguaucgauagaagccacuuuguuccucccagugacccuuaagcaaccuggugucaguguguguucgauaagagugauauagacagaaugauuggaaaauaugauugcauuuugcaguagcuuuuauugauauuaaaaauuauauagucuccucucacuaugcauuuggauuggcuuuagggcccuucagggaucccaaaauccauggauggucuuuacccaugucuaaugugauaugagcaauaccauuaucccauauauguuaaauauucuucgggacaauuacaaugaauauaauacaaugcuaucuaaguaguuauacuguguuaaaaacagcugacuguuuauguucacgagaacacuuuucaugcuuuuguuuuuugagacagaguuccucugugaacccuuagcuauccuagacuuuacgcuguagaccgggcuggccuuaaacucacagaggucuggagaacauagucuuucuugaaugcuuucagcuaggugguuagaucccuggaaguagaacaugugcacacagagagcacugcugcacuuagaacuggaaacuccacucccagauaggccaucuccgaccaggaaggccaucgcugucagagacuugaugacuucuagauuggcagauacaaaacuuaaauggaagagaaaauagaucauucauuaucagagcuuuccuuuuguacguuuucuuauuucuuggccaagauugccucggugagguuagccguagcuggagaccuagauuggcuuuggcuguccucaaguccacccuuuaccuccucauugucuugagaagagaauauuuuuuuuucuuuuccaaggaaacaauggcucuucacuuaaaaugaggaacacacauacuuauuccaugcuugucaucuuuuaguuggcaggaguucgaaaaagaaaccacaaucccacagacaaaacacagccaccauuaggauuuuagcuuguaaagcaugcgugcuuuuccgggucuuuguguaggccagugugguacucacacagggcagggauuuccauguuucauuucccccuucaucacacaacuguaaucguucaauuugugcacugaugcuacuauguccucaucauugucuaagacagcaaaauaggacacacaagagugcaauucucuaaaccagcccuggaggcaacauugaacuugaacuuuguucucacccuuuaaacauuuaccuccaggccuucuguaagaaucaagaaggaaguuggagacuuguuuucauaucaacccccacuuccgaaauccuccugcaucuuugugcugcucccccauggcuguguuacaucuccgcauccugugaccauuuaguuuucugcuccauuucuucucuguucagacuccgccaagccccggccuacauacuaauuacugacuuucugccucugcagugcucgguucauugugucacauuuucccgugugagaguggacuggggccuuggcaaggggguuaauggauuucagaguuacucuuguuuaucccugcaaggcucagcaaagugagccaguggcugacccauuuuguaaaacaaacugugaccagauucaacugcaguccagugauggcuuacacgguaguggucacaagucagaauuugaagaguggaaaauguccaccccaacuuaaaguaacacuucugccucauagggcagacuaggacacaguucuuugugacaucaguaaaauucucucauuaacuauaguguguaaacuuucacuacuuacuauaugucuauaucugccucuuaguucuuucaucuuuaacauuuaauacucaacaccagggcuggagagaugguucagugguuaagagcacugacuucucuuccagggguccugaguucaaaucccagcaaccaccugguggcucacaaccaucuagaaugagaucugacacccucuucuagugugucugaagagagugacauucauuguauucacauacaugaaauaaauaaaccuuaagccuuccgcacagggaaggaguagggccagaacgagaaguaaaaauaaauaaauaauacuuaacacuauaguuggcucugagugucugacauuuucaguaaguaauuccauuuauacauucugaagucauuuauucauuauugcucuauccuaccuagcugcuguguucaagaccauacauucagucuuaaagucuaaauaagaggacauuuguuucugaggguuuuaugcaguagacuuaggguuaacauaaauuuugcaaugguuuuguuaguuguuuuccuuaagaugggaagguugggggauauaucuugcagcuaagaagguuguagauaauuggucucuaggggagacagggagaagcuguuucccuuuuaaaaauaaggucuuuaauuaagcuguuugagagagaagaaggggagaguucccacacagaagguuuccaccaaauccacuggccccguuuaucacugaaagccaaguaauaaaaguagacugcgacuguacggccacaggcuaccuguuucaccucugucuccauuagagcuguggaccagagucaguguuccauuguggcuaagagggaaagcauccagcuaacuucccuucuccaagugaaggagguuaccuucauagcagucauucccaaaccguaugugugcgcguacacauggacauagauaugcauacuuauguaccacacacgugugcggguauaugugguauguguauauuuauauacauauaugugcgugugugugauuauacauauguguguauaugcaugugugguuugagugugucuguaugcaucuguagaaagaauuggugggucucacaaaaaaucucaaauuuuuaugaaaauuuagauuggcccuucaucuuguuauuuuuuuguucuauguuuguuguucuuuuguuuuguuuaguuuagauuaaagacauguuuuaaacuuuugaaacugaauuaaaccaaggaagccccuccuuccuccuucaaucccagucccuacuugacagcaguuaggacuuagucucuuggcuaaaggguccacggucuuaucuuuuacuguuuuccaacuaccuguggggcuuugaguaaccaguugucuaucaugacagucaucaucuuugcucacauaucagaaaccuuuugaugucaauggggauggaugugcuuuuagauagccuggugcggcccuaaucuaucaaggagugagaggagggaucugguaguuaagcacagcccuggcauagcucugagaccucucaacagcuguguaucucuuugacaucuuugaaauuguguuaaaccaguuccugcuaauuacccagcaauggcuuaaugcuuaccugcaucugggacugcagaccuauaucuauauagcucuaaucauuuaauuugcuaucgguaauggguucuacugagcaaccagaacacgucuucaaaagcagucucuaaguauuaauuuuccagcccccacagcucugggaacuggaauccacuuguaaagccgacucucagaaaguaagauggagaccagauaacguaugcugcuuugcugccaacugagagcaggccugggcuuuaagcccgcuuucuguagagugguuucaugucugucucuaaguggcauguuuauuugcacuggaaguagaacgacacagacacacacacaacuucuaugguauuguccuuuuaaaggaucccuuuuguuaacuuucuuugccuuuugcuugcuuugccaaaugggccuuccuacucuccuagaguugcagaaaagauaauacaaacucuaaagggguccaaaaggaucucaguccuugguguaauggucuguuuuucuuuccccaggcccaccaucugcuccccucaacuugauuucuaaugucaacgagacaucggugaacuuggaauggagcagcccucagaacacagguggccgucaggacauuucuuacaacguggucugcaagaaauguggagcuggugaucccagcaagugccggcccuguggaaguggaguccacuacacaccacagcagaacggacucaagacgaccagagucuccaucacugaccuccuagcacacaccaauuacacguuugagaucugggcagugaauggagugucuaaguauaacccuagcccggaccaguccgugucugucacagugacaaccaaccaagcagguaggaaucaauuccuauuuacuguauaacucugaguguuucuggagaaagucauaggugcugauaaucaugaauuguaaaaccuauuuauuauaaauguagaagcugcguuaaaauauaaaaaggugcuaguuugccacaaagcuuuggaauagcugcaugccauucuuguagcuggcaauagagugaaucaggcagugugauugaaagacgaugaacuguagguaaauccagucccuugggcacacuuaugugauuugccucuugucuuuugagauuuaacuauuaccaucagugaguguagaugcaugugcguauucagguacaagagcccaugagcaccaaagcacuaagagucaggaagagccuaguguccaccucuccaguauuuccucugaggcagaaucucucccuaaaccugggguuugugauuucuaggacaggcugggagccagcaaaccacaguaauccuuuugucucugcuucauucuggggaugcgaagggugcaugcugagugucuggcuugcuaugucauuacggggauccacacucugguccuuaugauugcccggcaagcacucuuaaccacugaaccaucuccccaccccucgucuuugccacuuaaucccuaaauucauagguggacaucacagcauuuacauauuacauaggaucauaacaucgauuuuacuaaugcaggguguuacucuggcaucucuugaauuauccaacaaaagcauuagcaguuguaguuugaaucuuguucuuaaauguaaaagacuacaaauaauacacauggcucuauaucggaaccaaguguguaaaucuuacuucuguacuuaacaaaauuugccuuaagaagcuugcucauccugugugauagacacacccauaagcccaguacuuaggagauggaggcuggugagugaagagcuugggcuauggucauaccuuucuccaauuccauccuacuuucucaaagaagauguaugcuaauuuuguagcaucuaucucuuguauagcauacuucaaacagacauaacuagaaaacuuuguuguuccuuaaaguguuugggcugaguuaauuaccaaucugucacaauccugaauacugagaaguacaggggagucaggguucacauguggagaucagacccuuuaggaaucgagcucucccuccgcuauggaguccaaggguuggauuaggucaggcuuuccuggcaagcugguuuuuuuuuuuguuuuuuguuuuguuuuuuuuaaccugcugagcuaucguacuggccagguucccuauuaauuuugaagaguucaggaggagggguaggaggaaauuggcuuauguaugagguucuuaugauagcagauaaagauuauaggcugcccccaacccugcugccucaucuuucauuucuuuuaaguguuucaggaggugacucccauagugaaguaaaauaucuaucuccaaagccauuauuucuuuuuuccauuuuacucugauuuuccuaaaauacauuaaagaaacaauuugggacuuucaacaggagcgacuauggaaaaaucaucagcuguuuuaaguuuggaguuauauuguaguuaugagccauaaguaugucaacugggcaaguuuuuaucuuuuauguauauauucacauguauugagaugugugucugguacauucguuguguacacauguaggguagugaucagaggacaacacugauagacuccucagguauaaucuuguuaguuugauauaucauuuauuaucauuauuauuaucacuauuacuauuuuagacugucucauuguauaaguuaucccaaucuuccacugaucacaaaggaucuauccauccaucuucaccuccuuguuuguuauaagaaucggccaccaaucuuugcuaaucuuucuaggcaugcaccuuacugacagcuucagucccuaagccuuugccuuuuaauuuuguacuuuuagguagcccacacuguuugagguuguuugguuuuucuaaaaagacuagaaugauguuagaguuuucagugaccaccaguaagguuucuuuguuguauuuuguuuguuugugugucugucucugucucucugucugucugucugucugucugucugucugucucuguguguguguguguguguguguguguguguguguguguauuuaacacaacggacauaucauagcuccuuggaccauaguuggugucaguauaagaagcagccgacaugcacagagguguguuuguacgcagaagaaucugguuauggcuagucaguauuuuuaaauccaguccuccauccuuauuccauccacagcucugggacaacugcucuuccacugagcucaguccccucuuuuuuauuacaccuuuucaauuauccucacacaaauaagaacauuguguucuuaaccaauuuaaaacuaggacugccccuuuugaggccacaucuaugcagggucaagucugaaaucauucucuggcagagggcagcccuugggagaugggcuuaacauccacagguuuaaggaagagacuuccaugguucuucauauacuuaaggacucaagccaaaagauuaugucagccuauacuaugccaaaagguccaaagagcaaaugaaaggcauguugaaaaucuuccccacgaauaacacgugcaagaacuuuauuaggaauggaggaaagagucaaaacuuucaugaaaaaugcuguuguaauuauuuuagaucuagcagaaagguagacagguaauuccucugaagcaaugaggugacucuuugccugucuuguugaccgauccugcagggagguuugcuuaauaggacaaaauuucaucucuuuauuuuaauuuucauggagguggaugcugggaagcuguucaaaauuaaaaauaaaucuuucaauaaggagaccuccuaucacgccagccagaaaguguuucugcucaguagagaacuuuacacaugugcauagggccgccuccauguccugccccacacuuugaaguucgaugauuccaaaucauugggugguuugucuuugcuuaacaaacccuuucuuaacaauggugacuguuaauaauguaggccagauuccugggugacucuugcagucuucagcucuaucaaagcuccccuaagcauauuuacauaugcacaauuauauucuaauugcauuugguuccaucauuccauuaaauuagauuccuuaaggaccuguauaggcaaugauggcuuacucuauaaggaauacauggaauuaauggauguuaaugguuguuagcguuuagcaccuagaggccccacaauaguucucucuaccuuugcuuugcuguguuugcaugguuuuguuuucuguguuuucuuuguguguguguauugcuguugugguucucaugaguaaucaugguuauuuguuuuuaaacaaauauuuauuuguucguuauguuuuauuuguuuuuaaagcaaaccaaguacuugauaacaaggagaaaauauugguguggaccauggccuuuccuuccaaucauuaggaaucaaugguauuccuguauucagcuugaccugucucccacugugagagaaaggggugugugugagguuuggauuuagaggggcuuugauggaagguggugugaaugggccauauucucacaagaauguguaaaaccauuugaacccagauguagcagcagccuuuucucccucucccccugcgaucaaaacaaaucaacacaaaagacaaaggaagucaggguaucugacacuugguuuuugauaaguugagugauggaugccagcuuuaaccaaaaggcuuuacuggagagacacugguuguuucccaguagguggggguccugugggaaggaagcuguugcugaggcaugugcaugcgguaaagugugggcuggucugcauuggauauuacuacuucuggaguaccugguuucaccaaaugcuuaaggacaugucgcuaccucaccccucaugccaggagugggaugagggggaaucuaccuaaaguaucaucgcuuuaaagcuugaagacuaggaagcuccucccagacuuccuggccuucuugacagacugacagaaggaguaaauggaggccuggcuuccuguggcuuccauccuguagcaacucuucugccuuuuguuugagacaugguucugcaaacugcugcugacuuguuuucuugcuuuccuucgguuuacuuugacuuaaguggaccaucucaggcaaaugaauacaggguguguguauguguguuccuagcagcgggagacgccguguaaauggaaaaaaaagguuuucuggcuaaggaauggaauugugauauuuuuccuuaaaauccugugggagcacccagcguuaacauugcugacuucuuuuuacugugcacuucuuaaccucuucaggcuugguuugucagcucucagacuagaucacacugaaacagaagggugcuuguuugucuuaaaucuuaaacugacaucaaugagaaguaguuuucucuacuaaccccucugaacuucaucccugggcagggauaucuguguuuuaaaaaguauuuuguuuauguaugagagaggguaugcauguagguuggcgugcacaugagagcacuuguguggugucagaaaauaguuuucaggaguccagucucucuuuccaccaggagauagcucuaagcacuacugaaucaucuccccaauguacaguuuggauucacauuugccuguaacuggguaggaaagagcugaccacccaacucuuuggcagcaaucauguuacaguaacaaacaucugaagcacugaguccagaagcguucaaauagacuguagaugugguucucuaaaccugcccaguuaucuaaugcugccuuuucuaugggauccuaugcauucagauguacagucaaaggccaugaccuuguaguuaauaggucugcacauucagaaucaggaccuucagagcuauuccuaggugggaagcaauucuaaagggcuucauuauaacuuugcuacaguggugugacuucauaguaaagcucaucuccuaagaguuccauagucaaguaacaugaccuauuccuguaugacuguaguagugcacgaagcaggcuccuguuuccuugauugaacugcuguaggcugagaacauaacuuaaucauugcuguucucaggagguuguuugagccuucaggagccucucugaagaccuuucccaguugcuuugccaucagacaaaccgguagggcuuguuagacuggcacuguucuugaggguugcacagucaaggaaacuguaagaagaaagaaagccacaccaccaauaaacuggcacaaugcuuugucauaauaccauuguacuaaaauguagucguaguuauucaauauguuuguugacuuaauuuuuauuuacaguaaaaacaaauggguuaacuuugucuaguagucauacauccaauaaaccuaaaauaaugagacaagaaaagaaaauaauuaaguacaagaggcacacugucuguuauuacucaacuggguaagcucccauucucuuucucugccaucuuuuaauuagacacauuauguuauuugagugggauaauggagaacagugggaauucucauccccacuggguauaauugcuaccugucuucuagacagcagaagaaagcuuugggggaaauggugggagaagggaggagaaucuugggacaauuggguguggugguuugccacaagcauaaagaagccagguuuucuggggucugaagcuuagauggguuuugugugauuuaagggguggaaguagggcucaaaauaauaaaaaaauaauaauaauaaauacaaggacccauaugaagguucuuagccuuccuuugucacacucugacaagguuaaagagaauacaguuggcagauaaggaguucauugcauuacuaugcucaaggcaaaauaaggaacaggaggauuuggcuucauaugaaagguguugacaagcgaggucauugcucaguaugagucuagccagugguuaggugugaggcucaaaggccuuacuggaguuagccaggaagagaauuugagaucaaaggacaagccaaaaccuuggucccauuguuucuaagaauuaugguggaaacaaugcucaagugaagugggcucgggaccaaggcuuuucuuuaaguaugcaaaaggggaaaaagagagaaagaaacaaauugcuggaauuuauuugaaaggcacaaaaguuagcuguuuuuagcauccuaccuccccuguccucaccccuuaagaacagcuuuuguauuccuaaaggguuaaauacaaucaaaggaugaguaacaguuugugacauucagaccugcagaauucagauuuuggcaccuauaaauaaaguuuuauuggaacaggaggcagucgucauuuguucacauguuguguaggagggcuuccggcugcagaagcauggcuguggccuagugaauggccagcaguguaaacauaauuagcaaucuggcuuuacauuuuuauuuucuaagcuggucucuacugugguguacuaaaucuagaaaggggaguagucagaauggagguuaagauguugaaauggccgcgccacuugugggaaaugaugcuucaggggaaggauguggcggcuuaacacucugccuaauccccacgaagcaguuuguauuuggcaagacagacuauuuguaagauguuuugauuguguuaaaaacaaaauuaaccaaagcaauuaugaucucaaugcuuuugcuuugagcuuuugcuuccuuggaccacaaaucuuuccccauugauacucacauuuaugugugccucucucgaugcugacuggugggcacagauucgccucaguuuuuaaaauuauuuacauuuuuuauuugugugugugugugugugugcgcgcgcauacgcgcgcgcaagcaugcacgaaauguaugugucacagucaaaggacaacuuugcagucagucuuuuccccccaccuuuauaugguuccagggauugaagcccagccauccaucuugcucagcaaguaccuuuccucucugagccauugugaggaauccugguucucuucauaguuuacauccuucccacuuuaggucucagauaaucacacacucugauuguucauguuauccucucacugcaaugauuugcugucagcuuugaucugccuuaccccuacaaaauuugauaggagcagggagcuugcccaacaaacucagacuguaaagaaaucccacugagguugcacugauaggugaucugugccuccuuccucgugggcgaauaacauuugggggugcagaagaggugacuggcugagagaccccuguuugcucagaucauuauaagcuucaccaagcacacaauggucuucagaggauccaggcugugguuuucucauuaacagcucugcugcagccacaggguccgggcucaguucauaguccuuaugaaaugugaauuugaaaaaacauagaguacaauauuuucuuuaaagaaaugaucuccuaaguuaaacuuaauaccaaaaaaaaaaaaaaaaagauuuucauuucuguagaauguuguugcuuucacuguaauuaauaggccugcucauuaauucguuauuauaauguuaaaaucaaauauauaagcaguucuauaaaauauagccuuuuuguuugggggaccaggauuccuggauuuguauucaugguugguaucauaaggccuggugaggagaaaaaaaaugaaaagccuuccaaaggaaucuacuaaauuauccaacuucaagguugacugagcagcuuagacaaaugguaugucuacagcgccuagugguaauuauuguguacaagugaaaguucucauuguuuagagagguaaauauuucauucucagaaaauggacguugguuuuuauuuauucacccaagcccagagaacacuguuuuucuuaacuccauuugcuuugcuccuacauaaauauacacacauguucaucugugagacgggaaauccacucucuugcuugcucuuggcagccuaauucugcguucuuucucauugcucaauguugugcuuguuacauugagcuccacugccaacuucuaugcucuggagaagccaucaagagauccaaaaccuaaaugccugccuucggucagaauugaggcaccuggggcucacgugaguucuuagauggguuucugcacucucuagauauccuuccaacuugaaaugaaugacugucuccucagaguagccaguggagacuccugaguucagucugcaauugagcaucugaaaagauccagagcaucuguaucaaagcuccuauuaacccccugcugaugucucuaaccaguuuuuaauuugccuuaaauaccaagcaaaucuaaaagucauauugaaggacuaauccuaccuugagagaucugaagccugcagggaccaauugaaaucuuucuccaugucuuucaaagguagaguauuucuauuugggaugacauugucuguggccuucagguagaucagaaaauauugccuuagguuuguaguuuuucagagaagcaagccuuagcuguugaacacuuucuuucuuucuuucuuucuuucuuucuuucuuucuuucuuucuuucuuucuuucuuucuuucucucucucucucucucucucucucucucucucucucucucucucucucucucucucuuucuuuuuguuuuuuguucuuuguuuuuugagacaggauuucucuguauagcucuggcuguccuggaacucacuuuguagaccaggcuggccuggaacucagaaauccgccugccucugccuccugagugcugggauuaaagaugugcgccaccacgccuggcaaacacuuccuuucuuuaauuaccuuuuccgugguguccaccuggcuucagcauccucaaugugugaaccuccuuuggcuugugccaaaaguacaaagauaguuaucagcuguacaguaguguguguguguguguguguguguguguguaguugggaguagucccauuucuuugaaaauggugaauuguuccaucuucauuucuaccaaggccauuacaauaugagggucacuguuaaagcugugagaauucagaaugguuauuuuuagauagagaacaagcaaacaaccccuuacacaauuucuuucuaucugaugaauuaauugcuaagccuuuagagcagcaccauagauauacaaauugcuugggcagucugaaauauacuuucagaaaaaaaaaccuuucuggaugcaaagccgcaggacugauauuuuuaagacguucucauaggauccuuugggcuguagcauaugcacgcagcuuuuaagggguuuucuguugagagcuaaauaaggaucugccaccagcaggcuuccugucuauaggacacgugggucagauccauccauuagaacacacauugcaaaggggcagcucacaguggcucccuggagaguuuguguuugucuagauuauacagugcaagcaguaaaucugcugccuuuagaaucaacucuuugggugggggagggugauuaaguggauauuuugggcauaauaaguuaagguggauagaaacauggcucugaucauguuuccuuaccaacacuaagggcauagaaauaagccagucuuucagauaugcuuguagaagaaagguuacuuacgaauucucugccuucacuaaaguagccaaggagucuuuuuuuuuuuuuuccucugaaaauuacuggugaucccaagaguuguugauauagggcagaguccuugacuguguugaagcccaaucaaccugcccugauccuauaggguucuuaugagauggagguuugagggagcuuugaaggaagcauucuucuuccagugcugaaucuugggggccguaucaguuucuuucuucccacugaaaauggaggcagagccaucacuguagaagguguggauccuuguugcuucauuuuuuuuuuccaccaaaaacuagaagaguaacacagaacccugaacaaugggaguuagaagcguguccucagggaagcagaaagaaagguguuuauagcuuucauuuggaacuuacuccacugcagagaagccagcugacugcagugagagcccgagacaaugccuuggaaaucuuagaauuuuaaagcauguuauucagaggagaagcccuugaaauaaauaaaagugcuaauuuuucgaaguauauuugcacuguguguuuuucucuuccuccuccauuuuagagcgcacacaaaauaacuugcacagcacacuggcgccguacuuuauguguuucuuaguggccaugcugggcauguauuuuuaggugagauguuguucuaaugagguucuuccaacacuuagggauucacuccuggguggagcuggauccagcaaauuucacacuucagcaaauuguguuuaaagagaggcccuugagagaugcucugaaccccucuauuaaaaaaaaauccccaaacaguuagggcuuuccuaaugcaugcauucuuuguuauauuuuaugacuacaaaagucaucuugaauucuuaagcaccgaucuaguugaagacaucuauuggccuuaauaacauuuuaaauuuuaauggcucaguuguuuccgcucugagcuuauacugcauguaggaguuuaaacuaucuggcacacacaauuccgugucuggcugauacccuaaaaauuaaaaaaaaaaaaaaaaucugugguugccaauucucaaacuuaaaauccuccucauaaaugacucuucuuuuuuuuuuuuuuuuuuuuuuaaauuuuuuuuuuuuaaaguuguuaagaccaauuucuuuuuuuuuuuuuuuuuaagauuuauuuauuuauuuauuuauuuauuuauuauauguaaguuacacuguagcugucuucagacauuccagaagagggagucagaucucguuauggaugguugugagccaccaugugguugcugggauuugaacucuggaccuuuggaagagcagucgggugcucuuacccacugagccaucucaccagcccuaaaugacucuucuguuucuaaucucuaacaucgcuuuuagagaauuaauuguccaagagguaaaguuuaagagaugaggauugccgaaagauaauuuuauggccauguuuguuuguuuguugagagcauagcauaugguggugaccauucugaggaaccauuuucaaaaggagcuguguauaaucuaauccaaaagccccugucucuuuguccacucacuguggcuucacuguguccugucuaucgcagcaaaagagacaguugcauggaaaguggaagcugccugccccauaaguaucuccucagcccuugggcuuagaacuccccuauacuuccauacuguggaaucaaagagggaucgagauucaacaucacaaacacgguguucaucuguugcucugucugccucuccuuucugcuuaugacauuccacguaauuguccagagucaucauuuuuuuuuuuuuugucagccccacaguucuguaagccaagugacauuugggcuuggaaagcuuccacauagccgggaauacaucaauuugucagagaaagauucacccacaucuuucuuaagacaguaaggcccugucaauaauauucccuauccuauaauuuugugauauacuuuaauucuuuuccaaaaagugcuaucugaauuuuucucucuucugacuguguuucaaaggcaaugagauucauuaaagaagaaaaaaagaguuuuaaaaguuuagguaaagggacucaaacucucaauuuauaguaacccugacuuuugugaguagcuugugugaucucuuaaaaugaccauuagaaaauaggugugcuauuucagauacauacaucauauauacgugauggggaaucggguggcuuagaaggugacuaauaggucuuuggaccuuugggucaccucuuugaauguagaugucauccuaaguguuccagagccugaccacuuggcagccaugagugacuauguuaauggguuugauuucaguccaggucuuugccgacaggugcucauaucauaacugacacuaauugacuuccuaguguuucaacuuggaugauagugggccaucucugagacaguuauaaggaaggagagcuucgugauauauucagucucccuugaaagucaagaaacugaauguccugagugggcccccuggugccaugucucugccuggccccuuuagcccaagaggcaggacaaaguaaucuaauuuugaaaauuuuucuaauaacucaggauggcuaaugacucuugucauugagccuuucuuuucaauuguccuguacaaauguauaccauuuaugaaaauugguacuuuuguuuaaaguuuuuaaccagaucauguauucauaaaaauagcuacaaaugaugcuuauugacaaagaauauaaaguuguauucaugcccuugcaaaauuaaggccaguaugagaaaaguaacagggcacccuuuauccgaaaauuucaaagucugaucugggugcagugguguaucucacugcaaucucagcaccgaggaggugguagcaggaaagugaggguucaaggucaucaccuguuacauagcaaguugaaggccagccugggcuacaugugaacuugucucaaacaaaaccuaaaaagaauaucaaggaauaaaauuaaaggagacucaagcgucuaagguucucuugaaccucuccaagugcuugcauccagauuaagacaucagcggguagucugacuggggcagcggccugagacgauuuguauugauaagacuguuuucuggagcuuuucugaguuuaucuauuagcugaccccuuuuccuccuucuuucccuuccuccuuccacugcuucuucuuuuacuucacagaugauuccaguaucccuauagcacuuggcaaagucacaacuguccugaauuaaucaccacaccuuaaacaauucucaauaacaauagucacagaucuauuuguuaaaaccaacaggcuccuuuagcaaauguuaaacgccuuaaccucuacagaacagcguuuauagacguaagacaguagaaguagcuaauagagaggaaggagcaggacucuccuuuggucaguuucuggagaaggcuuuccaagucuccccauguguaaauguggaaauuugaaugugggaagcaggaggccagagccaaacucuacugggugcaucuaucucucaugcuggcauuuagaagcuuggugauuaaaacauguuuaauugaggaccguucuagaugcucuggccgucagaaagcuaaauguuguagcauugucaggacgauuagcagcugucugggaaacaaagcagcccauggcucagcccguucauuuugcagccuugggaggcacagagcucuccagcagggcugacagugaaggaguaaagcccugguggguagcaguuaauccuucccucucuuggccgcucuguccaagaggcuucccuuacauauuccaaauaaauucuggagggcccugugggucauggaggagcuggcuuugacaaaggguucucuauccaagucacacagacagacuagcugagauacucaauaaauaauaacucuucaauuuaggugagcuugacaucaucacucuucucacuagaagcaucuaagguggaaaaaaaaauuacgcuuuuuuugcaguuaccagauuuaacuaccuacguccuuaucuuaauacaguugucuugcucaggcaaauucuuauaaaaagaccaccgagaaggaaggcuuguuuuccuguugccucaaacugccauucugacuuagcaggaaguacauucguggaguccugugguguuucuguuggcaaguguugggcuacacuugucagaaugcgccaacgaaccucuugagaaacacgcagugaaacaaacagcugagaagauacucagugcaggggcaccagagccaggaaaggagcacgugacugcuuauggagucccgggugugaugcugggaccggcccugugguggcacaugaaguagugucuguuagaagggaaaaugauaaugcaaccguugucugcgccaagcgcagggaucccggugcuucgauugcauuguuguuuuugaagucacuguggcucuauucuacagaaguuucccccuuucuagacuuguuucgguuuuuucugagcaggaaggcuuaucagggauuuuggaucagucuuucuaaugauaagugcaauaauucacuaccuguacacuccaauaacccuaauauuuguuuuaugaucuugucaugaaaaauguuuacauaacacagaaaagugggcaauauauucuuaauuugucaccauuggccucaucucauagcagacaccuguuugauggucacaucaugaagcacaguaccacagaauacugugaaucuuccaaaagcuucucgugagccucuuaccccuccuccaacuccaaauacuauuaguuguguguuaucuuuaucuccacucuucaaguuaguuagcucaaugugaggggauucaaaacuagauggugugugauaugugugcuagcagaggccauguguacugacuugggaaauucgggaaaccaccacaacuccauguuaguugcugcuauuucuguggaaaggaaaguuagcuuaaguauacaauuucucacucaaggguaugguagguagcacaugucuuuaaucccagaacuguggcggcagaggcugguggaucucugaauuugaggccagauuggucuacagagugagucucagaauaaccagggcuaccuucaagaccagaaacccaccuauguuagcuuggccuuaguaauaaaauuucuauaauauucccaaauuggcaccacuguuggggagcaaauguucccaugagcccauggggguaccauuuccuauucaaauccuaacagaaagaaaggagaugcacagcuuucuguagaccagugggugaggaugugggugcuagcauauggcuaugaaauucaccaguuacggaauuaucuuaaggaagcuccacuacuuuguccuauauucuccucaaggugggauaauaauagugccaguuucaggaaguuggugggaauuaauuuguacaagagauuuugaauaaagcuugguauaucacugcugccuaacguggguucauugcgugugugucacuauugacauguggcguggagaaagaauccuuugagucaggggaacuuccauuuuuaacucuuacagcuuugauuaaauuauuuaauuucuuuaugcuggaguuccuggauuugaaacgugagugauaauuauagcuacugcaaagaguaguuaaggguagaaaaaagugguguguguguguguguguguguguguguguguguguguguguguguccuguagugaggguggacagcuccuuucucacucauuucugugaccagcucuuacccacauggacucacaucuucaacugugugcagcuaauuaugcaauggagacuaaaucacugcuauuucuaaaaagaaaagcucgcccaacccuacugucuuuuccauuucauauggauacaggcucagccaaaucccuuggcccaguauugucauuuugcugagccuacuuugcugagccuacuguuggaagaagacucgcaugucccugcagagccuuuacuucugccucuggccccacucaccucaggguaacaugcuccaguucuucacaaaugagcgcggaucugccugcccaucauccauagccaggaacuggaaggaaccuggacaccagucuggcagcuucagaccacagaucaaucuuccauuggccacaauacacuacacuucauuugaguucauuguuaugaaaaugucuuuuuuuuuuuuuuccuaaauggcccacuucgcuccaaugggcaccugcuguaacccucagcauccacaaguagguuauuacaauaaaacauaauuucuugcugaagucacauucaguuggugguaauguggggagagcuggcgugaggccuccaggacaggccaagguuggcaucaaccuccagcuggcagauuacagaugagagagaaugaggagucacaagggggauauucaugagugagucuagaaaauaaguaauuacuucaaccaaauuccauagucccaggcucagucauaugaucguccuuggauacaaaggagucuaggaaugugguuuuggcuggguagcuccaucuuugaaacagcuauuuggauuaagggaacucacaucucuggacaguaaguaaauggagggggucucgccaccucccaccacaacacuaaagcccuuuacaugaaaguuaggaacauuacauccuaugguuccaaguuuuauugauggcuuucuguaaagaguugaaaguaauuugcuguccaccucuuggcaguggggguuggugccaagacaacuguaucaaguuuggauuccacauuuagccaaaaauagagacggggugacagcccauguaaagccugagcacauaaacuguucgauugaagccuuauuaguguuccaaaaucagauuucucaaaauccuugggugcauggcucaguuguacccuucaguaaacaugcgcacgcacggcuuguggcauagcauuuguugaaaauacaugcugcaccucccuccgaaaacacgcugucugagaaagaugcaagcgucccguguuucaguguuucagaguuuaaaauuaauccauauggauccauccguauuuaaauguaaauaaaugucauuuaacucagacucuucugaggauuuuggcugaaaaucaagcuguguguuuuuuguaaaugugaaaaacaacagaugauauaaacuuuugcuuuucuguaccuuuugcuuaguugucauuuuuacccccaauuugggaugguuggguggguugcucuuccuuccuuccuuccuuccuuccuuccuuccuuccuuccuuccuuccuuucuuccuuuuuuuuaaaauuuauuuauuuauuauauguaaguacacuguugcugucuucagacaccccagaagagggugucagaucucauuacagaugguugugaaccaccaggugguugcugggauuugaacucaggaccucugaaagagcagucagugcucuuaaccacugaguccaccccccccucuuucuuucuuuucuuucuuucuuucuuucuuucuuucuuucuuucuuucuuucuuucuuucuuucuuucuuucuuucuuccuuccuuccuuccuuccuuccuuccuuccuuccuuccuuucuuucuuucuuucauucauucauuuuguguuugaggcaaggucucacauuguaccucagucugaucuuaaacugccaagcucagcauggcucugacaucagggcaaccuucuugccucugcccccuggaucacagaugugcaccaccaagcccagauacuuuguuucaugugcucaugagguguaguaauuuaacagcuuaagugagagcuguagagaauaggguaagguucuuauacaggcauccuggggcaguugaguuuuuaaaggaauuuacugggggcgaaauagcccagguagucuaacuuaauggaugugcugcaaacauuguguguguguguguguguguguguguguguguguguguguguguguguguguguguguaugagaagcuuuuggucuuguuaacuacucuaagaauaguagcguuuaaaaaaaaaaaaaaaacugaguguauagccuuuuugguuauagaaacugcuccgugguuaguuccuugugccauagauacugcugagcccaugagaaauucuucucuacccuugaauguggaagaaagcaauuaauguuagcaccagaguucuuagccucucugagauguaaaaccucuaaucacaaggauaucauuagugcuccaaagcauuucauuuugaugcuugacagcauuuuaaaaugcauaaaccuuugauaugaggcaaaucagagcugugguguugaauugagaaagaaaagacugaacaaaaaccaccuuaagcugcgaguaauuaaauuuaaaugugccguuugaauaaagcagagguauuuauaaacugugcguuuuuaguuuuucuaucaggaagagaccccuugaguacacaucaucuauuuaaauucagauuccaggguaggaggaaguuagccuugcuguguggcuaucaucaucuucaggucauacaauggucaguguaccauugacauccacccauucaggguucuaaacuuugaagggcuguuuuugcucuuccuuacccauagggaggagcugguuuauuuccugccuuauucgccacugccccaaacccuaauugagccaggaauguacagcaguuggguuauuugagcuguuuccuuucccccuuuaaauccacaccccaacaguuuucauucauagcccacgauucucacuggauacaagaaagcaguggacuacagcccaggaguugaguaguacaucuuucccugggucuuuucuccuugucuccuuuucucuuccucaucucaucuggguaucucaagcaccaaacugaggcaguaaaaugacuuguagguguuuaauggcaagucauugaggaagugaauaaaagaaaauugcaguauucacaucaguagggagcaaggagaacugcugagcuuugaaccaaagaaaguuaaauuuaccacauucuuaaagggagccaccucuguuugacaucaaagcguccccuguaauucuuucucccggugaaaugugccaccguuagucacgauggagcccucuaaucuaugcgguuucuguuuauccaaaacacacacggagauaaaaccgcaugugccuucugaaugcuuuuguggucuuuucacaaaccagauacaaccuuagguacagagcgaauggagagucuaaauucucauuuucucagggauauguugaauuuggaaugucagauaauggggguuggcgguaguuggagaugugugaaauuuaucuugguuuucuauuagaaagcucaguucauucaacuuccaaaccugggugaaucuuccccuuuugucuucucuagcuuuugcuuuauuuuacaaauaacuuuacuuguuuccgcugguguguggaaaggcagucuguuccgauuguuaaaucuugguguuccaagucugacugcagagggcccucgauuccucuuauguggcaugauggauauucccagggauauacagggaugucucccgcugcagcuguuugucugcagugguccauacagucuuguauaauaaaaggaauguuggggaccuucugaguuucaggaaaugaccuagaaaccucaacuauguccuuccucacaauuaagaugucaggaaaacuauucgcauccauccuagagguacagaugagaaacagugaguaaauugucaacaccucugccauccuaaagagcagucccuccaaaugucuggaacaggugcagugaagccuggcuuuccuguuaacuuacauuugaaugacauuuuacagccugccuguuugaaaaguguucagaaacgucacguggaccucgccaacagagaucccauuuauaauuaggacugucaucugcuucgccgccuauugucaaugucuugguuaagcuagaugacaaaacuaaacccgccaaaggucaugagagguggaugcuggggggcgugguggggguugaaggagcauucgugacuggcacguaauauucaggaacuguuucacuguucacacacacacacacacacacacacacacacaaaaguuuaucaauuuuaagauuuagcucauuauuauucacucaaauguacugaccacacaugcuccaugcuaggcauccugaauccugaucuguaguaacgaccaguauagaauaaaacacuuuuugcccccaauuuucuuccaaguuaguccagcauucuauuaaaucauuuaggugaaaaauauacggauugaauaauuaucuuuuucacgcauuguagggcuccuuccacacagaaccagagagagaauuucuguuuauucgucccagcuucacccuucucuaucuugcuuccuccucaugcaagucuuuugagacaaggucucauguggcaugagcuggcccuuggguuuacuguguagcggaguuuaaccucgaaucucugacugacccgcaccaaccuccccagugcuaagauuacaggcaugcuccaccauucccaacauagauggcagaaaaacccugacaggccuuaccucaaauuaacgagaaauacuuugugacccaagguaccuuucuccuuaccccauccuccggucccaguauuaucuuguccuaugcagugcuucaguuccaauauaaauuuccaagcagaggcauacagcauccuuggguuuuuguuuguuuguuuguuuguuuuuguuguuuguuuuggaauggcugaaugguuaugucaguaugguuuguaaguaaaaaaggaaaugaagaauauccuuaggauuaaagaaaacaacauucccuugagacuaauaggagaaguuguucucuuagccacaucucaaacuaggacaauugucaucuguuugcuauucagaacauugccacaaaaccuugaaaauuaugggcauaauugagugagaacauaaaccuuuauuuagauaucacccucuccuccugcucgccuuugccagcuucauauccaucuuucccuacccguauauuaccaauuagugucauuaucccuucuugcagugugccacugcaaauuucuggcuuuuaaaacaggcaugcgcaguaggacuggggacauaguuugacuguaaaggacuugcaaagaauucucagggcucuggguaggaucccagcacuaugaugaugaugauggagguggugguggugaugaugaugaugugugguuaaacccagguguggcgguacauccuuauaaucuuagcacucaggaggcaggggcagaagcagguagauugcuugaguuuaagggcagccuaaucuauagagcaaguuccaggacaacuagggcuauacagagaaacucugucuggaaaaaacaaacaaacaaacaaacaaacaaacaaaaacccaaaaaacagaacaucaaacaaacaaaaccaguaccuuucuagauggacuggggauagacagauuuguguagauaucgugauggcacugaggguggucccagcgaaggacuacugggauguaacaaaggaagggauuguucuauguaaaguugggguuuuuuucucaacauucucaguaauuuugagcauaccaaggucaggaucucaagucagugcuggagagccucaaucaauguuucuuggaugcuggguaaucucacauuuuaacuaaguuuggggaggcaagagugaaggcugauuuuauauuguuaaagguuaucugccauuaauuggaagugcuuaaucuacuaaugggaaguuuccuuucaguauaaccacaguuucagauaaauguuauguauucaugauacaacuugucaggggcuggagggugguggcacaugggcggugugagaagaccuauugaugcuugggaaccagugggcuaagggaccgauugggacauuccauugccaagugccucaucgagggaaacagagcugcaggcaggcaggcguacacggcaagcugauggcuuccagauguagaauuggaggcugcaucggaaaugggguagaaaaaggcgagggacgaacccacauguggcuugugauguggaggacauccaaguugccucuuucccaaaguggcaguauggcagagcugacguuuucucaggccugaguuccuucccaggagagggaugaagcucuuaugugugagcgcuccaugugcuaaugccugacuuagguaugguucccggccucaccagcccauagauggcuuuugucacugugcccaguuaaacaccccccuccgccccagaacagcuguucaaucaagaauucaaauaggacagccacaucaugggguacuuuuugugaauuagagcucuguguucuauauuucaguagaugguaccaaaggcaaguaucaauucagaauucuuccuggccucauccgaucgguuucauugucuuuccuucuucccauuguguuccucuuucauuucucucucuccugcauuuuuaggacgucucagacaagauccacucugcccauuuuccuucccaucagugcaugcacauccguuucccacggaagugugcuuuaagacuauuuuguuaaccaagggguuguauugucucccugcuugagaguuucgaagagccaggcuaagccuagaucccuuuugagcagcuauaggaaugcugcugcucagacuucaaaaauugaaauuggauucauuuccccaugccgcaguguccucauaaccuagccagagagaagccauuucaguccaacggcacucucuggaggcauccaggccauuguugcccagagacucugucaauucuuuuucagaauccaacccaggcuguuucugagagaaaguucauuugauaauuuucugauuugcuucccuccugccucuucuguaauggcuucacuuuucuauuucauuucccaaucucgaacuucgaagcuuaaaagagcccccuuuuauggaguguaugcuaaagugcucuguuaggcaauauauuuauuaccuggagugaaauggcuuuucacagcuaggcagccuccugagccugacugccucucuaccucuauauuuaagaaacuugcuccuugaauucuauaggauaaaaguucuaugccagccagcacagaaaaagaauagcaugauguguguguguguguguguguguguguguguguguguguguguguguguuaauacaucuaacgagcacauuuccguucuucauuuucuucagauguucaguggcuaccauaugucugcugcuugcagcuuuguucauccaguuggguauuacuaaccuuggccuugccuuugauggagaccauguguauacacuguaucuuucaaugguguuuaugccugaguuccaaucuggaauagcuuuggauaugaggagggagagggagggagggagggagggagggagggagggagggagggagggagagauuaggagggaugucugaacauguguucccauccuagggcaucccuaacagagaugucaggcugucaguaucugccucaaggagacaacccuugcuggauuggcucugucauagagagucuuacuuuuaugacgggucuauccacgccacucugcugcuaggauacauaagcaucauguacggucaggcgggucuggacucuuuccauauucuguuucugcugguaacuuauuuuacuuaucccuuucugcauugagaguuggcagccccagggguuggagggaagcuaacauucauuugucagaagcccauuuuuacauucccacaguuuggggaguaagcauucaauuuagcaagcccccuaaucucucugguacuugaguccagcuuugugagauaagaugaaggauuucagggaaguuuccuuuucucucuggggauucacuuuggcacuggcccaugucugucacagcagagcugacuaacagcugucccgagauggcaacuccacggaggagagauagaugaaagcauugggcagccugguuuuauaaaucucuaguaugugccaccuuucccugcccaccacccccaccccagugaaaacugcuuucauguuuuuccugguagaaaggaagguuugcuacccaccaggcacaagaacaacaacuugaaccucuuguaaaauagcugcauaaugucauuaauguccagggagaccaucauggcuuuuauuuguguucuucauuauuugcauggccgugcuuaaacgggaaagucuuacuguaauuaagcaguacuuuuauuuauauuggaaaguguguaaaucgcuugccuuccagcauuccccacaguaacuguggaagaguggcaaauccuucugcuuguauacaauuaaguaucaguaagaagccucaguacuuggaggcagggugaaaggcuugcucaguuugaauggagguucugccugaggcaaguaggacuuauaaaaggauaucacaggcagugagcccuguacccacgacacccaauauagcaaaggcaguuucaggaaccaaggaauugacacugggcugcuaaaguuaccaacccuuugcuucacaguugaguguguguguguguguguguguguguguguguguguguguguguguguguguguaugugugugugugugcgcgcacacacacacauuuccaugcccaauuuugcaauggccaucagguauagaauauccacuguccuagucuuaguuaguguguccauuucagugaagagacaccaugacaaaggcaauucuuauaaaggcaaacuuuuaauuggggcuggguuacaguuucagaggucagucccuuaucacccuggcaggaagcuuggcaacuugcauucagacaugguggugguggaagagcugagagaucuaccucuugauuugaagggagcagaaggguuggcuggcugucuuuugcacugggcaaagccugccuccagugacacaccuccuccuauaaggccauaccuccuccaauaaggccacaccuccuaauacuguuuuaaauacaugaauccaugggaaccaaaccuagucagaccaccacagucuuccuccacccuuccccauucaccccucuacuuccagccuuacaaaccacugccaaccacacccagcuuuucuguggguacuguugauccagacucaggcccucaugauugcagagcaagcccuacccacagcguugugucuucagucuccucacaauugaucuuuuaaagacaaacccuaaacaaaggaaggucuggagauaaugguaauaauaaaugcucuugucuggaaaagggcaacgugaccaacaggaaggcaugggacucugaagucaagugaaauuguugaguugugguuucuaaaauauguuucuuucuaaaguaagauuauuauuucugucuuucugucuuucuccccgauagcaccaucauccauugcuuugguccaggcuaaagaaguuacaagauauagcguagcucuggcuuggcuggaaccagaucgaccaaauggagucaucuuagaauaugaagucaaauauuaugaaaagguacuucuuucuuucuucuuugcuuuccuucuucuucuuucuccuucccuuucuuucuuacuguuccuuccucuguguuguucaaguauuagacaguucuaaaucaugaaacagcagcaaaaggaaaaucaaaugcaucuugauuccccacaaaucugauuaugagauguaauauuuggcucguuaucuugaaacacacacacaauguucuaauauaauuauauuuucuuucgaauaaaagaaaucaagaccuaaucuauauaccuucuaucacagagcaugccucauaacugcuaaaauaaugauauguuuaagcagaucacugcuguucaaaauaaagguguggguuuugaugauuuuuaacagaaaauuggcagaggaaaauuaacauuccucagccccuuauagaaaggcauuaauuuugcaaauaauuugucucuuagcagauagaguucugaacagagcuauuugcuuccaagcuuguccagaaaaugaacagacuccuccucccccacccugcuuagauuuuuuuuuuccaagacaguguuucccuguguagcccuggcuguccuggaacucacuuuguaggccaggcuggccucaaauuuagaguuacaucugccucugccucccaggugcugggauuaaagcagucucuuauugccuuccuuauucaaaguaaagggagacuggauuguuuaauugaagucagacuauaguuuuugccacuuuccagacagaaaagaggccuucuuaaggggggcaggguaucauguagaaggaauacaaaugcaugguuuucaaugcauaguuguguucuagacccuugcacacuaaggaggacucagaggacacacauacaagggguaagggucugaaauaaaagauagugaugcugauuucaauuucuuaauaauuuggggguaaaaaaaacuagaaaaaaauaucaacuaucacuugauauuccuuucaaaaacagauggcuucauucucaaaacuccaaaagauuauaaauuaaaaaaacaaaaaacaaaauaacagaauagucaaugucaauaaugacccugagcuuuuuuuuuuuuuuuuuuuuuuuaaacuguaaaaagagacaccaguacuucaacacugcagagcacugcagagaauguggggcuuagggaauguaccuggugucuagucuuucgcuuccagacuccuggggaguuggagucccccucccccccccccccccccacuccuaccuagagucuccucucccacaccuggagacuccucccuagcuagagucuccucccucuccuagcuaaagucuccucccucucuaccuggagucuccucccccugcuaccuagagucagaggacucauuuccuagcucaccaguuugcuucacucucauguaggaucagaaugaacgcagcuaucgcauaguccggacagcugccaggaacacagauaucaaaggccugaacccucugacuuccuauguuuuucacgugcgagccaggaccgcugcuggcuacggagacuucagcgagccccuggaagucacuacuaauacagguaacagagaccccccaggugccaccuauucccagacgcuucauuuauagguucagccccacucuagugaaacccaaagagcuguguagauaaacauuuagcuacuguggauauuugcaugaaacagaagagccaauaucuaccucuuagaaacccuugugcuguuugaaggagaauguuuuucauaagaguuucucaucugccuuccuaugaaugaaaaacgaugucaauguuuaucuuuuugaaccuucuaccgaccaugaauaauggguuugcuaaccugacuaauugaagguucuguagccaccccacuuuaagaaaaagaguuuucuuccugagaagauuaaagaaggaaccaaaauuacccuuuuccccccuccuacuuguuucuaagaaucuguuuaaauagugucauuagugugcauguauguuuuuaaguccuuuguagaaauauuaagucuugcucgcuggagagcuggaacacaguuuacugagcaagagaucuccaccuccugaauuacuuaaccuaggcugggccuacucgauagggagaugcugcaacggaaauucucaacaucuguuacagauauaaauuguucauauuggagggcuauuaagugaggaugaagaagacggaugggaagguggagaugacuauaagggacacuggcauucuugguguuuacaggaaggcuauaaggagaagguugcucugagccgaccugucuauaagcuggauuuuuaacagaggugaugaaggcagggcaaaccuuaugaguuuuccaaaugugcuuuucaccaaggaauauaguuuuucaguaugugauuuuuuuuaaccaaaaaaaaccccccaaaagauuuuaaggcaucaacauauauuuuuauauuuaucgcagaaugguugggggugguggugugggauuugccuaauggaugcugugacauggauuugcuaacuuggauguugaaugggcuaacaaguuccuccucuugggaccacucccaugugaccccauguacuugucauuccagugccuucccgcaucauuggcgauggagccaacuccacuguccugcuggucuccgucucuggcagugugguccucguggucauucucauugcagcuuuugugaucagccgaagguaagaacagaagcgccucacgcucccucccaguuuucuucaggaggcuucugucuucccuugcgugcccauaccauuuagcccuuuuaagucuggacucugcaugcaccaagggugagaaaagcuguauaaaacgcagacccaaaaccugagcauugccaucugacagcaguauuuuauacuugaaagagaaauaguaauggcuugguugcauggucuucuuccuaucaccucuguccaauuguucacacugaccaguacauaguaucauggggcaucaucaucagcugugccgauucuuaucuuagccgcuucucaccauagaccacauucaugauuucccacagcagggcuuuuguuguaaauaggaucuucucauguauaaggcucuucaagugagaggggaugaaagugacauaaaggaagauagggugcuuaugcagcaucaucuuguugguaugacuguauaguuagagcucuguguggaucccgagagcuaugcuuggcccaccggccaccaacugucagauugucccauccaccugcugauaaccucaccaaucaaugucucuggcugucuccaucguguuugcaagccacaaugcuguuacuucccauugacaugcauugacaguagggugaugaacugauguaagaguuucccugagaggcccgugccucucccaguaucuugauuccacccuugcucuguagagugccccaguauauauacaaagguccauuuguucacuccagugcuagcacaguauggaacgauguguugcucuguauggugucucuguguucgucauuggcuucauuguuuuuugcaaagucuacaaguagacauauucaaucagagcuguaagcuaugucuccaagaaggaaaacuuugaaaggcaaucaagacuuucccuaccugcugcccugucuugagguuuuacuucuauguauguguccuguaaagaaugcauuguauaaugcauaggaagugguacauuguccugaacucguccaguugcagagaaaagaaugagauguguggguggguggaaauuacguggacauuuguuuacacuaaggcauauuucaguguuucaaauauaaauacuggacauauuaaaaugguaauaauuaaugaaaaccaugaauggccucuacuucaaaaacaguagccuaaaaagucuguuuacugugugaugcuuaggggagcaugagcaugucaagcaccuggcaaaugaacucaucuuguagacuguacucaucuugugguccagcuuuucuguaaauuuccucucucucucucucucucucucucucucucucucucucucucucucucucucucuugguugcaguuguuuuaaaaguguccccaaacacagcagugucagacucaggcaguuagauaagccacuccuuguuacuguucauugucaaauuuuagcuuuggugagaagaaagaaaagcaaggacaccguaaugcugggagacuggaacuaaaaauuggggcugcagaaggcagcauccucauuucugaggacuuaauucccuuugugcuuuuauugaucauuuuauuauauaaggggagaguggcagaaggaugcaugagauuuccaauuaugaggccauccccuccuuagagaauugagccugucgaguuacccagugaugacuccugcuccuucccucucauuaaaaaaaaaaaaaagucacuucccaagucugauaaacacugcuuggcgauugguccucaauggaucaguuuuuagaaaaugaaaugucagccccuugcccucauauugauucuuccuuagugccggccauaaagcugucaagggaagggcugccuggagccagguagcugacaggccugcagcggcagggugcucacucagcuaauucuucucccuaccaggcugucugcucuguuuaucagggacaacuacauguauuuaaauaggacaacaggugagcagagaggagaugggaacuccagacaaagaagugugacccagggcuuuaguuagaguacaaacgacagugccaacaguauaaggaagucacagacugagcaucugagccuggagaagccaaguuaccuuugcccuucaccaucucuugcuucugagagccaccuaauguugcugucaaaaaggaugguggaagccaggccuggugacacccagcacuggggaagcugagauaggaggacugagagguuggggcuagccuguguccauagccuguguccauagugaagcagaacccuugugagcugagcugaaucucagggcauuguuggccugucagugugaauggaaagagacucagaggaagaaguaguuugagagcuucugggggccaccaggagaaaaaucuguuuguugcuaauuuguuauuuaaggggaaacugccuuaggcucacaauuggcauguugguggauuuuaaaauagcugaaguuuauuuauuuuauuguauuuguuuaauuuguaaugagaugccagaacuugagguaaggaggaauaacccccucuuucauucagaaaguucaccuuccuuccuuccuuccuuccuuccuuccccuuccccucccccuucccccuucacccucuccuccccuccccuucuuccucccuccccuccccuucuuccucccuccccuccccuccccuucccccccccccccucucucucucucucucucucucucuuguccaacuuaaacaugugagcacugagaaauuucuaugaaagaaugaaauucuugcauuuauaaauuuuaaguauccaacauguaagcagcaugaaugcuguccagcuguggcaguuauguugacugagauguuuuuuuuaacucacagguaaauaagugaaugcacuuucauuuuguuacauuuuaucucuugggcaugcgcauguguguagaggucagaggacaacuugcaggggucugucuccuccuccuucuccucccccuccccuuccccccucccccuccucuuccuccucuuucuuccaucaugaagggucuggggaaugaacccaggucuucaggcuuggcagcagaugccuuuaaccaaugaacugucccaacagucucuaauuuacauuuuaugguauuauagaucugugcuuagguuaucauuucaggaggauaucugcuuuccagagcacccaacugcccuugcuauagaugugacacuggaguacugucaugagaauuuuuaucccaacuauauacauauucucuuaaagagcaaaucaccguuuccccuguuuauauauauguguguguguguguguguguguguguguguguguguguguguguguguauggucucaaguuuaaccaccuucuuuacugcuuuuuaaacaucucuuucaaaggacuguuaauaguuauauaauuaaacgcaacuugaaacccaggaccucccagacugacagacugcauuaaauuucucugauaacccuuccccuguuuuagcaaugauuucagauuauuuauuuauuuauuuagcauguguguaugugcacucauguaugccauagcaugcaugugcaggucaaaggacaacguucagggauugaguuuuuucuucuaccaccggagucccaaagaucaaaccuagauccgcgggcuuggcagcaaguaccuuuacccacugagccauccugccggcccucaacagcauguuauuguucaaacaugggaaacaauguuaagaacaugacuaaaauaugggaagagcccuuggguguucuuaaaggacucuucgguuaaaggauagcaggaucugaugguccaagaacaugcgcugacuucaagaugguccaguugugauagccagugcuccuggguuuccauuugcacaaggauuauaacauggcccuuuccccagauuacaaagaaccaaauugauuuuaaggaaaacaguguaacauccauggaaaaauuuagauguuuaucagggccuguaaucuuugaauagaugacauugaauguaugaaacaaauucagaauuaauuugucucauaccggaggcucacauucugcacuuuggagcugacagacagcucaaggaauccuaaaagcgauucugcuuggccuaggcccaccuuuccuugagcccucagaugagacucugggaugacauagaaauguugcccaaaugggcucugauggcaucagguacauugacacaauugggaggcaacugacuccaggaaaacauuucuaagcagcuugcaagcaaccacagugguucaauuccagaucuaucaaacugcugcuugggaggagccauuaggcaucuuuugaugcaggaacaguggcagcuugaggaaggggaaaagggaugugauguaugaaucuuuguggcagagacuccugagcucuggaaagggucccuacaggagccaugcuccuuauuacggccuugucuuuaaucugcacuuuagugaauaaauuacuuaccuuuuacuaauuaacguuggaacagugaaccacauucaucaaaucugugcacuugaugaggaaaguugcuauuuugauaaaaagcgagguuuaugggcagccccugccacacuccugucuucuuauuuauuuuauugaguagucaaggugcuaggaagagcccauuggcuggaagguuuccugcuguucccucuggugaugguuaauacccuuauuagccagucccugggauggcagggaggauuccauucacuccaaguuucaccugcagcgugagggcccuuugccaggacaccuacuguggcaagguuccacguuuccuucuggaccauucuaacuaaccauuccacuacuuccccuugcuaaucgccuugucgacaucuuuguaauuagaaaaucucccacaaagccuugcuucugccauucaggugaccugucugggaugucaauuuagacucagcucaucaggagggcucacucgaaaguaagcuucaauggucuuucucuccugggauaauaaugagccacauuguccaacauugagcccaagggaaaagggucauaggugacagagguagagccgaacucuggcauuuuuguuuuuaagguauuauuagcgugguaauaggcuacaauuagucuuugaacaguaacccuccuguuucuuucucaauauccccuguacccuuguaggguccucuacuccaaauaacacuccacauuaaaaaggccuuuaaaagcaccuucaccggucagauucuucuucuauguuggcaagucugaggaugaaaugggagggucaaccuuauccuuaaugaccucagccauuuuguauuuccucugguuuugaccauuuuuaaugaaugugcuugaugugaaaacagccaugcuucaggauuucuugaggccacugguuucuauuguagauacccaucuaaaaacaaaacaaaacaacucuuuaaguuccaauggaugccaagagcuaaaguauauggcucaaugacugaaugccuuuccagcaugcauuauguucaauguugggucucuggacagguaaauaaaggagggacaguuacuaaagcucucuuguucucucucuauuuuuuucugcuuaauuucagcauuggaguuuuaaaaugguuuaaaagauagucuuacgauuucagauaaagcuuuuagaacucugauaagauagccuaucacacccuagggauuuaagucuugauauuuucccgaccccaaauacuguuucuguauguagucucugaccuaacaucuuucuguuaacuuuuaaaaggggcaaaggacgggacagggaagguuagaggggacugcacgcuucauagacaguucuuucuagucacggcauuaaaucuauuuguuaaguuucuuugacgccguuuaggagcaguuggaucugauguguggguuugcugauaucaaauguacuguuuaggcuggagagagaguucacauagucaguugcuugcuuugcaagcacaaggacccucauucaagccucagaacccaagcaguagcagauaaaagccagcauggugguauguaugcugauaguccaguuugggguggagggacaagauggauagcuagugagucccaagacacaguaaaagaccuuaucucaaaauguggagagccucugaggagugaccccgaggcuguacucuggcaucugcacaugcacaaacaccacacacacacacacacacacacacacacacacacacacacacacacacacuuguacucgcaugcacucaugcacauauacauaaaacauacuugcaagcgcacucgcacacacaugcacaaucaauaaauacuuuucaauguacgauuaagucucaucauuuaucuucucacuucaucuccucugggagaggcacuaugcagggcuggacuggaccagggcuggagaggagaugugagugaugcccuugguucgguauccuugccuguaccaugucuucauccguacaauggagcugaacaugugguuuccaccugauuccuuucauaggguuguugugaacaagcaauuaaauaauagacccuuugaaggcccuuugaaaagcuaacugcaaaggaaaacacaggcuguuauuugggacugaaauaugcacuuugcaguuagcugugguaacuggggucucuguuuugcuaagcuggcucaugcuuugcaaacagcuaggggaggagauaauguauguaaugagacuacuuugaaaaguuaaaugcgauguaagagcacaagguauuauuauuugcaagggaauuauccacguagaggaacaucugugggcucugagggucugauugcugaacuggugccuacauagcugacaaauuagaggacgugggagggagcuuugcgcaugugcccagggcugcgcaugcgcuuuccgcgcugccagcggugggcugucugcccacuugcccugcuuaucucuuuuagucucuacccuacuuucuugucuguaggguuaucuagccuuucuacuuguucaaaguugauaguuugaggauaucucauucugauuggaauacaaacacacuggccuuacuuagucuugccuugccuuugaaacucaagguacaaugauuaauuuuauuguaaauuuuacuaaaucauauauuaacacauuuuauuccuuacuuuuccuuuagucucccaaagugaagggaacuguaauaaaugaauuaacuuuucuaauuauuuuauaugauauaaugucuccucacuaaacauaaaguguacauuuaagggccaaggauauaguccguguggaauguuggccuagcaugugauagucccuggguucuguuucuaguaccucauacucagacgcaaaauuacauaagcauauacauguguguguauguauuuauauauuuguuuuaauuuucaagucuugaguugauuuuuccacuuuauauaagugauucauauuuucccugacucaagaguuauauguauuagagauuuauauuuccaaaacuuuauuaaaaauaaaauaaaaucucauuucaacagguuaugggcaagcaguauguacauuucgagaccagguaccucuuauuggaagagaacuuaaagaccuggugguguaucacaucuacuggaauguagucaaguacaaagcaaauauuguacuuucuaaaauuguaucuuauaugcuauagaguauguccucccacccaaccucuagcccccagaugaggaccuauccuagggccuugcucuuucuaggaacccuacuacugggcugaauccucaaucccugaaaccuggcacgauaaugagauguuaugaugcuaucaugauuauagcaacaagauguguucauuaacuaucacacacugaacauuauugccaucucacuaaugaaacucacuuuaauuaagaauguguguacagggccagcaagauggcucagaaugaaaaagcacuugaguuuaaucucuaaaagccauaugaagguagaaugaggggaucaacuguccaaaauuguccucugaaugccacagccauguguacaggcccacacaagugcucuuauauacaaggaagaaggaaaaaaagagaaaaagaaagagagagagagggagggagggaggaaggaaggaaggaaggaaggaaggaaggaaggaaggaaggaaggaaggugggaaaaauaagcaaucagagauucugggcucugauggcuucagcucuucaccccgacucaacagagauuacauuauuaucuuuauuauuuuaccuuucucuaagccucaguuucccuauguguaacaugugcacugccuauccacccaacuuguguuguggccgggaauaauuuuucauuacagauguuguauuggaaaucauuuuccuuuucuuuuuaaauuuuaauagacggaguaaguacagcaaagcgaaacaagaagcagaugaagagaaacauuugaaucaagguauuaaaacaaaaaacaaaaaacaaaaaaaaaaaaccaauugauuccaaaaguaauuucauuuuuagagcaugcuuuguguuaucuaauuuagaaguguugguuaauaugccugugaauauuuauauaaugcauuccuuauccaaauaacauucgucaaggcugucaaggugcaauuggugauuccaaacugugcaacgugagguuaaaggcaggaaguucuauagagucugcacauuuccucuucugcuguggaaaaguguuccuuuagcugcuucacgucuggagcugggcagcaagacgugccggguuaauaguuuauucucaugaaugaaaaacugggggaggggugggaugguaaaagaacagguuaugugaugguagucuguguugcugggaugacagccaucaagaauuugcuagugaauucuagauggugagcuuacaaauaggcucugaccaaagacauugauuuaagaaguuccaaacacuuaaagaaaaccagaugaccuagcagugguucgcacgggacuuucugagaugacaagauagugucaugugagagaacuguagccuacucaguuucuucauaaugacugaggagaagaaagggaaaaagauggacacauuugggcaaucacggagauuuggucagcuggcauugcgcauccucaaguccccagugcaaaugccaaaggaagcucucaguguaugucaucagcugccucagagcucacauuuccaacuugucugugggugugaugugugacugaauuguacccauaguaucugcaacauucagcuagacugaagcucuaccuccagcugaaccugcucuguaaaacagaaugcaaguggagguggagucuuuauucucaaaucaaccaguggccaguauuccucccaugcauuaucaaucuagguuuaaucuaagucuguuccuuacugaucauguacuuaguuggucuagcuaugggggagaugugacacccuguagacagggccugugggaacugagagugccuauuuauugucuuugaugagggacagcauuugaaacgauggcuauggaauguaugacuuuauguuaggacaaugaagcuagaagccacugguugggagaaaggagccugucaacucauuccaaauuuuuugauaagagauucgcuuuuccuccagggacaaguuguuuuuaaacucuuauccuugaagugugaggacauuccaggaagucaguagagcugcggugucuugagcagcuagcaaauucuuuguuuacccacuaaugaaaaacagagcaagcauuuaaacauuuucauaugucaacggccauagaguuaacccagcuuuugcuaugcaaagggauuuuuuuuuaagagcucgacccuuuagguuuauucauguugccuuuauccagucacuuuauaccccauguucauuucuuagguguuagaacuuauguggaucccuuuacauacgaagaccccaaccaggcaguucgagaauuugccaaagaaaucgaugcauccugcauuaaaauugaaaaggucauaggaguugguaagugucugagugugcaucugauagcuuccuuuguaaauguaaaacguauauguaaauuaaacaauuacauucacauguacgaguguauugcacguacgucuauaugcauaaauaguauucacggagauuuccuuaaucagaguauaaaugcaauguucuguaaggaacuuuggugcaaauguguauuuuaaucucaggaaaaauggggauaaaauaaaggagcacgugagaucuguagccagacuagguagauucagaaugcucuaauucucgaaagcugggagacuuuggugagcuuuaccguaagcuugaguuuccugugauaaaauggagccucuaagaacagccuucuacuaggcuuugggaaggacuaaaugaaaucgucacuguggugcccuagcuaggcaccuguccuauaauaagcauacgaugaagguuaucuuguccucaaugcauuccugaugcaucucgaacccuucucccacaggugaauuuggagaggucugcagugggcgucucaaagugcccggcaagagagagaucuguguggccaucaagacucugaaagcuggcuauacugacaagcagaggagagacuuccugagugaggccagcaucaugggacaguuugaccacccaaacauaauccaccuggaaggcguugucaccaaauguacgugugcccccccacuccccccuccaggaagcuaaguugagaguuaacagggagauuaaauacacauuuucuuucuagggaaaugacagaugggacaggccuacugauuacuaauaagaggaaaucagugcaggacaagucauuaaucuuucagucagcucuaaaugggucuaugacugcagcugaugcccugucuccaaggcaacuucugugaaauuugggggaaauuaauauugcagaguuuuggguacaccauaccaucuuucagaucuuugcuagaccaaacugauugucacagggugggcacgagcagaugguaaacaaaaucaguuuuauauaaagcaaaacaaaagcucgccacaccuuguauuggaagcuuggguuccagaugcagcgagggaaacuugggaaucuuuauuauauugagggauucgcuugucugcucugccugauuuauggcuguugccauucagcaccuauuuacaguaacaccugguugaaccuuccuuuuuuaguccauuagcauucacugagcuugugaaccacgcuucaguuaaaaaauacgacacagcucaacagacucguuuugugaagcaaccccuguguacaucuguaaggcuggcuaagacuuauaaaacgccacauggauggggcacugaagcaggguguguuuaagguggcucugguccaggaacccugguaccuaacgacaguuuguacaagucaaggaccuuguaagccuggggcucugucuucaaugaagccaaggcggcucuuacuugauuuaaggugucugugaaaagcuugucaaucaacaagugcugagggucaggauggcugcuucaguugaugagacacagggagggggggaauggguuacauuuguagggagcuaaaaguauccgaucuuuaggaugaagaaaccagaagguuacuuuaaacaaauacgccuccauuggaaucuucuaauaaugcuugggggugggguggggggcagcaagaugccucagcauguaaaugugcuugcugccaagcuugauggccugaguucagucuuaggaaccugcuuggcuggaaggagagaacuuuacuccuaaagauuguccuuugacuuuaggacaaguuccuuguggcauacaugcccuccccuguauucuaaggaaauaguuuuaaguagauguguucucuuagcuuuuaaaaguucccugggucuccucuaaaagcaguuugaauguuggguggggauggggagagccaccuggguuuuccuuccuaugaaggacucaguaaaggggaggcuaacaugggucccugauccauuuggagaguaacugaccuuaugaugaaguguuugcugacagcuguuaucagaagcuggugguggcuuugauggguuggucagucuuuuguuuuacuguucucaucuauaaaaauggagauaaauaaagcuugccuugcaaagauauuuagggaaggaaauaaaauauuuaaaguaguuuguauugcacaauggcaaauuauacacacacacacacaccucuuuaaguguuaacggguguuauuaugucugaaggagugcaucucuccucacauugagaauucuucaaaaagggaaauuugaugcuaaggacauauaauuucuaccucaggugaagguuauaauuagcauagaauaguucuauuugcuuuuuaagauugguuuuacagacaggauauuuuucuguugccuguggccuucgaagcugcccaagcccuucacuacuuuaauuaaaagauaacauucccuuuaaauacuucugcaggucccuuuucuagaaaagggggcucuguucuacuccccguguuuuuccugcagcagacagugauuuuccuagcaccucugcggaagagagaagaaacaggggaucuuuguguuaaagucccaccgcgccuuuaaaaacccguagcuauuacagcuguaacuguuacaaacgacuggguucauuugcauaaugcaguugucacugaauuaaaaugauuuaaaaauuuccaccagagaaguuguuggggucuccuccccuucuguccccuccccucggaaucccugccucuuggagggaagcagccaucuccaucccaaacccacuccugacggauuguucuuaccuuuguagagcuaggcaagaauaacccagugauauuuacccuuucucacagcaccccuaagacaucccuuguuuuucuucuguccucuccaacuccgaagaaggagcuugugggguacaacagacuagagaauacaggaaacuugaauagaaugggaggagacaggcuagggagcugugagggugaaagggucccaucaaagcguguugucucaugaccaaccagcucccuggagaaacuaucuagauuccagggaagggagggggaggggugcgaaguguugggggggggggacaccauaaauuuuucccuuuccccacucuuggaucuucucuucuggaaagcuccagagggaacagguaaaauggaauuagguguuagcgcuuggccgagagagcagacuuuuccucauuaguugacaaaguaucuuuugauggaggcaggaugacuaagauucacgcaggugguuuuguugaggcccaggacuuggggagggcaaaugugcugagaauggggcccuuccuacguggauggaacugagcaaggcgagaagggagcaccggaggaccccuuucagcaaggccagagccauucuuaguggccuuguguaguucugacuucuguuccucgcuggaagucugaauggcgucauucucuaguuuaaagugcuugacacacacacacacacacacacacacacacacacacacacagagagagagagagagagagagucagccaagaauaaauugaacuucauugaaauuaaaacuucuaaauucuugccucugaagcgccucucccuucugcacuccaucuuuggguugggaauguacugauuuccaaauaaaaggugcuuuucagcaguaagauagcccucgccuauuuuaugacuaaaucacgaaguccaaucagcaagaacaauaaaaguaacuauuuucauccgcuuagggguugcuuucaucaaggggaucuguagcucuguacucuccccuccacacuuucucuuagugacacaaaaaaagcaggguuacgacgcuugcuaacucccccuuucccacccuguaacaguaccucuugaaaagaaaauuucagauccuaauuuaauucguugccuguaagaaauuaaagaaagguuauuuccgaagguuccacagaagagcugaagcaaaaggaagacgcugauuuuucccacaagucccgauagaccucccgacucuuuugcucaaacaauggauucaagcuccugucucagaugaaguuauuugucuucacaaauaacuuuauuuaguuuuaagauuuuacuuauuuauuaaaauauauacaauauauuuucucauauucuguccccuccuccacaccucccuaucgcuccaacuucauauugucuccagaggggggggggaauggaaacaaacuaacucuccaaaaaggauuuguuugucuuauaagauaaguuguuaaaggaagcacauagaacagaugugugaugugagaaaguacgggaaaucacagagcccaggacaagagcgagagaagggagcaggauccuauauggugugugcuucagguuucaugaauaaugaaguauucaguauaacugcagcacuacaaaacuugacuuucucuaaagaagcagcuuucucuguccacagaauuuagcaucacuugagaugcucuucuggggauaaaaaucaaugaauuauucuaaccccccccccggcuuuucaacaggccuacccauuuaucaucuccccccucccccguuguuuaagagagcaauuauccauucaugugaucccuggauaccagaggccacuuuuguuaagggcccugucaacaagccauccgaaggguuaaaccuuccagauggaauguaagccuauguguccuuugaauauuucauucguugcuccccacagcugaggcagaagcuuggcuuguuuuaauuaaauuagaucgcacaagacaggugucuuggcaguaaaauuccgcgcggcccauuuuuaucucauuaacggcacugcucacggagaguuuuuguuuuucucuuggaaacucuagguaaaccgguaaugaucauaacggaguacauggagaacggcuccuuggaugcuuuccucaggguaugugucuacuuucuaugaagccagggaauacuaguagccagucacuagcagauuccuuguauacgcucuguuccauugcguucgugagauuuguucaguaggauucaggaagagacauggaaucuggugugauucuuaaggcuauugaauaauccaugggcaaugaagguagaauuugauuuauucucacaccggagggcucuuugugccaugaauucauugcacuuggacaauuuccaucuaucacaggaagccaacccagcuccuugaguacacucuuacucguuggauuagugacuuugcucagaaaggcccggaaauaaugcugaguuucauugcucgccggauacagauauucaaaaagagucuaggaauaacugcuuggugguaauugauuugcccugauguuaaugggaccguucccacucucuuccucugcagaagaaugauggccgcuuuacagucauucagcuggugggcaugcuccggggcauuggcucggggaugaaguacuuaucugauaugagcuaugugcaucgagaccuggcugccaggaacauccugguaaacagcaacuuggucugcaaggugucugacuuuggcauguccagggugcuggaggaugaccccgaagcagccuacacuaccaggguaaggaccguuugccaccucuggcauggcaugcacucucaugaaacugaucuucucuugucaucuugagcuuggaacucuuccuaauuuuuuuuuuuuaaguuuacuuguccuucaggcccucuccauauuucugcauucauuuuuuuuaaaagcaugacuuaaaaaaaaaaaaagaggauuugaagccaacucuaaugggugaccauuuuauagagucacaaauuacaagcaaaaugaauucucuuuccucugaauuuucuugggcaaaguguucaugaacaaugagaggguaucuuuaaaauugagccaaaucagaagccagagucaaggccaaauuuacucaacaaaugauacauuauuaugaaaaucaggaggcuggaugacuuauuguauauguauauauguauaucaaauauauaucgauguaaugcuagaguucucuugauuuucugauuuuuuucccccaucuuccuucuguacuccuuuuccuuucugagcuuucuacuugguucuuuuccauucaaaauuucauguucuagacaagccaaagcaauauuucuacucauuggcuagugaauuugugaauguacgugcagaacauauagagcauuucucaauaucugauggcuuucacuuuagcacggauagaucaggaucuaggaacuagaucagaaaggaaugcucgggguagggacagaaugugugcugucuuagccugaccaucagaaaagaacauuggaaaggaauaaaggccccacccucaaguaauuccuaucugcauacagguccccuucucaauucugaggaggguaucuaugcccagcucaagagauuuuuuuuauugccauuuucaauauuggaaauacauguagauagguaauucccuuagcaaaauaugugagggcagcaaaugugcccauccauaaauacgggauguggacacaguaggcuggguuuuuuucauagugaaccacagaacaggaaaguaauuccaagugacuuauaaggcaaauccuaaacgcuggcugauggaaccauguguggaccuaaauucaagauccuuucucuaggcagaacauuaggaaauuugaaacucaacugggaaaaaaggaaacaaaaaaccaaacuuuuuuuacaagaagaaucaaguagaaaagugugaucaagcaagaaacaugaaagauguuuaguguaguuuagcuuuguuuuuggaaaacauuuccucuuugucugggugaugauuucuuagugaaucauuuucugugauuuuuaaauuuuugaaaaauaauuuagcuaaaaaguagacuuucccucauaaaaacauacugacauuuuccaagggccuauugccuuuuagauuauauugaguaauguuugccaugcuaccuaagacuagggcagcaguaugguggauagaaaauguccguauuugcacucuuccuuguucuuguucaauauuuucugucaguaucaagcaaagccuucugcaaggcugcaugagggaaaggcaguaagaaggcaaaacaaacauaagcuauauauccuuugauaugccccaaauaacauauguauuuauguaaaaccugggauuuccucucuauaauacugcccuaagcagcacucaggauaauuaggcagauuacucauugacuucccugugguuagcaaacccguacagagaucugccucaaccuaaaaggcuucagcuggaauaaacaagucuguuguuaccgagagcuaccucaggaaugcuguccucucucuaucaaguagucccagcauucagaaacaaaacuggccggcacaucggugggaaagugaggaaacuucugauagcugacauguuucacaggguggcaagauuccuauccgguggacugcgccagaagcaauugcguaucguaaauuuaccucagccagugaugucuggagcuacggaaucguuaugugggaagugaugucauauggagagagaccguacugggauauguccaaucaagaugugaguuuuuacccugagcuucaggaaguuguauauuacccuaugguuaaguaagcauuggguuugaaauaauacauuaaagucaauguuuuaaauauaaguaaauauaccuaauaaccucacuccacauuauaacccaucagugacuugguuucaagaccaaaauuaaauuauuuccaauguuucguguaggggaagaaguacauucaugaauuuauagauaaauaaacaaugugaaguuuguaaggaaaccuauuucacaugugguaaaaucgacacaaaaguuuuuuguugaaagaaaccuagugaauauuuuaaaacugcuauaguuguaauuagaccuuggcccucaaggacucuuaaauaaagcuucacuaaaugacccuuuguaaauucugcacaucccuuuaaauguaccaucuggacuaguucgagagggaguaucuacgaugcaugcaauuucagagacgcauucaauaaugacacuaauaagauuccaggcuaauagaauuuaauuacagacaucuccagugaggaagggaaaaacaaaugcacaacacagugaggcccagaucagggauuuccuacaacaugacuuaguuaauucugguaaaaauuuuuaggauuagaaaugaagugacccccaguccccauaacuuccaaacucuacuacuauuuacucaugguaggacauuauagaagagaguuuacaauguuauauuuaacuuaucaaugaaaaugaugcuuugagggugucaugcucugcuguaaacugagcaagcugagcccuuaaaaguauauuuuggaaagcuuuucuuguaaaacuugauucugacguggaacggugucugugcauuggccucaucucccuaacacaauaggaaauuacaaaccccacacaguuaaagggccaaaugacuugacuagaaccacaaguuccaacaagcagaagguggaucacaccaaucgggaggccuuguguucacauguaaguggccgagcggggauuuagcugcugugccuacccaguuuuaaaaaagaguuguagcacuggcauugugcaucuaccauucauaaaagaggauccaaaguggacaggauggaagaugacagcuagaaugaugggucaauacaagauggauaaagacugggugguguguggggugaaugcuguggaguccauuguguaaagggauuaucgcuuauagaugucuucaagaauucucuuucaauaguguuuggauucagucccucagagcacggugagcuugacuucacauaaugaguuguuugucauuaaccuuccuuuauuucaauugagagucccagauaaaugugugucuaugaaagugaacaacacugcugcccuaccuauucucagacuucauaauuuugacaguuucuuuauuucuguagagcaauacuuugcauuuggguggcuuuguggccguuucuugcucacaaauaauacugauaauaucauuuauauauugucugucuggauuuggggaaucauuaggaaauguaaaugacaucacugggcaaugacaaauacaaugacagaaccagggaaaacacacaaaacuuaguaauuuuuuuuuuaaagaaagaaaugguuuccccacccaagagauucagcagugagcugaaaaacaugcuuuguuaaccuaaaagccaucuuuccagcuggccaugcguggguaaggagccugggagagcgcagagagcgcaugcucaccagugugaguucuccaggcaucagcccagugcucucugcauccucaucaacggagaaugcuuucaucaacuccaaagucaauaccaugcauuuggaaagauaaaaggaauaagaggcucaaacugaccuaaugugcuugccaaaauuaaaauuaaauacaaagaccuuacaggagguagagcagaaacaucucuuuuagaaggagaagcacauaauucggauacaguaaaauauugaaaaauacuuggggaggugguccuccaucaaaugaugauugcuagacugaagccaugugcuggcugaaaagacagccgucaaauuuaugccuagaaucgagaucuacucgaacugacuguuuucugcccuggccaguuuucucaacagucaauagccccuugagggacagauccagugugguuaugggauggccgcaguacuuugaauucugggcagcgaucauuuggggaggggcaaagaaaaagaaaaugacaaauaaaaaggcuuaagguaucaaacaaaacugcuuccaauaucugaggcugcucauuaacaaggcuuauuaugccugagacucugugugaagaguucccccuccuaaaguuggccggagucuuuccugccaaaucaccuauacuggauucgggucccaguggggaggggauuauagaaaaagucagugugaagguaguaugagccaagcaugguggcugaggcaggaagauguccauugggaggccagcaaacugaacuacguuguuagauccuaucucagaaaacaagagggauguggguggagacuggaagagaaccaauguccugucugugaagacacaugagaaggacuaaauuagaagagaagaaugguuccuguaucuaauuaagcaggaagacaaacgacaccaaauggccuugaacaauaagacaauagacaccuaccacugaaauuuccuuuaaugcacaggaucugccuuauaauaugaauggauucgaauauauuuucaagaauugacuuauuagcacuuugaauagaguucaucagcagaggacuguggccaagacagacccaguugaugcauaagagugcagaucuccuauagagaaaaugacuaggcacugaugcugauacaguagcuacugagugagguuacacagggcugaaaugaugccuagggacuuccaauuuggaauuacuuccucaaggaugccuggcacugguggcuuucacuggaguguguagaugugccgaagcugaaugguggagugcagacaggacccugugauguuggagggcugucaccaaagcuccgacaccaugcugugaucuaauuggguccuaaucacuuuggaauaucaaugcaucuuucguucgaguuugagauuggcaucacuuccauuuaacagcuggcuuuucucccccguugccagcaauaccuagcuuuggcuucuguaaaggaguuggagcugugcccacgcuuagccugcuggcagcucaccacaguguccuuuugucuucucuaggugaucaaagccaucgaggaaggguaccggcuacccccuccaauggacugccccauugcccuccaucaguuaaugcuggacugcuggcagaaagagagaagugacaggccuaaauuugggcagaucgucaacaugcuggacaaacucauccgcaaucccaacagccugaagaggacagggucggagaguuccagguuugucaugguuacuaguaaugauguaugagggaccgcaucauuugugacaggcaagagcagugcauccugauuccugcuuugcaaagucacaggcuaccucugagcucugcaaccuggguaacuucuucaauuacucugagccugaagaagcugauuggucugugaaauaaaaaaaaaaaaaagaaaaaaaaaaaaaaaggaaaggucccagagccaugauucaccaggaaguuuccuuaaaagaauaggauuuccugucaacagauucaggacaacaccuagacacaagacucaucugguguagaucaggguagaaaggccuguuguuuagacuguuaugucaaaaaugauaagacuugggcuugcuuugagugagcaucaaucucuggaauaacacuaaauguggcuaaacucuacaucuuagcugggaccguggauaacuuuauuauuugaagaaggacaucuucuaacauguggaggcuaucuuuuugcccuauucuuggaaagauuaaaauggcccccaagccuucuuuccaggucuaacaguuuuuuuuuuucaguucccagggugaauguucccuacuuucuugccuucaucuguguccuuuuguggggagaagcagggcagagauauuuuuaaggucuuuuuauuuuuuuucuuuuuccuuuuuucuuuuuuucuuucuuucuuucuuucuuucuuucucucuuucuuucuuucuuuugguauuuggcacuuuucuuagcauuuagaucgauaugaaaagcucuucugccacuaguacugcauaaugccugucuuguaccaaggaauagaacagguugagucacagcauauauuuuuuucaguuuugaacuuuuucuugauaauaguacuuaaauaaugccugucauuauugaugauaauaggauauaauagaauacgggacaugacuuagcacaaaauuaggcaacugugcuauucuccaaagagaacggagacuucagaacaagccaggcagugacuaacugacacccaggggagauauuuucaccuugagguuuucugaccuugucagucaguuggaacccuguucaugacaugccuaggcugaaauuacuaauaaaugauuugacuuuuguuuaacaacaaaugcuguggugcuaccucuccccccccccccacuuaaugacagauauaaaauucuaugugguaauguuauuaacucaaaauuaggagaauucgaccuuguaaacaguugcugaaucucacucagagacaacugaacugacagauacaagaggaaggucagagagacaaguuauugaaacacaaaacugauugcuguaaaauuaguuuuugucaaaguauucauguaaaaggaagauaauacaaaugaaaauaauuuagaucaaacaugaaagcuuuucaaggauuggauugauucuguauaaaaaaaacaaaucaagacaucacaauaacuuucuucuguuuuuuuuuuuuuucauaagaaaaaaaauuuuuuguccuaauuugaagacauuauuccaaccuaacugugcacaaucauagauuuaggcuaaaauguuaaaaucagacacagaauuucuaugguuuuaaggggaaagggaaacuuaagagcaccuuuuuucugugcaggaaauuacaauagauauguuauaaaaugucucuuugaagggcuagccuguggccauucaguagagagguaaugacgacucuuaagucuccuaaagacuuugauggaugggagauucuucauggagcuccaucaugaggaaaggcagaaugccugagaccagucacuauugaucugacaguaaauuccuggcuuaagaaugaacaaauuaauaacaaaguuaagaagugcuuugacuuuauuggaauaguuagcagaggaauuugaggagcuuauacccaaauccauagagcaaucacagugccauuuuuccacccccuggucuuugcaugugcuaguugggccuagguugcuucaggaauggauugccucccccuguccuggcuuuguggggaggcacacagagcaugucucgcacaccuagcuuagagcaugcuggaccggaacucucucugcucgcucagcuuccaucacgccugucagcuagcaagcucccaagucuucucccuuugauucacugaguuguccaugguugcugaacuaaugucugugguauacaauccugauggaaaauggauucuuucuccaaagacuguacaagcacaggcuuucucuaccucccucauucucuaccaaguuaggaugaucagggaccugcuaugagucucaguucccugaguugcacaccuaaagugagggcugugaagaccaaaaaaaaaaaaaaaaaaagaaaaaaaaaaagaaaaaaagaaaagaaaagcacguguuaauuuugaaugacaucuauuccauuuaaaaguuuggcccucuguuacccuggccugucugauucucauucucuuuucagaccaaacacagccuuguuagaucccagcuccccugaauucucugcuguaguaucagugggcgacuggcugcaggccaucaaaauggaccgguauaaggacaacuucacggccgccggguacacgacacuagaagccgugguucacaugagccaggaguaaguacucagcgauguaacaccaaaggguaaaucgagauuucauaguauuugccuguugugcuuugagcuucauacucauucccuacucauuaaagagagagagagagagagagagagagagagagagagagagagagagagagagagagagaagaaaccuggaauuguuguauuaaaaauuaauaaauaaaucucggcggcggguucaccaccagccucaauguuuaacauuccugaaugaaagacagacacauagauagccuuuagauuuugauauguccuaaucagcauaauagcugggcuauugccugaccuccacuacugagagaaucuaccucucacugauaauucugaguuacaacuuacuaaauuuuguguuuuaucuuggcuguucugggcccagagggugcucaacuggguggugcucugggccacucucucucagggaggcggaucucuuucucaauccccuccagucccaagcccaggaauccuaaauaccucagccucugcccuguccagccauuggcugcccguaucuuuauuagccaaucagaaccaacugggggcggguucccucaguguguuaugugcauaugugugggcucucuccuguaaacaauuugggcgggggggggggggggggacgggggggggacccaaauuaacauuacaauacaaacaacauuaggccaaacccacuacauggaaugccucucauuuugguugaguauaauuuuacacgaccuuuauauaguaccugcauuguuguauuggaugucugaaugagacauguauacaccugccuuguacuguacuaauuguggcagauucaaaugugugucugcaugaaaccuugaggaggagguucuccguaccccucaugacuuucucuccccuucucucggccccaccugcagcgaccuggcgagaauuggcaucaccgccaucacgcaccagaauaagauuuugagcagcguccaggcgaugcgaacccagaugcagcagaugcauggcaggaugguuccugucugagccaguaccgaauagacucaaaacucucgaauaguuuaccucauccaugcacuuuaauugaagaacugcacuuuuuuuacuuugucuucgcccucugaaauuaaaggaaaacaaacaaacaaaaaacaaaaacaaaaauaucugcagcguugcuugguguaagagauugcugaaaccauggggcuuauaaugaaugaccuugaucaucagaauuaaaccuggagccaguaauuucucagaagaacucuguccaucgcugguguguaaaauacauguacuuauauaaauaaaacucugccucugaguuucgaugcuguauuucccgucagaggcuuuucaagucacccuaauccuuucucugucuggaauuucaagggaaggauuucaucuguggcauuaauaacagucaucacuccuuaccagaaagaagaccugcugugcccaggagcacuguuaaaggacucaaugguggcuuucagggcucgguuuauaccacagaagaaaauccaggugaaagccacuuggcccauucaugcugccucuucaauggccaggacaccugguggauuuuuaugacauaggggggguuagaaagaaaagaaaauggauuuuuaaaacaugcgaacucccaagaccuauuaacccuaacuggacaaaugaggucucuuuggggcugaggcugugccauauaaagucuucuuugagaaugcuacaaacuucucauaacuaccuuauggauagugggcugagacaauccugaauggagaauuuucacacacacacacacacaccccuucaaagaggcaacucccaaauuuacaagguaaguugaaagaaugagcaaugacuuucuggcaaaucucucucucucucucuuucucucucucacucucucugucucucucucucucucuaucugucucucucuuagcuuguuuccuauugaaacacucaugucaggugccagguugugugagauuccaauucucuuugcauaguagaagacaccaagacuaauauggcuccccuguuauucuucaagaaggaucauuccuugaagugaggucaaggucauguggccggauccuauacucaccacuggcugucuuucucucaagaagggucccuuugcccuuuaaugccauucacugaggccaggccuguugguuaauaccuggaucucagauguaguguuaggagccuaaguacugaacugugcucucuaucuuuugggggagucccuuaaauaaggaaccguuuauaacucucuuauccugguaaccccuagaccagaccaguuuagcccuggaggauuuaucgagucaauggugugacuggaaauagcugucacuuccucauugucagaaagugaccuacuaaaauguacuuucaucuuguacuccacuagcagcauccagugucucuuuaaguucaagaacuuucuucaugaaacagguauauuauguuccuagaugcauuccuagaugugaaagacccaacuuugugcuacgauuuauggguuaacuauuuuaguuuuuaucacuuuuaaccaagaccuuggcaaaguuacguacuuacaugaucucucucucucucucucucuuucucucucuuucucucucauuuuuucccugaaagcuauuucuuauagaguaaggaauacuaaauuugcugucaaauuaugacaguuuaguaaaaacuuuucuuacaauauuaguuguaaaaagcuuuucucuucccaagggauuuuuuuuuuaaguacuccaacaaguuuuguuuuaucucugcuuuugcugaagucuaggaguucuugauuuuuuuuuaccaugcuagaguugacaaauauggguggggaucugcucucucucucucucucucucucucucucucucucucuucuuuuggcuuguuuugauuuacaaaaaaaaaguuuuaagaagcuguggaaauuuuggggcacauugauuuuuggagugugugugugugugugugugaugucuggagguuaaaggacaagaacauacaaaagucaguucuacaugugggucccagggaucgaacucaggucauuaggcuuggcaucaggcaccuguauccacugagccaucucacucguccaaguacuuuguuuuuaaccucugcaguccuauuccaauaagaaagaguuauggaauuauacauugccucgaagccggcacugaaggauuaaaagguuuccguuucuaaagucaccgacuugaggcgugacauguuuuucuaaacacggaauguguucaaagcacaaccucgcuaccguauucuaaccagugaacauuguuuacagugcugagguccuuuucucacucccuggcaguuaucucugcaaacggaauaauuuggaaaguuacaucauucaaaggccaccuucugagucuuacuuacuuagucuuaaccauaucccuaugguagagucaaacaaauccauggaaaggccaauaaagggcaucccaagugucugcaauaauacccaaggagcaguaaaaguguuuacugccuccugaacuuuuagcagagagccaugagaacaauaggaaagccacacuguuucccagggcacagagccagacucuggcaucccgacagcuaugcggucuaaagccaaccgaaacguugacacuggaaacucgccccacuuugcuuccuaacucagucccuccaccuguaaauuagagagauaaugauaccuucauaauaauagcuuucccgacauggcgugugugcaugugagaacugcucuugcagagagcuccccagagggacaggugccuucucucccaccucauccagguucaccacguguccucugcuuguggcccgguggucaaagggccguucgugugccgagcaccaggcagauggagcuccuuugcuuugguuuaugggaggcugggagggaauauguaucaauauagcaguauuaaaggacacaguuguaaagauauuugcauguccggugacuaacucaaaagagcagcaguuuuguguauugaagcacauugcauuuuauuuuauguguuauaagcccuucguagaccacacggcuuccuuggcuucgacuaauaagggaacuagcugccucggacucuuaucuuacucugauguuuacuagaugucaacuuucacagucccuuccuucucaccuuaaauauccauaaacaagcccagcaacaccccccccccccagucccacaucaaaugaagaaggggacuguagccugaagggugcagacguagcaaaagaaacuuucuauccaaauguugccugugcauauauauggugugcuuauauauuggaguuuuaaggucaaguucauauucuccuuguccuucaugugagcauguauguauguauguaugccugauggagucuaugcauggccagguuucaaaagcuacgguuuauuacuucccagaaaggaauagcuagaaaauauguucgauccuguuccuuuuuaguuaguuaguuaauuuuaguugguuaguuagguuuuguuugguuuuguucaugagacagucuuacuauauagccugcccuggccugaaacuuguuauguaaaugagucgagcuucaaacucauacagauccaccugccucugucuccugagugcugaaauuaaaaguuuguaccacuaugcccagcucucucuuuuuuuuaaauaauaguuugaauagccagauguaguggcucaugccuucaauccuaucacucagguggcagaggcagguggaucucuuggaguucaagaccagacaggugacagagugagacccugucucaaacaauaacaacaauaauaggguaauuauaaucagccucuguauugacaagugaguuguucuuacuaguuuguauucaagguacauauuaaugggacucaguacgcaccgagccucgucacuuucugggaacccaaaauguuguguguuugcuucuauuugauagaagcgugauguguagcugauugguugacuauuggcugguaauacuggcugacauuuguugucucucuuuucucuccagggaauagauucugguaucucagccucacagcccuuccuguugauuacauaagcgcuuggaagaaaauagaacacacccuccaccguuccuucugaauguuuuucuuuggcuucucuucugccgguuuuugaggcaaagacacgacaaaacaccugcaccugaacagcagaagaaaugugucaaguccccuucgcccaggaaaacgacauccagcuuuggcaucuguucucagcugcacugaggaaugugcugucucgaggcaccagcucugcagagcccuugcucccaaacuccuugugguuuuauuuauacguauuuccauauuucauuccuguacggccccgcugcauccguguggcagcaagugaccauauguuacagguuuuacuauggacgccaggucaggcgccaccacgcagaacaaagccaguuccgcaagcugccuccgauacgcaaugcuaaagugacauuuuacccagggugugccauugcagugauauaaauauauuuuuuuccuagacuaaaauaugaccugaauaucucuuuugauguguguacauagaguguguguguguguguguguguguguguguaugugaguguguaugggguguguguguguguguguguguguguguguaaccucaugcuuagaacugccugugaauguuguggaaugcuauaccuggagaguucugguuuauuaccaguucaaagauaaggaaagagucacaugauauacaagacccggagaccauguccguccccuugggaagacagcuuggaaacgcuacauguucuuuaucuguaaguguaaugugucugucacauucauccuaagaagcaguucuuuggacagauguuuucaccuugaugguggaaugauuuuuagauauaagccugacucgccgauuucacaauggagagagaaggggauggaauccaauuugugaccccagauggaguauaagucgccuuuguuucccugcauaaaugaacuuguugaaugcgaacaaauauaugcaauucauauacuuuuggaagaugaacuuaagauaugugugucagccuugagaugaugugucuggaguaauacuuugugucccagugucacagaaaaauacauacaugccaguggcucuugagguuaauguaguugggaugaaauggccucuagcaauuccagguuccccaauuacauguggaaaguucugguaauuaauaugcagcuaacuacuuaugcccuugaaaguauaccagucuucuagaaucggaguucugguguaugaagauucaguaucgacaggauauguauaccaaacuccagccagcauacugccauuuuacuuaaccugagaggcugccuugcuuauucugagcuauggucacagaaacuguggccauuuauauaagcuauaacaucaaaucagggaauuagaaaaaaaaaaaacggggaaaagauucugaaccauauauuguugaauaaguaaagaaaaucaccaauaaauauuuauugcauucugacaggguguauggcauuguauucucauaacuaugccagagugacaaaguuauuucaccccuuuugaggggaccuuaauauauuuuuaaagggaugugccuaugcauugaugccugaaaaauagguguaaaaaaaaaaaaaaagaugaaccucugagugcaucaucuuucccagaggucaggugggaggaggucaacuucugggucuguguccagcccaggagcaagcgcuggccuugggagcuggaaggcuaaaaucuagucaaaucuacuaaacagcuuugagcuguucccugcaccaaaucaagccguuucaccacgugucugcaggcucugagguuuuuauuuuuuggcgaucuucuaaaugaaauguucugguguguuuuaaagacuagaggaaagguuguguucacaacaugauuacuguguguguucugagaccucuuguauucaucugugaaggggacguguauuaauccauacacuccuauagccucgacuauuugucugaagacacuuaaauuuugaccaguaaaggaaaguucuagaagcaauauuuucacuccuuuagcauuguccaaauaacaucaaguauuaauaaacgcugaagaguguauuuauuuuguauuacuccaagucuguuggaauaugcaaggacugugguuauaauuagaauguauaaggcauauuauaauuuaguucauucugaaaaagaaguuagcugaacaucucuugguucauacauguuccaaauuuugaacaaucuuuugaguuagccauagauuuuucuauuuuguuuuuauuugucaagguauuuuuuucuucccuucaugaacuuuagguacacauaacuuaugucauuuauuuauggucuuuuauaccuaguuuguaaaguuguaaaauagcaaacuaaaugcaaagaguuugcauuugaaaguaauaaaguaguugccguauacaaaccugaaaucugguugucuuuguucuguuucauuuucuucaguguuggggacaccuuuuggacaaauguuucaccaaagagcuaagcccagccucuuguuccaucaagacaagcucuugguagguugcugagcauggc

SEQ ID NO: 240 - RNA, 3277 nt, Mus musculus
cucuucacagcugcagaguucagagaguugaacugcagcgcuuugaguuugcugcuugcucagccacagucaaccucuguuguaaauuuuccucccggaacacgugacgaugcauuucuugacuauauaucccaaggacagcagccgggcugucagagcgcagagccugacagagaagagaaacauccucagauuuggccguuuaagaguuccacacuugggacaaacugucagcuuuugguaaguuagcaagacuccuugucuucggagacaugcaagggggaauaguucuauuaauagagaaaguuuucuuucuuucuuuuuuauguaaggaaacuuuguuuuggaaguugaagcuuuugaaacaaaauguaaaguuugcuucugccgugccagcuaaagcaugccuuucaauuuuaagaugcuuuccccccaugaauccuuauauggucuauaauguucaaaguauagagcuaaugcauaguuauuuucugaaauguaaauaaaguguauaaucuauccauccauccaucuaucuaucuaucuaucuaucuaucuaucuaucuaccuaccuaucgaucaccugucugucuaucaccgauuuuucuaucuggugaacauuuuucucauuuuuuccuccuuucccuccccuaauuucucuuacuugcuccaagcucucugagcuaacccguugacugcuuggugagaugccuuacguucagcucuuucuuucauuccuguucuuaaucaaaauagguguauuuugaucuauugcaauuucacgagccaugugcuugccuucugccugucccauggauccagguggaagguuuaacuugcggcucucuccccagaucccggcugugugagcggcaauucaaugcugaggauggagccucugaacagcacauaccccagcgcugcagccuccagcagcccccucgagucccaugugccuaguaacagcagugguaauggcaaugaauacuucuauauuuuggucguuauguccuucuauggcguuuuccugaucggaaucaugcugggcuacaugaaauccaagaggcgggagaagaaguccagccuucugcuguuguacaaagacgaggagaggcuguggggggaggcuaugaagccgcuaccuaugauguccggcuugaggucagggcaggugcccaugaugcugaauaugcugcaggagaguguggcgccggcacuguccugcacucuuugcucgauggaaggggacagugugagcuccgaguccuccucuccugaugugcaccuucccauccaggaggagggggcugaugacgagcuggaggagaccuccgagacgccucucaacgacagcagugaaggcucuuccgagaacauccaccagaauuccuagcacccaccaggugcuaggagguagcuccguaagcuacacuugacagagggaagacacuugccaagugccggguuucgcuuuugcucugcggcugccacauugaacagacugagggcaagcuccaaaauggggcagggagagacaaggcucagcugcaguccuugagguuccugugggacucaucucugaaaaagucccagagacauacagcaugaccauugacucuggggccugggugguggugggucuguggucagcaucuggcuggauaaugugguguuuuuucacuggaggcccuggguaacuucugcagcaucugucugugcccagggcugacaacugcccagggcaggcugaaggacucguuucgauuugcuaauuuuccuagagcuuuguucuucuagaucugaugggcuguaaguaucuuuaaugugugccuguggcauucgauuagagacaguuauauauuucacuuggaggugggagaaagcugaagagagaacccagauuguuugcacaaugcaaagggagaagguaauucguacacaugucugaauuagcugggaguauaagcuaugaccucaucugagcuuuugucucaccugugagcuugaacucuacagcauugcaggugagcauggcuuucuuugccagucagcuuccucauaaccaagccugcauucgggauggcuguucauggugguccuccugaccuucacagauuggguaauggugggguuauacaaggccaaaucauugacagcucugcugcagcucuuuuucccagccuaguuuucugaggccagaaaggacacaugugggccucauaauaugggguuuugucacguagcuggacccuggaagggcauacuuaggcgagaucgagcagagcugggguucaagcaaugugcuuccuggucugagcccugacacucauucacugugagguucugggcaugucaucacaagauucugccuacaugaggcuccugaggcugugcagccccagggggcugggaggacaucuuuagacuuuguacugugugauaaauccuccacagccuggugugaggaaguuuggagcaaguauuuccccuuuggccgcuuagucuggagaaagauguguugacuuaaagacacaguuggagacuuuggauauguguagcuggggaauucgaggcuggaucaucggccuuccuuacuguggcuuucccaggaugcgacugaagaagcuggcagcauaguuuccucugcagagucguguggaugggaggauguuaacacacccaaccgagggaaagagaaauuuaaagggagcuacucaagagcuuugcagcaggcucuugugcccuuagaagaccagaaggaagcagaaaacuccccaaaggucaaguuugccucuagugcaaaaccuucuuaauuuuuauuuaucugaacucucccuggauuggagacagagcagucacuaauguccccaugagggguuaacacuauaaggagcuguuuuuuucaaucaguuuugacacagagauagaaagguaauuuauguuagaggcggaaaggggcccucuguucacuuuaagauucagaguguggaucaacuccaaagggggccguuuaaguugaaagaagccaaguuaaguuuggccucgugccuggaaucacuugaauucugaaacuuuacugcgacagacaugugcguugucacauuuuccauugcuuaauccugguuuggugcaagucugucugcgccuguuacaaagugauguauauacuuccuuccaguaugcugaguuguagacaauugucugguguauuuaaugguuuguaauuuucacgauauuuuuuaauuuaaauaaacacauuuucgauaugagaagccac

SEQ ID NO: 241 - RNA, 3277 nt, Mus musculus
guggcuucucauaucgaaaauguguuuauuuaaauuaaaaaauaucgugaaaauuacaaaccauuaaauacaccagacaauugucuacaacucagcauacuggaaggaaguauauacaucacuuuguaacaggcgcagacagacuugcaccaaaccaggauuaagcaauggaaaaugugacaacgcacaugucugucgcaguaaaguuucagaauucaagugauuccaggcacgaggccaaacuuaacuuggcuucuuucaacuuaaacggcccccuuuggaguugauccacacucugaaucuuaaagugaacagagggccccuuuccgccucuaacauaaauuaccuuucuaucucugugucaaaacugauugaaaaaaacagcuccuuauaguguuaaccccucauggggacauuagugacugcucugucuccaauccagggagaguucagauaaauaaaaauuaagaagguuuugcacuagaggcaaacuugaccuuuggggaguuuucugcuuccuucuggucuucuaagggcacaagagccugcugcaaagcucuugaguagcucccuuuaaauuucucuuucccucgguuggguguguuaacauccucccauccacacgacucugcagaggaaacuaugcugccagcuucuucagucgcauccugggaaagccacaguaaggaaggccgaugauccagccucgaauuccccagcuacacauauccaaagucuccaacugugucuuuaagucaacacaucuuucuccagacuaagcggccaaaggggaaauacuugcuccaaacuuccucacaccaggcuguggaggauuuaucacacaguacaaagucuaaagauguccucccagcccccuggggcugcacagccucaggagccucauguaggcagaaucuugugaugacaugcccagaaccucacagugaaugagugucagggcucagaccaggaagcacauugcuugaaccccagcucugcucgaucucgccuaaguaugcccuuccaggguccagcuacgugacaaaaccccauauuaugaggcccacauguguccuuucuggccucagaaaacuaggcugggaaaaagagcugcagcagagcugucaaugauuuggccuuguauaaccccaccauuacccaaucugugaaggucaggaggaccaccaugaacagccaucccgaaugcaggcuugguuaugaggaagcugacuggcaaagaaagccaugcucaccugcaaugcuguagaguucaagcucacaggugagacaaaagcucagaugaggucauagcuuauacucccagcuaauucagacauguguacgaauuaccuucucccuuugcauugugcaaacaaucuggguucucucuucagcuuucucccaccuccaagugaaauauauaacugucucuaaucgaaugccacaggcacacauuaaagauacuuacagcccaucagaucuagaagaacaaagcucuaggaaaauuagcaaaucgaaacgaguccuucagccugcccugggcaguugucagcccugggcacagacagaugcugcagaaguuacccagggccuccagugaaaaaacaccacauuauccagccagaugcugaccacagacccaccaccacccaggccccagagucaauggucaugcuguaugucucugggacuuuuucagagaugagucccacaggaaccucaaggacugcagcugagccuugucucucccugccccauuuuggagcuugcccucagucuguucaauguggcagccgcagagcaaaagcgaaacccggcacuuggcaagugucuucccucugucaaguguagcuuacggagcuaccuccuagcaccuggugggugcuaggaauucugguggauguucucggaagagccuucacugcugucguugagaggcgucucggaggucuccuccagcucgucaucagcccccuccuccuggaugggaaggugcacaucaggagaggaggacucggagcucacacuguccccuuccaucgagcaaagagugcaggacagugccggcgccacacucuccugcagcauauucagcaucaugggcaccugcccugaccucaagccggacaucauagguagcggcuucauagccuccccccacagccucuccucgucuuuguacaacagcagaaggcuggacuucuucucccgccucuuggauuucauguagcccagcaugauuccgaucaggaaaacgccauagaaggacauaacgaccaaaauauagaaguauucauugccauuaccacugcuguuacuaggcacaugggacucgagggggcugcuggaggcugcagcgcugggguaugugcuguucagaggcuccauccucagcauugaauugccgcucacacagccgggaucuggggagagagccgcaaguuaaaccuuccaccuggauccaugggacaggcagaaggcaagcacauggcucgugaaauugcaauagaucaaaauacaccuauuuugauuaagaacaggaaugaaagaaagagcugaacguaaggcaucucaccaagcagucaacggguuagcucagagagcuuggagcaaguaagagaaauuaggggagggaaaggaggaaaaaaugagaaaaauguucaccagauagaaaaaucggugauagacagacaggugaucgauagguagguagauagauagauagauagauagauagauagauagauggauggauggauagauuauacacuuuauuuacauuucagaaaauaacuaugcauuagcucuauacuuugaacauuauagaccauauaaggauucauggggggaaagcaucuuaaaauugaaaggcaugcuuuagcuggcacggcagaagcaaacuuuacauuuuguuucaaaagcuucaacuuccaaaacaaaguuuccuuacauaaaaaagaaagaaagaaaacuuucucuauuaauagaacuauucccccuugcaugucuccgaagacaaggagucuugcuaacuuaccaaaagcugacaguuugucccaaguguggaacucuuaaacggccaaaucugaggauguuucucuucucugucaggcucugcgcucugacagcccggcugcuguccuugggauauauagucaagaaaugcaucgucacguguuccgggaggaaaauuuacaacagagguugacuguggcugagcaagcagcaaacucaaagcgcugcaguucaacucucugaacucugcagcugugaagag

SEQ ID NO: 242 - RNA, 1248 nt, Mus musculus
cagcuuuuuuuugguauuuuuauuucuucaauuuuuuauuaucaggagugacugaaauaaaaauauaauugagucccaucauuauugucauuauggaaauggcuuuaagagaaaacuggucagaugaauauuauugcuucccacuuuucaacugguaaauaguugccacugauaaaacagacaagcccagagaaucuguccagaauuuucaagauaugguauauuguacaacaugccuguucuuggggagaacacguaggacauaauuauguguauuucuugaucucaucguacaagacaagcacaaaggcgccacccaugccucugagaacguugaaccaugugcccuugaaaaaagccuugcucccuucaucgcgcgccaucuuccaccagcagucaagcgugccuguguacaugauaucaguuccuuugcguccagacugcaucaucauacgacggcgaaccgugucaaaaggauaggaagucaggcuagcgacagcagugacaaacugugcaaucauccagcugaugaagaugugaguauucuugggaucugggagcauucccuuugcagugucauagauaccaaaguaggcagcuccguagaugauaaugcccuguacugacacauuaaagccuugguacaggcccuuaaucccaucagauuuguagaucuuaaccaggcagucaccaaggccuuuuucagauccagcuuugcccacaucagcugcuagacggguaugggcaaaaucaagaggguacacaaagcacaaggauguagccccagcggcaccaccaccugaugccagguucccugcaaaguagcgccagaacuggguccucuuguccacaccacccagaaagaucugcuuguauuuaucuuugaaggcaaaguugagagccuggguggggaaguaucugaugucauuggccagguucccacgccagaaguacaggacucccuguuccuuggggauacgaaccacgcagucuaugaugcccuuguauugcuuaucugacaugauuugcuugcuggcaugcugcaccugcagcagcagcuugacccucucgaugggugcuaccgccaucuuggagauggcugcggccacuccaccggccaagaaguccuuggggaaggacacagcggcaucugucauguugaaagcaaaaaaagaagaggcaggcgagugcgggacagggcuggguugacaaccggcuuugacuccggggcucugggcucuagacagc

SEQ ID NO: 243 - RNA, 573 nt, Mus musculus
ggguacugacuucggcuuuaggauggguugcgacggaggcaccauccccaagaggcacgagcuggugaaggggccgaagaaggucgagaagguugacaaaagacgcugaacugguagcccaauggaacuacuguacucuaagucaggaaauccugaggcgcccaauaguugccugugagcuuggcagacuguauaacaaagaugcagucaucgaguuucuguuggacaaaucugcugagaaggcccuggggaaggcggcaucacacaucagaagcaucaagaaugugacagagcucaggcuuuuugacaaccccgccugggaaggagauaaagggaacaccaagggcgacaagcaugaugaccuccagugagcgcaguucaucugcccuguggugggcuuggagaugaacggccggcacagguuuugcuuccuccgaugcugcgguuguguguuuucugaacgcgacuugaaggagauaaaagcugaagugugucacacgguggaugagagcaaggugugucuuucuuaucaccuucuccugguccucagcacagcugauacugcagucugac

SEQ ID NO: 244 - RNA, 3751 nt, Mus musculus
ugggguacuucagugauuuaaugacaugugagaagcauugacaacaagcaaacuagaaaccagcuacaucaacaaaugugaacucugagaguguaugcuugucucccaguagagaaagguuuaggggacaggucugucagaacgucuuuggaggucaacagaugaagaggcagguuuucucuuaucugauaaccaccaacauguccuuucaaguccguuauagaucccagaggaugcaaggcaccuguaugaguugcuuguguccuugcuguaacagaagcaacuugagagaggaagggucgacuuuggcucaugguuugaaagcaggagcaucaggcagcuggugauaaccauaaccaggaacucgauagagaugaauauuggcauucagcuugcuccuccacuccuuuuuaaagauguauuuauuuauuuuaugcauacgaguacacuguagcugucuuuagacacgccagaagaggugaucugaucccauuacagaugguugugagucaccauugugguugcugggaauugaacucaggaccuugggaagagcagucacugcucuuaaccacugacccaucucuccagccccugcuuucuccuuuuaauccaauucaggaccccagccccuagaguggugccacccaaauguaggauacaacuucucaucucaauuaacuuaauguagaugaucucuuacagacuucagggggcuuauuuccauagugauucuaaaucccaucaaguugaaaaauuaauauuaguuaucacaggauuaguuaauacccagccauauuauccauuucaaauacauauuauccauuucaaauacagccacccuggggaugggggccucauaguauaagaauuuuggagguguggagacacaguccacagugcccaucaaacaggcuugagugcugggccccaccaagcaugguagaugcugacucugguuccuagucucaccaugugccucuuuucugacuuggaauucauuagcuucaugucaugcauccugguuaucuucugugcaucccauuaggacagggccugauuguuuuccagaaaaagaaaucccaauauauauuucuauauuuccugcuauauuucagagcuacucuggaauccacuugacuucagucuaaaauaggucugaguccggcccuugcugggcuucgccuaggaagcaagcugugagguugaggcuuggccgccgggcaaugaucuugaagcacagauacccaaggacagagagcgcugcccugcaucuccugcagagguuuuucuuccucaguuuuggggagaguuuuagaauuaagcucugacuucugugggaaagaaaaacuagagggcauuaguugacacccccuccccgucccccuugcaaagagacgugcuuguugaagagguacuuguguugcagcuggccccgugcugccucagggaccaggagcacgauugcaagagaugacagcaaacagugccaagagaaccaggacaucuaguacguggcuugaaaacaggcuuucaaaacuuugugacuugcaccuucacagcucugcauccugucaccgggguaaauaccuuugacagcuagcucugacacuuaagaaaaaaaaguuuaaaucagagaacaagagagugcuugcauccucaggacugacacguuuuccagaacguagucacuuuuuauacuaaauuagguaagagucgaguccugugucaauggguauauuugagaauucuaccuuuuauccuccucccucguauuuuugaggcagagucuuauguagcuaguccagacugaccuagaacucucuaaguagccacggcuggccuugaacuccugguccucuugcuuucacccacccgcccucagugcugggauuacaggcaagugcuaccacacuuaguuuacauguugcuggugauugaacccaacccaggguuuuauguacuccaccugagccaugucuccagcuaugacuuaauccaugucuuaauuauuuaauuuaaaaucucugaacacagggaagaaucagucauauaccugauuauguugaaauauagcagaauaucaacagguaaacaguauguauuuugugugugugugugcagcauguguguaugguguguauauauauauacauauauauauauauguguguauauauauauauauauauauauauauauauauauauauauaguaggagcauguugugugaaugugugaaucuaugguguuugugguauguguuuagugugugggugagguaugugaguauauaguguguggauggauguguaugguauguacacauaguauauguuuggugugagugugugcugucuauagaaugugugugugauuaaugugaaguauguaguauuaugugacuauuguguuugaugugaguaugcauguauaugugcuauguauauguauauauguuugauauauauggaauaaggaugugugauauguauguacugugugauagugugugguauauguauuugaugugaguauauguauugcuguauuaugauauacauguuuaguguggauguauuaugcagaauguagauaauauaugcauguguguggguaugugcugugugcaugcauauuugaguuuguguggcacagguguuuguauauauauaugaugugagucuauggugugugugugugugauauauuuagugugaguguauguguauaguauguguguguaugaugaguguaguauauauguuuacauguugcuggucaaccaauccaggguuuuaugcacucuaccugagccaugucuccagacaugacccauccauaucuugaauauuuaauuuaaaaugucugcuaguugaauacagggaagaaucagcugugugugugguauauguguuuagugugagugauauguauguaguauguauguguguguguaugugugugugguauguacauguuguguacaugugugucgagucagcaguguauguuuggugugagugugcaauauguacaugccauacacaugugugugucauguguacaugugaacauguguggcagaccaggcagcccuguguguccucauaggcuggauguuucuucucaguucugagagcaucugugacugaugaagaguccuuguaucuccagcuugaagccccgccagcacaguauuccugccuuuaaaagcagcaguugcuucagggcuccaacaggucacguggcauuaagguauugucagaaaugccuuugagggcaugcuuggguguucacuaauaaccagccagcuggacugccauuucuaaaaacguucacuuuuuccuaagccuguuuccugauaguuugacuagacuauguguaggaauucuuucugagugucucuguaaacucaaagcuaaugagaauggcaggaagcaagcccuuucagugagaauaucauacuaaugagggcuugaucccccaagaccagaaaaacaacuccaucagugacauauaggccacccuccuccacucucacugucaccggcucucccacacugaaugcuguuuaucaugagagcaacuggguuaaugggagaagauccccaaacuuaccgccuggcucccauccugacagguugucaugacgaucuugcagugugagggcuugugguucacaaagaauugaaaacaagccucaugaaccagcuuugucuucaccucauaagugccaagugccaacug

SEQ ID NO: 245 - RNA, 655 nt, Mus musculus
ucagguaaauuucauacucuaguuacagcuacuguggccauugagaacccugcugucagcuucaucuccuccaggaacacuggccagcgagcugugcugaaguuugcugcugccacaggagccacuccaauugcuggccgcuucacaccugggaccuucacuaaccagauccaagcagccuucagggaaccacggcuucuagugaugacugaucccagggcugaccaccagccccucacagaggccucuuaaugucaaccugcccaccauugcucuguguaacacagauucuccccugcacuauguggacauugccaucccaugcaacaacaagggagcucacucagugggucugauguggcggauguuggccggggaaguacuccacaugcgagguacuaucuccugugagcaccccugggagguuaugccugaucuuuaccucuacagagacccagaggagauugaggaggagcaggcugcugcugagaaggcugugaccaaggaggaauucuagggugaauggaccacaccagcuccugaguucacugcugcucaaccugagguggcugacuggucugagggugugcagguacccucugugcccauccagcaguuguucacagaagacuggagugcacagccagccacugag

SEQ ID NO: 246 - RNA, 1163 nt, Mus musculus
cauggguugcugugguuguggagguugugguggcugcggcggcugcggcgguuguggcagcuguggcggcuguggcuguggaggcuguggcugugguggcuguggaggcugcgguggcuguggaggcugcgguggcugugguggcuguggaggcugcgguggcuguggcggcuguggaggcugcaacagcuguaccaccuacaggugcuaccggguucccugcuguggcugcugugguggcugcugcgguugcuguggcugcugcaagccugugguagucugcugcugccgccgcuccugcugccgcuccuguggcuguggcuccuguggcuguggcugcggcuguggcugugggaagggcuguugccagcagaagugcugcugccagcagaaguguggaugcaagaagugcuguugcuagcauggcugcuggcccccuggccucggggccggugaugguuggacccaggcucauauacuuagacuuuuagacuguaugcccuauaaucccucccaguucaccuaucaagcuguaaggcuuaauaaacauagcugaguagaacgcggaagacuaaaauacgucugugcugugcugaagaugccuagccauggauaaauaagucagccucccugaauuugcucauucauugaugaaauaaugaagcugaacucagaaucucuaaggaccucuucuucuuuaauagcauaugcaucuucgaguccuuaaaacugaacucagggcccuuccaccuuuacccauggaagauuucgcuucuauuucugauauucauagugcauguauaaugugaauacagggagcauuauaauguguuuauauuuuagaauccacccucagcccacuaugaacggccagugauaaucugcagaagacucccauuaaagaccucagcugagugaaagcaaugugaauauauucuauuauuuugaagcacuugccuuucaagagaugcauguauuauaugucugcuuacauuggcuguauacaccacguguuuuaacuuuaaaguguucccuccuuccccaauguaauuuaugaauaaaacaauggaaaauacuguguuucacugucuuugaauuuuuuuuucagacuauuggaacugauguuuuggcaacacagguugcgaacuccaggaaaguuuaaa

SEQ ID NO: 247 - RNA, 840 nt, Mus musculus
uuuauacuauguuuuaaaguugaaagacaauucaaugacaaauagccacauuauuuaaaauguaaaaguaauuuaacucaggguuaaguagacuaaacauacuagacccuuguaagaccuaggguuuggucuuaagucuccugccaggauuggcuucccagcugggcagguucugaaaugguuuuaccauauugcucgcuggacuccagaaaguagcccauggucagcuaaguggcagaagacaaugcgacuaaguuuccagcaacgcuuaacacuacgugggcgagaugucauaucauaacacaccgauuucugauucuaacaggauagcuaucccguggaagggcagcaauuucaucaccagcuauuuccugaagauccuuuggcaaaaugguauucuuucugagcgaauugauccaaagccucucaucugcauauucauaagccauuuucugucucuucaaaucacucaacauucuccagucuacauaguaaccuugaacuugaccugacacugauggaggaacugccugccggaauguccgcagcagcaagccuagcauggacaccgcauuguugucugcccuucuacucucuuucuaugucuauuuauuuagugacccaauggauuucauuaggguuguuuacaagguguggccaggaguucguuuacaggagcgugugcaaauaucuuucuccucuauugacaguuaucagacaugaauucucagggacggguggacccugucaagcacuugaauuuuguauauuuauuucuguuuucuauacuugucauccaauaaagagaaaccugauguuucaucagaguccucccucuac

SEQ ID NO: 248 - RNA, 840 nt, Mus musculus
guagagggaggacucugaugaaacaucagguuucucuuuauuggaugacaaguauagaaaacagaaauaaauauacaaaauucaagugcuugacaggguccacccgucccugagaauucaugucugauaacugucaauagaggagaaagauauuugcacacgcuccuguaaacgaacuccuggccacaccuuguaaacaacccuaaugaaauccauugggucacuaaauaaauagacauagaaagagaguagaagggcagacaacaaugcgguguccaugcuaggcuugcugcugcggacauuccggcaggcaguuccuccaucagugucaggucaaguucaagguuacuauguagacuggagaauguugagugauuugaagagacagaaaauggcuuaugaauaugcagaugagaggcuuuggaucaauucgcucagaaagaauaccauuuugccaaaggaucuucaggaaauagcuggugaugaaauugcugcccuuccacgggauagcuauccuguuagaaucagaaaucgguguguuaugauaugacaucucgcccacguaguguuaagcguugcuggaaacuuagucgcauugucuucugccacuuagcugaccaugggcuacuuucuggaguccagcgagcaauaugguaaaaccauuucagaaccugcccagcugggaagccaauccuggcaggagacuuaagaccaaacccuaggucuuacaagggucuaguauguuuagucuacuuaacccugaguuaaauuacuuuuacauuuuaaauaauguggcuauuugucauugaauugucuuucaacuuuaaaacauaguauaaa

SEQ ID NO: 249 - RNA, 3953 nt, Mus musculus
ggaaaaggauucauuugugaaagaggaauucagaaauacguauacaaacgacagcacuaaguauaggagcgucauaaucaaagcugaccgagagccaguggggcgggcugagagagcagggagauggccuugggcuggcugucuuuugaaugcuguauuaugaacgcuucuuuacauuucccuaaauguauuuauuucuuuuaaacuuuuaauuuugauacauuauagauuuauguauaguuuaaaagcuauuuaaauuguuuuuuuuuaaacuuuuguauguauauaugguguguguggggugggggguauguauacuuuugugcacauuuguggccagagcccagaggaggguauuggguguccucuaccacucucugccucauucccuugaggcaaggucuuuuucucugacccagaaauucuauuuuugccuaggcugucagcuaguuagccccagagauccucuguguuccucucagagcuggaguuacaggcuugcucacagucaagcuuggcuuguuacauaguugcuaggauuugaacucagguccucagaguugcacagcgagcacucucaaccaccgaacccuuucucuagcccuuuuuguacaguguuaaacacucuuccuuccauucccacccacuggcagcccauugcauaacuacaguaaaauagcaaaugagaaacugacauagagaucucaguuacugcauaguaugugugcuguguacauguaggaauauuccuaauuaaggucgaaguccgccaugaccagauagucucugggcucugugcaauaugggaaacucuuccuuaguagagccucuccucugaccuugucugaggaauucucuuuuuuucucucucucuuucaaaacuucuguuuuaauuuaagaauaacuuuugccaucaaguuuuacuucuaaagauaaguucagugacauucagcuagauuuuagcaagcaucuagucuauaaaaccacgugauuuuuaacauaaucugugcaacuauaagcaauucaauucaauauguuuagcaacugaaaauuucaggaugucaaaaucaaucucuuagcccauaucaugucuucaacugcagucuggggacuucuaaugcuccacauacaccucugccugaggaaugccacauagccucaauuagauuacaggaucauuuccuuucuccugauaaagucuguucagguagccccugagauuucugaaaugcuuucccaugcuaaugaggcauuucggugcccuaaucccucauccaaugaccuuugcccauucuacccucagcccccccccccccaauguuauaagccuucaaucaccuuuaguaaaguucucugccuccuaauaauggguaugaucguucucuguaaguacucacagggcuuccaagucgucaccaccccaccuccugccgucucuuucccuacugccuucacggaccuugaggucgacaaucuaugauagcagggagacacgugcauguaggugcacauacccaugugcccaugaaugcuugcauggagaccagaagaagauauuuagugcccuccucgcucuaccucaucccuuugugacaaggucuuccacugaaucuggaguuugcucuuucuuucuuucucuuucuuucuuucuuucuuucuuucuuucuuucuuucuuucuuucuuucuuucuuucuuucuuucuuucuuccuuccuuccuuccuuccuuccuuccuuccuuccuuccuuucuuuuuuuuuuucccagcuagacuggcuagcccugugauucuuuggccuucaaccgcacucuccuauacugggguuguaggugcccaugggaaugcucagcuuugugugggugcuagagauaugaauucgguccucauuccugcaugcuugcaugcuccuacuugucauauaucuccccaaccuauuugcuaucgauuuugaacaauagcaacccaaacugaguucauguuccuuuagcacuacacaaaggcagaugugagguauagcuauuuuggaaugaguaaugacauuuuucaguuauaaaaaugagugucacaaacuaugaggcaaggaacauugaacuugaaugagcaagacugcuuuuagacauguuccuacaugugagcaguauuucugcccugaguauuaagcacauaguguaucucagagggccuuugaucagaaaagaagcaaaucugaccacaggaggauuucuucccaacaagggcuguguauguacuguggaugaauauauagaauacaaagaguuguuucagcaagauaguagauaaaaacacaaaagagauucuuggaaguuaauuugugugugugugugugugugugugugugugaaauuuaaauuucaggauuacaggaguuguggcucuaaggcuauaguggaaaugguguggaguguaugaccaaagguacaggcaugguuacuagaaaggguucuugaaacacuuagcaaggaccgugauucuguuucuuccuauuaguuccauuguuacaagagaccuccauuaauacuauuaaauuauuaaucugcgauaugacaggagaguagcaaauccauagcaguugaaugcauggggaugaccucuggacuaugggaagaaaguaggaaaacagaaaggcugaccaaccaacaggcaaggacaucccagcaaggacgccagaggccagcaaccauacucggaguagcacugcuuugugcagccauacuucugcuggcaacagcccuucccacagccacagccacagccauagccacccauguuaguagaguggacucgggugaagugaggagagaacugaagggagaaggaggucugaaagucuggcuuggcaugaagccuauggucacuuccuugcugacgcuuuggccucuguggugagcacaucuccucuuggcuacuuccucaccuuccaagggcacacggcuucauuugaacuacaguuuuagguggauucauuuccuuuucaacaauggaaugugaacugucugaaauauuuaaugaaccuguuguucugucugcuugagaaugagauuucuuugaccucagcuggagaugaacaucuuccucauccuugccagucaaggcuggcaccccagauggaaggugucauugccuuaguuuuauuuucacauaacguuuaaugguaagaaguuuuggagaggaaagagccuuaaagucaauaugcaucaauaaagauagucuauaaauuaaguagaaaacuuuaaaaauaagcuauucaaggauagaaaaauggaucaauguuugcacccuucucacccacauaaaagcaguggaugugguggugcacccacaauccuagcacuuaagaggauauagaggauccccuaagcaaacugccuagcuagaccagcugaauuggcaagguuuggcuucaaaugagagacucuacauugauauguaagguggagcgcaauuaaagaagaugccagaugggcugccuaguuuucauguaaacccggcacaagcagggauuaucugagaagaagaauccucagcugagaaaaugcuaccaaauuggcuuguggguggaggcaugguucauuuucuugauugaugacuuauaugggaggacccagcucccugugggcagugccaccgcugugcuggugguccuggauacucuaagagagcagaguagacaaaccugugaggaacaagccaaaaaguagucgucuuucaugaccuuugcuucaguuccugccuugaauucuugcccuuacuccaaugacuacaggaucacaaguuguuagaugaaauaaacucuuuccuguccgagcugcuuuuggucccagugucucaucacagcaguagaaaccauaagaaaacaugccaaccucuggucuccacgugagccuguacacacacaugcagauacacauacaacccuuacacaugaacaugca

SEQ ID NO: 250 - RNA, 808 nt, Mus musculus
caucacaucucccucuccucuccugaaucucucuccucacugcaccugaguccucucuacugacaacauggguugcuguggcuguggagguuguggcggcuguggcuguggcggcuguggcuguggugguugugguggcuguggcugcgguggcuguggcugugguggcuguggcuguggcuguggcugugguggcugugguggcuguggcuguggugguuguggcugugguggcuguggcugcugugguggcugcuguggcugcugcaagccuacaguagucugcugcugccgccgcagcugcugccgcuccuguggcuguggcuccuguggcugcagcuguggcugugggaagggcuguugccagcagaagugcugcugccagcagaaguguggcugcaagaagugaugcugcuaguagaaccaggugcucugcuccuaccuaggagauauggaggccacacugguguccugcugguaagcauucaccccauuccccccucuucccuuccucugccuaucaccaauuuagucuccuacuuugugaacccuaaacuuugucuaggcucugcauacaucuaccuagaccacaugaaacagguacacagccaaagacuguaaugguaagcuuauuugauauagccagagccaccuaagaacccugauccuaugcacuguaguuuccuuaaauguucaaucuuuuauaaauauucaggcguauauuuaaucauuuugauguuuucugguuauacucaauguuuucuauauucacuccuuaaauuuccuaauaaaguaacuuuauaugccu

SEQ ID NO: 251 - RNA, 798 nt, Mus musculus
ugguuuaguguaauuuauuaagacaggaguugcuuugugaacacagagaagcuuugcagagguaaaaacagaacauaaaaaugggcgauuuaagaagggacaucauuaacuauuuugacugcauuccaucauaguuaugauuaaaauguggugauuuaaggagaaggcugcauauuuguuuauuucuauaauuguuacaaagugugggauuuccacaggcuggugacagacucaggucacaguuguagccuacagacaaauggaaacagauacccugacacaacucaccaauagcaauuaccugcaggagaagucaagagauggggggagaagguaugcaggagagauccaaagugaagugguaagccuagcagcaacauuucuugcagccacacuucugcuggcagcagcacuucugcuggcaacagcccuucccacagccgcagccgcagccgcagccacaggagucacagccacaggagcggcagcaggugcggcggcagcagcagacuaccguaggcuugcagcagccacagcagccacuacagcagccacaaccgccacagccacagccacagccgccacagccacagccacagccgccacagccacagccgccacagccacagccgccacagccacagccgccacagccacagccacagccaccacagccgcagccgccgcagccgccacagccaccacaaccuccacagccacagcaacccaugguguuaguagagaggauucaggugcagugaggagagagacucaggagaggagagggaagauaugaug

SEQ ID NO: 252 - RNA, 1095 nt, Mus musculus
agggacauuuuauguaguuuauuagauacugaggacauugaagaaaaccaacuacaucauagcagaagagacacugggaauccacuguucucagagagagggaagacagccauugguggacagcaacucgggaacaugugaugggaaucaaauacagacaguguagcccgugagucugagauccuacugaucuacgcuuuaggcacugagagaugcucacaugcucacaugcucacauuuaacuacugugaguccagacagcuuuuaacugggaaggcuuagagagaagacugcacaaaggccaagguuccagaacaaucucauuagcagggcauuaaucaggaguggcaggcaagaguagccugcaguacuuacccugaucccaagggcauaggccaggccugagggcagcccaagucagcgauuuugccaagaguuguagcaaccagagaacaaucaggaaguuucuauguuaggccuuagagaaccuugugagaguugucaaugagacuacuuuaaagaucaaggaagaaaguaugagagaguuggagggacagagagccagcuggagacagacaugaugguguguaagaggccuuuagcuauaggaagcaaugggacaaaggacucacacagcuccugaacacccuucugucuagcagcagcacuucuugcagccacacuucugcuggcagcagcacuucugcuggcaacagcccuucccacagccacagccacagccacaggagccacaaccacaggagcggcagcaggagcggcggcagcagcagacuaccguaggcuugcagcagccacagcagccacagcagccaccacagcagccacaaccgccacagccaccacaaccaccacagccacagccaccgcagccacagccaccacagccacagccaccacagccacagccaccgcagccacagccaccgcagccuccacagccaccgcagccacagccgccacagccgccgcagccuccgcagccuccgcagccacagcaacccaugguguuaguagagaggacucaggugcagugaggagagagacucaggagaggagagggagacgugaugcucc

SEQ ID NO: 253 - RNA, 994 nt, Mus musculus
uguuuuauuuuguaauuuuauuuaaaggggauuaacacauugucuggacucuagaaagacuucugugacuacagagaaucuauauuaccguuguuaaacagagaauauacauuaccauuacagagaauagacauugccauuguuaaacacaagcugaccuaaagcauagauagaaauucaagaaggaaacacaauggggaccauuauacaaucuuauugacaucaguaaccaagaugcccugcaccuuuguccuuucuuaacauugacuaugacugcauuuaaaaugauaaggaaauuuacuugaacuucagaguauucaaaucaggcaacaaaguuucagaguccggauucuagagagacagaugcuggggagacagcaggguauacucagacuaggacagaggaaagccuuagcagcgagaucagggugacuuguuccauccucugcacucaggacuuaccaacagaucgguacugguagcacuugcucaggggccagacaucccaagcuagcagcagcacuucuugcauccacacuucugcuggcagcagcacuucugcuggcaacagcccuucccacagccacagccgcagccgcagccacaggagccacagccacaggagcggcagcagcugcggcggcagcagcagacuaccguaggcuugcagcagccacagcaaccacagcagccaccacagcagccacagccaccacagccaccacagccacagccaccacagccacagccacagccgccacagccaccgcagccgccacagccaccgcagccacagccaccgcagccacagccaccgcagccacagccaccgcagccacagccaccgcagccacagccgccacagccacagccgccacaaccacagccgccgcagccgccacagccuccacagccacagcaacccauggugucaguaaagaggauucaggugcagugaggggagagacucaggagaggagagaacagugugaug

SEQ ID NO: 254 - RNA, 1701 nt, Mus musculus
acaguagcucauuaccaaauaaaugcugauagagacaagagugaaaugagagagagaaggaaagcauuuggugagcagcuaccaauuuuuacaacauaaauacacggacaacuucaagcgguacucugugucauucucucugguaauuuuucucaagauauagacuaacagaaaagaaaaacagaggaugaaauaagaggagcccagccaaaaccgggaccuagcucuggaggcagagagacugcccagagggggcaacuagauggcacaguaaacagggcuaguuuggagcagaagcuuggcccacaugaacagcaugugggaggacaacccagaggcaaaaacacugcucuugguugcuuuauaaacaaguucugggguucuuccauccaaaccacucuaucuuucuucugugguuguuauuuuccaauuuauuuaggcuugaucaucggcagucagacugaaggcccacauuaauccaaaugaguuuaacacaagggcaggguaugauucacaguuugaaaggaggcuccuguguugaugagaggagcugcuaagccugacaguggcccuagugcuguaaugacaccauagucaaggucacugucagaguaaaaguccucugccaacagagacauucacaaggggagauucagagcagaacaagccugugcacggaaacaaggaagagauuccauaaaucugagcauugcaacaggagacugaauggcugauggaggcacagcagugucagccucgagugcauggucagggcagugcagacacgagcuugccacccacggcaugagcagacacgggacuuggguguccggcugugacugcugacuuucauccaaggaguucuuuggucuugcugccagaugcugguccaacucugccaccgugucgucugcaauuuggcugaucugcuucuccaugagucuaaugguguccuccgagguuuuguccuuugacuucuucaguuuauucauugcauuagugcaaaccuuccguaaauuuucuuuggccuuguugguguucuguuuggccaauuuuaccagcauuucucuguguucccugguuaauuuaggaauggguacccgaauuaguguuccuuccacuucuggguucagauucauucuacuuccucuuauagccuugauagcugcagcugugcacucugggaagauggccauauucaccagaaucaccuguggcgacuucauggagaucuggccaaucugacuuagagcaaccuucccaucagcaguuaccacaguaauaugaucaagggauccugaugcaguccuuauguugagaguccuauugaaauuauccuuaagugcuuccaucacagauuucaugucuucauccaccucuuccaagcugauuauauccucaacaaaggcucuauuaauguucacccuggccuggggcuguccuuucccuuuagcuuuggcuuucuugauugcaaaauggcgaacugguacugcuggguaggcugaguacugccuauggucauguugucuuccacucacugucuucauggaaacuucugaaacaggucuggucaaagcagcaugguaacugcgaaaagcagggugcagcaggcgaaggcaucuuauucccaaggccaugacagaagagaauccucagaagcagccacagcuacagccgggauuauagagaaacacaugcggu

SEQ ID NO: 255 - RNA, 195 nt, Mus musculus
gaugccucugugugacacuggcugcagacccguggaaguagcuccugaguuugauggcucagggaacuugguuccagcugugaggcacuggccaucaggggcucuuccuaggacuugcuacauuuccaauaccucuuccuagaaaacacacucacucacuggugguuggaucagaaaggaucucuguuggcaagg

SEQ ID NO: 256 - RNA, 195 nt, Mus musculus
ccuugccaacagagauccuuucugauccaaccaccagugagugaguguguuuucuaggaagagguauuggaaauguagcaaguccuaggaagagccccugauggccagugccucacagcuggaaccaaguucccugagccaucaaacucaggagcuacuuccacgggucugcagccagugucacacagaggcauc

SEQ ID NO: 257 - RNA, 737 nt, Mus musculus
gucacugucuuuuuuuuuuuuuaacagacaaaggcuuguuuuauuuuaaagacugauccacaugaggccacagccaggccgcuauguacagacacaagggaagcuuuauuucuuggucuccuccuccuuggacagagucuugaugaucucuuccuucuuggccuggaggcgcuccucccagcgcuuucgugcuuccuuggucuuagaccugggagccucagccuggucagccaggagcuucuugcgggccuugucugccuucagcuuguggaugugcuccaugaggaugcgcuuguuuuugaacacauucccuuugaccuucagguacaggcugugauacauauggcggucaaucuucuuggauucccgguaucuccugagaagccggcgcaggauccucauccuucucauccaggucaccuucucaggcauccgagcauuggcaguacccuuccucuuccuuaugcccauaugccugcccuuccgucgggccaggguguuuuuccggcaacgagcccgggaauggacagucacaggcuugcggaugaucagcccaucuuugaucagcuuccugaucugcugacgggaguuggcauuggcgauuucauuggucucauugggauccaaccagaccuucuuuuucccccagcggaggacacuagaggcaagccucuucuguagccugagcauacucauggcugcggccgcagcagcgaaaggaaaggcugucacugucu

SEQ ID NO: 258 - RNA, 58141 nt, Mus musculus
caaagccgggcucaggccggagcugggcgcggggcgccaggagccgcgcggccugagagagucuggggcuucaguagccgcgcgaaggcugagacaaccucagaggcgaaggcagugcgggaccucacggccacagccgcagcccuaccgagcgcagcaccgcggcggccacagcaggaaccccugggccaccguccgcccgcgcagccgccgccgccgccgcgggagcccgucgcccggagcagcugcgggcggaggacaacggagggccggagcguccgagccgcgccgcggggaccgagcgagcagcccgaggcggcggcggccgaggacggggacggagacgaagcagagagggagcucccuggcccggcccagcccggugagugaucccccggcccggcccugcucgcgacgcggacgcccgccggcuuccgcccgacccgccuccauuuucccggguggcggcggcgggagcggcccggagcagccggagcuccgggcgccgcccuuguccucgcccguacuaggcuccgggggccugccggccggggcuacaacuaaccgggguagagcuggcccggccagcugucacucccgccgcuccggggacuccgagcaccuagcccugggcuccgcguagccucacuguuagcgggacgcugacacuaucuuuguaggggaccuuucaggaaaaugccuaacugauuucuggcuaggaauugugcguucggcgcguucccggguucgguuggagcaauccaaaacgccgacugcgugccggugccggagcgacuccgaggugaacccggccgggaggugcccuccccuggggagcuuuaacgcggugaugugagagauaagacgaguacacaaauagcuaagauaccaggcaggagggggauagauaaguuccguuuaggaacuaccaauugcuagaaaggugcuccggggugacuggaccugucgaucguuuccgccuucccacgaaccugggaggcuuccugggcgaggcggugcuaaaccgggucuagaagacucgauuggauucgggagaaggggguugcaguggagaagggcguggaggggcaacaaagcuggaggacaaagguacaaagagcaugcgaauguugccaauuccaucaccgggugccgugauaggugggguagacuaaagaggcauuuggagucagaucuuugaaugcuguagaggagcuguuugaacgaccuuccacggaaaacuuagaacucauuuuucagugacucaugaggccggaaauguaugcuagggcauauuaaaggcgcucuugagaaagacaggcgagcagagaaggccacagucaggacuuagcauuguuuccuaaauauaaugcaguuugaggucgauuuugacagcuuccgggauauuuaaguaaaucuauguccaagccaaggaaaauaccuuuuguagaaagugucacuagaugcgugcuuaucugaaguaauuaaaagaggugccuaaauuaaccuucucuacacacaaggcauuugcguuggugaguucucuaaaauugcaucagaacuucuggaucccuguguuggaauugaacauuaaacuguagauuuauaaaaaaaaaaauaguaauaagaacugaacuguuaacagucuagacagacaguuggacacacaccauuuuucuggaaaaguaaaaaauuucuuguuaauuuuuaguuaugaaaauauuggagagccagaagugaaaguuuuuaagcucuauuuuacagguuuaaaaaaauuagcaaguaauuaguaacuacuaaaugcuuacaauauaugauuuguaagaauugccuuagaacuuacuauugguuuuguaagugcuuauauguacaaggaaaucauacuuuuuuucagucuuacauuuuucuuuaucaaaguaagaucuagcugcugcugcugcugcugcuggugguggugguggugaacgcuuuuagccucugcacuuuggagacggaggagggccaggccaggccaggccagccggcuagaucacaguaagagacuuugucuuuuuauucuaauuuuuguuucuuaaaguaagacauacucuuugaaacauggaagcaguaguccaucucuccuuucucccccaccccauccccaucuuuugaaacaguguagcucaggucuuccaaccugucauccuccugcauuggguuucuaagugcuagaauuacaaaauagacugggaauuuuuuuucuuuaaguuuucuuaaucuuaucacuuagauuuuguuucuguaaacauuuuugcauauuuccuuucugaucuuuuucuguguauauuuuccuaaaaauauauuaaguacauuuauuuauauauuuguuuauuuauuggcauuuugaaacaaccucuuacucuggcccaaguuguccuggaauuugcuguggaggccaagcuagcuuuaaaauuccagauaguucucccgacucagccuccuaagggcugggcaugaaccaauagaaccagucugaaaguuuucuuaaauguuuuauuaggcuuuuaccugucaagguugcauuguucccuuaaggcuucuuguuagaagucuguuuauuagcuucucaucaagguuugguccugacugcugcuuauugaauguauuuugguugguagaauacauuuaugugaucgccaggaguggagacgggcacacagaccucugcuaugugagcaggaguacuuuuaguaggccacugaggggcuggagagguuaagagugugaccugcucuugcagaggaccugaguucugcuguuguuggguucccagcauccaguuugguucacaacuuccuguacagccccggcucuauacacuccuguccuccacugacaccugaacucauguucccauacccacauguguacacaauuuaaaaagaaaauuaaagaaggacaugauaaaaagaauauauucauggccaauauaaucuguuguggccccaccuacccuuuguucuacuacuaaaaaauagucuauacuagggcugacuacagagcuaauuacuuuuugaucaugauaucagaagucaggcuaaauuuuuuuguugguugauugguuuguuuguuuguuguuuguuuguuuguuuguuuguuugagauaggguuucucuguguaguucuggcuauucuggaacucauuuuguagaccaggcuggccucaaacucagaaauacuugccucugcugggcuuaaaggccaauaccacccaacuuuguuccuguaauuuucuuuuuuuccaaaacaggguuucucuguagcccuggcuguccuggaacucacucuguagacuaggcuggacuugaacucagaaauccgccugccucugccucccaagugcuggaaucaaaggcgugcgccaccacugcccggcucuguauuuuugagaaaaggucugauucaguacccuagacuagccugaacuuaacuuuguagccuaggcuggccuagaauuuaugauaaucuuucugccuuagccagauucuggaauuacaguugugugcaccacauccugaagacuugaguuuucauacgauuacuaugaaauagcuuaaaaagucccauuggguuuggcuuuacaguuugucuuaugugaaucucuguuguauauugcaaaaauauauacccucaaagccuuucuuuugguccauuauuuuuaaguauagauuuuuguagcaauuacuguuuguuaguaagaguguaauuuuccugagaaaguugaucacugacuguugauacuuguucugcuggccuuauaaauauuuacauauagacacaggcacacaaauucccccuccccacaagcauaaaagauaaacuucaguaguagauuagaguuucagggagugucuucugguuaccuuugguggugugccuggguucucuuuuguuguuggguuuuggguuugguuuuuuguuugguugggcguuuugguuuugguuuuuugagacagggguucucuguaacccuggcuguccuguaacuaacucaagcuguagaccaggcuguagacuaagguuggccuugaacucauucauuaccaucagcauccugugugcacacauacauagguguugguguguaugguccuuugcugugccauguuuaucuuacagaacuuacauguauuacauagugucauuuuaacuuuacccaggaagaggaagauagacuugugaucuauagcagcugugaauuuaaacugacagacaagggagaauagcaugcugagaauugcaagaggucagucaggugugaaaguagccccaaaggagaguguuuguaaagccugcccaugcccauugaguuggcuguguacagcgcauaccuauuccuucauuauuucuucuaacuuuagaccuuguuacucuuaauacucagauucagaucaaauuguuuuuuagcuguaguuuuauguuugcuuguuuauguguauauuuuuugggaggaauccgggcagggucucacuguagccuggguuauagucuguuguagcccaguuuaguuuccagugcauugucuuccucccucacuuuccuagguacuggcucaugggcauguaucgccacacucauuucucuguguguuauguguuguacauuuucagggcaguuuacaaagaaagaaaaccuaguuaaccaauguuuaguggcagccugguuuuauuaaguaauuauucuuugcagcauuauccgguggguacauuguuuaagaccaaggaaguacaguaauguuaaaacaucacaacucaucgauuaauuuugauaaaauguuugccugagaaacaaaacauagguuuuguggcuugguauuaaguuucuacuuuauagccuugucuaauggccaauagcuugccuucuaauagggugcuguuaauuauauuggccauaguucuuccuccacaaauuacaaacuugcuauauuaagcgcaggggaaaacagccugaccagguugugguuuacaaguuuuuguggcccauucuuggguucauggguuuggauagagagcaggauuaaucucgggguuaaggcauucuguuuggacugggauccuuaaucugcaguggguucuguaaccccaggcaaguuccugagcucccuuuuagcuuagacuccugagaugggaaugacuugauugcaucuaagaggcuaguagggguaauagacuugucauguacuaacuauucagacaucauaaguuuuguaaugacaauaauagacuguucuggguagaagaagcuuaagagcuucagaaacagucuagccagaaugauucuuucuacauauggaaacccugaagcccacuguagcuggaggcaguguuugguuaacucugcaggcaguuuucuguaaagugcaaccacuuguccaggguugcacagcuuaugagcugcaggacugggacuggcgcuggggcuuuuuguucuucauguagauuacuugaguggaauuuuuguaguaauuuuuuuaugcuuuaugcaguaauguuguuugagccuguuuuuuaaacauugacaauuuuuuucgguauauauuaaauggucuuuaacacauaauaggcauuuuguuuuagcauacaaauguucauaauuauguuuggaguagcagucugaagauuaaaggugaacuagagaucuggggagauuaacaaaaauuaauacauaaaauugacauggcuaccauugcauguugacauguuugacaaaugucugagaggguagugccaucccaccaucauuacaguugggaaaccaaagggaaaggcuuauccaaggucuacaaauacugaaguugagcugagguuagaaaccaggucugccucacuucaaagcaggaacucucuggacuguacacuacuucaucaucugaaauuguuuuccucaguaaggauuugguuucuugucaaggauuuuuaaguuaauauuuuaaaguaaagguuuauaaauaaagggcuggugagauggcucagugguuaagagcacugacugcucuuccaaagguucugaguucaaaucccagcaaccacauggugguuuacaacaaucaguaaugagaucugaugcccucuucugguaugucuggagacagcuacaguguauuuauauacauaaaauaaauaaauaauucuuaaaauaaauaaauaaaugcaguugaggauuuuuaauagauuucuaaacaauagccacauuuuauaauccaaaaaagaugguuuguuuuaaaugcuuuagcuguauaguuauaauugcuuaguaguuuauaguuuauuuaggccagcagguagcauuuauuuuuuuauguuacuccuacuuugaggaugggagguauguggguaauaugcagggcuggguucugaauggggugacuaauguuauagcucugggcuucagucauuguugauucuaccaagaggccuagguuggaagccucuagagucuagauugcuccuauuuucugugaccauguguggagaugugacuuaaccuuuguagccucugggguuuuguuugugguccugaaggcuguuccuuuaugagaacuuaaaggcacgugacuacacuugaacauuuuuuucuuccaguuggucaggugccuggaguuacuucacacuauuuaaguagucugcauaagguaaacaaaaaauaagucuauuuucuaauucucuaccuuuguacuuacaaaauguugagaacuaauguuauaugguaguaaaguaaguacaaguucaguaagucagguagugauuaacaaguucuaaaagggaguaacauugucauuguggugaaguccuaugagcugucuggggagaaaggaaaggcaugaaccaaaggcacugagaggaaaggaaggaccagaucuguagaauccagugggagauggccacauacugcacugcgucuugccuucuuaggguuguaacugugguaaaagaugagggggcacucauuaaguaacaacuccucagaugacuuuugcuugauuuacauguuaugaauauucugcuaaauauuguuuuaaaugccuggcuucaagaaguuguugaucuaucuagacaguucuuuucugcuuuaauggcaaaguaucagccaguuuauuuucugauacuccugauaggcaugcaggcaggcauacuuggcucaccaguauagucuaugcagauuuucugguucuuacagucauaacuuuaucauuuguucagccuuugaguuaugcuugcuauaaaaguuguuuggaauuaaaaggguuguuuguuguuuguuuguuacaggguuucucuauguagccuuggcuguccuagagcuagcccuggaaaccaggcuggcuucagaguuauagacauucaccugacucugccuuagugcugaaauuaaaggcgugugccaucauucccuggcugaaaguuuuugguuuuguucucacuuuugaaaaaacuuguuaagguuucuucuucaguuuguacuuuuaggaaauaaaauguuucuguaaauaauaaaugaucugggcauaugauauugugauaaaauuuugcuuuagucaguagagaugaacugcuuagccagaguacguuuuccuguucacuuaucuauguugcauuuguacaugaaagggauuuauuacauaagagaagagauugugauagaaaguuaaagggaccccuacccuuuuuccugggaguuuacugaguuguguuuuauggaguagucuuuugauagaucaguagcucuauuaugagucuuuggggguuggggaguagagcaggaucucauguccaggcugaccuugaauuuucuguauagcuuaggaugaccuuauauuccugauuuuucugcugcugauuuauauugcugauuuuucccagguguugguuacaggcauaagccaguuuuuuguuuguuuauuuuguuuuaaugauugaucccaggaccucaugcauucugaguggauguucuaucaccagacuuuaguccuuagccccaggugaucauuuuucugcagagcuugucagagaaaaauaguguacauuaugaccuuuuccagcggcgccagaaugggcaguaguacuucccaacuugcugauaagguuauuuggucuugaugucucuuucccugggaagacugacagagaccuuaaaguagguuccaucggaauagguuguuaaauguucucuuagcacacuuacugguuuauuuucauagcauuuauuuuucuguuaacuuuuuauuauuauuauuauauguaaguacacuguagcugucuucagacacaccagaagagggcgucagaucucguuacggaugguugugagccaccaugugguugcugcgauuugaacuccggaccuuuggaagagcagucggguacucuuacccacugagccaucucaccagcccaacuuuuuuuuuuuuuuuuuuuuuaaauagcagucuugcuuuguucuucuaccucaccuggaauuugccagguagaccagauuggucuagaacuuuuggccaguuuuguuucuugcuuccugaguguugugauuacaggugugugcuaccauacccagcugggaggcgauaccuuuuuauagaguuaaauuuguuauuuuaaaauggguauuuuaucugcauauauguguauguaucacaugcauaccuagagcccaugaaggccagaaggugucagucagaucagcuagaaccaaagauacagauggugugagccaccauguagaugcuggaaauggaauccugguccucuggaagaguacuguaccauaucuacagugcaugaagcaguuuuuaaaccuuauugugugugauguuuuccaguauucuagauuuguuaaugccuguuaugagcuauuagcgauaacucaccaugcuauuuaagauacucucuuagguaacacugauuuauagucgcaggaaauaaaagagaaaaagaagccguaccagaaagaugguucuauaaaugaaauagguuaaaagcucguguuguguuaauagagccauaagaaaggacuuaaaucccccuuauauguugcuggggaucauuuuguaugcccguucuucccugacuuuccugucuguaaaauaagaguagacugaugucuguaaagaaguuguagaaguucaauaggaaaaugcugugaaucugguauguuccaaguucccaguucaugguagcuauggugacugaagcucucagagcuuuucuucugugcagucuguacuuugagacaucuuuaugacucuggaaaugcuuuaaguagccagcagugaaccuggacucuggucuguaguugaaugugucauuuguugugaugucagcagaaaggacacacuuaaaaauuuuaccuccuaguuaugagcuuuuugguacaguauugcacaauuaaaaauuucuuuuacacaauuucuuaaguaagcauguaauuagauacaaauguauccauauuaaccaagcaucauggcaaaugccuauaaacauagcucucaggauguugaggcaggaggauuauaacauuugaaucuagccugggcuauauagugagacccugucuaaacaaacaauguacaugcuugcaguggaaguuucuuguaguucuuuuuuuaaaaaugauuuuaugugcauugguguuuugccuucacgugugucuguguaaggauguuggauucccuggaauuagaguuagcaguuugugagcugccauauugagaauugaaucccuguucccuggaagaucagccagcgcucucucuccagcuccuuuuauuuuuuuuuuuuuguauuuuuaauucacuagaacaaaaauaaaaguugguguuucuuauucuuauuuuauccccauuucuacaggcuauuuuuaguucuccuacuuguagguauauauuucugcugcugcuaagggcuuacuccaagaagggagaccuuuaaagaggucaguaauggugggccaaaucaacuaauauauuuaugugacccaugacauauuugaguuuuuccccucuugauuuuuuucaaacacuuuaaaaauuacguuucauaacacccccaccccaccucacauaaaaaaggccagguguaauagcuuacuucuuuaauccuagcacuaaggaggcaggaugaucucuguaaguuggaagcccgccuggucucaggaaaaaaaaaaauuauguuucagcucuagugaauuugaaugaagaugugugcacguaaauuuaggggcuuccggagaacgggguauagaaagccuuggaccuagaguuaaaggagauuugagucacccaacaugggugcugagaacugaauucagguucucuucaagagcagcaggccucuuaacugcuaggccaucucuccagaccucuggugaacaguuuuuaugggaguucugguguaccugaaaaagggcuucucuguuaauuuuaaguacaaguaguguaguggcuauuccugauugucaacuugacuauauuuggaaugaacuacaauccagaauuggaaggcucaccagugacccucaucuggaggcuuggagauagaaguuucugaucuggaucuugguauggagaucuugaggcauaguggcuauggauuccagaagauuaaaucuccgaguucaaggucaucugggauuaaaggugugguggaacacaccuuuaaucugggcuacaccuucugcuggagacaauauaaggacauuagaagaagggagucuggcucuugcuccuucgccugcuugcugugugagacugaguaacugcuagauccuuggacuuccauucacagcugcgacugaaccauuguuggaauugggcugccgacuguaagucaucaauaaauuccuuuacuauauagagacuauccauaaguucugugacucuagagaacccugacuaauacaaguaguuagugaagucacuagucuagaguaugccuaauagaagagcuguagaccaugcccucuguauauaccaacucaguaugagaauagcuugugaguuccgugcugguguaagcaggaagaacaagauuaaaaaguaaauaauugccacccuacacauguuuaccaguuugugguccauugucaagacauacgguuuaaucagugaaacgauagucucaguuauuaaucuagaaaggguucuacauucagaacucuggggcagaaccuaacuuuguacaugcaguaaguauguuuguguguguguguguucacaaaagaauggguuguagacccauccuggagcauagccaagccaagccuccugguccagcuguguguguguuaccaaguuaguaucagugcuggcugaggagcggggaagaaaugaacucuuacaagacgacgagaaguucagguaccugccuuucucacaggagaggugaauuuacaagucucagagcccgcacucugugugauugcuggaggccuuagccggguguggauuccuagaagcuccggaccauugauuaauuucucucuuucagcguccuaaguagggaaaauauucagacuguuuuaaguuggacuauuuuugaugucuuuaugaaguaauucuauugugcuaguuaaaguuuuggguguuuuggguuguuugcuuguuuuuguuuuuguugguuugguuugguguuuguuuguuucaacuuguuauaaacuagaguuauuugggaagagggaaccucaacuaaagaauacccucaucaaucgcauuggccuuaguguuaguaaauccuguggggguuuucugaauuccagacuuaggcagggggaaucacaagguugauuguacccggccuuaguuacagugagauuuuuaccucuaaaaagaaauucuucuaauauugcuauucucucccuuuacauaccaugcuggccagguaguagucagcagcagaguuguuuucuaagcacccaugcucaggaagaacuguguaguuagcacucucaucuuggagaaugcuagucagagaaagcccaaggcuaaguagccgcccaugccaggcccacccaggcucuguggcuugcauccuaaaacuccuguugaguuucugucugugugacuagaagaacaacuugggcuuacugugagauacacaggugaggugaacagaacagcgcacagauauaccgguuguuacccucuugagucccuauuucacuaaauuugcugguauuuuauaguucuagagccauuuugguaagugcugggauuaucagcauguuucacugcacuguaaacuaguaaaaucaagucaguagccauauuuuauacaaagauagauacaugauuucuuguuagauaaacugaaaaaaaugaaaucucuaagaaauauuugggaucacugggaaaaaaaaacaaacuuuuaagaaaguauaagguccuaagaaaagguaacgaaagaguuccuguguucucaacugggaagacuaugaacaagaaaaucucucaucaguguauuacuguccagagaguacucuuaagguguuuuauuauuauuauuauuaaauugaauuuauuuaguguacauacauucauguguauuguguaagugcuuggaugcacacaugccaggccuguggagaccagaggacagcuuggauaacuugguucucuuuccauuguaugggucccggggaucaaacucaugcugaaccauuucaguaaagccagcuuacggaacucaaaauauuuaguaacuuacucaauggcuacaaucacaguagugggacagagaaaggauuugggguuugggggagaguauguguuacucuggcuauucugaaacucacucuguauauauaggcuggccucuaacucagauccaccugccucugcauuaccaagugcugggauuaaaggagaccacaccuggccccgagagaguauuuaguaagaaaccuuuagacaguugguguugaagagagaccaugugaagguacuacuaggcuuuggaaaaaaugcagucaagucgguguagaucugagggcucacaauaagagugcuugcuuaacaugcuugagaccccggauucacuucccagagccaccagagaaaaagggcaaauaccaugaggaaaauaaaaauaguaagugugccuaaaauggcauucaguucaccauccaggaugauggcugcugaugggagauugaagauuugggacaugugccucaaggggaaaaugucauccaauuuaccauugggguggauggauguugaugagagauugaagaguucgucaugggaauguucuccuguaaacauaaggaauuguauuugccaagggagaguugucuuccauuacuaaaaaauucuuaggcacuggugacccuguggaggugcuuugcucuugcucgauaggaaugugaacagaaacagaguggaagcauugguuggcuagaucaagauaguaggagauaagagauuagucagagaagaguaugacuuuguguuugacuucacacaguggcucaguuaaucucuguugauuccagauuguucugguuuagaggacaguaucuuucuacuguuuacugaugcgagaguauagcugucuccaccuaguuugacucuaaggacuaauucuggagucaacucacucacagguccuuugacaacaaagcaguuuuuagaagauugacuuuucucagaaugaaagcuguaaugucacaguacaucuaacuauaaaauguucugcccagccaagagucagucuugaaaggagauauucuaagcaacugugccugcauucucucuuccuuugacauuacauccucaggaauuauuauaaagagaauuuggguguuaaguauuuuuguugauaguuuuguuuuuaauuuugugugugugugugugugugugugugugugugauauguguguuucucuaugugugugcaugugucuuucucucacagaguugagggccauaugucaguuauaggugucuuccucaguccaucugcacuguauuucaagggugggauugauugauugauugauugauugauugauugauaauugauuuagagguagggucucacuauguaguccugccuggacuauagucagaucagacuggcuuaauccauuuuguuuuguuuugagaacgagacuucucugagccucaaagcugaguucuaggggucugccugucucucucugcccccacccacaccccaaagcuuuggguuacagccuuucacuaucagucccaacuuuucauagugggugcuggggaucucugcucagguccuaguguuuguguuuuucugaaggagccaucuucuuucuuucaaacuccuguuguucaccuuaccauagaaaacaagguaaggaacaguagaaaaacagaaaaaaauuaacucuugggucaggguuaauacacaaauuaacaucugucuuguguacugucaggugaaaucccacauuugguuuugaauaggguagcuagaauaaggagucaguuccaagacuauguaaaacacaggcuggccacuuaaagaugccugacauuuccaggaauuaaggucaguauagugucuacaaaugagcuacuuagucuuaagauaucuuuuauuuuuaugccuaaagauaauauuggccuggagugcaguauuauuaaaucauuauuuuuuuuaaagauuuauuuauuuauuauauguaaguacacuguagcugucuucagacacaccagaagagggcgucagaucucauuacggaugguugugagccaccaugugguugcugggauuugaacuccagaccuuuggaagagcagucggguacucuuacccacugagccaucucaccagccccaaaaucauuauuuuucugaguggucuaaacccacuugggauucuuccacuuugaccuggaguugugggauuguaggcauguaccacuguaucauguuaaagucauugauuuucugaugcucuggagcugucauagaggccuuguaauaaugccuccaaacaucuggagacaccagaaagguuuaagguuauaaucucagguaacugcucuggcuuuaacaauuggcuaauccuaguggacagcacuaauagcugccucugaaaaguaaagagcuuacccauggcuuggugcagcucugaguaccuacauuugauuuggaugccaguaaaaugccagaugacuuggcgucugccaguaaucccaguacuugggaagcaaagguaagaggacaagugugagucagcuugcauuacauaugacuuacagauuagguucuaccugugacauccaaguccauuaucuaaacaguagggacgaggugguacgacuggagcagacucaccucuuacuccagaacccagcuaccacaaaguuugaaagcugcuuucaucaccauagcuaaugccauuuuuaucugaagaugcuucugcacuuguauuauucaucucccaugauuuugaaacaaguucacccuauuugcuucccuccaagaacacuuguaggaauccauccaguuuuaaucaguauaacuuucuguucaaaccacugugauucugacacuucaguuagcaauacucucaauauuuggaggagguaaaaaaaaaaucaagaagaugcugggcaugaugauguaugccuuauaucgcagcauuuuggagucagaggcaagugcaucucugagauccagggaaauugugggacuguaucaaaaaaaacuagaaaauaaaauaagaaauuagaaaaucaaucaagaugaaagaugugggguaucugcaucugggugauaucugugugguugaauuguuccuuugugugcacgcucggggauucagccucuguagucacuugguagcauuccacuuuggaaauagugaaggaaacauuaaguucuauguggaaaauguguagaggaccgaaaguuuucaauguaaguagcucuuccugguuggggugucucucagcugcugugcucccguggcuauaaaaagcaauugcuuccucauuuuagauacagauuucagaugaaaaggcagauuuuccuguuugacuguauugugcuaucaacacaucaggagugaguggaauguucuuugagcaauaaaaaaaggcauguggccauucuguaacagcacuugggcuucucaacuuuugccuuccuuuccacuccauacuuucuuacccacagaacuugaaaaaaaaauuacaaaauaauuuguuuccauaucagacuuuagacugugcauacagcucuuagccaauuguaauacaucuucugguuuucccuucaaaauuaucagugucuaagggccaguucagggagcaucaucuccuugaugccugccugcaugccucuagcauacagugugccuugccuguccucugaacuugguauugaugagguuuucauuaggauagauuuuaagucuguucuguguguaccuaucuuuauaaucuacuucaaaucaugaucucaucuuuuuagauccaugagcugaguuguugguauguggugggaaucuucauucccucuaaaagcacaugcagccacuuucuguaugauccugccagcuaguugacagcugcagucuaguugcuucccugauguuaaacacuauuuagccucauuguuucauugagagcucuuuucucaaccuaagaccaagccuucauaagccaguuaauguguugacaaagaggcuagaaaggcuaugguuucuggguagaagaaaggucaucuuucauagaauguucuacaucagugguucucacuaugggucacgaccccuuugaggguugcauaucaggauauccugcauaucagauacuuauauuaucuaguaguaaaacuauaguuaugaaggaacaacaaaauaacuuuauaugguuggggccaucacagcaugaggaacuguauuagaggugugcaguguuaggaagguugggaacugcucuucuacaggacccgcagucugaagugccaugcaguugugcagucugccuccaaauauuucugcugaaaaaaguuuauuuacacuaaauacuacuauuugacagccuuugggcaguuacaaagaaaacaaaccugcaaaucuccaacuaugguggugcagcuuggacuggcucugcagucuguuugugcuuuugugggcguuuggccagaacaaaaauaguaaugccagaccuugaaggagagugauuucccagguuuauauaucugauucuguagacauuuaaagcugugaguuuaaauuuuuuucaaaauauaguucuuuaucagaguaauaacuaagggcaaauuuagaaauuacuuuuacaaauauaauuuuuuaaagccaccaaauuucuaacacaucauuaguuuuucacccuaaagggaauuuuccaaaagguaccuuugucuggccauacuugagauuugugucagguuuuucucuucuguuuacaguuacaagcuugaauauugcguucuucuucaggaauuugcuuucuaaagggcaggguuggcuauuugcuuuucuuauuuacaaaaaugugggugagaccaugguguuuguucauaaucauauggacuguguuugcacagccuuguggcagagcaaguaaaguuuacccucguaguuucuugaagacugauacuuuuucauuauuaaaaaaaaaaaaaaacuauuucuguucugguuuauuauauguguauguaugucucacuuugcacaugucaaggucagaggacaacuugccagagugaguucuucuacucucuggguucuauggauugcacugucaggcuuguuggcauacguauuuacccacugagacaucucauuggcccaguuugucauacuuuuuuauuuuauguguacaaguauuuugccuacaauauguguauguacuguuugggagucuggugucucucgacacuaagcgagagugucaaaacucccagagcuggaguuagaguccguugugagccaagguauggguacugggaauuaaaccuggacaaucugcaggaacagcaagugcucuuaacugcugggccauccaucuaucaacccuguuuuucauuuuuaaaugugaaaauugguuaacuuuucuuauuaaguuauacuuauuaaauuauuucuuauuaaauuacauauacuguuuguaaaucguugaaauucacguuuugaaauugguucuaaaauuauaacuguagcuuuuaauucuuuaauauaucuaugaaucauuugagauaggacuaaaaugguaaauccauauuaauuuuaaaaguuagagaaagcagucaguuauguauuauaauugcauauaaauaauaauuuguaauauguaaccauaauuuccaaucucaaguuauaugaauucuuugcauuguaacaguuugagaagucuagcaugugaauaagaaagcugucaaagcuuuucagauugacuuauaaagaaauuuuauuuauuuacuuaguauaaguauauauauguuguguaaccuacagugugcaugugccuaccacaugcuuaucaguguucugagaccagaagaugucauaacucccagagcuagagucacauggaguugggagccuccugacaugagugcuaggaaccuagcuuagguucucugagaggcagcugggaaguuucuuaguguucugagccaucuuacuagacccuacagauuaauuuccagccuuuguuuugcuuauugcaggucucaucaguagauugaaaaaucacuuuagugaauuaccaccagccuuuagaaggagggaguacaguggaacaaaaaacagaaugcagaguaauaugagaaauuaaugaaaguauacaguauaauuuuaccaauuagcaauaaguacuguuuggugauaauugguugguugguuagguuuuugguugguuguuuuuguuuuguuuuguuuuucucuuuuuagucuuuuccaagcugaccuuggaacucccuggcugaggaggaucuggaauuccugauccuucugccuuuaucucucaagugcuagaguuacaaguuuaugucacuauacucgauucuuguucuuauuguauaaaugugugaucuguaagccuccauugguaacaggaauaaagguagauuucuuggucuuguaguuguuuaaguuacuacuggagagagauugacuguagacuuuaguuggaaaguuccaguaucgugucuugccuggguguguaucuugguuuuuugguuuuugauuuuuuuguuuuuuuguuuuuuuguuuguuuuguuuccaagacaggguuucucuguauagcccuggcuguccuggaacucacuuuguagaccaggcuggccucaaacucagaaauccgccugccucugucucugccucccuagugcugggauuaaaggcgugcuccaccacgcccagcucuggguuuguaucuuuaacagaaaguaaaggaagaucugugugauuuuacucaucaaaguuguaguuggcaggaauuggauaagagaaacuaauaaugcaauaaaugacagaaucaagauucaagaaaaaauuacauuuugggguggggguggcucugugugcacaugucugugccaaugugucugucugcauauguggaggacagagggcaguuuuggaagucaguucuguccuaccaccagcucagguugucacuuuggcagaggaugucuuuaccugcugagaugucucauuguucucccacauacauauacacacccuaauuuaaauguacuguguguuggaucuaaaucagaagaaauuuagaaguaaaugcuccuuccuacaggcuugucccaaauggagcaguuaucaggugaggauguagaacaugcaggaaagacuggaguagauggaauugcucaggaaguuuaucagcugcauucuuugacuauugaaacuaucaauaagauucaagaccaaauuuaaugcuuaugcuggucagauugcauguggaguugaguguuaaguuugauccaccacacucagacaaacaguugaagaacucccaauugugccagcugccucugcucauuuuuaccagacuugagcuggauggacuuuagaggaauucuguugcuagcuuggcuaaaucuugugcagauagcaugugcacacauuccugccuuauuuuguuuauuuauuuucucccugggguuugaaccuagggcuucguacaaaccaaaccagcacacugacaaugugcuauacuccuagcaccuuguuuguuuuugagacaagaucuuguccucuaacuuaggcuggcuucaaauucaugaucuuccugucuucuucugaauguugggguuacagguauguacauuguucuacugccuccuccugaguguugggguuguggguguuugcagccuacacccuccucaaggccuuuuauuauuggaugucauuuguacagacguggauagaauaagagaaagccauagugcuggggcugagcacuuaugcauacaauaugggucuagccuagaaaugacaaugaguguaacugaagccuagaguaaggggggugagcccagagaggaacagaucacaggagccuuguagucucggugaagagucaauuuuacugaaugaaaugguaagucauuggguggagauggagguugagcagagaggcaacaaugcuuuguaaacuguuuauaaguggugcuacauuguuuuaaauauuccugcuacuguugccauuccuaccagcuuccguuucuuaucuaggcuguaaaauuuuacuaucaagucuuugauuagcauuggccaggaaagaagccugcccuugugugugugugugugugugucugugugugugugugugugugugugugugugugugugugugugugugagagagagagagagagacaaagagguaauguguaugugucucagaggggagucucucucucucucacacacacacagagucagagagagagagaaugugugacauagacagagagguaaugugcacaugucucagaggggagacacagagagagagagagagggagggagagagagagagagagggagggagaaagagagagagagagagguaaugugcacaugucucaggggagacacagaaugaggaggagagguguguguguguguguguguguguguguguguguguguguguuugcgcaugggggugggggugagauuggugugggucucacucugcaggcugaccucagucucaaaaucuaacuacauccacuucucagaauuaaagggugugggcuaccaagcuugggccugaaaagcccuuguuaauuacaaaacgcagucuacccagugucuccugaggaguugguauaguugguuuagaguuaugcuucugguggcuuugguaauuaaccaaggcuucaucuggcuucuuaaaagguguuccugguuuaauuuuaaugaggcugagucaucagaucuuauaugcaguugagagggaagggcaggccucucuuccauccaaaagcugaauggaguuuuuuuaguuacagcacaaaagcaaaguauauacacucucacuuuauugcauuguuuaguaucuaguuauauagacaauuacccauuugguuuuauucugaaauuaguagucaugaaucaauuuagaggcaaggguggguagcaaucccuuucuauucaaaauuuucuaugugcuucgaaccgcaucucaaugugguauaaaugaaaauacuugaaacacaagguuuuacuuugcacaucaugguuuggagaggugagcgagagauuaagaacaugugcuguuccuuccaaggaccagaguucaagucccagcacaucaucaggugucuccucaauuacccuuggccucuguugcaugugcauucauauacauacaccaagggaugccauaucauuuacaauaauaaaauaucuaccucaaauagcuuaguacuuagaaacaguaucugcuuauuugauaauuguauagauuaaauggcauuaacauggcaguguaggguuggucuuaagugucaacugaaaaaauaaacagguuuguauguacuggguucacacuuugcaugacugcauacucaaucaggaacccugauggaccuugaaugcaaucaucuuagagugugugggcuuuuuguucauuuauauauuuugcauuugaccaccaaguugaugagucagauugaauacauguguuaauauagaguuuuaggaagucagcugucuagggauguguugucauuccacaguuuucauuauugucuccaaacacacacccacauccaugcauaccagaauuuugugugaaaagcagucacuagaugccuuuaguuuguagcauauauuauaacaugaguggcugugcccugauacugacuuauguguuaucugacuauuuuucaguguuuauuagcacuugggugaauaggagucuggugcauaagccaaagcuauccaguugccaaaguggcaccugugauucuuaacuuuaaugguguggauaugcuguuaauaguguuuuuaaacagaaguguccauugcuaacauccucucgucucccaucuguuuuagagaagaaaguaaguaccaguguaaacaagcacaaauagaaaacaagaaauaaaaagaauauaucgacccacaaauagccucucacucagguuaaccuucaugucugaauuuugcagaaugagcagagcauuuucuguaaaagcuagguguuuguaagcagugggcuuggauauagcaacagauagaaaauguucauuauucugacuuguacccuaccaaugaauguggaaauuuacagggucagguuuaugucucccaaucagaaaauagugcucuuuuuccaaugauggcagugcuguuuucauccgucauugugacaaccaguauuuuuucaccauccuugucuuacucuguacugcuaugacaaaagcauaguuagcguuaggcgacagcucuggaggcuggauccccaugaacagguuucuagguugaacaaguguuaagguccauagccucacauaguguaaagaaagggagucaaaucuugcaggcccuauaaaaagacagcaucagccaacccacaagcuuccauucuggugacaaccuccagccucuuggugcacguguugagauuaaguuugcagcuuaugaauuuucguaucauguccuacaaguacuaccccuggcuuauauagagaaugcugaguguccaaaagaaagaguugcgaaaguggcaucugcucucauggccaaguguucugauggaauggaacucuaggaguauggcacuagaaacaagaaguaagacuugguugaguggugguggcacaccuuuaaucccagcaucuaggagguagaggcaggcagaucucucugaguucaaggguagcaaguuucaagacagccauggauacccaaaaaaaacucucucaaaaacaaaagauaugaguugaggcuaucagcaaauaaaaggcaagagagauaguaacccuggagcaaagacauugaguuaauuuuagaaaaaguaacaagugugcaaagaagggaagaagguaacuggugaagaacaacgagaccaaacaagaugcauuggguacuaguuccaacuugagcuuucaguggucuaaguauuuguuggagcauaaaguggaguguuaaguuauccugccccuuuucaggucaccuuuggccuccagauucuuaggauucaagcacguaucacugauuacuaucacaaauaggucucuagacacguuuacacuaacuuuagucuuaaaaacuuauucauagucguauauaaaggagggguuugugucaaucgugaauaaguuuccuugugugauuggcuccuuccuggaauaucuaguuguugucuugaguacauuucagggacuacuuauaucagaguacauuggauucguuuuuauguuccuguuggguagaucaguuaagaagaaugauuaugucauaaacuuuccugaauaaaggaauuugauauacauguucucccuggcagcuguguuuuguguuguagccaacauucauaggaccuuuuaagucuccuuuaaccuggcccaucugcacuggggagaguagaaaguccaugauauaacucucuuaaaggagauugauccaggguugucgggguucccuccagcucugaaauacucagaugcuaaggaagugcaugcauggguguugcaggaguguguaggggcagcaugagccgugggguaacagcauguuacuaauguuauguggccucacuuuugucaacugcagaauagacaguaucaguuggggguauaguauugcaacuaaggacaaggucaguaggaauuggagcuuguuuuaccuuaagccagauugucaaccuuacuaaaccucuauaaggaagcaguaaugacuugccaggguugucagugggccugacaguaguagucacucugugagagguccaccaugcuacccaugucagcagcauccacaugcaccuguuuggugggucguuagggaacagaagacugggggggcggggggguggauuaaaaauuaagaguguuucaaagggccucucugucucaacauuuuuacauaucuuagugggcuugucagguuacuagaacuuuggacaugauguaaaauguuuucuuguguguaugggauuuugcuugcaagugugucuauauacuuagugucugaagaggcaagaacucaugucacagaguugugcaugcuaggaaccaaagcccugcuuucuggaggaacaccaagugcucuuagcugcuaagaugucucuggcuuccaaucuggcuuucuucacagguuauaauguaaacgugugucagaauucuguuagcccuggggucucacaugagccuuguacuguguugcaggucaagcagguagagugccguggaagccucuggcgcugccgucaugccguucccauuuggcaagucucacaagucuccggcagauauugugaagaacuugaaggagagcauggcuguuuuggaaaagcaggacauuucugacaaaaaggcagaaaagguaugcaucuggacauauuuuaauuccuucauugaggaccaaauacacaacuuuuaaaaacugauaaauucccauuuggauguaguuggguuguuguuguuguuuuugguuuuuuguuuguuuuguuuuuuugcuuuuuaaaaucaggucucauuccauagcucagggugguauggaaugugggagucuucugagaacugagaugggauugcaggugugagccacagugcccagaguucauuauuccacucuugcagugcuaguuacuugauuccugaaagcaguguuuccauagcccacaugugugccaggcaagugcucugccagauuauagauuacuuuaaacaaaguuuugcuuuccucucaacccauagcaucuccaucuacuuaaucacuacagucuaaagccuggcuuggaucucaccugggccucacucaguuuucucagaagaauccgaugucuuuugcuuccuaaaaggcugugaauaaagcccaugaguuccacuuuuuuuuuuuuuuuuuuuuuuuuuuuuuagauaggguuucucuguguagcccuggcuguccugaaacucacuuuguagaccaggcuggccucaaacucagaaaucugccugccccugccucucaagugccgggauuaaaggugugcgccaccaccacccggccgaguuccacuucuugacgacaauccuuguaaucuaccucauguguauuagcaguugucccagcauucaugaagucagauaaucaaauagacuguaaugccuugucuuguuuuuccauggauugguauuccccacauccauuuccacuaaagcccuauucaucuuucaaaauucuugccuauauauauuuccuuuuguuagaaaguaucucagggucuuccuacucaugcccacuaaaacacaccuucaccguuugggcaccugccuuaaaaugucagaacugccaccaucuugaguuugcucucuuguauuuuguuccccuugcuagacugagagcugggagcacauauguuaauagccugaauaugagugaguuguggcauuggguuuuucaucuucucuuuaguuaagagauuauuuucuuuauaaggaugaaagauagguuacuuagcuacuuuguuuuuuuaagcaacaagacuuuaaaguuuauuuuuguuuuuagcuauaauauaaucaugguuugauaugagauucuuccucucaaauauuaugccacaguauauuguggaugccuucaggugaauuuguagaacaugggacugguuuuugugacugguucuuucuauucugaaugguuccaaaguggauuagcauuagcacuugcuacauccacauuugccuguaacuccagcuccagggcuuugaugcccucuucuggacuccauggguaccuacacucaaccaugcacacacccacauacaugcacacauaaguaaaaauaacacaaauucuaaauagucccagaaaugaugguucugaaccaucauuucuguucugcuuuccucuguugcuuugccagugucuuucgguauauggcugacugauccaggcuccuuuucuuuucucauuuuaucuuauauuuucaaugcccuuugaaccaggaaacuaaacugauguaacauuuguuucuguaucugucugucuaagacaacuggauaagauaaauccuaguguguacacaaaauguaauacugucccaauuuaugaaagugguucauaagauguaaaaaauagggaagccuaguugcagacaauggaaacagguuuucucaggagcucagaggagauagcagaaccacaacaccaccugcaguucacaggaucuggcaucagauggaaguaacuauagcuaucacggagcagaacugacacccauggcuggcacaugagcugguccccugaucuaagaaggcacugugaaggagaacagaccccauagaggagugauucauaccauaggaauugccucaguggcugcuccuucauccugaauuguuuaucauugaaagucugugugucucuuaagaugaugauucguuuuuugccugugccuaaagauaacagucuauuccuuaaauucauucuguucaucaaacucugugugugugucuguguuaguuaugcuagggauugaguuggggcuuugcaaaugcuaggcaaguaacuaccacugagauacacugcagcagucucaucagacuuacuccauuuucagcacuaggaauaccagacaaggucucuucuucaagauagggccuguguaacucugacuugaaauguauucuguagaccaggcuggccucaaacuuaagucacccccugccucucccucccgagugcugggaugaaaaguguacaucaccaccuggcaguuuuuaaguuuuuguucacaggaccccuuuauacucucauaacauuaagacaaaaacaaaaaaacaaaacuucauguauguggaguauuuauauuaucccauuagaaauuaaaaucaagaaaguuuuaaauaaucauucaaaagaaauacacauacucugguuuaacaauaacauauuuuuauggaaaauaaccauaucccaaaugaaaaauucagagagaagaguagcaguuuuuacugugcugacagaaggcauuggauccgcacuccugggcugcuauacgucaugcugguaaagagagggcuagggcuggagagaugccuuagcauuugcugcuccauccccaggacccacggcaucucagaacugucugugauuccaguucccggagccugacacccucuccguaucucuguuguguacuucugcauauauauggugcauauaaauucaugcacauauauauuuuuuaaagaaagaaagcuauuuuaauagcauuugagauaauuuugaaaauuugugggaagccguugcagaguggcaguugcagaguggcaguuggcuacugcuggccaccacacaugcauaggcagugaagguucuuuugccaagacaaguuaaccaaucagaugugagacacgccuuuccuaggccuauguaagcagcaccacuucugggcucagggucuuuucgccucuacaaucaagcucucccaaaaaaugugugcagaaggauccuguugcagcgucguucuuccuggccagucgauugcgcacaagaaaaauugauaccauauaaaaauuugauaauuggcaguuaugcgguuuuuauuuuaacagccauaucuguaaggaaccaaacacacuucccaucuuuuauaccaaauuguguacuaaaaaaacaaaauuucauaacauuaaugacuuucuuacugcuuucucauagguauuccuuucuucucuuucuuuaccuucucucuuagccuagacugagaauugugauucuccaccuucaaacucccugaguacugagauuauaggaaggugccauugugcacaguucucccgagcauccuuaggugaaaccuguagguucuuuuaaaccaaguauguggucagacaggguuauauaacugcuacgguaguguguuggcacugccuuagguugugcuggaguguuagccccuuuaggauaaauagcaugcagugagcacaaggcaaaugauguccugccaaugauguaaaaccucagucuggaggaacccaagagcccacacuuuacaauguacugugauaguucauaagaauuaugacagggaagggacuggcuugagagguggagaauauucuaaguccuguaacguuacagagaaaacguaagaagguggcuugauggagggaauagaagaaagugcugggaucuguaucaucugcuugacuggaagaaugggggguuuuguuugaguccacgagcuguuuuguucucuuagaguacaguuggaaugccaggaucauuuuuggugguagcacuagggggaaggcggcuacuggcauucaguuaguaaagcccgggauucuaaauauagaacagcaacaaaaaagaauuacccagcaaaaaugucauuagugcggaggcugaguacucccacuccaagccagcaucacacaagcauggacuuacucugaguauaaaacacggggauuucugaaaaauaaauuucaguucaaggugauaggccgcucugaagaauuaacuagucuaaccagcuuggucuaaguagugaguuucagggcagucagaucuacagagacagacuuugucucaaacaaauaaacaaaaugcaaaagaugauaggaaaaguuaggacugcuccaugaguggcacauccagccucugucagcuguagaaggugucugucuguaucagugucaucugucugucucauucacuuuaauagaaguacagacuagucaggauuacuuaagccuuugcgugugccccuuccacuucuguaggaucuucacccuagcucccucugugguucacaugggaucuuuuuucaagucuuggcucaaaugccaccuuuucguucaguuugcuauuuaagaugaagcccugcuguucugcauuccgccucuuccucucuuuucuugugcaauauauguaauuguuucuucuccaguggauuauaagccuuucaaagacauaccucaguaauaacuuguauuuuuugaagauggaauagagagcagaguuaaugugaacugcugcuaccuugcugucaugcaucaccuaugacugcugagugugaaaaauguccacauugaguguccaucuaacaggaaggagcuguaaccaagugacagcuuagaaugacugaagaugaccaagagccauauuuauuucucuuucaacccugucacccagagcucuguaacucacugcccaguuauacgucuguccugauggcugcacaguugcugugacauaacaucauaaccaugucagcuuauaaaggaaagcguucaggcuugugguucuagaggguucaaguccucagugauagagugaaagcuuggcaguggguggcugaugcagagaagucucaaaauggcaugaguguuuuaaaccuuaaggaccacccccagugacacacauccuccaaccaggucacacauuccaaugcuucccaaacaguuccacuaaguaaagaccaaguauucagauauaucagccuuugggggucauucucauucauacagugacagugaccauuucucccccuguaguuaaggauagucagaaaacauuuucaugauuagauaaucauguagagugauaugccuaauaauaaucagagaguuuaaucacaggauuccugaaaucuucuacaaaauauagcccucaacucugaacuuaacauugugguaaauuuaucugaugggaaucaaagcuauaacuagcaauuugauuggcaaggagaauaaaaacuuaugggugaaugaaauuagucaccaaagaaaaaucaguuaacacagagcuuuagaguguuuaauacagaccauauuuacugugccagagcaacuggggcugcuaagagcaugagaugguguagccacuuuagaagacaggcaaguuccuaaagaacugaauuaaaucagcuuugauagaaucaugacacuucuaaguauauacccaagaaaccaugaaauauauauccauaaaagacuugucuaaguguuuguagaaguuucauguaaaauagcccaagucaggaaauagccaaaugcgugaauaaucauuuuggccgcauuguuaauagaacacuauuaacaauaaaaggaugaacuauauauaacagucaaaucucaaaauacuuauguugcuaaaaguagccagugugcaugauuuaugcuuuauacaaagcucuaggaaagguaaucaaucuauagcugcagaauucaggcuggugguugcuuuggaauagaaauagagggagaagaaaucaagagaaaugcagaaggguacauaagggaguuauggcaaugaugucucuuuucacugucuugauggguguagacacccaugagcagagcaaauguacacaaacuguacuuaguaugcuguucaucaacaauaacuugagagaggaagaagagaugcuuguuucaugcaucagcugaggcagaugugucuuaggaaccacauagaucugagggcauaugugugccccaagaauaacuaauguaaugaagaacccaaagagaauauugaggacagguugcaguaacaaggguauuauuuaaauucuguuccaugugggcaaguccuugcuugagguuguggaaugauaacuguguugcaaggaguaauuaaccugacauggcaguucaaaacuacuguaaguaaaaaaaaguuaauugaaccaggaguuagauuugagcagagugucucuuaagaauacagagucucaguguaguuccuaagcaaaauauuuguaaggaaccgccuacuauaaagcaaggguuaaaccugcuuuauaguagagaccuauggguggaagcccaguaggcaaucuacuuuugucuucauauuaggugacauaaaguccucagacgcuuccugcgucuggggcauuggcauuggcaugggcuuggugaccacuugguuaagugcugcagaaggagcucuuaacuguacuguuggcacaucuuacaccaccaccuucugcaaggugcuucacagagaggccucuguuaccacucucaagugaggaaaacugcuuccuaagcaacucauuauaugggaauggaauucacaguuagcuaugccaagccauaauaaaaguguacuccuucguuugcagccuccuagaguuuuuacuuguguuccauggugcauaguuauuguacugagguuguguaguaggauacauacacauaggucaaucccuuuuuaacuuugccacagccuuuuauuuauuauuuuuuuauuuuuauuuauuuauucauuuuacaaaaccccuuucuuuauacaaaaaaaaagaaaaaagaaaaaaaagaaaaggcuuauuauucuuauuuuagguaaguggcagacaggacuagggugaaacuuacucuaccacuaacagccuaacagcugugccuuaguaacaacuauuuucacauucaccugccauauacagaggacagagcuaccacccucagcuuauacucaguucucuucaccagcauggaugcuaguguucugggagaaguauagguaggugccagcauauauaagaggggggaagggaauauucuuuugauagcauggccacuuaacagugacuuguaguuagagaaauguuucacacuaggaauuacuaacagguuuuucuuaguucacguucuuuuaguugagaauagucagauacuuucuauaaugaauuggggaaggugagcuugaaaaagcauucaacacaggaguuaauauauuaauugagucuuuucaucaaauauuuaccacaacuauauucuuuuuuuuuuuuaauuuugucuuuaugugagaguaagcacauugccaugguacacacgccugagacuagagaacaagccucagacguccuugugcacuguggggcccagggcugcugcucagggucucaggccugcacauaagcuucccugccugagagcaucuuuagauuccauucuacaauuuugucuugucuucauaucuuucuguauaaaagcuuugauucuucuuccauuuuuagacagucuuacucuguggguuuagcuagcuguuuuggaacuugcuccuuagaaaaggcuggucuugaacauagaccugccucugccuccugagggcugggacuaaagggacucacccccacacucuccucuguuucacucuaaauauuuguuuugaaauugcuaauucauaagaaaccauuuuccugcuuuuauccaguggacaguggccuuauucugucuuuccucugucugcuugaugcagguggagcacuagcucugugcgauugaccacagggcagccugagccacagcaacacagaugaguguuacaaagaugucagguuuaaggcagagaggcuuucugguuugggagguccugaaauagaccaguugcaccaguguuuuaguuucuugaguuacuucuccccaucauggacccacgcacccucagguauauuacccaggcuggccugaacuccuguaccuuuugccuuugccucagacuccuaauuuauauuuaaggggaaaaucucauagcuagggugcuacuaggggagguugugcuggacacaaucauaaaggcuaaagaacaucccugaguccuccucuggguaggaaagagguuuuauucuaauacuguugccagugauacacacauuagauaugaaaauugagaugcuaaggcugucuacauugaucuaauaacguaaauauuuuaaaaaauaaucccuaaaagcuaauuaaaguucucauuugguuguauguggaugcuagggaacucucucguacuucaggagucacuugccuucccuccaagggacuuaagagacuugagcucugcucuucuaccccagcaccugaauuccagggaacuaacaugcccagacucuguucaucacaggcacuucuaagccccgguacaugcagcuacuucauaggucacuucucagaaguccuaaggaaacaacuaagaccuuaaccacagucuuuuucucuugucacagaguaagaaauguggaacaugggacuucauuuuccagucaaaugaguagcuugucacaagggauacucuugacuaaguauuuauaaacaguuggcugcuguuaauaaagcagucugccuaugaaacccaauaugaggcucccuggccacgcaggaacagcaucugugucucagaacaccauguccagaugaugagcacucaaagaguguucugccaacuaacaaaaucaugaggucacuguauguguaaauugcugucagacccuggaguguaggaaacgagaggcacaugagaagggccagccugcaaggcgggcagcugaagaaggccucgcugcugcagcuggagcccaccuggaaggggaggggcggagugugaacacucaggcuucaccuggagcagagaugaggcucuucaggggugcaagauaaaguauucuucacuaaugacacauacauaucuguccaccuuacauuucguaguugagcuccauuuguuuggacuccauagaaaaaaacugcaccgagaaacuucugguggaacacgccuuuaaacccagcacucgggaggcagaggcaggcggauuucugaguucgaggccagccuggucuacaaagugaguuccaggacagccagggcuauacagagaaacccugucuccaaaaaaaaaaaaaaaaaaaaagaagaagaagaagaagaaagaaaaaaaaggaaacuucuguuggugugccaguggcuucuugccacuucuguaacucuggccgauuggcagagugaugucagcuuauacagacucaagguaguuuuacuaagacagacucacauacugaggcaagacccauggaggacacaugacauuuggaggaaguaugaauaggacucaacagacugugagaggggcuuguuuauagaacuaacuuuacaacaugucuuggucucucugcuucgcuaaucuucacuuuauuugagagagacacgacagagaacuucuggagucccugacaguccuguucggcugagaccuggcuuuuucugcuagguuaugccacugcugcugcuauccugacacuacugaacuagacugcugguauuugcaaguggauugagcugcuacugcugcugcugcugcccugugaacuaaacugcugauuuccugagaaugcaagaaccauuucuaaacagcuccaucuccccuguauccuaauaaccuuucuuucccacuaccucuggugaguggugggcuagaagagagguuaaaaacauuuuaaaaccaucauuaguaguaagucuuuaaacaaauuaaaacuuacaugcagugugugugugcgugcaagagagagaccuuccucacuaguuugcuugcuucguugaaaauuguucaggauaauagggaucagaaaucacacaaguaguugaaauaguuaaaagacucugccuuugaucccaagugcauaaauaaauaaucaaacaauaaauagauaaauaaauaagccauaaauugauagaacauucauacaagucugaaauagagugaaugaaaaguaaagaagcaaacaguacucaguuuaguggaauguucuuuuagagcagucguucucaaccuuccugguguugugacccuuuaaugcaguccucauggauuggugacucuccaaccauaaaauuauuuucauugcuucuucauaacuaauuuuguaauauaaauaucugauauugaggauaucugauauaugaccccuuugaaagguuuucugcauccgcaaugggaucacaaccaccaauuaagaaccacuguuuuaaucuauguaguuacaggaauuaggcuguaaguugagcaaaaggcacacuuaaccuuuuaacuuacuaguuucccauacagagugauacagugugggugagcugugacucaagauuucuaacacaggcagcacgggacaaacuucuuuucagcuagucaagcacuaggcacagaacugguucuccuugguguuagcuuugggagaugucugcacuaugaccauaugcacaccaggauccaaguuuagaguacuuggcccuuaaguaaaauggcagccuuauugaauuagucagccaguucacuuguuugcucacacuguaccuuggcaagcaggcacugcuggaguguugcuucccucccacuggauugcaguuccuuucucuucacacacacucccacuccugauguaggugauuuuuuuuuuucuuugcucaucauaaagucagguugguuuuuuuccaggugccagauacaauauuugauucuuaauucuaguagccaccaucuuuccuuuaucaauaacugaaauauuagcucaguuaucuuguguugucuuugugguaaaccagcagugcuggggggucugaauuuggugccuucuuucuagaaguaaaccagaugaguugcuccuagauauuccuguaccucccccgaacuguuuugcauaaucuagucugcuuuugggcucuuuuaagcacuucuuuugccuucucaguggggucuuacaggguugcucugcccuggaggcccuguuucuacucuuaagcucucaguguagcggaagggaccaguaacugggaaauuacaaggaacagaagaaucacacucaacuaugagaaagagugugagggaaaacuuagccauaggugaaugugugacagaauuuuaccuaggaaauuuuugaaauuuuuuuugaaaaagcuauccaauacugaaguaagcacugaagaaagaaagggagaguuggccaucaggugggugcaaaggacacaugagcauaggaaaccacauauguguguguguguauauauauguguguguguauauauguaaggccucugaggacagacauguguccauacaucguggguaaguagaugucaucgugcaggucuagguuagacaguaggaccagacuuuguaggggccaugguaagaaagauuuugcaccauucuaagagaaauaaguaaucauuggagcaugcuaaacagaaucucuucaucauuuggguuugauuggaaaagaauguacaaguccuguacaagacaggauguaaggaagucaauaggcuagguaguaauuuuagcagaaguuacaggacuuggguuuuggcggcaauggcacaggagacagcagauggcaggaucugggagaguagagacaacuuagccauuugcuggcucagaaggaaaaagagccagugaugaccccugaguuucugagggcaacuguacugcuaccugaucuguguguaaggacaaggaagaauaaccaagcagugggcaacaacgcgaacucucuuuuagauagauuggguuugagguagguaccauacuauagacaucuaaauacauuuuguguagacugcugaaagacaaagccugggagaacugaagauaggcaucugugagguaucugccuuuaggaguuaauuaaagcagugggcauggaugagaucacuuaaagagaagcugcagaaaaacaagaggcaggaaggaaaaccucacaucuggccuuguggguuuaguuaaggaggaccaacugaaaaggagaccaagaagcacccagagaggugggaaaagguaaaaauaaggacagggaugggugcaguaaauaacaaguacaaacacuacaggugcccaggcauaauaaagacagguaauuuaauggcauguaaaucauugucagcuagccaaaagcaauaaaguauuaggugcaggagcugugugagaaugggaaggagacguggauugugacaaacaugaguaaauauucaagagacuuaguuauagguaaaguguagcagagaagaauuugugaugucuagaaagagcauauuugguucuguuaaggggaaccuuggucauauguaaaaacugaaaaugggcugaguugggacuuggcuauaugagaagaggagauaauaaaauacaugguucucaggagggcaggaggguaucagaacccaaagcaaguaagcagcaagagguaggugcaucuaauuccauugucagugccuccccacccucacuguggaagagccuggcuuucagcucagaaguagaauagcugccauuuugucccuuccucucuugugucuuuuaaagacagcuuuauugaauguacauaucaugcaguucaccauuuaaagugugugauuccaugucuguuaguuucugcauggauagaugugaccauaacuugagucagcucuagaacacuucaucaccucacaaugaagccuugcccuuuaacugucucuccuuucagcaccuguuguuguuagaugaaagcaugagguuugaucugaauugaaagcugaaaaucauaaaaauuucaaaauugauaaauuaaaauuuucuaagaguguucaaacuugaguuuaaccagaaaagcaaaggagggugaagaagaucugccauuuaggaucaugacauaaccaccagguagcacaguuagaaacccuauuaagucagugucagauuuuuuuuuucuugucagugagaaucacuuggaauaaaggaacugaaaaagcauugcauauaaauagauuauaauagaaucuaucccgcuucuauucugucuugguccagaaaaauuacauuuggggcaccuuauugcauaugagauuuuggacuacugagaaaucuaagccuuauagccaauaaaguguauauuggaccagaaaaggugagcucugcugcacgcagaggucuaaggguuuauaggacuuacaaaucagaauagguuugauuuuuuuuuuuuuuuuuuuuuuuuuuuuuuuaaaaagucagaguugaacuauauagcccuaacugaccugaagcuuccuguguagacuaagcuauccuggaacucaaaagagaucugucucccucugccaggauuaaaggcauacaccauuauaccuggucaaaugguuuaaugaaaagauuuuacuaaauuaacuuguuugauuuuuuuuaauagucagaaaauaugaaaugaugucauuuuaucaagauauuaaauaaaaaucuuuacaaauaugauuugcaaacccaaguagccauacccaagauuauuagaucaaaacuagguguugguagcucaugccuuuaaucccagcacuugagaggcagaggcaggcagaucucugagaguucaugaccagccuggucuacagaguuccagaacagccaggacuacauagacauagugaaacacugucugggggguggggggugcgaaggggauauauauuagaucauuacugaaagauaugauaggcucauuuuugguacuuuccugguuagcaauuuuagcaggccgcagaagcauaacuagauaugugauggaaauauaagaguaaugugauuuacuggauauccuuuagaacacagaaaugucugugcagccuagguguuaggcugauggugaaauacaauuaaauaggaguuaaagccuucagugugguaucaugacuucaguuggccauagcacccauggaagacgaagaaauccacuccacuuuaaacucuuucucuugauugucuacacuacuaaggaugaccucggcuggguuggcaugucccauaugcaggaucgucuguaucuggagcaggguugggcauuagccuaccuuucuuggaacaauaauugaaaauaaaauugaaaagaaguuuucugaagauauauuuuaaaggaagacagguguacuaccucaggcagggagagaaguuacugcuugggccaucagacaguauagggaggccauagacccuccaauacagcagugcuagaagcaggagauacucaagaaguugugugaccauuugguaagaagcuuugaugguuguaaaggaauuaauguggacuguuaaauuuguucugaauacugucaucugcugauguccaauagcaggucuucuauauuuugguagguuagguuuuuuguuuuauuugcuugcuugcuugcuuguuuucaugagacggcuucccaccauguaauaaucaaagcugacccuaaguucacuguguagcucaagcuugucuugccuuggguucccaaauggugggugggaucacaaacauuuugcuaccaccuuugucugcauggagguuuuuuaaaauguuuggucuaggacuuagguuaauaacaucuccaucuuguacuagucugucuugagggagucugguacugcacgcuacaccuuacgcuauguuccaugacccuccaugacccuccugagcuacuguugccaugcguuuucuuguacaugcagucaucuuagaguaugcuauuuuugcaucaaagagccaaauuuucuuuaauauuaaaggaaaacguugcuuuuauucaauuuuucuccucauuuguaucuuuuaguuuuaaugcaucucaaaaacucuucauguugucuuauucugggauugggggcggggggcauuuucuuuugaaucagggucucacuagauagcuuuggcuauccuggaauucacuauguagaauuauuuuuauuuuuaaaacauuuuuauuggauuauaaaauucuaggaugauagcuuaguaguuugguuuucuuaguaguuuuagcaguucccugcuaucugcuggcauguauaguuucugucaagaagucccacuggcauucuuugguuugcuuuggcugugcuucucuccguacugcccccccucccccaacggcuacuuuuaagauucucucucuaucaucagauuuaaacaguucuuuguucugaaucucugcauggacuccuccucugugucuauaucugcauguggguacaugugcauauguguauacguggagcugaggaggguauuauugaagcccucugaggccuucugagaguucuaagaucugaauucuaguccuugugacggcacagcaagcgcucuucaccacagccaucuuuuuauauaauccauucuuauuucuuuuccuuuaacuuuuaaaaauggguauguguguuuugcuugcauguagucuguucaucaaaugcaugacuggugcccaggagccuagaagagagcaucauaccccuuguaacuggggugaccaaacuguugagagcacacaaguaggggcuggaacucaaucugggucccccagaagacuagccagugcuuuuaaguacugagccaucucuccagccaucuuauuucuauuucuuacacgagauuuauuugccuuuuacuaguauuuuuuuuuuuuuugcuuaggacuuuuguuuguuuuugagauagggucccucuauguaauccucacuauccuggaacaacguaaagauaaggcugaccucaaacucucagacaugccuaacuccaacucccaaguacuggaauugaaggugugcaccuggccaauucacaguuguuuucauugaucacauugucaaauuuuuugucuguucuuuccucucuuuggggacuaacuauagcuauguauauuacuaaaguuacccuaaagcuuauaagcaggauguccccaccuacgucauucccaugauucauuuuugucuacuuguuacucuucagcagcauuuucuucagcagggucuuaccugcuguuacauccaccguauccacuucaaacaucagaguuucuaguucucagucuguugucuuuggugucucuguuuuuuccuugguuuuucuugaaugugacacauacuguugcaguaacuuuucacaucuucuuuaaccuaccagugccauuucuuuugcuugcuuguguuucuaguuuccucucccucauugcugccuucugcugccccuucucccugaugcuuaguuguuagucucacacacaucaccaccaucuccacccccagcagcagcagcaccucacaugccucuucugaagagcuuccccaagcuugaggaggaacccagucuugucauuuguguuucuacuuuacauuagcuggguuuccauuguauauucagaacaugucauccuuucugagggagugcuugcaaccuucccccucccucuuccccccccccuccuguagaguguccagcuccugaggauggaguuggagcuugcacauaggucugaagguaaauacuauaaaaaaauggauauuuagcuaauagagcuauaauauguguuuguuaaaaugaauuguuuuucucuucugcacuuuccucccaaaaucaggcuacagaagaaguuuccaaaaauuuggucgccaugaaagaaauucuguacggcaccaaugagaaggagccucagacagaggcgguagcucagcuggcucaggagcuguacaauagcgggcuccucggcacccugguagcugacuuacagcucauugacuuugagguaagaaacucgcuucuuaauucucaauagcacuuguugugguccuuuuccaugcauucuauucuuuggaauaauuuaagaucccuguugacucaggccccugaccuacauuacacacauuucaccacauugcacgugaagguucuuggguguucaugauacucuuucauuuagauuauguuucauaaacugcuucucucugcgucaaggaaucaacagucuagagaacgucauagaaugcuagaagacccuaaaaugucuuacagcagagaucauguguuuuguguuuaccuggcacugcuuuuaaauuuuuuauuuaguguaguguugaaacagauuuuauucacaauucugaauuucugacuuuuguaaaauuuauuucugguaauacugggccuguacucuguggccccacagcuagagcggaacuacaaccaagccauucauucuuggacuagcugcagauagcacagcuggcuucuccucuuagggccugcucccucuacccuacccacauugccucuguguauucaauuggaucaggacauuagguagauagugaguucaugaagauaauggccccugaguccagccugagaagcagauacacaaaguacucugucuccauggucauaagcaccuuccucuuucaaugucaugaguaugcuuuaagucucaguguuuaucugccugcguaauucgauaucugugugaauuuugguggagagagguaugguaaaguuugaagaagggauagguacuucaauaauucuuaaaggaaaauaaacauuuuuguccuacuauggagaagauagaacuagauauuuccauuuauacaacugauuuuguguauuuuuaauaauguaucaaacuguuuucucuguuaacuugagaggugcaauugggauaucugauccuucuccgucuccaccuauucucucaacugaacacugaauuuaauauucauuugaaacuuuagaggcauugguuucuguuuuuguuuuuguuuguuauuuuuaagugugugcccugggacugauuuguaaaaauuaccauuacugcaccugagccagcacaggccccagaaugaucuguccaugggcuucagugcucucugagcuuugucagccuugggacgacagugucuauacugaaacaucucuugggagccuuuugucaauuauuaauuucuuaggcaacuuucugauuguuaagguucacuagauaugucuguguuuugugcagugguauuguaaaguacucaucucugaacuuuguaauacuuagugcuuuuauuauuuaauauguauuuaagucuucccuaggugagugaauuuaauagaggaguuuauguacuugccaaaaauucucuaaugucaucacacugagaguauaaucuccuuccuuucuguuucuguaaaaguguacacuguacuguucacaacagaaguauccgcuucuguaagguucaaaucccuauagauuggaagugugcuaccaacaucugcuucccauaaucaaaucagcaugcuucugagaguuagagaugguugaaauuacuuguggauuauaaugagauuucacuuuguugauaaaauuguauuaaaauugcacacuguuaaauuuaagaauuugucauuacaaauagauaaaauuagaaauuuaaugucuacaaauguuguaaagucagauauccagucauaacuaauacacaguggcucuuugacuuuauauugaggguggauggacauuuucauacuuagacagguaaauauuuuaaugauuguauuccuaauagggcaaaaaagacguggcucaaauuuucaacaauauucucagaagacaaauugguacaagaacuccuacuguugaauacaucugcacccaacagaauauuuuguucauguuauugaaaggguauguacaaugugauaaaguuuauauucuuagcugaaaagaaaaagaaaaguuuguuugggugggacaagauaaccaggucgguaaaugggaagauauucucuguaguuuuagcucacuuuuacguagaucuugaauauacugcccauuaaagucuuggccuguaagcuagacuaacacaaaaauacccugugaaugcaagcuuaaaauugggugaguuaugagcccuuaaguucacaaaucaaauacaacugaaggaaagaaauagagccaguguggccauacuuguauucugugagauagaaaccauugaaguccauugaaaucccagccaaguugaguccagagaugccuccucugcaccucagcucaccucacaccucacacagcagugaaagccuucuuggggugcuggggggugggggcaugcaugcugcucacccucacucaggagcacaugugcugcuaggucacuacacaucuuucuggaguuauuccuaggcuaaguaggcauuugauuuggguaguuguccauuucagaaacaaaaucaaaacuuagaucuaaacuaacaaaagugaaaagacccucuucguucugagcacugagccuaccuggcuggcaggguagguaguuggucaauuccacacuacuauugucugguaccccuugagcucauuccagcaucggcaguguuugcuaaaccagugggcaagcauguuugcccacugcagugacugacugcugcugugaacgaccuugcucccuacacauuaccucacuugguuuguaucuaugguuuaacacuucccccaaguucagacuuguuuagacaaagcaugagucagugacaugucacaugccagcuccuccuacuuccuccucucuguuccuacccaucuguguugcuucuucacccguuacuguuguaucgguccagugucccuguggaaaauaugcuauaugaauagucugaaaucugacuguucuuagaacagugugauacugaccagaauuuccuuuguuauagaaaccaaagguuuauugaaaucuaaacguuaacacuuccuauuacuucaugguagcuuugauguaaauaauuuuuaaacaauguauagaauuaaaaacaacaacaacaaaaaccuuuguauucucauuguguaaccccugcuggucuugaacuuaaaagaucuaccuaccccuaauuuuugaacaaaguauuaaaagcaugugcugucacuggaagcugaaauaagauuuuugagagagaaagcauaaaacucucugggcuggugagcagaguccuuggccgaggagguaagaaggaaaggccuagaaugaagcuuggcuugggaccugagacagcaagccugcccuacccacaaccccaccucagccauuagccuugcaucuuuccugcuuucugaggcuccuccucucucccugcacacagcucggcgaggcugcuccccgcgcuccccguguuccucaugcaucugccguguaugcacugcacaggcuuuucacagcuacagucuggugaaagccagcgccgugcuuuagugcauugguguucuagcccacuaacuugaauaaggagcgaauauauuguuugagcaucaucguuaacucaaaaucuauauuggauguuauauuaguuacuuuuccugcaauaguccugacaaaagcaguccaaggaaggaaggguuaacuuuguacucaguuggagggugggugagggggucaggguggacgggcuggucaggagugcugguagucaguucuccgcucacuuuuccuuucuguuuuguccaugacaguaguuguagcccguggggugaugguaucauuguugaggcgaccuugccuucucaccuuaacgagcaugcugaggcuaccuaggcuagauuguuccucacaggugugcuggggagcuugccucuuagaugauccucauccugucagguugaccgccaguauauaaaccaacacaaagcugguuuagcccauuguaaacuuuacuuuucuauauuuaaguugucccaccucaggccauugugugcuccuuuguucuuuuggcagagcccaauuggucugugauggcuucuuugcuuucugacaccuuacucaguucauacgauuccugccugaccuggaagguggcacucuauaaaaagcacugugagccaccuuuuaagauaucuguacuugagcugauuaaauaguuuagauuacuuacguucaaugugguugacuuauuaggcucuaaguacuuugauggaagcuuuuaggggugguacugcugauucuaguguguauacaggaaguacuggcauggacuggauuuagaaacaguauuuuacuagcuuuuuaaaaucuaaugugauccccagucuaguguuaacagguugaacagcauaacuguuugccuuguauucacuggcuuaugguuuaauuauuuagacaagcuugaaaaaccugccacacuuguaaccuaaacuucauuacccuugucuugcaaguguccuguuuauaagagauaagcaaagauucaugcuaugaucagcuaucuggugaacagaccuuuuaaucacaugagagccaguguacaugcugaguacugugcccuaacugaggcagacguguacaacuaaaggacaggggguagugcugccaggcagaaaaucaagacuucaggauuucagcagcuaaguggguuuguaaaaaggaagcauuuuaagguuagacuugcagagagcuuagaauuuacauagacagaaaaaagaaagcauccugaugggauaucacuggugaaaacgguccaggagccaaaaugacuaccaugagauaggcagcaguaagcugcagaacugaacccuauuaugacaggcuaggugauggcuuguaccagagcagcaaacccaggaggacagugugcccagaaguuuguuuggcaguaguuuugaacucuaagcuagaaacacuggugguaaacuuuguuggcuuaagguuaggaugcauuugcaguucuuacagugugagugcaggcggcaguggagauagaggaaaggaaguagagcugagagagagacuugaagaguaaaaggcccagugauuucuaaaguaggaagugcugaaagcugaagauuugcagggaagcuaguaugguagcuacuaaccauguguaauaauuuaacuuuaaaucauggcuguuccaucccucauuugcauagccacaccuguggcuuaguagccaccauaaugggcagcauggaugcaaaacauuuccccaugauggcacgucugugaugauaggcgucagagacagagcacuggugccaaaauguagagccgagggggugggaaguuaggucuugguuuuaaguggcaggguugagguuucaucuuagauaugcucaacuuacauagaccuuuccugagguuuuucagguacuuuggaaaauacccagccacauuucagaaagagugaacuggggaaaggaaauucagucacaguggggguugugagauugugggcuguccuuagcagguaaagacaacagaaagaagggggggaacacggggaaauaaaaaggagaacuggggggacuuuuuucuucccuauuuuuaaagagagggauagugcuggguuguagcucagugauagaauacuugccaaguauucacaaugccuugaauuugaucaacccuaccaaaacaaaaaggcauagauagacaagaagagaaccaucagagaacauuacacagacagaucuuggucaguccuguuuuagccaagaggaagucucugcuggccaaauaauuauuucacuagaguauugggaaauguuugacuaccaaaaaacacaacauaugugagcuugucggugggaaagaggcagagccaacauugguaucuuggaacacgagagcagccugucugagcagguagcagucuaugaaaaggaaagucuaugagaaggggagaugccugcccagcugagagaucuucaugaugacaaaggaagaaaugcugagaggaacugagaauaaaggaaaaggcagcauuugcagaguuagugaggaggugccaggaucuugggaucccccgguucuccaugguagagaugcuuuguaaaaccuucagagugaggcuugcaauugugugagguuuacaugucucugagaaucuggaaguacuguuuugagugucgaaacagugauguauaauugcuguauauuugauggauggacauguuguguuuauacugucaauuucugaauuuggaaaaauacucuauuacuguucuuuucagguuguaguucuauugguuguugugagcacgguagguaagcuaagguccuagauaucauaucucuucuuucuagacuuuucccaccagaacuagucucauggucucugccauaguuuucuuuuucuuuuauuggggggcaguucaagacaggguuucucuguguaacccuggcuguccuggaacucacuucguagaccaggcuagccucgaacucagaaauccgccugccucugccuccugagugcugggauuaaaggcgugugccaccacugcccagcagaauuuucuugauugaacgcagcugucuaccucugcaugcagcuguaagcuccagaucaaaugacccugcuguaacguggcuguagucacuuaggaguaucugaaacuuccauugagaaaguuugaaauguucacuuuugcugucuugaaagagaaaucauguauggcuuuuguuuguuuuguuuuguuuuguuuuacagguaugaaucuccagaaauagcucuuaauugugggauaauguuaagagaaugcaucagacaugaaccacuugcaaaaaucauuuuguggucagaacaguuuuaugacuucuucagauauguugaaaugucaacauuugacauagcuucagaugcauuugcuacauucaagguaacauuuaaaaacugaaauucuaagcacacuugcaagucagauuguuuccccaucuuugucuccucuacucacacugcccucuaguggaaauagagaugugcuuuauacacauuuguaugccucagguauuuguaguaaaaccacaaaaaaaauuguaauguaaaaaaauuaaauucucaaaucuuaucagaaaagcaaaaguccuguaaggucaaaauugcacuuuccuguucaauuauucacuaaguguggcauagauaauauacagauuguccaacaagcaggcuuucucuugugaugaggcacucuguagugccuccuuuggcuggcacuggaugggguaauagaauuggccucugcucagaggccauggauuuuggaauauauguguuaucaaauacaagaaccacauucaggguggacagcuauaaguuguugaauucuuguuuaguacauguagcucacucauacucagaagccaugaacacuaacacagaauugucacuuuccuuguaagagcucagcuucuuaauaaagagccccugagacaaggguggcucuggguaaaguucguauguaaggguaaugaauacgguaggacaggaggaaggccuggggacugacaguaagguuucacccugacuaaggcauuaauaguaccaaggauuuauuuuccaaaauuaguacagcuucugcagaagcuuuaaguaauuucucagauaauguguguacaugucauguaugaaggaagcaaacuguaguuaagugucaccaugaugucucaagcucaccgcauuugugggguaagacucacgauuaggaugcaucgauggaagggagugccccauucaggagcagcagcccagcaugaagagaggugugguauugccuugugugaaagagggcccuuuggcugcacuuacucagauugccugcaaguaugauucagccacaaaauugaaguggcaucaccgugaacagauucugacaugcuagucuccauccauccaguuuccgagugccugacuuguuucaagcacuauucuagggucuggggauucagcaguggccuguacauagaagcccuguccuugugguaccuacucaggggacaucagccuuuaacaagcaugguagcaggcuacaagguggacaugcucuuugacaaggaggcuuagaugcuuucucuguugguaacucccuuggaaguaauuguguuccucuuuugcauugcaaccauugaugcuugaacuuuccuuucugccugugaaggggguuguagcaccugucacaugcagagagaccuuguaugugacauccgcugagcagcagaugguuacugaaggguucaguaaaaugacuacugcaucuccagagaggccgaaacuuaauuccagcuuuuuuauuucucuuguuuaacucucacaguuaagagacuugggggaacugagcaaaguuucuugaacacccucuuuaaugaggaaacacagcacaagcccugugcagcagugaacagugugaauucuuggggugggguuagaagcuuucuuagacagcauaccaugcagaacauugaguaugaugcuuccccgaacacaucaucuaauuuuccucauccauucauugauguauuuauuaacacuaagcccuugcuauguacuaggaagaguuuaggugccagaaauucaaaaguuguaaauaccaguguggugugguccuuguguuuauggaacugacagucuaaugaaggagagaacuuacuaaauaaucccacaagcacauguagaauuacaaccaugacacaucaggaaaaguuuucugaggaagugauguuaagucagagucuaaggucaggaguagaugacuggacagacaaaaagcuucugugagggacauuuuugggaggugagaggcagaucaacucccugcauacccagaucucaguaaucuccacaaaggagcucaagcuggauugguguccaugugugugaccuugggccagggccaccuguaaugaggcauaaacaguucugaccaagugacaccaaggucauuucauggucacuuuaugguccugagaaaaauuaugaaauauuaaguagcaacugugugcuaauaguuaacaacaguuuauuaggcaguuugguggauauuuuagaauucucuuuccuaagaaagcauuaauggagagcaacucuaaaaauacauguuuucuucuucuaggauuuacuuacaagacauaaauugcucagugcagaauuuuuggaacaacauuaugauagaguaaguaugugaaauauuuuaaaugauguuuguaauuuuuaacaaaaauuaacuuaaauggagauuuaaguuagauuuuacaucaggauauuugacucuuuaguauuuguaaauagugcuaugaucacuuuacugaaacaacauugaggacuacuaagucugaagcaaaauuugaccuugauucauacauugcccuuugcaucuuuuuuuuauuuauuuuagaagggggaaguggucaguuuugcuccugaaugauaaucuaguuaagaugcaaagagaauuuagucugacuuuuauacuuuuucuuccuuuuucaucaguugcugcacacaaguagagagaaagaggcagcagcugauaggauuugagcagcgcuggccuagugggcaggaccccagcacugccccugcuucgcugcuuacuccuuuguggccauggccaaggcacucacugcuugggggcuuagaaacccuccuuauuuguaaagugaggacauuggacuagccaucgguaagguugcuuccagcucugugucagugucagucaaacccagcaaugaugaccuccagagagcugucagugaucccgggugcuugaugacuuacugcccgucagccacacagccaccccagggcuacagugccuguguucacucguauaccucucccuuccucuggagggcuucucacagugccacaguaggccccuauacacuacacuguccaggcucugauaggcacguguagagaacuuagaauaauaacuuuccacuuaaacuucccguccaugcuacaagacuuggcuuaauuuuuaauccuuccacuaguaguuuaaaucuuugaaguuuuaaauauuguuguauuucaucauuugcuuuccuaucccacuccauuauaagguucuggaggcagaaccuguguuuccuccucuccucguauguccuucuuguucccccucucccagcagcagcacagcauguggcuaagaaagcagccucaucaguggcuuaaacauugacagcacuuuauuuccgccaugaguguuuggauguggguguuuccugugugugugucugguuugagguggcagcuuuuguuucuuuggagcaacguaggcuuuuuaacagggugguucucaaccuuuugauaugacccuuuuaaaaggucauacuagauagccugcauaugagauauuuacauaugguuuauaacaguagcaaaauuaguuauaaaaaagcaaggaaauaauuuuaugguuggaggucaugacaaccugaggaacuguaaaggguugaagcacuggauagugguagugcgugccuuuaaucccaacauucaagaggcagaggcaggcucugaguuggaggccagccuggucuacagagcaaguucagccaagacacacagaaaaacccuaucucaaaaaaaaaaaaaaaaaaaaagagggggaggggguagggagagaaaggauugcagcauuaggaaaguugagaaccacugcucuaacaucagaagccugagucugacuucaaguccuaagagcaaaggcuuucuuuacucugggacuucugcagccucagaguagcguaugcccacugauaagagaguguggccucugaugcuaaagcucauagagaccgugcuaaccauaguaagaguuagucauuguuaaccuacuuuauuuccacaaggccucaacucugugacaucagcuaacaagauuuuagaaagacauuuuuacagaaauguuuggaguacagucagaucugagggagaaggaauaucaaguccuaucauaaaauauuugcacuuaaaacuccaaccacuuugauucuuuguuuuguuuguuuguuuuaccaacuaaagcauagggggaaacaaucaguuaaaagaugugugcuggugcucagaauuuucuguuaacauccuuaacggggaguuggauugccugccguggguugacuuuaauuguuccuacucuggugacauguucuuauuauccccacuuugaagccaugguaggcccuaucagcucugauuugcagcuuugcacuccccaggucucucaaacuauaacuuccuugugcuucuuccaggaauaucuuuucccugccccauauucuaaguaauauugcucccuuccuucaccuuugaugcaaguucucaccuuucaaaaccuccaucuacuuaacacacuagguuucucccccucucagauuuauuuucucuccuugguugauaccuugaaagaacagguucauuuuucucuuugugguuuagacaaauugaguuccuguuuaugaaauaauaggaauuuuuaacaccaagaaaugaauauggaaagugugaggugguguuaaggcagugguccucacuuaucggauauuuacauuaugauucauuacaguagcgcaguuacauaauguuacguuggggucagcacaugucuuaaagggcugcagcauuaggaagguugagaaccacuguguugguguuuuaugcacauggaguuaggguguagagggagacuugucagagucaucucuguaacugacuggaaccuggaggagacccgucccaggagcucccugaauagaaguggcaucaccagaggggcccaagagaaaggaagguuugacaucacauuauugucagcaggagagcacaggccuuuguugauuucagagucuguccuaaacuuuacaguguuaucuaggugucuuuucccuauccugauguauguuuucugcucuccuaguuuuucagugaauaugaaaagcuacuucauucagaaaauuaugugacaaagagacagucacugaagguauggcacauucucuuuuucaugucauucauuucucuucauuuuguauuugugacuugaacuuggagaauuggguguugguuguagaccuuuaggaaaaaguacauuugugauuugggcgugguuggguuguuuuguuuucaggguucaggguauggugguggucuguaugcccacauauaagguagagacaccaaaggggaauaugccacucaaggcuacagagcugaacccaggcaggcuggcaccagggcaugcucucaacuauccacaaggauaaugccugcucccagcaguguauguagcugcuacacagccucagcuagagccuggugcaagagcaaccuggaggaaaagucccagcuaagcaguaacugaguaaacacugaguuuacguggaagcgcugaggccggugaaagugccuucagcucccugcuugguuucuuaccaucagggcugucuugaggaaccacugccgaagagucagugaggccggugugagaagaugaagcacuuagcuugugcuuagguaaacacccuucaucccggaaagcaaguccugcuaaauagaguuuaaaacaggaaagagauuacuuaauguuaauaaucagaacuuccuaguacccuuuccuucuuuuggguagugguaguuuguuacauuguccauuuuuauuuuuguugcuguguuuugaaacuagucucuucuaccaucaagugaugacuaucaaauggguuguuuaauuuuuuuuuauuugcuuuaaguuuuaauaauuuaagaguaauggucuaugucuucucagcuucugggugagcugcuguuggacagacacaacuucacaauuaugacaaaguacaucagcaagccugagaaccucaagcuaaugaugaaccuccuccgagacaagagccgcaacauccaguucgaggccuuccacguguucaaggugagccgcccgcccgggcaccggugccagcuucugaaacuggucacugcaguuacuaaacuagugccuguuuugguaaccaaagugauaacucaguucagucagaauguuuaacagaagcgggaccuggauggaaaugggcugugcccuuguacaagagaaugggaugggaaaguauagucagagaggguguuacucucuucagcuugcacagaagauaguuggagacaaacacgaccccugcugcccuucucccccacccuccccuucacucuuucugcagauucagugagggcuggugcaaagccagagguaguuuuaaugcuuuccugggggggcgggggggauccucuuaaauuucagucugaccucuuaugcccagaaauaauuugauucuaaaagucaaagucgauauuuaguccuaagugcuguguuucaggguuggcagaaugacuuggcaaucuuugugcuaaacauguagucauuauuauuacccucacuaucauauaaaaguaaguucuucuaaagaaaaaccccuggucccugccugcccaggagcuugcuggauggacacugaugucuuugugacuggcgugguguucucuucuacagguguuuguggccaaccccaacaagacgcagcccauccuagacauccuccucaagaaccagaccaagcucaucgaguuccucagcaaguuucagaacgacaggaccgaggacgagcaguucaacgacgagaagaccuacuuagucaagcagaucagggauuugaagagagccgcccagcaggaagccuagugucuacucagccccggucccauccaagcucagcacuggcugucagcuccucagcaucaggcacucucaucgguucauggggagcacuacugcuaaucugcuguuaagugaacgguuuuucauuuuaccuuuuuguuuuucaguccagguuggagaacguagcugcugcugcuugcacauuagagcgcacguggucuuucuuucccuugaucucugugucauuucagaacucacagacuccauuugcuacaggaguucugaacauggcuggguucaugaaagcaaaugagagugagaguggucuagggaaaagacggugauacaucgcugacaccugcccguccaucggcacugcucucugcaggucugugcaguauggcacgggcauacccaccaucucugccgaaggaagauggcgcauacagggauuguuggagaacuguauccagugugagcuuuggggaggauaaaguuggugugcaaauaaauugauacugaagcuuagcaacuugucaaguguggagcuucauaaggucauaagaaaguguauauaugcuuuuucacagcuuucuagaacuuugugacauuugauuuucuugaaacuuguaaaccuggauagguugaaggguguuuuaauuuuacuuuugaagguguuuuaaaacaguagagcuagcagcaacaccuuauguuucauuucaacacugcuuacagguuucuuuuguauauaauucuuagaaugcucauuucuuuuaaaucguuuaauuuguacagcagaggaauguuauuguaguaguauguaacuauuaccugaguuuugcaacaaacaaaaaacaaaaaaaagaaugcucauauguaauugaaauacuugagauuacaugaaaaugcugauuuuaacauuuaaggaucacagcauuaaaagaaaaagaaccaaucccuuguauucaguuacccaauggggcgccguuggcaggcagaacuacauaccuggaacucugucugcuacauauucuugcagaauauuggccuuauucauuuaaaaugaguccuaagguugccauaucuaugaaugauacagauuaugcuaaauaaugcugguuuuuuuguuuuguuuuguuuuguuugugagggaccuccuauagagcaccguuucuuucuuagaguaauauccaguacaguagccgaguaacugaauaauucuaacuuuggcuucucuaagggaaagaagagcccugguccugauguccugggagagauggauggguuuaauguccuuuuccuuaaugcugcagaugaucaguauuuauaaaguaaccgauuuugcaccacuuuuugugacugugaccacagcagaacaaugucuccuagacuguaucuacauaaaguuacuagaauggugucugucugucuuagugacacacggaucacaacuaacaacuuaaaaucagaguuugcccgauccaauucagcauggcuguagcugacuaaaaaaauuuacauaauuauucuuuguuagccucucuuacuaacugaauuauucauuggccaguaaaaggagccuccuagcugacguuuuagcagguuuuaagguuuccuucaaggaauacaagucagaaaaaccacuccagaaaauauaggucuguucuauuucaucuaaauggcagucuacaguaaaggguuuccaaggcucucuuuacccaugugcgugcguguauaguugauggucucuaguagagauagagaaagcauucaggcuucuggacaaggacauucucagcuggguagugugcagacucagcugugcuaagugacccaguccuugccaccgcguugugagucaggauuuggugacagaguggccauuucaccaaguggaaggagugucucuuugccaagcuagcucuuagaacuugagacaacagaacaguuuccacuugggcuaacacagagagcggugcuagagucuugcuguggaagaugggaugcagugugucagggaacugucacucacacauuggaagcugagggcugagaaggcuuucuggauuguuuuuaaacagaacaaugugaaaacauucaagauugaaaaguugcauuuaaagugugaucacuuucuagguuccuauuaccagaacgauuauccugggugugguuucuuugguguuauaaaggguuaauuuuacuuaaggcaguuacuuaaugugauuuuuuuuuuuuuaacccuuaaaaaaagugggagauguauacaauuguuaaugacaugaaaguguuuccuuucuccugaggaaaagugaauuucuuaucagaauaucuggcuggcccuguaauuuaaauuaaaauaaaauuuuggagaaacugucuu

SEQ ID NO: 259 - RNA, 12947 nt, Mus musculus
auuuuuuuguuucauuuuauuucuuucuuaacacaacuuuacacacauuagaaacuuaaaaauuuguugacauucuuuuuuuuuaaaagacugaaauuuaucaacuuauuuaauuguauuugaaaaccagaguagagauugcguuuguuugaagccaucagaucuacuuuagccaugcuugaguuuguuuagauaaggaagcuggacagccuugguacuucacucaggagagggugggguuuucauucacucuguaccuuuccauguugcgcgugcguccugcucaucaccucucucagaugagggcggcccguucugcuauauguagcugaccugcucuuccgcuuugucgccaucguuuucagugagaaggguaucgaggaggaugauugaugaggacugaaugguugaacuucggagccucauugggcucugguacauggcaggguugaucccauuucgaauuccauguuuugugaaaaauuuagaguuuucuaccauugaauucccaaaacaaaguguacuggaaaacuuccuaagugcuuuuacugacuuuguggcucgguaauugcaggugauguaccugccaaaugcuucccgaaaugucuuauugaagaguguauagaucagaggauucacccccgaggaaacguagccuauccacacaaauaucuccaggaguguuuugagaguggucugauugcaggaaucacacagagcuaaaguuagauuuguaauaaaaaaggggcaccacauaagcagaaaaaggaaaaacacgacuccaagggccuucgaggcucucugcucauuagaaaugguuugggcugaucuuuuuccaacugaggacauucuucgcauaagugucucaucacuugaguuagguagaauuuuaucccugugagacccauccagcauugccaccuuuucuggugaugaaaaggaugagucuucccuuaggaaaacugugggcacaguccaccguguuaggcguugagguggcuuauuuuugaccaaguaagcuuucuucuguaaagugugaauggugagaaaguaagugacuaccaugauggugagaggugcgaagaaagcagccagugacccaaagaccauaaaacugccaaagcgguccuuugucagcucacaggugacauuguguggauuaaucacaucagucucgauuccuuuaauagggacugggauggcgaugccuaaggaagaccaaguuagauaaauuaagucauucaugaucuguucuuagaucaguuauuuugagguuuaucuuaguaacaucuugcuaaugagugcuuuauaauuccugagaccuucaguuccuucaaaucuguucaggauuuaucaacagauccuuugacuaauggaaucuaacugagcaucugcuagucuucauauuggaaaagaauucagaagauaagguuaauauccaggguaauuaauuuagagagaauuuggagauuugguguccuaguuuucaggcaguaucuaucuuauuaucuuugagguuguacaggcacaccuaagaauuuuaucuuucagugcuaugaguaucauguaauccuaacuuuuuagagaaaacaaaaucuucuuccuuagaaaauugcugccugagccagguguggugguuacaggccuuucuuuuacucucuuacagcaccuuaagucugagccgucuaagguacuuacauagcacauagcugcuaagccgucugucagagcuuugucuuuuuuuuuucccccauguaacuuuuuuuucuuuuugugcuuuuggcuuuuucaagacaggguuuuucuguguagcccuggguagccuggaacucacucuguagaccaggcuggccucagacucagagauuugcuucccucugccucacaagugcccugauuaaagaugugugccgccaccaccuggcuuuuguccauauauauauuccuagaagcuugcacauuauagauacuuagcaaaaauuugauguuuaugaagucagguuauccagccuccguuuagauaaguucugacaaacugucaccauauuccugcccuuuauagaaagacugcugaucccugaccuaccucguuauuucugcuguucuucuccguucugaucaucuacuguuugacauaaaagucucuguguucucuaaagauauuuccuugacccuucuuccucccaggcuuuucaaaaauguuuaggcucuagagccaauguuuaagcaauguggggauaauuucaguaucuuucuugccuuauugaacacguucugacacugauuagagagaaacaagcaauggcuguuuucuccucuuuuagcacuucaggucucgucauuauuuuccuuuucaaaaaauguucuuucagcugggcagugguugcgcacaccuuuaaucccagcacuugggaggcagaggcaggcgaauuucugaguucaaggcuagccuggucuacagaguaaguuccaggacagccagggcuacacagagaaacccugucucggggggaaaaauguucuuucuacugggaagcaguaaaucccuggucaguuuauguguuacaaaucugugaaccuuuuucugguacuaacucaggagagcuucgaaugagugccacacucucuugagguacccuagcagcagcuaucuuugaguguuaaugaugacagcagacuggaaaaguaacucaaaacgugcugaaacuccaaugcccucaucugcucuccuuggacaugaggcacacacaagaugcacauucauaugugcaggcaaagcaccauauacagaauaaauucuaauccuuaaaaaacaaugagcucagaaaaauaauggguuaaaggaaauugauuucugucuaaaaaucauuucuaaacauuggcuuaacaucuuuuugagaguuaaaccacuaaaguuuauauuuaacucugccuuuaaucuguacauaugggaacucugacuuacugggccaguuuauggucuuggguaccugcauacaaaauuuggcaagguuggcuuuuuccuccucuuuuguuuauucugauagacaugauuuacgauguauuuaauuuuuuuuuucugauuuacuuugagggcuagauuccucaagcuaguuagacuuuaauuaacuacuuguugacaaauaccaauacuuuggagcuuaaacuuccugaauaucaaaaucaaaguggaaugguagcucaguaagcacugguuuauucugaagacaugggcuuacugcugacuuagauuuuacugauggcauggcugagaagcugcacacugaaugugauauacaaguaucuggguuucaguggauugccuuuaccucugaguuuuccuacuuaccagagcuggcauucuggccauauggaaauagaggcauuccccacauaccuauugaaauuaaccauaccacuguaaucuugaugaaugcaguagcccgggaguugcacugauuggccugaauuggcuuuuugauggcuauauagcgguccagggaaauggcacagagaugcaugauggaggcaguugaaaagagaacaucgaggaauaaccaggcaggacacagggccagugggaggggccauauagccucugaaagaaaaaacauuugcucagagaauggcaacuuucaauuuaaucuuuuuuucuuaauccaguacauauuuuuaaaccucuuaacaugacccuugagauguuuuugauauugcaaaugaaucaauucaaauguagcuaacucuuugaguauguuuauggaggagggcguuugucaaaauugaaauauuaauugaaaacguucuauagagcauuguguacucugaucaagaguagagaauggggaggauaucaccuggggcacugauggagcaagcaggcucuuagguuucgucugauaauauauacaggcauuguaugaaaaugcagugaaccacaucccuacaugaucgcauggaaauaggguuaaacaucuauucuauggggagacuuuguagaaaagacuaucuuagacuucaaaaauaucccuggguuuacugguaugugcuagacacucagaaugucucauaggaaggaacauuuaggagcugggaggcuugauugguaaagugcuuccgugcaagcauggccgcugaggucagauccccaaacccauauaaaaagcucgcugugacagucugcacuuaugauuucagcacuggaguaacccccugcccaccagugguagaaagacagaaacgagagucccugggaucugcugaucagccuagucaaaucacugagcucugggcucaguaaagagauccuuucucaaaaaaucagauggaaagagaaugaggaagacaucauucugacaucaaccucugaccucuacacagacagacacacauacacgcacagaacucguaagagaccuuucgauagagaaaaccuaaauaauugaaguuucuuagcuguaguauacaguuuucugucagccguggaaaaugaccuuagucagaacugacaaugcauucucuaaccaccuaacauuaaaggcaaauaguggaagaaugaaaggacucacugauagaagagcuucacauggaaaccacggggaagccaaaccuacauccugggcucugugcagggaaacaggaaaaugcucgagucuggacuguaggaugaaguaguccuuagagacccagcuacuguggaggcuaacauggaagggucacuuaaccccagacccaaaucuaaccugggcaacauagaagacccugcaucaaaaaugaaaacgcucaagagcauguuuguugcuagagauggaagcuagggccugaaguaugcugggcagguuuucuaccacuaaaaauacugcuugaaauucuguuguuguuguuguuguuguuguuguuguuguugaagaggaggaagagcggguuucuuggguaguuuguuugagauaguaccauagccuaaagcuggccuaaaguauguggcccuucugccucgucuggcuaugguguuuuauccucaaauccacacagucucucuagaacuuuuaaaauaaaauacuuuccuacuaauuuaaacuauccuguuuaguuggucuuaauuauguauucugcauuugaaaauuaaggucuggaaaauucuagccauaaaucuuguagcuaugagcaggaagccacagagaaaacauauaaaaaguacaugucuguggaauuugacucuuugacccaugauauuccuuguuauaggcuaaaaacaaaagcuuuccagacugauuuaauuaggucuuugaagccuuguuagacauauuuuccaacagaguuaauauauuuaugaacacuaauuuuggagcagaagugggaauuauuaaaaaucauauuuuaaucagaaauaucuaacagugauauagaauuuuaagaacaagaguauaugagauaagagguggaucuuuaagauucuaccuuaugaaauaccaauggauagacuuuuaugaaagcaauauaaugacacuagauuacuagaaaucuuuuauuaaaagcaaggaagggagcuggagagauggcucagugguuaagagccuagcugcucuuccagaggacuugaguuuaauucccaacacucauaacagcaguucacaagugucuguaaccauuguuacggggaccugacaccuuuuucuagccuccaaaagcaccaggcacacccacagugcauagacaugcauguaggcaaaauacacacaaaaaauuaaauuuaaaaaaauaaaauaaaaucuagggcuggagagauggcucuuucagaggucaugaguucaauuccagcaaccacaugguggcucacaaccacguguaaugggaucugauacucucuucugagagagcgacagaguacuuauauacauagaauaaauaaauaaaucuuuaaaaaaauaauauagggcuggcgagauggcucagugguuaagagcuccgacugcucuuccgaaggucccgaguucaaaucccagcaaccacgugguggcucacaaccauccguaacgaaaucugaugcccucuucugaaguaucuaagaacagcuacaguguacuuacauaaaauaaauaaauaaaucuuaaaaaaauaauaauaguaauaaaaucuaaauugcugguugagagcaggaaggaaaccacaggcaugguggcagcuguuugugguccacauaauaagugaaagccagccuugacaacacaucaaccaacaccuggucuccaaacaagagucagcaacuuagcacaggaggaacuaggaaugucagcuggaguguggcaccauggagcacacaggaggcauugggcuugauuuaggauuacaguuucuuguuggaaugcauuauguuccaccuguuugcagcagaacuuggauuagauauuaguuaaauuuauaguaaucaauuggaaccgcaaacauuuaagcuuaaaaagaaaacauguaagaaggaguuaaucaggcacauagacuaccugacugcuucuauaaaaacaauuccugcuacccuguccuuaccuaccugcuagcaucacccucccugagccagagccccaagacuaagcaagcuguccucuaaccuacacaaaccacaguuucaacuucauuccuuuacugucuuugaacaaaaacuacagaaaguaauguuggaauaauuggaauuuuuaugggaacccaaauaauuguagguuaaaugucauggccuaauauuucaggagcaaaacagguuuuaguuuguagacaguuuauucaacugcuaguaggacaauccuuuguucagugugaaacugcauacuguaaagaucaugaugugaggggagucacucaacugccucuguuugccucccagcaagguucaacuuaguaagcauugccuguuucuaguaccuuccucagaaaauagauccguauucaccucaaggauuguacaaguacuagcugagaccuaaguauucuaccauauaauauagaguauaucuuuaauugaaaagauacuggguucugccucaucagccccagaauucuauagacuuucuuguuagucuuauaugcugaauaugauacuuggaauugguaggauuaacauuuguguuugagcagaguacagucaugaaggccgagcauaugaauuccagacucaguccucuagauucacauauugcugcuaauuauucuaucaucucagacaguccagugaaccugugguagauccugucuguuaugcugcucuuucauaagcuugcuacgauuuuauuuauuuauuuuuauuuuauuuuacauuuuuaauuuuugggggguuuucgagacaugguuucucuguauagcccuggcuguccuggaacucauuuuguagaccaggcuggccuugaacucagaaauccgccagccucugccucccaagugcugggauuaaaggcgugcaucaccaccgccuagcaugguauuauauuuauagguuugaaauacuguaaaauaaucugugugaaguauucgaaacaguauggcacagagaaagcacucagaaaaugacaguuaucauuguuguuacuauuuucaacaguaaccggucaaccagacuucagugaagacccauguucagaagcaagccaggucaccuguguaggaccagugucucuguccaaguacagcaagaaugcagugcagcuacuuaaccguuagccugugccgggggaggcagagaacagagaauugaaguuuccugcuguuaauuacugcacuagcgcauuacuaaccuacguguauuguaacccgcugugcccuugcucuugcuuggaagaagacuauguuaguacuuaauuucuuuuuacuaauuguagaaaucugauuuuuuuuuaaccaaaagcccuugcuuuggugagauagagucacuacaucugacauauacuugcccuuuaggcaggcuuuuaguuuaugaaaaaauaauuagcaucagucuauaaaucugagucauaaaauaucccauauuuuaagaacuuuaaagauuguuuggaaaggcuuuccaaaagacuacuccuacaggguucacaaagguacacaguuuaggaaauugacuguugugggacagcccuaaauagcuuuuuuaaaaaaauucuacugcauuuuuuuauauuucaaaaaguaaugauucagagcuuagauacuuauuagaaagcuucugaguuaguugguuaguguuuauuuuuuguuugugggguuucagggucugugcgugcaugugugcguguguguguguguguguguguuuguuuucauuugcacauaugggaucuucuggcuacuaugauaguguuuuagcuguuuucagcuauuuagagcauaggaaaauuuuuucuugccucuuuaaauuuccacuuuccaaaaaaaaaaaaugcucauugccuuguucuccuguuucagaauuagauaaucuuuccaagucccaugcauuguguuuugccugcuuuuugggaacgcuguggcucguggaacauggauaaaccuuguuacaauaggguagagauggcuccacugucugcuuuuccagagacccugcgagauucccagcucacaaccaucuguaauuagauccaguccccucuuccgguuuuucugaagacagcuacaguggacuuauauaaauuuaaaaagaaaauuguuacaauggagcccagugguuacaaugaugcagaccuuuaaucccggcacucaggaggcagaggcaggccugaucuacaaagugagauucaagacagccaggucuacacagaaaaaccaaaccaaaaacaaaugcacaaccaaauguuauauacuuuugccuucacauuuucaauaauguauuugauaaggaaaaagcgaaauuauucuguuuccuacucaaauguucuuaucuuguucccugucucccugccuucaucccuccccaucuuccuauuugguuuuccuuucaaguugucacuuuauuuaguuuuguuaaauuuuucaaaagauuuauuuauuuauuuguuuauuuaauguaugugaguacacuguaauugucuucagacucaccagaagagggcauugggucccauuacagaugguugugagccaccaugugguugcugggaauugaacucagggccucuggaagagcaguuagugcucuuaaugguaguucauuauucuuguuguuuguuuguuuuuaaguuugaauacuuaacuguuauaaagguuuuuaguuaauuucauugaauuuccugguaauagcuaagauuguuuauaaugauaauuaaucuuuuaugauauauaaccaagaacacuuuuguuuguacacuucagaaguucugaugauuuuccaugcaauuagagaaaaucauguguugcuacuuuuaaaaauuaucagaaguucaugcaaauguguucauuuagaaaaucuuauugucuaucuucugggaaaggcuauacagagaucuuacuguuugaaaucaggucccccauauacuguacccagcuuccaacuuaugaacauucauuuaauguuucccaggggugcaugaauccacaugcacugucucacagacuaugucucaaaugaguucauacugugacauuuucagugaugaauauguucuggguugcucccuuggccccagucuaagagcuccuuugcccagcauuauuaccgguagcaaagcuuuauuuuauuaguuguuaaguauuugcagauugagaugcuauuaaaauagguuauaauuuaagaccuaagugugcaggugauagauauauuuuauguuagaauguuuguuuuucugcuuuuuauuauuaauaucuuaagcaacaauuuuuauauauaagcauuuuuuucucacuucaugggaagcccacuauuuggaaccuugugaaguguuuguuugucagcuaacuugaacacuuuaaaacuuuccucugcuaagauuccuucaccuaagccaguuauuuacauaccuagcucagaauuuugcauuaagcagauguuugguguuuacaaacugaacuuucaaauuaaagugcacuucuguaaaauuuauacuauucuuuauucaauauuuuuaauccucuguuagcaaaacaaagauaaagcauuuuagcauuuucuguaugcccgcaaagcaucagaguguggcuuuaugcuuuaagcuguaguuagggcccuagaguugagaguuggaaucugugucaaccuacaucauccuuacucugcuccugcuagcuucaggcuguuuuuagagucucauuucuuacucuuuaugguacacauguaccauuaggcuauucagaagguuacagaauuacugaaggcaaggaagagaaaaacaaugccacugacuaaagaguccacuaaggcaguggaagcuuguguguuguugcuuauccugucuuaguuugcuuuaaagcugggugagcaagcgaugcuuaaaauaaaguuuuaaccccucaccauauugcuacauaugaagacacagugcuucauuucagauagcucuguguuguuucuuauaaaaauaauuggaauagcaguuuuccuucacuuuuaaauuuaauaagcuuguauguucuggauuagugcacuuuauuucuauaacuuguauguuuauucuugauauaggugcaguucuuagaagccuggucaucuauaguuuuaaguuauuuauuaguagcauaccaguuuaucccaagcauugacugaugaaauguucuuauaaugcugacuuugaagcaggagccuuucaacagacucauuuguguucuucacauagcuggagauaauguaacacagcagaaacucuaugccuacuuuaauaucuuuuuuuauuauaacaaucugaaagucaaacuauauuuuuauuaucacaguaacucagggucuguuccauuucuuuuauuaacuuacaaguuuuuugggaacacagauggucagauaccauaaaaacuuuaaauaaauggaaccucucuugagauacuuugaggaagaucauuuccuuuuguaacuaaacaucuucucuagcauguguagacaccaugucauagcuuaguacucagguuagaaagagcuaggagaggaauuuuuugaacaaugccuaacuuuaauugggacucgcugauuuaaugauucuauuauuaaagucccacaauuguccuaguuaucgaucacuuuguuaaagggaaaggaugaauaauuuuuugaaaaauguacuuuuuuuacuuacuaaaauuuuuagguaacaaaugcagaaucuacaaauauugccaacuuaaugacuuuauaaagauggcugaggaaggguaaacaugcuccuaagaaauuauuuguauguccuuucacaguaacuacaaaucaugaaaaaugaaggaauguucccuucuguguuuuuaauccagguccuucuuuuauuucaaacaaaauaaaggucagugaguguccauuucacuacguuaguaguguucaguggcaggaacaaggggaaauacucaccaaacaugauugucaagagggcaaucggcaucacaaacaauccaaccagcaaaucugcuaucgccaaggacauuaaaaaguaguugguagcguacugcagccuuuucuccagugcaacagccagaaucacaaggauguucccaccaaugguggguauuaucaccgcgaguaucaggagagcugcccagugcacuguaugccccugucccuccacagucugcuucauuuccucugcuacugagucugucucuaauccagaacgguuagucaggaucaggugaucacaugucuucuguaaaaugugcucagaaguugugcuuuguucagacauuuuauaagaugaagccauucgccuuuuggugacucaguccaguuccagacaguggucagcauggucaguagcuaagcaagucaucugcuuuagcaaagcauuuagcaaaccuaccagacacucacagccaaggugacuucuuccuucuaaaaagauucaggcucucgaagaugggacuguguacacgucuguccguguuugcagguaagacauccacauuuuagauuuucuagaggcuuagauuccagaagacuugaugaaagacaccaauagauguggaugaaaaauguuaguuuaucauuucuuuuuuucuauaauuuuaagacaugaauuuaucagaguuuccuucuagauacagagguaguuauuucuaaaaagcaguaaaaaaacacuagagcuucccccucccguuuugauaggacgguauguauugugacagugcagccagugcccccagaguugauaauagagacgauagcgcauuacgugguaucuggcccuuggauaccuugucccuuaacuuuagaaagcauucagaauaguggcccaccaguaagaggcaagcccaccuaugaguaaagaauuuaccagcuaagaaccugaaugaguguugauuuaaaagcuuguuuguaacucauuuuauaauucuuaaaauaauuucuuaaguuggagagaaaguaguacaaaguaucacuagccaaauacuugcuuuuaguaguaaucacuucuuuccacaagauuuuaaauguaaucaaaucagucugccaacuuugaaccaguucuuuuuaaguucuuaagucuucuuuacuuucccaguucccuugagaagcacuuuaagaggaagauuauguuauuuguucauuacacugacaacucccauauuaaauuugccuucauauuuauaauuuuuaaaccacugaauagauacaaaggaauguggaagcagagcuccugaagauuaaaaugggaacaacaaaaaccugcuaguugcauaugaauuugcuaaauacucaccgcuugucuucuguggcuuccuaagccagccguccugugucuguucaguuggacucccucuccuggcagauccucccccacugacuugcucug

SEQ ID NO: 260 - RNA, 4476 nt, Mus musculus
ugggauuaaaagcacaugcgaacacgcuagcaaaagaauggacuuuuugcagaggauaauaagccuucucacuggggggugguaaugcagaaagagugggaaacccagagcuggauugaccugagcuggcugggggucuaacacaggcaacccagcaucaucuucucuugagaucgccgcccaggccuaagcgagcccgggaagaagaaaaguagacagggcagagauaagguaacuuuagggaaacagccuuuauccaccucccuccacucuacacacccagggcuacuccagaaggaagcaaccaggccgcuaggcgccgggugggcguggaggugggcgguguccgacguccccacgugucccgaaggaggcgaggcgggcgaccccgugaaggcccagcagcggggaagucgccgccucaggauguuggcgaucuucaaggucucugagauucuggcucuucccuucgcguucccguggggcgugccucugagguggccagggcugaacggaguugcuguccccacagugagccggggcacaaaggguuaaccuaccugggccaccgccccugaggccccuccuccagccgcagggaaaaaaagaaagucucagcgggggugcggcucggccucgucccgcuguccccagccgcggcgcucagagcugugauccgugcgccccgcucagcugcccuggaccgggccgccaugucucuguggugagucggggucccgguggggcgcagaguaccuccgagcuucaccuccucccggggccgcagacugcaagggaugcacgcuagguguccugaggccgaccccaguuuccccgggcagcgaggguggcgggagaugcggagcagggcgcgccgccggagcggcagaugggaugugggagaugcgaggcgcacgcuuggcucugcggccacgacuccggcagccuguaugcaacgucucucuagccuugggguuucacuagcagacacacacacacccgaccccuccggucccucuucccuccuguggccucuucuccggaccgccucgacccuucuccuuccccggcuuugcucuuacuaauggaguggauugguaugugcgagccagggcccugaggcugguucuuacccggacuccggagcuacgacguggagcuucuuuagaacccugaggacuggaguacuggguucagaauucucuuacuuccauucccagcagcgcgccuccagucauuucugucuuucuccauccaaccugguaaccaggaagucauggggcucuugaggaaagcucgaugaauguggguaggaggacuuaacauucacucacccugcgccuccgcaggcuuaaaaccuggcguuaucuacuacgugcuucgugggccccuggcucuuguaccucccagacuuggaggugagaaccaucucucugcuggcccaguccuggaaagucaugagucucccagugugagcuaaggagggaagguucuuggggaagggggcacaggcaggaucauuccugagaagagcuaggauuucugccucugaaaagggugugcugggcuuacuugaccagguaggggccccggaaaguggguuuucguccccaggacugaagggcuaggcaccucauugcuuuguguagaauauaaagguaaggauaaggagucgugaugggaucuguccacuucccuucgagacuucccaauuagagcaagaaaggcucgcuucuguugagucagugggggcugcuaacccacuccccacugcagcccacaaggagacuccccaaaagcugcaacaaggauacugucuuuuucccuuagagugacugguucaaagugauacugcuguccacauauguaugugaacuaaaaauaaaaaccagagcucaggggauggacaguggucucuuuuccuggcaaaaugacagcauuucacuggguucaugccugguacuuuauccuguguucugucccauuuugggggaacuuaagggguuaaauggcccccuucccaaaauuguuguuggguuugggaccccaguagcugaauacacagugcuucuugaguugggcaguuagcaugagaaaagcagcagguuccucugaccuuccaggaaguagaguccacuggcccaucuaugggccccuaauccucaggaggaguaugagugccagcucaccuuccucucugcugcuccccuuuaggaagaaaacccucuacaagaguguaugccuggcucuggcccuccuuguggcugucaccguuuuccagcgcagugugaccccuggucaauuccuucaggauccuuuaccgcccacgccggggccagccaaaacuggaaaucuggucaaccccaacagcuucuggaagaguucaaaggauguagcggcucccacucccacaguuccucggggaccccaggucugggaugugaucaccacuaacugcucuaucaacaucaaccugacccaucagcccugguuccagagucuggagccacacuuccgacaguuucuagccuaucggcauugccgguauuuccccauguugcugaaccacccagagaagugugcuggcgaugucuauaugcuggugguugucaagucggucaucacacagcaugaccgccgagaggucauucgucagaccuggggccacgaaugggagucagcggguuugggcaggggugcagugcggacucucuuccugcucggcacggccuccaagcaagaggagcgaacccacuaucagcagcugcuggccuacgaggaccgucucuaugcugacauccuacagugggauuuccuugacagcuucuucaaccugacccucaaggagauccacuuccucaaguggcucgacauuuacugucccaacguccccuucguuuucaaaggugaugaugaugucuuugucaaccccaccaaccugcucgaguuucugucugaccggcagccccaggaaaaccuauuuguaggugauguucugaaacaugcucggcccauccgcaaaaaagauaacaaauacuacaucccagccgucauguaugguaaggccaccuacccgcccuaugcugguggaggggguuuccucaugucuggcagcuuagcucggcaacuccaccaugccugugacacacuggaacucuucccuauugaugaugucuuccugggcaugugcuuggaggugcugggagugaagcccacaggccacgagggcuucaagaccuuuggcaucucucggguccgaagcagccggaugaacaaggaaccgugcuucuaccgggccaugcuugugguacacaaguugcucccugccgagcugcuggccaugugggaucuggugcauagcaaucuuaccuguucugucaaguuccaggugcucuaauguugcugagccaccagugcguuuguccucgggggauacauggcauugucuuugguccccugcaggaggugaaggguuugggcccucugugccccuagguguggugagguacagagauccagagagggacucccagaaauucccagaaagagguccaggaauagccagaacuucccugacuggaggucauccgagaaccuggaucucuccuaucuugggccucuagccugaccucucuagccugguaggaggcccugguggacucuaaaggaacauuugcucagguaccugagcuagaccuggccccaaugggucuguggcugcuucuuguccucacagggaagcccccuuccugugaaaugccucuggcucccugagggucaagcagccuuugugggagcucaggccugugcagguccacagguguccccuggcccacauugcuggaccuccuaagauaggagcucucucuccauaggcccucagcacagccccaggcuugccuggagucagcugccgaggcauggcuccuggcucugacuucucuuguccagaagccugacuggccgcucugacuaccucagcacuccucuaaaccucagugugggcuagugccccaccuuaugccccugacacagagcaaaauagcagugcuccugcacccugcccaccccacccccacccccacaaggcacagugauccuugagcauaguccaagccaagucucaccuuuggcaccucaccaauacugacucccuggccagaaacuggccggaugggcccuagauguagacauucuucuauuacugugaaauuuuauuuaugaagaauuggaaggaggccuugggagguguaccucuuuccuguacacuuuccuucagcagcuagcaucuuuaccacucacccccugccuuucaagcccucccccacugacaccccuacuuuucuggggccugcccagauauuuuccccugugaaagaauaccaccucccaccucuggcuggggucaccuggaaaagauggaggcaucuucucuauuuucucaauaaaacaacugguuguugaaggugucugaau

SEQ ID NO: 261 - RNA, 4476 nt, Mus musculus
auucagacaccuucaacaaccaguuguuuuauugagaaaauagagaagaugccuccaucuuuuccaggugaccccagccagaggugggaggugguauucuuucacaggggaaaauaucugggcaggccccagaaaaguaggggugucagugggggagggcuugaaaggcagggggugagugguaaagaugcuagcugcugaaggaaaguguacaggaaagagguacaccucccaaggccuccuuccaauucuucauaaauaaaauuucacaguaauagaagaaugucuacaucuagggcccauccggccaguuucuggccagggagucaguauuggugaggugccaaaggugagacuuggcuuggacuaugcucaaggaucacugugccuuguggggguggggguggggugggcagggugcaggagcacugcuauuuugcucugugucaggggcauaagguggggcacuagcccacacugagguuuagaggagugcugagguagucagagcggccagucaggcuucuggacaagagaagucagagccaggagccaugccucggcagcugacuccaggcaagccuggggcugugcugagggccuauggagagagagcuccuaucuuaggagguccagcaaugugggccaggggacaccuguggaccugcacaggccugagcucccacaaaggcugcuugacccucagggagccagaggcauuucacaggaagggggcuucccugugaggacaagaagcagccacagacccauuggggccaggucuagcucagguaccugagcaaauguuccuuuagaguccaccagggccuccuaccaggcuagagaggucaggcuagaggcccaagauaggagagauccagguucucggaugaccuccagucagggaaguucuggcuauuccuggaccucuuucugggaauuucugggagucccucucuggaucucuguaccucaccacaccuaggggcacagagggcccaaacccuucaccuccugcaggggaccaaagacaaugccauguaucccccgaggacaaacgcacugguggcucagcaacauuagagcaccuggaacuugacagaacagguaagauugcuaugcaccagaucccacauggccagcagcucggcagggagcaacuuguguaccacaagcauggcccgguagaagcacgguuccuuguucauccggcugcuucggacccgagagaugccaaaggucuugaagcccucguggccugugggcuucacucccagcaccuccaagcacaugcccaggaagacaucaucaauagggaagaguuccagugugucacaggcaugguggaguugccgagcuaagcugccagacaugaggaaacccccuccaccagcauagggcggguagguggccuuaccauacaugacggcugggauguaguauuuguuaucuuuuuugcggaugggccgagcauguuucagaacaucaccuacaaauagguuuuccuggggcugccggucagacagaaacucgagcagguuggugggguugacaaagacaucaucaucaccuuugaaaacgaaggggacguugggacaguaaaugucgagccacuugaggaaguggaucuccuugagggucagguugaagaagcugucaaggaaaucccacuguaggaugucagcauagagacgguccucguaggccagcagcugcugauaguggguucgcuccucuugcuuggaggccgugccgagcaggaagagaguccgcacugcaccccugcccaaacccgcugacucccauucguggccccaggucugacgaaugaccucucggcggucaugcugugugaugaccgacuugacaaccaccagcauauagacaucgccagcacacuucucugggugguucagcaacauggggaaauaccggcaaugccgauaggcuagaaacugucggaaguguggcuccagacucuggaaccagggcugaugggucagguugauguugauagagcaguuaguggugaucacaucccagaccugggguccccgaggaacugugggagugggagccgcuacauccuuugaacucuuccagaagcuguugggguugaccagauuuccaguuuuggcuggccccggcgugggcgguaaaggauccugaaggaauugaccaggggucacacugcgcuggaaaacggugacagccacaaggagggccagagccaggcauacacucuuguagaggguuuucuuccuaaaggggagcagcagagaggaaggugagcuggcacucauacuccuccugaggauuaggggcccauagaugggccaguggacucuacuuccuggaaggucagaggaaccugcugcuuuucucaugcuaacugcccaacucaagaagcacuguguauucagcuacuggggucccaaacccaacaacaauuuugggaagggggccauuuaaccccuuaaguucccccaaaaugggacagaacacaggauaaaguaccaggcaugaacccagugaaaugcugucauuuugccaggaaaagagaccacuguccauccccugagcucugguuuuuauuuuuaguucacauacauauguggacagcaguaucacuuugaaccagucacucuaagggaaaaagacaguauccuuguugcagcuuuuggggagucuccuugugggcugcaguggggaguggguuagcagcccccacugacucaacagaagcgagccuuucuugcucuaauugggaagucucgaagggaaguggacagaucccaucacgacuccuuauccuuaccuuuauauucuacacaaagcaaugaggugccuagcccuucaguccuggggacgaaaacccacuuuccggggccccuaccuggucaaguaagcccagcacacccuuuucagaggcagaaauccuagcucuucucaggaaugauccugccugugcccccuuccccaagaaccuucccuccuuagcucacacugggagacucaugacuuuccaggacugggccagcagagagaugguucucaccuccaagucugggagguacaagagccaggggcccacgaagcacguaguagauaacgccagguuuuaagccugcggaggcgcagggugagugaauguuaaguccuccuacccacauucaucgagcuuuccucaagagccccaugacuuccugguuaccagguuggauggagaaagacagaaaugacuggaggcgcgcugcugggaauggaaguaagagaauucugaacccaguacuccaguccucaggguucuaaagaagcuccacgucguagcuccggaguccggguaagaaccagccucagggcccuggcucgcacauaccaauccacuccauuaguaagagcaaagccggggaaggagaagggucgaggcgguccggagaagaggccacaggagggaagagggaccggaggggucgggugugugugugucugcuagugaaaccccaaggcuagagagacguugcauacaggcugccggagucguggccgcagagccaagcgugcgccucgcaucucccacaucccaucugccgcuccggcggcgcgcccugcuccgcaucucccgccacccucgcugcccggggaaacuggggucggccucaggacaccuagcgugcaucccuugcagucugcggccccgggaggaggugaagcucggagguacucugcgccccaccgggaccccgacucaccacagagacauggcggcccgguccagggcagcugagcggggcgcacggaucacagcucugagcgccgcggcuggggacagcgggacgaggccgagccgcacccccgcugagacuuucuuuuuuucccugcggcuggaggaggggccucaggggcgguggcccagguagguuaacccuuugugccccggcucacuguggggacagcaacuccguucagcccuggccaccucagaggcacgccccacgggaacgcgaagggaagagccagaaucucagagaccuugaagaucgccaacauccugaggcggcgacuuccccgcugcugggccuucacggggucgcccgccucgccuccuucgggacacguggggacgucggacaccgcccaccuccacgcccacccggcgccuagcggccugguugcuuccuucuggaguagcccuggguguguagaguggagggagguggauaaaggcuguuucccuaaaguuaccuuaucucugcccugucuacuuuucuucuucccgggcucgcuuaggccugggcggcgaucucaagagaagaugaugcuggguugccuguguuagacccccagccagcucaggucaauccagcucuggguuucccacucuuucugcauuaccaccccccagugagaaggcuuauuauccucugcaaaaaguccauucuuuugcuagcguguucgcaugugcuuuuaauccca

SEQ ID NO: 262 - RNA, 1000 nt, Mus musculus
guaacuuuagggaaacagccuuuauccaccucccuccacucuacacacccagggcuacuccagaaggaagcaaccaggccgcuaggcgccgggugggcguggaggugggcgguguccgacguccccacgugucccgaaggaggcgaggcgggcgaccccgugaaggcccagcagcggggaagucgccgccucaggauguuggcgaucuucaaggucucugagauucuggcucuucccuucgcguucccguggggcgugccucugagguggccagggcugaacggaguugcuguccccacagugagccggggcacaaaggguuaaccuaccugggccaccgccccugaggccccuccuccagccgcagggaaaaaaagaaagucucagcgggggugcggcucggccucgucccgcuguccccagccgcggcgcucagagcugugauccgugcgccccgcucagcugcccuggaccgggccgccaugucucuguggugagucggggucccgguggggcgcagaguaccuccgagcuucaccuccucccggggccgcagacugcaagggaugcacgcuagguguccugaggccgaccccaguuuccccgggcagcgaggguggcgggagaugcggagcagggcgcgccgccggagcggcagaugggaugugggagaugcgaggcgcacgcuuggcucugcggccacgacuccggcagccuguaugcaacgucucucuagccuugggguuucacuagcagacacacacacacccgaccccuccggucccucuucccuccuguggccucuucuccggaccgccucgacccuucuccuuccccggcuuugcucuuacuaauggaguggauugguaugugcgagccagggcccugaggcugguucuuacccggacuccggagcuacgacguggagcuucuuuagaacccugaggacuggaguacuggguucagaauucucuuacuuccauucccagcagcgcgccuc

SEQ ID NO: 263 - RNA, 14929 nt, Mus musculus
gccaccaauuuacucacacauugucucucagccguuguauuuauaaaccuugaaaggggaaacugcuuaaauguuccuuuuugggucccugaauuauuuuuuuuucaaacugucagcaacagccauuuuuccugaagggaaaaccaaacacccagaucuagacauguuuacuagagguuuauccuucccauaguuuaccuuguggaugugaaucauuccgauguuuaauuacuguaugagugauaugcauguucagguacaugcuugcuacagagaggccagacaaaccuauuguuucucuccuucagcuuuuacaucuucuagagaucaaacacaggcugucagguuugguggcaggcaccuuuacuaauugaacucacuggcccccuuuacagauauuuuuaaccaacaaaugcaguuucuuccuaauuaauguccaaguuaccauuaugaugccccuaaaaaauuugcacuuucuuugauaugggaaaagaaacuagagauggcacccuuccaaaugauuagacacugggaguguuaugauagaauagagacaaaagauuaucaaaauugcuuuaccaggcgguggcggcgcacaccuuuaaucccagcacuugggaggcagaaacaggcagaucucugagccuggucuacagagugaguuccaggacagccagggcuacacagagaaacuuggggcugguggauggcucagcaaagguccugaguucaaaucccagccaccaugccccagauuucauggcuuagggugaguguuuguaguucagcuaguccuuucuggaaauacucacacacacacccuagaguaugccaaaccacauugucaacugaacuggaucuagaaggaaauagacacgcuucuaagcauaucuguaggaaauuaucuagaucagguuaacuucuggcuaugccuaugagauuaucuugaauuaccucagguauguaaaaccaucccuagguuggaguccuagucugcauggaaaggaaagcuagcugaauacaagcauccaucaacuuuuucuaacuauagaugcaaugugaccagcugcuucaagcuucuggcaucaugucguccuugucccugccaugauggacuauauucuggaacugugaaucaaaauaaaccccuuuucuuuaaauugcuuuggucagguauucuguuauagcaacauguagaguaauucccuagugcccuagacacuuaucaaucugaucaaguuuauagcugauauuaacagcuacgaauccacucucuuugaugccagcacucagaaggcagaggugaaugaaccucugggaauuaaaggccagcuggucuaaauaguaaguucuaggauaaccaaagcuacauagugagagagacccugucucaaaaaaacagaaaucugacagaaauguaaaggaaaaaaacaaaaaaaccaaagucaagaaaaacugcaaucaccuaauuauauguacaaaccaagguccuggucuaauuccaagcaccauaaaaauaauuaccagauagaacugaggcacauacucucaaagucaguguuuagucuggcgcgcuacaggugugccaagauuagccggauuucugggcaacagagggguacugaggagugagucuggaaguuugggggggaccaugaacaggaacaguaaauuugacauaaaaucgcuuccaacuuuuccuaaauuuuucauuuuccuauucauuuuuauguauauggguguuuugcuagcacccaagaaagugcccaaaaagcagaaaaggaccuugggucccuggaacuaguuacagucaagcagcaucuggaugcugggaagugaacugggguucucugcauguaaacagccaguguuuaaucacugaaacuccucacuuucaauuugguuggcucaagaaaauacacagcugguauucucaggauaaacacauuaccuggcuuuaaaguaaaucucaucauauucuaugaaaaacagaaacucagauuuugcuagcuacuuaagaaugccaguacaaaauguacuugaauuagcacauggcuggccucuaaauaugggucaauguccaguuuagacaugcaaugaaagagaaacaacucuucauaauccuaacaaguacucaaccauaacuccuguuaaaacuacaaauaaggggcgacuuaagggcacuggucacucuuccaggggacccaaguucaauucccagcacccacauagcagcucacaacuguuuguaacauggugggucugacuccucacacacauaaagaccaaauacuaaugcacauaaaaaaauuuacaaaugacuucaaugauuguagauguauaggaauuugcaggaaaagaauuuaaaugacaaaaugggggcuucauaaacuggaaaccuagaagagaaaggaaacacuugaagggcuagagagaugacucagcuguuaagaguccagaaaacacaaguuugauucacaguacccacauggugguucacaagaacuugaaggcggcuggugagauggcucaguaguucagagcacugacugcucuuucagaggucaugaguucaauccccaguaaucacaugguggcucucaauaaucuguaaugggauucuaugcccucuucuggugugucugaagacagcuacaguguacucauauacauaaaauaaaaaucuuuaaaaaaaaaaaaaagguuggaagauccacccucuucuggccuccuguggcauugcaugcacauggagaaauacagacacuauacccacacacacaaauuaaaaaaaaacuaaagacaccugaaagcuucacuaaagggccuaacagaagaaucagugaacuagaauccaaaacaauagaauguauccaaauuaauauucaaagagaaaaaaacuaguuucaaugccaguaucugguuaucuaagaguccaguagagaauaaaacugaaaggccguauuugaaaaauaaugggugagaauucaguuagaaccuaagaguacugugguuguacauacuugcagucucagcacuucgaguugaagcaaauuaauuucaaagacaaucagggauacacaauaaaaccuuauucaaaauaaguacuucccuucccuccccaauaaacccuuguuuuuuuuuuguuucucuguauagcucuggcuguccuggaacuuacucuauagacccagcuggccuugaacucagaaauccaccugccugucucccaagugcugggauuaaaggcagugucaccacugcccagccagaauuuuuuucaaaggguuaaaaaaugggccucagccuaucauccuucugauaguaguguguuucuauaauggagccugacaugguggcacaggccuuuaaugcaacacucaagaggcagacaucuugaggucagccuagucuaccuauugaguuccaugauggccacagagcuaaagacccugucucaaaaaaaaaaaaaaaaaaaagacgguggucuuuaagauuuaccagcgagaaccugaugaccaggaccccugaaacccagauaaggccacugaaauggcaugcauugcuaaucccauucguauugccagaaguacuugaaagcuuguagugaguaagaaaauaagagacccugcuucaaaagguagaaauaucccacaagcacacacagguuaaguggccuauaaguccucacuguugaguauuucuuggaaucaguuccauccucuccaucacuuaucauuuaguaggcacuuaauggaggacagcaaccaaaacuuguuuuacuacuagaaccuugagagcccuuuuauucuauggcaaaggguuuuaccacuaacugaaugaaauuagccuguuauagaugguaauccuaaggcuauagauccagcuuagaaguaaagaguacaugcuccucuuccauuuccccuuccuuucuaccucaguauagggucaagaccuacacccuuagcaucugccuauguuccuuaagaguugaaaagguucaggcagauugaacugaaaacuacauuagguaacuccuaucacuagcauccguaggaaaaaagccacacugaagggguaguguauagucaaaagcaggugauaaauggucaggagugaaucuuuuuguuuuuugaggcaggguuucucuguguagcccuggcuguccuagaacucacucuguagaccuaggcuggccucgaacucacucagaaaaucacuugccucugccucccaagugcugggacuaaaggcgugcgccaccacgcccagcugaagugaaucuuucaaaugagaaagcuuuguugcucuuuaaaagaccucuacaagcuacucuaccaccagaauaagagcuuuguguuuaucuauuaggugaaggcagauuaacugccuucccuccacccuuucuucaguucucauguugccaccugcuggaagaaugagaaaagaaagcaaacaaccauuuccagaaagguuugcugcuuuucuaaaaugucugccucguuuagggagagcuauucaacuguaaaucuucugaugauccuauagguuaacuauguccucaauccacaaaaaaaugaugucugcuagcaccagaguugaaccuuuccuuugcuauuguagucuugggggucuucuguguagcacuggcuauucuggaauuccuuagccucaaauuggucugccuucuaggauuaaugacagcugagugccuucagcuacaugccauuaaucuuuaacaaggagguuaacauaaucaagggcuccacuccccacagcaaaagaacccaccaaacuguucccugcuacacaaaucuaaugcccacgccauccucacuuuuagacaggacugcgacugcaauggucauaccacauacucaagccaccagacaggugcuaagcgcaacccuacagagggucuuugguugagaauagcugacuggucuuucuugaaaaucaguuuguugggagugggacuuggaaaaacaccuacaggaaaguuucuauuaagguuaucuaggcacccaugccuuauacaaaacaaacaaaaaacaaaaaaaccaaacauccuugauagaucacugaaaaauucauuaaguacacaggccaagggccacuguauuaucccuaguuaaacuggaccucugacaaccuuuaagucaaaaaggccacuguucccucuguuggaacuuacaaaccuuguuucccaaagcuucucucaaauuugacaggucuuguuuuuuuuuucaagacaaaguuucuaaguaucccucacuauccagcaacucaguucugcagacccaacuggcauugaagucauagacugcuuuagccucccaugggauuggauuacgucacucccagcuugcugcugagacuugguacucaguggcuaaaacucuguauuugguugucugugagguuuuuuuuucuuguuuuuucaagacaggguuuuuucucuaauaaacagcccuggcuguucuggaacucucuguacaccagaucaaacucagaucuaccagccucucccucccaagugcugggguuaaaggcaugugcaaccauccuggcuaugugaauuuuucaacccaaugggguaccauuccuuguccaggucauuucagauugcacuguacuguuuguucuuauuaugcugggaauagaauuacauaccacacaagcucuuguaugguauuuccagcacugauccaugugcucuaucaaccacuuuuccaguacacacccuucuaagauacaaauuaaaucuuccagaucagaaucaugaugaagcuguuccccaccaauuuccacauuuguagcugggaauucuugaaagcaguaggaacacaacugaaauucccacugggcagaguuggucuugccaagcucuuaagcaacaauccaaauguaaccucuaggaaguauuaagucuggcaacagaguuuaggaucuuuacugucuuggaauguccuuagaaggcucugucauugaacagguaacagaguaaaaaccccagaguccuuucuuuaaaaugaagagggaaagaaugggauggaaggaacuauucaaacuucgucuucuuuccuuguggcuugaagucucccccuccuccucugccgccucggaagccuccucuaccuauaggaaggaaaaacaucaaagggugauacaauuaggacugaccuucccauuuaaggugguugguuaggacacagguuuaggaauccguuuccaguuccuuucccuuccuuaccuccaaagccuccccggccucuuccuccaaauccaccucuuccaccucugccuccaccucugccuccgaaaccuccucugccuccaccucgaccaccaaagccaccuucacccuuagguuuggcccaguccaagguaacuuuguuuccgucaauuucuccaucuuccauggccuccuuggcagcuuuggcaucuuccucacuauuaaagucuacaaaaccaaaccuaaaacagaaaagaaaaacaaaaaaaccucacccauuaaguaaacacauuuuaaaguaacacaauaaguaccaagucacccaaguagagugaccaaaguacucuucaggucgagaaaaucgccaguaucucauaaugucucacacaacagccaaauauacuucugcaaaaacagaagauaagugccaguucugugaauucucucuucuucucgugcgaauccauaaucuaucacugauggacagaaaggagcucaaugagaagauacugcagacccaaguucuccaugcagaauucacuaaaaagcagcaacacuacuacgccuucuuacccuuuggaagaaccaguuucccgaucagugacuauucuugcacgaacagagcccucaaaugauucuuuuaaggucucuucagugguauccucagacagaccuuugacaaacagaguuuuggaugguucuggaagagaaaaauuccuguuucacuaugaacccuuggugaauacugccauacugccacauucagcugaaguagauuccuuuuuaaaaaaaaaaaaauuuuuuaugugcauuaguguuuugucugcaaucuaugucagagcuuaagaguuacagacaggguugggcagugguggcgcacaccuuuaaucccagcaccuaggaggcagaggcaggcagauuucugaguuugaggccagccuggucuacagagugaguuccacggcaggcaggacuacacagagaaauccugucucgauaggugccaugugagugcugggauuugaacccagguccucucagugcucaaccacugagccuucccuuacacugauuuuguuaugucuuuuuuucccccuuuuaccagaaaaagcaauuaacacaagaaauuaagguuaaaaaaaaaaagacuacacuggaucaaaaaaaaagcguacucagagggcaaucaagguugcugcuuugaguugacauagcuggaucagaacuugacuaucuagaggaauuuucuugagauuucaucaauuauuucucagguaaucagucaucauauccaguugucauuuucucagcaacaacauaaagacagccccaaaugagcauauaggcacauaaaaauaaaaaaaaauaucacccaaccaagucauaucaugucaaaggacuuacgacuucucgaauuggauccuugcaacuccagccugauuguucugcccucaauuuccauuuuauuacaggaauuuaaagcuucuuuagcaucuucaaaugaagcaaauucuauaaaugcauaccugaagguugaaagucaguucucagaauaaagcuuagaaacacuuggcaucagcauguaauuuacuaucaauauuuacugcccuuuguauagcuaaaacuuuaguuuuuuuuuaagcuaacaggacagucuuacucuuauacguaagaguauguauguccagcccacaucuaacguaaaaauuauuuuacccuuuagguuugccauguggguucuggggcacuuugauaaaaguugcuuucucaaauacuuccucaagaguuucuuuuguugcacuguaggaaagguuacuuaaaaccaaagucuuugauucaccugcaaauacaaagauaacacauuagcaagguauguuagaguaugucuguguauauuuaaacacucaguaagugggucaccuauaaagcaugucuccaaccuaauccacaagguuacuggaauguuaacugaaacaauggcacuucaaccauguaccauauaccauaauucuagaaccaccaguguauauccauuauauacaguaaugccuucuuugcuccuuucauuuucauucuaauuagauaacuguucuuuguugucuuacacuauuuucuaaaauaguuuaagccauuuaaaguagaaaacauacccaacaaaaagcuuuauuugccuacuauacuccaaaggaaaugauuucaaauagcuuucacucaugaagacuaaacaucagcuauaugaacaaaggugaacuaauuguagguaaccaauuacuuaaaauacaaagauacaaaugauuccuguucccacuacacaauaaacccuuuaacuuaccacuccaagugcuggucuuuccaguucucucuugccuuugaccuuucucuccaguauaguagagugaaacagaucguccaucaauuucugcccccugcuuuucuuccaaauuuuucucugcaucagcuucagacuuaaauucaauauaagcaauccugaaagaguacaagacaauucaguuacuacguuagagaaaauauuacucaagcaucagucaugaaggacuuagucacaugugcuuuuacuguucuuuuacuauguauuagcucaucuucauccuuuaaacuggugaggaggaaaaagagccaacacaauagacugaacugccuagaaucacauuucucucauaaaauagggaaggauaguacuuguggcaaaagaugccaauuuggauugagccuguaaaauugaucacagcuucaaaacccaucaguugagcauuuuuaaugucagaacuugggagguagaggccagaggaccagauauucaauuuucugguuaugaaguuaaguuugaagcagcagacuagagacugucaaggacaaggagaggggaagaagacacuaaacuuaauaaaacuuuaacacucaaagacacaaaacauacccuuuacuuuucccauccuggcugacuaaucugaucuccauggcgucuucaaacacuuccuuuaauucauccucagugauguugaaagagagguuuuuggcuagaaguguucuugcagcucgaacuauguuggaaaaagauuuaauuaaguacaucaauuuacaagucacaagagaauaaagcaaauaauuccuauaaaguacaaggauauaugcuaaaaaaaaaaaaugguauaaagggauggagagguggcucaaugguuacuaaccauuugcaugaagaguacccauguucaauugucaccugaugacucacaaaccccuguccaguuucagaugaggcucuccuggcuucccuggacaccagacuuaucuccuuccuacuuguuuacauguauaucauguuccuuagaccauauguauuaaguuguauauggaacaagucuauuuagacuuaguuuccaucucuaagauaccucaucacucauaugguucauucuacaucaaaagccuagauccaguaagcauauaacauagacugcagauugagcacacagcaaccuuguaaaaugagcaaaaggggacagaggauauguagcaguuuuaagagugauugccuagcagggcaguggugacucacgccuuuaaucccagcacuugggaggcaggcagauuucugaguucaaggcuagcuuggucuccaggacagccagggcuacacagaaaaacccugucuugagaaaaaaacaaacaaaaaaacccaacaaauuugccuagcaugugaaaagcccacguucaauuuucagcacaacuaagaaacaaacacuuaaaauccaaauucugaaacucaaaauauagggaucaagaauucauuuaagagauacguaagcuucaagcaugucacgauacacauguggucagaggauaagcuaaaacuuuuuuuccgagacaggguuucucuguguagcccuggauguccuggaacucacucuguagaccaggcuggccucgaacucugaaaucugccugccucugucucccaaaugcugggauuaaagguucuucucucuucauguggcuucuagagaucaaacauuuugcagcaagcaucuuuacucacuaagcuauuccuccugucagcccugacauuauauaucccaggaaucaaaccugucaacaagcacaugaccuaugacaucucauugguucacaaugaggaugaaacuaaggaagaggcaccagacugccuaagucuguuaguauccagucacccagacccccuuacauaccuuucuuacuaucucuuccuuuugguuuuucuaguuuaauuucauugccaaacacuuuuaaaccagugagcuccaaggccuuuucuaggucuucagcagacucaaaguccacauaaccaaauuuccuugaagauggaaaaaacaagauuacagguaugagaaggugaucugcacuuauaccauguggcacacacacagagcaucuacagcacuaacaaaaauaaaacuagaucacccuuaucuuccauaaaaccaaguccaaaggcuggagagauggcucagcggguaagcacauugacugcucuucugaagguccugaguucaaaucccagcaaccacaugguggcucaccaccacccauaaugagaccuaaugcccucuucugaugcaucuuaagucagcuacaguguacuuauguauaacaacaaauaaaucuuugggccagagcaagcaaggacugagagcagagcgagcugagauccuaaaaauucaauucccaacaaccacaugaaggcucaaaaccaucuggacagcuacagugugcucauauacauaaacaaaucuuaaagaaaaaaaaacaaaaaacaaaacaaguccauguaccaagacauuacaacaaauucaccucgauuucuucauucaguauauuguaacuaacagcaguagcuagcauggaccccgcuaaaaguacagagaauacuuuuagcuaaaagcauaugacuaugcagauccauaguuguagauacugcacaaaauuuuauguguuuaauaucuuuucuucuuuaaauuuuauuuuaucuuuaucaagucaaacacaggaacuucaaauugcaggcccuaugacucgaugauuuaguucaauacuauagucuuucuuacugcagcuccuuaacuguacuuaaggccacgagaggagacaacugacuuuuacuaacauaguuagauauagccccauguuuaaaggcagggaagaauacaacuggaaaguaaaaauucuagcugauacacauguaacauucaauuaaaacuuaccuauuuguaccaguucugacauccacaacagcaagaucauuuuuagcaaaaaguucacugauggcaaauuuuaauucauuaacagacuuguuuggauuaagguuuccaaugaacagauugaaagguguaguugguucugagccugcacacacaaaaaaugaacuuucagcccacuuaagcacacaacaaauuucaucauaaacuauaaagcacaucagcauauuucauuucaaccccaugguucaguauuaagucccuuugucacucaucacuugugcuagugcuacucugaucuguuuccccaguuuugcaggcuuaccuucuacuuucuguuucuuggcuucaggggcuucuuucugcuuggucaucuccuucuuccguuuuccaggugcugcuuuaacagguucuagauguuuuaaaaugccauucaugaguaagcagacacuuuagcauagccaguaagccuuacuuaggucagcauacuuuaaaaguuaauaugguuaccuuccuccucuucuuccucaucaucaucuucgucauccucuuccucaucauccucauccucgucaucuucauccucuuccucaucauccuccuccucagccacacucuuggcuuucauaggaacaacuuuugcaggaguuuucuuuccuuuggcuguugugaucuccauaacuucuuccucagagucuggaagaaagauggcaaaucaggcaaauguauuugcuaccuaccaauccagacaagauaaaugcuacaaauacuuaaaaaaaacaaaaacuacuuagcaaaugaaaaccuauuaaguuauggaaagaacuaagagcacaaaaugaguuuuuaaucuaaugaaacagugagggaauguacaugcaguacccuaaauauccuaagaucuaacucaccaucuuccuccucuucaucaucaucuuccucaucaucuucauccucaucaucuuccucauccucugaggcaggagcagcaggagcugcuuuugcuggcuucacuccuuuuacuauugguggcucaaacucauccucuuccucaucaucuucauccucaucgcuaucaucuucauccucuucaucuucauccucaucacugucuuccuucuuggcauucuuaccguucuuagcccccuuagcuggaguggcagcucccuuuuuaccaggaguugguaccaacgcuuuugcuugugcagcucccuucuuacccgguguuggaaugacuuuggcugguguaauguuuuucuuagcugguguggcuacugccuuuuugccuggggucacagcugcuuucuuagcuggugugggaacugcagccuuuuuuguuugugaaacaaccaccuucuuugcugggguugugguagccuuuuugccuuuuuucugagggaugacaaccuugaaagcaaacaaaucauaagcauuccuuuauacccaaugcuacauuaagagacuaacuuugagcacaagaaaauggacauuagauaggcuuaaaaaaaaaaaaacaaacaaccaagaacuggagagaugacucaaaaguuaagcacauguguuacucuuguaacauguaacauucacauguggcuuuaacuccaguuccaggggauccaaguacauucuaguaugaggguaccaagcaugcuuaaugggugcgcgcacacacaaagauaaacauuaaacccugaaauaaggagacauggcuuucaauacuuuaaaaaaaaaaaaacuggacucagcaccugagcuuuucuaagaaaucugauugagcaugaccauaacaacggucuugagacaagguuucacuauguacuacucccugcuugccuggaacucaaaauucugccuguuucuguccccuguuuugccgacugucuugcagaaggaaggaaggaaggaaggaaggaaggaaggaagggagggagggagggagggagggagggagggagggagggaggaaggggcuugccauucaaccauuuacuacauauccuguauuucuaagacuuccagacauucaauuccaccgguuuauugcugcaaauagcuucuuaccuccucuucuccacugcugucaucuucaucuucugacauuucuucaucuucacuauccucuuccaccuccuuuggaggaggagccauuuucuuggccucaccguggguuuugccagccuacaaacgcacacaaaaauugcacgcauuuucagucacuuugccuuuggccaccaccuuuuucuuacuaaaggacacaagcauaaagacuucuucuuggccaggcauggcauucuccuggcaguuuuuucugcgaaccgcgcauaauuuuuuuuuccuucucacagauaacugagcagacagaacucuacaccaagaaacagccacagguuauaaagucuccuagucguggccaucuauuuucuggcaucuuccacaaaaaaaaaaaaaaaaaaaaaaaaaaaacccaguuaaagggaucccuuuaaguuauuugcuggggaaggggguaucucgaaaucaccucuuaaagcagcaccacguaacccaacugcuucccacuuucucucgcuuccagccccaccacguggagucaccacgccgccaccucagggguccaccacguguccaucccggucaccggcagagacagcagaucgccgggccacccauccauccccacgcugccgucccccuuuccgggguacuacagacacucccccacugccccgggucgcgcgacacgugcggggcuccgcagagcacguggcgggccgcgcaccagagcacgugcgcggggaggcggggccccgggaccgcucgccgccuaagguuggcccucucuucccacgccgugccccuauccgcucucagcuccuccgaucucuccucacaccguccccucccgcccgcuacauccgaacccucgauaucgcccucccggaaaccugccuccgcucuucucaucccccuaagucagagggcaagcaccgcgagaccucccgcuagucgcgcgagacuuucccccccagcauggcgcccucgaacgcgcccgggauugcgcgcaagcccuccuccccuccgcgacggacgggcgggcgcgcgcgcgucccuccgaaagcaggggccuagucguccgcgucggcgcgccaaggccucuuaccuuugcgagcuucaccaugguggcggauuacggcggcggcgcguguggagagcgagcagcucggaagagcucagcggaagccacacgaaagcgacugcaguagcggguaccgacgacucuggagcacguacaaccgccugccagcuacagcuagcgucugaggcaaaagacugagccugcccaguaaucgccucuggaaaggcgacgaaggggguccucgugacuucggcuccaccaaccagagcucgcguccguccccggagccaaccgcgagccuuaacg

SEQ ID NO: 264 - RNA, 14745 nt, Mus musculus
uagucgcgcgagacuuucccccccagcauggcgcccucgaacgcgcccgggauugcgcgcaagcccuccuccccuccgcgacggacgggcgggcgcgcgcgcgucccuccgaaagcaggggccuagucguccgcgucggcgcgccaaggccucuuaccuuugcgagcuucaccaugguggcggauuacggcggcggcgcguguggagagcgagcagcucggaagagcucagcggaagccacacgaaagcgacugcaguagcggguaccgacgacucuggagcacguacaaccgccugccagcuacagcuagcgucugaggcaaaagacugagccugcccaguaaucgccucuggaaaggcgacgaaggggguccucgugacuucggcuccaccaaccagagcucgcguccguccccggagccaaccgcgagccuuaacgcggggcagcgugaggcgggccuaaggcuugacgagggcggggcucuuaggggcggggccugacgucugcuccugagggcgggacucguuugggcccaggcggacguugacuggucagugugcggguccuuugaaugcuccugagcgccgggcucuccccacgccugcgcagugggacgggcgaguuuggcgcggcuugugugugaggcgcggguagguggcggcguggcccggauucccucagguguuccgaggcagcaugggcggcgaugcucagguggucugggcguuucucggugcuuucccccgcgccgcgugguccugcugaagaacgccggaaggccuaggguucccucgggcugaugagcgggccucggccuguucuccgcggagucgcgaacggcuucuuggcuaugaugcgaguccccgcuuuccugagagcuccuaauaaaagcaguugugcguguguguguguacgagcagugcacaagcgauccauguaaugucggugaccucucgcgguagguauaacuccagguucagagaggugacuuccuggugugguggggagaaguacucggcccgccugugaccacgcucacagguucccuccauggcggggggaacgagagaguugucuggcguugcuuuaaauggauugcaaccaacugguuccaagcauagcacacaggcgcccuucaucagcuaacaacauccacuagaaaugaccuguggaguuuucguccggaguugagauaggacuuuauucuuuacuguccuagagcacacauguagaccauguuagccucgaccuguaucggcacgccuggcccgaccuaggagauguuauuuuaugagacagguuuucucuguguauuccuggcugcccugggacucacgcuguaguccaggcuggccuugaacucagagaucccccugccucccuagugcugugauuaaagucauaugccaucauaccugacuucaaccucgggagauuuuaaugcgagugggauguguugaguccccaaguuuuuuuaucugaacucgggccuuuggagauaaguagaaauagucacugugugaugcuuacuuacuacggccuucccaacgcgguggagggcagccacagcuacacaccagugcgcucuugucagggcaggagauggcgaacccgaguuguggugugggggcauugucuuuauagcgagaccggucacaccuuguacuguauauuauggaaccaagggagacucuuggguagagagguaggaaggguggugugaggaagacucuagauauuuccaagcagagcaagcuaaaggcauucgggaggagacaagaagaugagcugugagugugaaaugacuugggugacauggcuuccuuugucaauccaaucuaucuguaugggcuauccucagcccucugguguacagugccacuaagagaccucugcuugcacccaagguuaguuacacucucagauaucagcugccuaguacuuuucuuggccauuuauuguucauuugccccuuccccagacagcacagacuguugucugcuuuauucuugguaccuaaagcauugccuggcauaugauaguguuggaaauuacuugcuaacuggagugaacagaaguuugagugcaccagcagcagggacagcuugcaggauuugguguuucuguggaaucaacaccuaauccaugugugaugcuuauacaaauuauaauugaauauaaccauaucauauuggauccccaauaucccuguagaaagcaugggguggcagcauauaacuaacaacuccagcacuggggguuacagggagcaaggacaggaggaucccuggcaucugcuaaccagccugucuagccaugaaaggugacccugcucaaaaaaauaagauagagguggugugaggauguuagugccugucugguaugcacaaaaccaagaucaguaacuguccaguuauuauacaaauagagccaaguaccagguucuauuucagcucuuuagaaauuuuaaauuaauaaauguauucaaaauagacuaaaagcaucgcugcucacagacaugagggcaaagagcagcaguucucaacgugugggucucaaccccuuugaggucaauacccuuuuauaggggucauauaucagauauccugcauacauugcaauucacagcagcaaaauuaguuaugaaguagcaauaaaacauuuuaugguugggggucaccaccacaugagaaacuguauuaaagggucacagucuuaugaaggcugagaaccacuggcauugaguuaacuuggccaguuacagagcuaauaggagauuggauguguauguauguggggggagguaugccugaguucaaauguagaggcaacagguuaauccggggugucuuuuucuaucacuaccuuuuuuuuuuuuuuuaacaaucucauguaucccagaguguccuugaacuucugauucuuuugccucucccaagugcuuguauuucaagcgugugcuacuacuuaugguuuauguugcuccggagauuaaucuugacuuugugcaugccaggcaggcacuaaccaacuuccccagcccuucucuaccuuauguuuugagcaggaucucuuacugaaucucaccuuuuaugguuagauaggcugggaagcauaugccagagaucuuccuguuucugcccccccaccccccaacccuaccccaaguacugggguuacaguuuuugugcugcccaccucaugcucuuuacagggauaucagggaucugaacuugaguccucauacuuucaauguaagcacuuuaucugcagagucaucuggcaaagaauaacaaaaucucuaagucaguuccccacguuaaagguccuacuguuuauuuaaaugugcuucucucuuaguuguagcaucugauaacacaacucagccauuuuuuuuucuuucugacauggucuuguuagguagcccagguuggcuuggucuacugaugguuuucucugucaacuugacagaagcuagagucaucagagagaaaggauccucuacugaggaaaugccucccugagauccagcuguaaagaauuuccucaauuagugaucaguguggguugugccaucccugggcaggguucuauaauuaaggcaccuggaaauuguguuucugccucugccuucugaccauuggaauucagguguguuucucugcaccuggauuucagcaagaacuaauugaaaaaaucaguuauaaauauaccacauaagguacaaaaaaaaaaaaguuaggcaugguagcucauaccuauaaucacagcauuugaaaggauaaugcaggaggauuaucaugaauuugaagccugaauuaacaaccugagugacugaguuccagacaagauccuauaugaaugaaugagugagugagagagagauucaaaacaaccaagcacaguaacauaugucuguaaucccagugauccugaagaauuucuaguacagagccaaccuggucuaaaccacaagaccuuguaucgaagaaggaaaaagagaaacacccugccccauccuucuaguuucuuugucuaaauaguaaggauaauaguaccaucauuuguguguaguggguauuacagaagaugacaauuuuuuauuuugaggacacaugcccugggagaaaaugacuguuaggcccguagcaaaggagccaauagauagccagagaggaauugaggcaggcauaugugaaaaaagguuuuucuucuuucaaugucuuauucuaaacucuaggccggucuacaacugacccaaguguagccuugacuuccugccacagacucccuagugcagaagaaaucuugagugaagggccacucccugaacaagggaacaaagaaauggaugguuuucuuguagcaguguacauagauagccacauguaaauuguggaaggcaagacuuacugucagcugguucaguugcccaauuaaugagugaaacaugggcaugaagauaggcugguguguuggcaucuugggagaauaaacugucuuugaaagggaaggaaguccagguagauaggcacagagaggcagggaaagagagaugcugucuuaaacuccaaagaaggccagugcagguguuagaugccuuuaauucuagcaaucggagaucugugggaguuugaggccaaccugguguacauggaacguggacccggucucaaaaacaaauaacuugccaaguaagcaucagagaaaggcaguuggcuucaagaauugacugauuugaaaaacaugggcuagagagauggcucagcaguuaagagcacugacugcucuuccagaggcccagcaaccaugugguggcucacaaccaucaguaaugggaucugaugcccucuacugguaugucugaagacagcaacaguauauauauuuaaaaagggggcgaggguuggccugaagagaugguuaggagcacugccugcucuucuaacgguccugaguucaauccccagcaaccacaugguggcucacaaccauccguaaugagaucugacgcccucuucugggauguccgaagacagccacaguguacuuacauauaauaaauaaaucguggggcuggaacgagcagagguccuaaguucaauuuccagcaaccacauaauggcucacaaccaauaaaucuuuuuuguuuuguuuuucgagacaggguuucucuguauagcccuggaacucacuuuguagaccaggcuggccucgaacucagaaauccuccugccucuaccucccgagugcugggaauaaagguguccgccaccacgcccggcacaaccaauaaaucuuaaagaaaaagaaaaaaaaaaggcaaaaugcuucuguggggacgucuuuguaagaaccauuauggcauauaaugaguaggccauugugaaguucugucccauuuacacacauagucuugaaccucagugauuucuauuaaauggaggugauaauuacuacuuacuuuuucuuucuuucuuuuauuuauuuuuugugaguaugccuaaguaccaacaguaggguaagucagauccacauccucuagaguuacaaccuucagguugaagaucuggaaaggaaaccaguaggagacugccuaaaugccucaaacuggaggaaaacacggucccuccucccaaccuguaaccaggaucacaagacccagcaugguagaguaggugggcacagguaguuuauuuucaaaugaaugcaaaaagaacuaagcacagugauacccacaacccagucuucagaaagaaagggagaaaaagagucacagaaaacacaguaaacuaagucccugccccacucucuuguaggcccuuggcuccagcgcaguggcagaagauuccaucaguucauuuacaauuagccauauuuuuguguuuuauacaaaugucuuuauacacuguucuggacucuccuguuuuuuauuaacuacaucucauaaucccaccuacauccgcugcucuauucuugauaguuacaggguguucauugcauggaagggucacuuacuuaaccaguugcuguugcuagacauugcagaaagagcuguguuuaacuauuauuacaaccuagcaaagaacccuuuauauacuuuugucuuacacguguacaaguccacaucuuaucaggagaauacuuaauagagccacuggauaaaggugcagccuuuuacauuacagucuccaaguuugucagagaagggucugaguaggaggggagagguaugaauguagggguuggcacuaacucuggggagucugacuaagcucuaacaccaggucagaagcuccaaaggcacuuagccugcugccacugucagcuccgaacuugcauaacccuaggcaaacucugcccacucccugcugacaugcacuggauugcuguccacuguaccacuuggggaccuagcaguccacuggagaaaauccgaaggauuugagaaacaauccaagauuccuagauagacaauccucuaggaauggauugucucaggcuccagcuaaauaagaaaguuacaucaaauauuuaaaaacaaauuucacacaucuggaucacaaagaagacuaagcaagcagcuguccucucccccuaggcucugcacacagaaaguagagccaugacaaagaaaagcugccucagagagucuaaggagauagggcuucaaccugucuucuaugugcaaggucuccaucuguccaagccuggagaguacuuaaccuacagaaaccugcagaaggcuggagaauaucaaccauagccugacuccacaaucacacccaagcaaucuugaguaucuguugcuauuuaaaaaauuauugccuggggcuggagagaugggucaguaguaguuaagagcacuggcugcucuuccagaggacccagguucaauucccagcaaccacauggcagcucaaaaaauguguguaacuggauuccccaguuccaggggaucugacacccucacauaaacauucaugcagacaaaacaccaaugcacaugcaauaaaaaauaaauuauuuuaaaaauuauugucaguggugcaugcuuuuaaucccuuaaucugaacacuugggaagcagaggcagguagaucucugaguucaaggccaaccugauuuacuaagggaguucaggauagcuauggcuauauagagaaacccuguccucccaaaaaccauauauucauacuuuuauuuuucaggaacuggaaguucaguugucaucagcucaacuuguguguugagaacugaacucagguccgcuagcagagcaugaagcacugagccaucucuccaacuuuaugugcagguuuuguuuguuuguuuguuuuuucgagacaggguuucucuguguaguccaggcuauccuggaacuuacucuguagaccaggcuggccucgaacucagaaauccgcuugccucugccuuccaagugcuaggaucaaaggcgugcgccaccacgcccagcuuuaugugcaguuuuuaagagaugcuggcaaucaaacuccgggcuuccuguguguucggcaaguacucuuccaacugagccacaucucuagcccugccccuuuuaaaaauguuuaacuguagacaucuguagccaaagucuaacuguaguccagguuauccuggaacucacuagguagcgcaggcuaaacccaaauccauggcaauccuccugccugggccuucaaagaacuggaauuauuggcuugaaccaccauacccccacagccaugcuugcuuugugugaaguagccuguuaaugcuuuuggcccagugucagggucaacauggcccccacccccacccugagucucccugaggcagccaaagaguccucaccugauaauggagcagauuccccggacaccaucauaguagucccuauagcagccccagccacuggccugaauggucuuucaagucuucugacuccuuuuuaucccccacuaaguggcuauucuaagcuuucuccucccucaggaucaccuaugucuucuaccuucucuucaauuuccucuuucuacuugacagagagaccucccugagauauacccacuuguguuuuacagacaaccucagacauccuuagcuucccaucauggcucagugucccaggaaaauacaauuccuguggaugaucucuguugauaucagccaccugcuaugccuggcaagacaccuguuguuguaccaaaaagcuaccuccuggggacuuaaagagcuuuuauguuuauauuuugagacagcaucuguaauggcuauuccugguugucaacuugacuauaucuggaauaaaauacaauccagaauugaaagacucaccugugauccugaucuugaggcugggagauagaaguuucugaccuggaucuuggcaugaagaucuugaggcauaauggcuaugaaucccaggagacuaaggcaaggagaucucggaguucaaggucaucugggacaaagcaaaucccaccagauccagauguggugguacacaucuuuaaucugggccacacuuucugcuggagaccuacauaaggacauuggaagauggaagauucacucuucuuugccugcuugccuuguggaacugagcaacuacuagaucuuugggcuuccacucacagcugaccauuguuggggaguuggacuacagacuguaagucaucauaacaaauucucuuacuguauagagacuacucauaaguucugagacucuagagaacccugacuaauacagcaucucacuugauagcccugaaccugagaugcuccugccucagccucuagaaugcugauauuacaggcacugcuaccacacuggucuccaacacugucuuuguugcuggccuaaagggcauucuguagaccccuccucaccauuaugcauuuccacauuuugucagaacuucucuggcuucuuucucuugaccugauuucucccuuucuccuccgucagcauucuuuuguccugcacggcuacuugacauuccccauguguuguccucugcuuggguuuccuuucuugcuuuucuuuuuuucucuuaugguaauacuggggauuaaaccuaggaucucaucauugaagacaagcauuuugccacugagcuacaaucccagccuuucccucuagggacagcuucuugggugacagcugaagccccuucacaguggcuccacauccaucugacaggguugcuccagucucugaguagcccagcuggucucucccuccacaugcagcaucugccacugaacuuccuccacccucacacugccuuuucacgccccaguaaaugagacagcaucuucccuagcccagagccaggaggauguaguacacuacgacugcuguagcaaaacacaacggaguaauuggggggaguuucgagacaggguuucucuguauagcccuggcuguccuggaacucacucuguugaccaggcuggccucaaacucagaauccaccugccucugccucccaagugcugggauuaaaggcgugcgccaccacugccuagcgacacaguaauuuauaaacaacuuuauagcucacaguucuggcuccugggaaguccaagaucagggugucagcagcacagcaucugagagggcugucuguccgagaccuagcucaggcacccauacacaugcggcagacacauacacaaauacaugaaauacaaauauuaaaaccaaaacuugggggggggcgaguggggacauccucuaggagacaggaggaggaggaucuuugcaaggguggacacagaggaggccaaugacuagacuauaaaaaauaaaaguaacaaaacaaaacaaaaaggcauagugauauacacccuaaucucagcuguuauaaggagggucacuuacugaaccaauugcuguuguuagacauuaaagggcaaucuauguuuucauuuuguaaaugagaaccaguauuaaaaaccuuuauguguguuggggucuaaagaaauugcugaguaguuaagaguacuugcuccacaaaggaccuggguucgguucccagcacccacaugguagcucacagcugacuuuagcuccaguuccagggaaucugaugccccuuccagccuucacaggcuccuacaugcgugugaugcacauacauacauuuaggcacauauacacauauacaauuaaauaaauuaacauuuuaaaaaauguuucacaugagcaaacgcuucaaugcucacauuuaaauagcaucuaaauggucauguugucauuaacagucuggggaacuuaaauauuguguuuaauuucauguauauauauauauauauaucaggguuuuacugcugugaacagacaccaugaccaaggcaagucuuauaaaaaaccaacuuuuaauuggggcuggcuuacagguucagagguucaguccauuaucaucaagguaagagcauggcaguauccaggcaggcauggugcaggaggagcugagaguucuaugucuucauccaaaggcugcuaguggaagacugacuuccaggcaacuagggugaggaucuuauacccacacccacagugacauacccauuccaaccaggucacaccuauuccaacaaggccacaccuucagauggugccacucccugguccaaggauauacaaaccaucacuauauauauauauauauauauauauauauauauauauguguguguguguguguguguguguguguguguguguguauaccuaaaauauauuaaguuguuuuuaaguguggaaacaagaugacuuguuucccagguuagccacaaauacaaaucuucuugccacauaaguagcuggauuuaaagguauuugaaagugcaacaggcuagaccuaaagauuuagacaggugaaucacugugaguucaaggacaguucagucaauuuaggaaauuccaagucaacuaagucuaccauaguuugacagucuaaaauuaaaacagaaaauuaggcaggcccuuuuuagaugugcuguuucugauccauugucagcgcuguaucgcuguauuucaauccuuauggugccauaaaacauuauauuuaauuaugauuuauuugcaugugugugcaugugugugagugaacauguguaugccucuguguguguguaugccucuguguguguguguguugccgggggaggggugugcaccugugcauuuagaggcaaaagauaaccagagaucgcauccucagcaauaccguucaccuccuuuaacacaggaucucucacuggccugagcucaccaaucaggcgaggcugggaagccagugagcaccugucuuggcuuccccacuuuuuguacuuaggagccuguaccaccacacucagcauuuuuuaugugguugucuuaguuaggguuucauugcugcgaagagacaccaugaccaaggcaacucuuguaaaguacaacauuuaaguagggcuggcuuacacuugcagagguucaguccauuaucaucaugguaauggugugcagaccuucucucaggagaaggaccugagaguuguacaucuccauccaaaggcagccaggacacugacuccuccgcucuggguggagcuuaagcaaaggaggagaccuccaaagcccacccccagagugacacacuucuucuggcaaagccaaaucuuccugacagugucacucuuaauagaucaagcauauucaaacuaccagaguguauuuuggggauugaacuccagcccucgugcuuauaagacugagccaccccacccacaucugaaaaauuaaaaaaaauuuuuccuuuuuuugauuuuucuuuuuuuuuuuuuuauuuaauguaugugaguacaccgguuaugagucuucaugugguuguugggaauugaauuuuuacuaccucugcuagcucuggucaacucugcucgcucaggcccaaagauuuauuauuauacaaaguagcugucuucagauacaccagaagagggcaucagaucucauuacgggugguuaugaaccaccaugugguugcuggggauuugaacucgggaccuucgaaaagagcagucaauacucuuucccgcugagccaucuugccagcccuugauuuuucaagacaguauuucucuguauagcccuggcuguccuggaacucacuuuguagaccaggcuguccuugaaaucagaaauccaccugccucugccucccgagugcugggcgccaucacgccuggcuuuuuucuuucuuucuuucuuucuuucuuucuuucuuucuuucuuucuuucuuuucugaaaauuaaaauauuuuauuuuguuuuuguuuuucuagacaggguuucucuacauagcccuggcugaccuggaauucacucuguggaacaggcuggacuugaacucagagaucugccugccucugccucugaaugcuagaauuaaaggcauguaccaucgcuacuugacauuaaauuuuuauuuauuauuguguguaugcuugguauuuaugcaugaugugugugugugugaagauaugugcauuaauaacaaugaggaagucauaggacaccuuuuuguaguuaguucucuccuuccacuuuuacacaguucuaggacuugaacucagguccccaagcuuggcagcaaacaccuuuacccacuaagccaucucacagguucccccccacccuguuuuuuuuuuuuuuaacuuuuacagaguuucacuauguagccccagcugaccaggaacucauuguguagacuaggcuggccucaaagguccaccuaccugggccucccaaguucugagauuaaaggucuguaucaccacaucugggucaugugacuauaguuugauauucccauucugacaucgaucacuaaagguggcuauugccucaauuucuccuuuguaauguucuuuugcuuuguagcaucuacugcucuguggggcaaaugagacuauguuacuacauguauuccuugucaaaaauuuaacauuuuucaugaaaaaaggaggaggaaggagagaagauuggguuauuuggcaacuuaucgucccucuuacugcuggccggugcaguagcugcagggggccagcaggugucagcgccgaggcacaucugggucuggaacauuggcucuggugcugcccugagaugucaugcgcugcugaagaggagccaaguaucuuuguuuuauggcuccagguggcagaacucauucugccucaagaucugcuguccuugucacuaccgagacaucccuccuuugugucguggguuccaucuucccugaccacacugucuccaguaccuccacugcggagacgcccgaagcagaaaggaacuccccacaagcagaagacaacagccuacauacugaggaggagcaguccacacaagaaaggaggacuccacuuggaaaggaaggagacccucaucuaugaagaagacaagaucuaacuuagcagagaggggacugacugagaccugggugcagauggggugucugauggcgagacagacuggggcuugggagauggauggagaccuggcacgugugcagauggacucuaggcuacucuuguggaaaacaggcagacguggagggccaaguggucaagaacugacgguagggugcccuacggugccuccugugcuuccucagacuggucguuucccggguauaauuggaacuauuuccgcuccucagagaaagcgagaaauacagaaguuccagagccucggagaaggcucguuguauaacagccugaguuugauucuugggauccacaugggagaggacugaccaccacaggcauguuguguuaggcaugugcucacuaaaccucaaauacacguuagggaacgaggagcguccccugcccccagguuucugcuucaguuucauaccuuggcuuuccaccaugauggaccguaaccuguaagcuacauagacccuuuucuucccaaguugcuuuuggccagcauuuuaucacaauaauacaaacuaacugugacaguuucucagcuguuuacuguggugguuccauugagaaaugucccucauagucucagacuuggagcacuugguuccuaauuggugacaguuuggggagguuuggaguguggggccuugcuggaggaaguaugcagggguacgguaggcuuucagaguaaaaagucuugccucuuguuugcuuucucugcucugggcuuagguuaaggaugccagguuucuguuuucuucuucuucuggugccucggcagccccuugcugccaugccuuccaacguggaggagucguuccuggaaccacaggcccaaauaaacucuccuguuaguuuccuuggucaugguguuuucucacagcaacagagaaguaacuguuggagcacagggccgagucuguguaugaagauuucuguguuaggagacgucuuagcguuuauaagaaaacaagccaaaagucuugugagcccgguuucuucagaacacggaguuguucuuggaauguguucucaugccccucccagauguagagaggggugaguuuaccucagacuguucauuacaacuggcuauugucauuuguuuauaugccuuuaugaaaaaaacauguuugguguggcuugcccaccaugggcagcuucguucuugugauuggacauuuuacuuaugugacucuucucaacccucagaguauaaguugucugauacucuaaauaaagcuggcuaaugcagga

SEQ ID NO: 265 - RNA, 1344 nt, Mus musculus
ucgggcgggcgguggccgcgacacagaggcccuuucaggcugcgaggccgggcggggcgggucugcgcccccguggagcgccccgccuuggcucccugcacccugcuuuucucccgcugcccgggaggccccugggccgccuggcuuuguccuguuuuuaaacgcucuccugcguaaagccuggaagaaagaggcuucuguuuguggcaucccaguccacacguccaccuuggccaggacccaguaucgguggugcucaguaggugcccagcauugacauucccagaaggcaauuucuacccuuuucaagcugccagaaucagaaccccuugucaguuucugguauucggcuacugggcagugccugagugaggcgucuuggugagcagaugggcuaacagagcuuggaaaccuucaugggaaaauaaaacgaugguccagaaaagauucaccauguacgaaauaaacccaguuugggccacugcgggugaacuacagguguaccaaguacgcgguaaacugaggcagauagcaucagucagaggagaaagaauaugguucgagucuggagaggaagugaguaugucaggagcagaaaaacaggcaugcaaaaauaaagcaaugacccaaauaugggcguuaaagccggacaaagcccgucggugccaggggcucuauauucagcgugccgugacuauugucucugguuuagguuacacaguaauccaagcuucuccgaggcuucucccuaccacuggcagccuuuucauccaggucccucaccaucugucuucagggaccaaccaucuccaaccuccaacccccacacccuacacccuccacacccucagccucauaggccuagcucugacuuccagacugucugcuauucagucugcuccaggagccguccuacugguuucuguaaacucccggcaucuuggcugcuuuucaacagccaguagcugcuguaugacauagacgcacgagguucugagagcaggagguagcugucuuucacugagaggccucugggcugccuuucuagggcagacugaucugcggcuggaacaguuagacugggguuaucuuuuucccucuaguuggagcuucaccacgauccuggcuucacacacacacaagggcacuguuacucccauguuacacaacuugaggccuaccugggcccaugcccacccuuaacagugucacccugacaguuucucagagaucagcccugacucaguauccagagcuggagaacaggacuauguaauuuaugcaaaagaaaaaaaaaauccaagguuccuuguucagacagacgauuaagaauuuuaggcgggg

SEQ ID NO: 266 - RNA, 1344 nt, Mus musculus
ccccgccuaaaauucuuaaucgucugucugaacaaggaaccuuggauuuuuuuuuucuuuugcauaaauuacauaguccuguucuccagcucuggauacugagucagggcugaucucugagaaacugucagggugacacuguuaagggugggcaugggcccagguaggccucaaguuguguaacaugggaguaacagugcccuugugugugugugaagccaggaucguggugaagcuccaacuagagggaaaaagauaaccccagucuaacuguuccagccgcagaucagucugcccuagaaaggcagcccagaggccucucagugaaagacagcuaccuccugcucucagaaccucgugcgucuaugucauacagcagcuacuggcuguugaaaagcagccaagaugccgggaguuuacagaaaccaguaggacggcuccuggagcagacugaauagcagacagucuggaagucagagcuaggccuaugaggcugaggguguggaggguguaggguguggggguuggagguuggagaugguuggucccugaagacagauggugagggaccuggaugaaaaggcugccagugguagggagaagccucggagaagcuuggauuacuguguaaccuaaaccagagacaauagucacggcacgcugaauauagagccccuggcaccgacgggcuuuguccggcuuuaacgcccauauuugggucauugcuuuauuuuugcaugccuguuuuucugcuccugacauacucacuuccucuccagacucgaaccauauucuuucuccucugacugaugcuaucugccucaguuuaccgcguacuugguacaccuguaguucacccgcaguggcccaaacuggguuuauuucguacauggugaaucuuuucuggaccaucguuuuauuuucccaugaagguuuccaagcucuguuagcccaucugcucaccaagacgccucacucaggcacugcccaguagccgaauaccagaaacugacaagggguucugauucuggcagcuugaaaaggguagaaauugccuucugggaaugucaaugcugggcaccuacugagcaccaccgauacuggguccuggccaagguggacguguggacugggaugccacaaacagaagccucuuucuuccaggcuuuacgcaggagagcguuuaaaaacaggacaaagccaggcggcccaggggccucccgggcagcgggagaaaagcagggugcagggagccaaggcggggcgcuccacgggggcgcagacccgccccgcccggccucgcagccugaaagggccucugugucgcggccaccgcccgcccga

SEQ ID NO: 267 - RNA, 4338 nt, Mus musculus
cuuugagacaccauuguuagaacaacucagcaaaauaaaauuccgguuuauuguuggacauuguuucacacauacaucaaacaggccaaaaaaaaauaaacagcaacuucauagacagaaagaaaaggaaaaaaaaaaucuuuuuaucuuuggccuuuuuaaccaucucauacaaaccaacuacuuauaguacagcuagguacauacacaaaaguuacuggaaugcucggaauaagauuguuuuuuuguuguuguuuuugcuuuuuuuuacaagguuuuuuuuuucuccuuugagauuauaaugaacauggucacaccacaaguaaagucugaaguaggacagaaaacgcucugaaggcugguuuggucacccguuaucauuaaaaauggcugaccccuaacaauauguacaaaaauauaaaauguaaauaaaaaauacaaacaaauuuuccuuuuaaaguauuuuuaagaaaaaaaguagggccugggaaguucugguucuuuuuuccucccauguugccaauucauguuguaguuuuggaggggugguggagagcgcaugucauaucuguggguggcauugcccgcugugggcgggcggggccugcuucucuacucgaaggugaccacguuuaaauucugagacgggaaguggagggugaauaggucacggugcguaagguuauuuuuccuuuugcugucuagucauccuccucggucuucugcuucuugguguccacaucgucauccuguagagaacaucaggccugugacuacacauaagcucccuaggccuuggcccacaacucccagagagcaaagcugggaugggguccacuaagaacccuucaccauuugccagaaacccccaaagcuuuuagugccccaggaaaggaaccucacacauaccucaucauccucagcuacccgcuugcccguaggagccucagcuuccucaucuucaucuccauccuccuccucaccuggagaaucaaucaaggcccacauaaaccacuauccucccagcugcagaucaagaacggccccaauaggaggguggaguacacugcaguucaaagugguccaacugcccagaaacccaaccucucccuucuggcaguaaaagccaaggaaggaaccugagaaaacaagacuacucaccgucaccuucuuccuccuccuccucuuccuccccaccuucuuccucuucuucaucuaccucauugucagccuccugcuccccauuuuccucauuuugcuuuaacagaaaacacaucugccauuagccagcucugaagcaggccuguauaucuagugcaccuugccccuccccacaccauacagcuaccacaccaccucccaaacaaaaaucagacaaguucccuugucugguccaacauccugaacuaagcugaaaauuuaaaaaaguauaaacugggaacacaagccccagcuacuuggacacucacagcguucccauuggcaggugcaucucuuccauucucugccuccuccacaacuuccuucuucuccuucaaguccuuuagaaggaagaggaaacccguuagucuucagaacaauagagggccacccaucagccaaagugcugaaaacuagacaaagcugguccacaggaccaaucugagucacuggcuacuuggccacccuaggguaaugucagcauggaccauaguagguacucaaggccuguaguccaaauccuaugcuuuccaucuucuagauacauugaaaacaaggcagacucaugugucgacucaacgcacuccucuaccauauggcaucauagccacaaacccgccaggccaggcagacaagcucgggaacuguagcccuuaccugcacgcccuuugccgccgguuuccagcuagagggagcuccaccccucagaaacccuucuuggaaggcaguggcugugugccuuaaauaaauaagguagaagggaggagccagucgacggucauucgcucaggaauggaugggagagucuggauggggaucggaaagcgccugggcaugcagaaacacccccuucaagucacaccagccaugcuugguacuagggaccuccuggccuccacagcccaaaggaaauaaacuagcacucugggcccugcggcuucggggccggaccacuggguaacuuuucccacuacgacggcugaacggucggcucggucggggcccaggaacaugguccagcuaauuccgccggugcaccgcuggguuaccugccggcaaugguggguucgcgcccaccggaggccugccuaggaccccacugcacccgcuuccgcccccuggcggccgaagcccgggggagugagugggggcgggguggcagcggugcgcaggcgcauagcucacccagcgaacuacgcgcgcgagccucuugcacgcaccgcgcgcaaagagcacguggcccggggcgccaagugcgcccugugcccuggagacccgagguccgcuuucauccaggggagcggagucacccacuggagaaagcccgcuccgugcugcccccugggguccugccugugaggggcaacacgcggcuuccggcuccgauuuuggcgccaagcucucgcgguaggucaccagggacucggagcuccucggcuccgacccucgagaccuucggggggggcgcucccuaggagcgcuggaccucgcgggaauucaccugagacucccgccgagggcggaggugggaccaugcuugcuacaaaguguuacagcgguggcgggcaucgcuccagagcgcgcucugcacggggucgcaccagccgagggagauggcgagccacgggaguuuaaagaaacaaggcgacugggacugaguccccacugcgggacaagcggggugcgaacaucgagguguuugaaagcaacgaguccgaaccgaacacggcugaggguggagaagacuccaccgggagggcgagccccugccucaggaccccagccaggaccgcggugcugcgcgggcuucuagaccgccacggcaccaccgcagcuggggagccgugggggggcguccagccgcuccgcagcuucacuuucuauuuccucccccucucgcgugggcucgccgcccgggcccaaccccgucagcaaugacugacccugcgacgagguccgccgccgcggggacaaacacgaccacccgcguucacccguggcugcggaccagacccuuaggugucgcggucagaauccccccagcgcagcacgccgccccauccgcgucaucccggauaaccgguggccggcccgcuauagggcgcgaacccgggcgccuaacaaagagcgacucggccgcgggcgcccucagcucgccggcgccgcacacgcgccccccacacuuccgacugcggacgcgccggaguuucaaaguuauuuccgugcgccgcggccccgcgaccccggccccgagagcgcucaaaccauucgcaaacaaguuucgagaauccgcgucucggcccuccccguuugcguccgaguuccgaggcgaccccaggccaucggccagcucccgacggcggcaccaaugcccgcgccgcuucgcgcccccucccccgcacacaaagaguguugcccggggccaucgcgccgcuggaggguggcggggucgccuggaaaagcguuugcgugaugcuuuccugaaagcccgcaaccacgcgccccaacgccgcccgggcgacggcgcgcagaccccgagggggcgggcggcguccagccucaccuugguggugaucucggagcugguauccacugccgcgucugacaugguggggcacgccggugguccgaugccgcgagugagggaauuaaaagucgaguucgaggacucuggcgagagagcugccggaguccgcgcuggaggaggcggugggcggcgaagguggcugcagcgagcgcggagcacgacccaggaacaaugcaaagauggcuuuucggagcagccagugggggacucacgcggcgccagaagcuuuaauauagauuagugggcggugcucagccacccuagucccggcgcuauuggcugagcgcagggagcgggcguccucucauuggcucgauuccgaacaaugggcaagugagcuuaaagcggcagugccucggcuuggcgcgcgcugcgcagucccccgccgcacugucauucagaguguugaauuuuguugggucucgccacgccggaggggggucgcgcgcgugcgcgcucccgcagcuguuuugcuaaggccucugacgcagaaagcuaaagcgcggcaaagcugcccgcccagccccgguccucccccucccucgcgacug

SEQ ID NO: 268 - RNA, 39556 nt, Mus musculus
cgggagcuccacgacuagagggaaggagaagggaucaggagcgggagcugaggggagggagaggccgguucgggucuggccgccaccgcuguucaccugagguguccggccgggcugcggcuguccucgguuccuggguaccgucugcgaggccccgcggagccagcgugggagggccgcgggcggcaggcgccgcaucaugucagccaaggacgagcgggccagggauauccugagaggcuucaaacuguauccgcccgggagcaggggcggggcugggaggaggccguggcucuaaggagccaggcuuuggcaggggcgucaggugggcaccggggaagaagggcuacgagaaggggcaggaaaggaacugugugccgggcccccgggagggaccgcgaacgggaggcaggcacaggggcacccugagggagaaaggggacguugauggagccugggggggggggggggcgggggggaggauggagguggaggagccccgggaccuggcuacugcgagaagaguucccauuugaaauuaggguccugaaggccgggaggccagaagggggcugcaguccccacgcagaggcugagggagugcagcaagcuggccuccuagccugccuaggagcgacuuuggcgggaagcccagggugggagcaggagaaagugacuccaagcaagugaccuuguaugugggggauaauguaccccaucccaccccaccacacacacauccgucuuguuuucacaacuuuucuuccucacuuguggcuucuuauagggcuggaguaguggagagguggggaaagagaaauuaaagacggaccccaucuuaacacuuuguuggccuuuggagcauuaacaucucaaguucucuuuccagcgagaugagaaauaggaggugugugagaugcaugagguacuuugguuuugaaccgacucccggcaaaauuaucuuuggcauugcugagguuaacgcuuuauuauggugaagcuguucacaauuacuugauuguguugaggacaccauaugauaucagaauucguuguuucgguggacuugguguugaaugccugugaucccaguacuugggagauggaagcagggggauccagaauucaggucauccucagaguuucauagaguucaagaccagccuuaguuauaggagacccugcuucaaaaaggaagaaagugagaagccagaggaggaaaagaaaccauugcuucaggccuguuguagcuacacugugacuuuugcaaccucuuuauauagagagagaaaacuucgaagcguuuguuuuauuuuggagacagggucauacaguguagcucuggcugacccagaacuugauguguagaccaggcugucuaccugucucugccuccugagugcuggaacuguuagaacucaggguguggccagcaccuucagcuagaagcuguguguuuugauggacuauuugucaccauaaaaugcagaugaaauauauuccaguuuuacauucuguugaccuuaaucucugcuguacaauauggaauauuccuaagugccucccuuugugggauguaaccaucauuuacccagcuccugccucuggagguuuaggcuucccuaaacugguucucugaacaaccuguugcauugucucaagaccuguuucacaucuuccaauaucuaauugcuuggcuaugguuagaaacuaaggugaacguaaauucuagaauucauacaaggcaugauuaaaucaugguuauaaccccagcacuuggugacugaagcaagagauugucauguguucaagaccaaucuaggcugacuccaaaaaaagaaugaaucaaaaacaacaccacaagaaccacguaccacugugugaacaguggugaacggauagacuggaagcauaaacggggucauggguuucuguggccccaaggggaaaaaccaacccaggaaguuuugggugcaaaaggaaaacccuucaaguaaaaacuauaccgagguuuugugggguuuguuuuugagugugagcaaguagggugcguugagaagugaagaaacagcucucugcaacuggcagggauuggaaagugagucgcccugcugugcuuuguaaacacagaaggcuguaucuccuuacacacugacauucaggauaaacccucaguggcuuuccauagugaaguuuaguaacagacucuucuguaguucccugucugcuugggauaaacgaauauagcaggaaacuguggauuuugucacuuuuacucuugacaugaaccuguugagauaaaggcuaauggacaaauauagaaaacacuauaaagcuagaugugguggcacacaccuuuagucccagcacucaggaagcagaggcagauggaucucugugagucugaggccagccuggucugcaaaucgaguuccaggacaaccagggcacacagaaaaacccugucucaaaaaccaaaaagaaagagagagugugugugaaucagccacuuaaguaaugaugugagugcuucaggaaacaggcuuucagggaaagcuugaccggagcugauuaaauuauaaagcaaagggaaauagccacauagcaguuagcacaggaggaauagagugcucauccuccgguguccuuuguugacaucugaaaaugaaaagacggaaaauggggcuggagauacagcucaguaguuaaaaacuuaaggaugugaauugcuccuguagagggccuggguuugauccccagcacccacaggcaguugguuaacugaauuccaaggaucuaacacccucuugcaccugcccauauguggcacauauaaacucauguaagcacacacacacacacacacacacauauauauauauacacacacacacauauaaguaauaaguuuuuaaaagagaaagaaaacaggaacuagauggcuuuucauucccauuuuuuaaaaaagauaauuuuauguuagaaacaacuugaucauucaccacuuuugguuggauaauuuuucucugaacuguuuucagauuguuucuuuaaaaaaauuguauuuacuauuuccuuaauuacuuucuguugcuaugaugagacacugugaccaagggaggaacuuagagaaaaagggggcuuaugguuucagaggguuagcggcugugaccgccaugauggggagccuggcaacagguaggcagacaugguacuggaccuuauaucuaauccacaaauacuaggcucaaacugcuaacugaaaccuugaggguuuuugaaagcccaaaggccaauucccaaugacacaccuccuccaacaaggccacaccucuuugccucuuuuuuuuuuaagauuuauuuauuguuuuauuuaaguacacuauaacugucuucagacacaagggaagagggcaucagaucucauuacagaugguugugagcuaucaugugguugcuaggaauugaacucaggaccucuggaagagcagucagugcucuuaaccacugagccaucucuccagccaaaggccacaccucuuaauccuccccaaacuguuccacaaacuggggaguaaccaaacauucaaauauaugaacuucugcaaaccaugcucauucaaaauaacacauuacuauuaaagaaaaaagcaccauuauauucucccaucaacaauacucaauuuugcaugucgacuuuuuuuauuuuugaaaaucuuauuucauugaaaagaaaaugauaaauuuuaauuuguauuucugcaucuucuacucucuggagaaauaauaaagcauaguuauauguuauuuuauauacauagcacaguuagaacauaguuaaugcuaaacuagcuagguguuggaggcacuugccuuuuaacucccgugcuuaggagauggagacagacagaucugaguucaaagccagcuuagcuuaccugguuuauauagcaaguucuagacauuccagggcuacguggugagggcugucucagaaagagaagaggaaacuguauugaagugaggagcuacacuaacugccuugcaugcuaguccuguguuccugaagcaguuccucuaaaccucugccucagucuucuuagggagaaaauagaacuaacagcaccugucuuaaaggucuuuugaaacaugaaaugaauuggucucuaaaccuuuggaaaagcaccugauaaccagugagucuuaugucuuggcaguugcaaauuucauuuuucucaauuuucuucucugaauuguuuuuuuuuuuuuuuuuuuuuuuuaaaaacacuugcuaaccuaggcuccauugccuuaaacuuuuuuuuuuuuuuaaagauuuauuuauuauauguaaguacacuguagcugucuucagacacaccagaagggggagucagaucuuguuacggaugguugugagccaccaugugguugcugggauuugaacucuggaccuucggaagagcagucgggugcucuuacccacugagccaucucaccagccccuucucugaauuguuaauguuuacccauuuuacuauuuuuuuucauauuagccccuugccuaacaugucuaaugugucuguuuugucauaguauacuguuuaaagcuuuuucuguaguuuuggcuugggcuuuuuugggcuuuuuugguuuuguuaacacuagagauugaagcuaggcacagaucacuugcuaggcaaacagucugcccagcugaauccucagcuuuccuuuuaccuguuuguuuguuuguuuguuuguuuauccucuggcaaauuccugcaugaauauaauacauuccagucacacucguuccuuucucucuucucccugcuguccccaucaaguauccacaccacuaucaugucuuuuuguuuuacuuuccauuuuuugugacuuauucacugaguuuaaccagggcugcccagugggcaugcuugaguuacucacaccagaggagggcugcacaucaguggcuacaccacugaagacagcgacuucguucccaaaagcucaucguaucucuuucaaucauuuuuacaauuuauacuuugagacagagucacacugaguaacccagaccgaccuugaacucgcucuguaaccucagcaagccuugaacuaguggucuuuguucuucagccucccaggaagcuagaauuuuuuuuuuuuuugauugaacagaauucuuuuuuaacuuuuuuuuuuaauauauaucaucuauagcuuccauuuggcuuuugcauuuuugucuuauuuaagaaaaucuuggggcuggagagauggcuuagugguuaaagguacuaacugcucuuccaaaagacccagguucaaaucccagcaccuacauggcagcucacaacugucuguaacaccaagaucuaacacucucacauagacauacaugcagacaaaacacuaguacacauaaaauaaagggaaauauauuuuuuaaaaaauacuucaaggaagaucucccuaauauauucugguucagcuuguauaaauacuuuaccuauuuugagucuuaauccaauuuugggggcuuuacagaagcagaggguauuguggcuguuguuguuguuguuguuguuguuuaaggagcuggugaucucucuuauccugagauuaaucaaauagccugcuucuuauuuucaguacuuaacccuuuaauccucugaaauguauuuauacuuauagugugugguaggaauaagcuguuaggaaagucaguuaccccaggaacauuuacuagcuacuuaaaccacccuacuuccauuguuuuggaauauugucuuugucauguaacaauuuccauaagacaugaguuucuuuuaggauauuguuucauuuauuucuugcucaugccugugcaugcuuaaggguaaucaccuaguuucacagugugguuuaauacagugucaaagugauugccaugacaugaguauggaucucuaaagucauaaagucccaaguaaauauuugugucccuucuacucaaaggaagcuuuuccccuauguccauuauagcuauccaauaagcaugaauaauauugcaaaacuuagauuuuguuuguuuguuuguuugauuuuguuuuucgagacaggguuucucuguguagcccuggcuauccuggaacucacucuguagaccaggcuggccucgaacucagaaauccaccugccucugccucccagagugcugggcuuaaaggugugcgccaccacgcccggcugcaaaacuuagauuuaacuaagagaauucauauaaagcuuugaauuuguuauauuccuucaaaacaggauguuguucucuuagcaucuccacccccaucucuucuuaccuguuuucagcucauacacauuaagagucuucuauuucuuuguuaaaagaaugacauuuccgccgggcauugguggugcacaccugauauauuguaaauccauguuccccauuuauuucuuuuaacaaaggucuuuuggguggcgauuauguucaggguauucugcacuggaagucuacaaaauuaaugaacagucgugccccccaccccuuaauucugcuuagaaugaaugucuuuagcaugauguuacuagcuaggucuggugguucaggccuguaaucccagcuaaauccaaggccuucuggggcaacuuggucucagaguaagcauguaaaauaaaauacaaagaggcuaguaaagagcagucaccuagguuccaucuuuauuacuaaaguacuuuaaauggugucuuguuuugcuguuaaauuuuauuacaguauuuuaauguuuuuaguguaguuugcuaauuuagcuaauaucuacaguuacuugcuuuuauaaaucuuagagaauuguuuuaaaauauuuuuacuuagcuuaucauguucauaauuuccaaagauagguacuguugauuacuuucaaugauauacauuuaucauaguacuuuuugucugagacugggucuuuguuuuccaggcuagugucaaauuccuaaacauaagacauccuucccacuuaagcaucccaaaugccugagacuacagccuaguucaccauagaacucucauagugacaggcuucucauauagcucugacuagauuauuuuaccuccuuggguaauuuuucauugguauaaaugugaaccuuaauaaguuaauaugggggcagugagauggcucagugcugccaacccagagcuagccccaggacccacuugguagaaagaaaugagccugcauaaauuuuccacugacuuccauguauguguacaugugcacacacaaacacacauauaaacuuaaguaaguaaaaaaaaaaaaacaaauaaaacagacugucagagaugauguuuuaagaucucauuaucuuuaauucacuggaaaauugcugugguagaaucuauguauauaugguuuugcuuuuguuuuuguuuugagucaggauuuuucuacauagcuguagcugucuuaaaacucacuauguagaccaggcuggccuugaacucacagagagccucuugcaucugccucauaagugcaggaauuaacgggccaugcccaauagguuguuguuguuguuacuuaauuaucuccauuuacuuauauuuuagaacuuaauauaauguucagauagaauauaaauuaaaauaaacauuugacuuaagaaaaagauauauugaauacuucuaaaggaaagaccaaugaauaaaugaaggcauauucagccuuauuaaaacugucuucuuauugaacaguaacuuguuuucaaccacuuuagagggagaggaacacuaacuuccucucuuauguguguauguggagccucuauagaaaguacuugauaucuaucaaaauuuuguguguaacggcuguagcaaguagaacaggcuguacgacuguagauucagacuugcuaccugcagccuuaugaccuucaacacaacacucacucacugugccccaguuuccauaacucauauccccaaaggauuguuacaagaauuaaaugaaauuucagccaguagugguggcacaggccuauaaucccaacacuugggaggcagagacagguggaucuuuguaaguucaagaccagccuggucuacagaguaagauccaggauagcuaaaacuacacagagaaacccugacuuggggaaaagaaaauaggaagaaaauaaaaaaggcacaacugcugauagggauuaucuuagggucuugguccaagaauuagaugaaauuaaaguuuaacacaguacucagcaugcauaaguaauaacugcaguuauucagucuauucauaauuaugaauaauaauaguagugaaccagggauauagcucagcuaauugagugcuugccuaguguguguguggagcccugacuugauuuuccaguacauauaagccauaucaaggucccagcaccuaggaggcaaaggcaggaggauccaaaguucuaggucaucuuagcuguauauugaauucaaggucaccauggauugcaggaaacccuaucucaaaaaacaguaacacuagugcuaauauccucuagaacauaagguaaugucuuuaggugcgcacgucugugaauacagguagcagccagaggucagucuaaagaguugauucucaagcaccaauaucaagugguccaccuugucugagacaggaucuagaacucgccaguuggccuaggggagguggucaggagcccccuguuuccuuccuuccaauacuuguauugcaagccugugccaccaugccuugcucuuuuguguggguuccaagaucagaacaugcuugcuucuuacaugcuugccuggcaagcacuuuaccagcugagcuauuuucccagccauaagaauuccuucuguuuuuacaauuauuuauauuuauguauaugugugagugccuacauguguguauucccacuuguguaucugguacccucaguguccagaagagggugucuaauccccugaaacuggaguuagguaguugugagccacuugauauuggugcuaggaaccaagccuggguccucuagaagagcagcaguguuguuaaccacugagccaucucuucagcccccacucauauuucauuugagaauuauucuuuucuguuguacuuacauccucuauguuuuuauuuuuuccucaucucuuaaauucaggggcagccugggauaagaaagguaauuuuaacaacuagucaccuagaaggggaaagauacuucuugggaaguauuuaaauugcaaauggcuaucuacuuuuuaauauuauauuucauuguauguaucugccuggauguguauuaaaguauuccuacauuagccucuggaggucagaauagugugucagauccccuggaacuagagcuacaggcagcugauaguuaccauaugggugcugggaguugaagccugguccucugaagaguaguaagcacucuuagcuaccgagccaucucucuagcaccaaauagguauauucuugauuucacuuuuuuuguuuccauuuuaaacauagacuguaguaaagaaaaggcuaaucacaggaauacaguuagcgacuuugaucaugaucauauagaagagcuuguuacucagagcuaauaagcacaacauuaugggccauuagguuuuuacagcaaaauuacucacagaacguauccaucuucaaaugagcagcccagacugccuuauaaaugagaaagaagugagaaugccucacacaaucccuuagaccacagcacacauaaaugaguguguagugguaguauugagaagacuaaugucaguagguccaguuauuuccacuucccucuggaaucuuguccuuaaacaugugaaaaguaucagauaaaaacuauauguggaccaagcagagguggcacaugccuuuagucucagcucucaggaggcagagacaaauggaucucugaauuaagaggacugcuccacagagugaguuccaggacagccagggcuauacagacaaacccuaccucaagcagcagcaggaggaggagggggagggggaggaggggggaggaggagggaggaggagggaggaggaggaggaggaggagucuugaggcaaaguggcacaacccuuugaucccaggauuucggaggcagaggcagguagauuucugugaguucaaggccagccugguuuacguagagaauuccaggacagccagggcuacauggaaaaauccugccugaaaaaaauaagaugaaguaauugaaaauagaauuaaaaccaaucucugaccuccucaagacuuguauaagagagaugggaagaauaacagcacagcaugguaagugcacagcauuauccuaagugcaguagaaaugcagagugauugcugcugggggcguucuggaaggcuucagaguugucaucuaaauagagucuugaaagaugaguagguguuaaggagucuaaucuuuagauacuggggaguagcagcaacacgauggcaggcacagugcagaggagcauuucgggcaugagcuggagccaagcaaaggagccuagagaucaaaaguccuuagaggauuggagugggaauuucaguccgugaauaugagacacuauacugagagucuaugacaguuuacacauuaguacugaucuuaagaguaauaucuaaggaaacaagaugaacuaugaucugucaauauuagaggauugauagaggaauuaaagucagcaaauauauuauucaagaaaucuggugacaaaaccaaguuuaggagguagcuugaguuaagguuaugacuggugggugugugggugggugugaauuucaguggucaagcucuagccuagcuugcaugaggccagagauuacccccaccccacccccagcacugaagaaaucaagaggaguucaguuaaacaguaagagucacuuucucaguugucuaacuguauugcaucauuuauuaucuguaagcacagauuaugguugcuccaguugacucggaaggauauuaugaaauuacaccaucccacuuuaaacaccguagcucuucaaauguauuugugcuuguuguuguuauuacagucauuuauuuaacuucagucuaaagcuuaaaauugcuuuugcaaauuuauacauuucauguuucaggaugccaaaaaggccagagacucauugauuuuccuuuauacugucuuacaccucuaaaagcgucuguucgucaggcugggacguaguugucaugcagugaaaacagaacuguagaaccaucuuucgcuuuccauuuccuauuuauuuauuuauuuauuuauuuauuuauuuauuuauuugaggggcaagaugaggcucccaaguguggauuacaacuugugagcucagaccucuugguuuuuuauuuauuuguuugguauuuguggaacaggaguuuuuuguguaguccuggcuguccuggaacuugcucuguagaccagacuggccuugaacucacagagagccaucugccucuacuuccuauauacugagauuaaagguguaucucacuacugaucagccuuuuuaccuuuuuuaaggguuauaauauaaggaaauugaugcccuucucagaacuauagcucuuuuuuuuuuuaaguuagguaaaguucaagaaucacuggauauagauuuuggugacauucaagaacacaauucuuugccuucaaauaaggugaaagaauuaaucuuuggggaacaugccccugaaagggggcauauguuaucucuucuaucuggaagugcugggauacaagcaaggcaaagcuagucgguaagagucuuucagaugugucucuucuggcuugucugaugccaguuucaggugcuuaacuguaggucaguacagucguugacucuagaaaaagaaauguuuguuucauugucugacuuggcuaaugagaagacuguguuauguuucaaguggugaucucuuucucauuacuaaguuacuugccugcacuguucccaggccagucuggauuuagauugucucuuuuccaagcacagcagcauugccaaagcaagaguauuauuucacagugauaccaccauuuguuacagcauauuaaguuccaaggaugcugaggccugcguucucagggacacauuuauauuuucucuccaugucuccuauaagugggaacauugcugggaaauuauugaguagagaaguugguuucauuauaugucaauuagaauuggcuuucaagaauguacuaaaacagcaagauuucacaguaauuuaaggcacuugcuaccaagccuagccaucugagcuuggucccccaggauccccaaaaaggaaggaaauaacugagucuuacaaguuguccucuaacucuaccuauguguacauguguauuuguguacacacauacauaugcacacaggauaaaugaaggaacucugaaaguuuuucauaaguggggcuggggccuggagagauggcuuagugguuaagaucacuggcugcuuugcuagaggacauggguucacagcucccacacauggccuuacagcugucuguaccuccaguuccagaucaucugacccuuuuucugcuuucaggaacuauaccaggaauguacacaguauauagacauaugugcaaucaaaauaccaauauacauagaauaaaauaauaauuaaaaaaaauaaaauaaaucuuaaaagaaugcccuaaaggaucuguccuauguagcaaaccuagggcagaaaccgcaugagguacugacagaguagguauacaagcaaggagguucagguagagaagaaagcaucacaaccagaaaguggaagugcagagcaaaggacaguuuugcugugaugaaaugcucaggaugccaccaaauagaaaccuccuuuguucacugccaggcacuguagcuacuuccaccccaaaagaaugagcagaaagcuuuucuuuaugccagugaccuugguauggaagcuuugccucguacugcuuuggucugcagugguagacauuagcauaugucauuauaugccuagucagccauuuugaaaaaaaaaaaucuacuuaccuugaaauuacucagagccacaugcccauauauaauuuacaaguacucugccaagucaugaauucaggccuaaugcagaaaaggcuuuuaaguucugauguguuuuaccuacaaaucagcugauggauuuagcuguucuucauaaagacaguggguggucaagguuuuuugaguuuguuuuuagauuuuuuuuaagauuuauuuauuauauguaaauacacuguagcugucuucagacacaccagaagagggcaucagaucucauuacggaugguugugagccaccaugugguugcugggauuugaacucaggaccuuuggaagagcaguuagugcucuuaaccacugagccaucucuccagcccccuuuagauuuuuuuuaaguguaugugucugugugugucugugugugugugugcaugugcaugcaggaacucacaaaggccagaugcuccuuagagcuagauuuauaggcaguugugugucugaugugugugcugggaauugaacucugguucucugcaaagcaguauucacucuuaacugcuaaggcaucucucacaccccccugguuaguuauuuuacagggcacuggucugauuuccucuucuacaaccugcugauccccgaagcagcuccccuggucugcuucuuagacacucuugaauaacccuugcuuucugguuguuaaccugaaggagaguucccaucaaccuucugacuugcucugugauguucucuuguguuucagcacauauuugagucucuuguguugagugcuaagauaagaugaucaauaaaccuggguggaauuugauuuacaaacucacacuguguauacauacacguucuacagugcagggucaguggggcacugaagcagacaucacucuagagaauggaguguguggcugagccuaacuaagcccagcagcuuucucugguaagccuucauuuuucagccugacuuuuuguuuuguuuuguuuuguuuuguuuuguuuuguuuuguuuuguuuuuuucgagacaggguuucucuguauagcccuggcuguccuggaacucacucuguagaccaagcuggccucgaacucagaaauccaccugccucugccucccgagugcugggauuaaaugcccggcucagccugacuuuuaaagcagcuuguuaaccugcuaaccuguugccugugauuuuucuguccccugccaaacugucaucuuuuuuacaauacuuccuauuguauuaucucuucuguugucuuuuuaacuaguuuuuuuuuuuuaauaaauucuggcaugguggcacaugccuuuaaucccagcacuugggaagcagagauaggcaauuucuauaagguugaauacagccuggucuacauaggagguuccaggacagccaggauuauauagagaaacuugucucauaaaaauaaaauucucuuuuaggauuugcaugauagguuaacagguaaaggugucugcugccaggucuggcaaccugaguucaaucccugggcccugcauaguggauggagagaacucacuuuuauagauuguccuccaacuuccccacauaugugcacaugccugugugugugugcgugcgcacacacaaaauaaauaaucuuaauuaauaugcccuugaccuacuuauaaaaccugaacuauauguguuccguagauaggagacagaccuugucaagagcagaaaagaaaaagaagaauaugcugucuguuaacuucuuauccuucaccauaagcaugguuaguacugaccaggcaggccagagguggauacauagacuuggaaaugacugagagggugaagacugcagacugcugugccacaggaaccuccucacucuuaccaccccacugacucucuuagcaagacagauagagucagucuaucccugaauauauucuuaagaaacaguuuuggucuuuaguacuuuuagugcuuaucugagcuagcucucuagagcagaccuaugucugaccaggcuugguuucagguacugagccccuacuggagccaguguaagaugacccauucugccagaugcuuuccuccugagauuuccugaucuccucuuuaucuucucguaacauuauccaaagaagguaagaggucuuuuuuaccaaaaucuuuguuacaaacaaacuuccauaucaacuaagguaguuucagguuguuuuacaaaauuaaauuuccaguuuaaaaaaugaaauuguaaguucuugaauaccccugaaauaauguaagcuuguggucucauucaagguauagaaaagcaagaaagcuacuuuuaaaucaucaaacacaauaguacucaaagaagaucauuauuuggaaauauuuaagcucaaguauuuaaauauagcuuauaauaaggaaguuuuguugucgugaguagaauuuuuguuaccuguaugaaucucuauaguuucaguaguuucguguucucuacuaaucauuucacaagagaaugauuuuagaaaggaacagagggccauucccaucuaggagucugcuugcauuucucaccuucaguuuuccuacccuugauggcuugucuucaccaagggacccaggacccugcagcugcacucucuucccuggggaauucaguguagacagacuuguuuaucuagaugccaccugugcuguuucuuagcugcaguagauucuguacuauaguuucucucucugggacaaauggcaugcaggaagcuggaagugucauagaugcuaagagcauagccauuggaaucagucaguggaaagccaauuuuagaacuaagcucuuagguuaguuaaugaaguauuuaucuaacaugaaugaaacccuagguucagucuacagcaccaucuaaaacagggucuagugguuuaugcccguaauccaagcacuugggagguagagacagaaggaucagaaauucaagaccacucuaagcuacagaaaacccugccaccaaaaaauaaguaaggcuuuaccacucacugguuuugaaaccaguaaguuugaaacuuucaucuuggagcugaaaguugcucaucaaauagggaucauaauuaugccuauuucagaggauuaugaggaggagucugauaaacauggauaaaagcuuauagcucacuagcuggcacuccgcaccuauuagccaucauuuauacaguaaauaggaacuugaaagauguccguuucugccagggacucuuaucaucuuguauaggaugaucaccugauaacagaauuccuucucauuucagucucuccuguucauuuaaacaaaucuuuuugauacaugugauaaccauguuauguaauuucucuggauauuuuuucagaaaaguuuuaauuguuuuaagaauuagagaaauauaaauaccuucugguuaauuugugaccauuuuuauacuauuuguuguucuauauguuaugcauuuguaauuuccauggaaaagcccaggcaguaggcaguuuucuucuuuaguuuguuacagucuggugcaguacaucuagaagguuagaaagucacagaaaaguugccuggaagcugccaagggcccccacaucuaagcuucuggguguucucucugcacacagaagagaggcauccaggcaggugguucaguuuguuguuaguucccaagcacugccaggggagacuuaacccccugagucucucguguccucaggagggcgugauggcugguagucuagcccaucuucaguguaguaacuggacugguucccagaugcauuucugacauggaagagauuccugcaggccuccugcuagcauuucuguaugccuugcuagcucuauagccaagggcuugcuuuuucuguuuuuaaacauuugaucauuucucucacugcccaucucucuucucugccgggccagcuugcccuucuguguacauacacugcaaaaaccacagugacugcucuccacucucccucaaaaaaacacgccauuccaaacguuucugaucccugaaaccucccuuccuagagacguguuuuguuaacggucccucccacuuguucaucaucaaggccucccuaucuagugcuguaguguauggacuucagugaugggaaugcuuuucuuucuguucuuuaagauaauuuuccuuccagaaucacagggcuacucagaauuuggcuucuggguauucgcuuuggccucacuugggaacugguuagaaauauagaaugacaguuuguagcucagacccacugaaguuugugguucaugagaguuuaaggaagccaggccuaauugagcaugcuagcacacuuauaacugcuuagaagguugaggcaagcuuaggccauuuuggaaaacuuagggagaucccugucuugucuuaaacuagacuagaaaauggauaagggugcuagcucagugauagaaugccugucuggcaugcuggagacccugcagucaauccccaguacuuggaguacuugucaauuaguagaccccagccuggcuuuuaguacaaucacauggggaaucauauaaaaaaaaauauauacacacacacauauauauauauauauauauauauauauauauauauauauaugaaugaaugagggagagugugugugugugaauuaguuuggagcuugguuuugguuuuuuguuuuguuuuccaagacagaguuucucuguguagcacuggcuaugucuuggaacucacucuguagaccagacugcaggcugugccacuaccucccagcuaauauuuauguuuauuguauguauaugugccagaauauguauguguguguauauauauauauauauauauauauuuuuuuuuacagagaccacacaagugcaugagccuguugaggucagaagaggcauuaaccaagguccucuucuagagcaguaagugcucuuaaccacugagcaucucuccagccccuguacggugaauccugaaaaccagugaugccugagcuccaccuccagagauuguaauuugauuggcuugaguggggaguuugcaagcucugauuuuaacaggcagccaaaguugaaccauugguauuuaucaaauuuuuuuaaaaagugucauguggcccagacaggccucagauuugcuguguaaccaaggauguccuugcacuccugauuuccugcaucaccugcagggguuguaggcaugcucugccacgugcagcaaagguucacuuuggaggauuuuguuuuguuugcuauuugcaguacuggggauugaauguagggcuucauacacccucggcaagugcuguagcccaggaauuguuaauggccuuuagauaucaccuguguaccacugaagggaauuguguuucuaauuuucccuuuuaaauccuuaguuuaguuggaauuguguucaagacaauucugagucuuacauagaaagcuagaaaauuccaagcagaacaucuugaaaaccuugacagucugugguugguugagcugcauggugauccaaggucaucaaagccacuggggagcagcucaucgacagagugcuugccuggcgugcggagggcucuggcacugagaaaaagaaaaaguaaggguacccucuuuggcaaaccuuuggaaguaagugccaaccuuaaaagccgagaucuacugcuagaugagguggccacaccuugagaagaaggguggucucugaguuuggggcuagccugaagcaaaaguugaguucuaggacauacagggcuacacaaagaaacccugucuuaaaaagccaggaggaagaggaggaagaagaaaaggaaacaaugaucuacuuaaagucauucugaggugggcauguagcucacugguagaguauguauaaggcccugguuccacccuccagaacuacaaacuucucagaaauguacaguuccagaaaauuuuuauuuuauugugugugcucaagggcucauuacgugcacugugagagugugccacagacagcacaccugugacaaucaguucccuccaccuguccacauagguucaugggauuagacucaggccaucagacuuaugcagcaaucaucuuuacccacugggcggucucaccagcccuccugcccuagccuccugagggcaugguucaccacaccuggcaacuggcuugaucaggggguuggagaaaagugugaaaguggguuugaaccuggucucacuauguagcucagccgaccugaacucauuauccaugugagccuuaaauucacagcagcccucuugccucaggcucaaacaugagccaccaugccuggcugcuccucuuccuucuccuccucuucccuuuuuuuuuuuuuuaaagaaagaucuuauaucccaaugcagaaagacuucuggagcugucccaauaguauauaguauggacaagaugugagcuuccuugagugguuuuagucugaguuugucuuuaccugaaacuguagcccuaucaguuuggcuaucuuguccagguaugcaaaugaggaagaaaggagacaccuggguauggccgaagacugaaaggagauacagguuagucagcauguguuagacacugauagauaucuuaucucacaaggccuccucaggguggagccaacuauggcacuuuguacuaaccucucuuacagaucaggcuucucacagugcaguguaauucuccuaccugguaguuucucuaccuggaggagacucugagaaccacagcagagccugaacccaacauucacgaccauuuagcaaaugcuagaugaaugaaaugcccaauuaaccuuguuauaauacaacaugguuuggucaguuucaaaucugaauuaauccuaccuuuuuuaauaucaaucauaguuuuauaccaguaaguuuaaacuguaaaauagauaaguacacuggaguuuaagaggaaaaauggaagaaaacuauuguggacuuguaaaauucuaucaaagcuuuaagauucaauuuuuacuuuuauuuauuuauuuauuuuuuuauuuuauuuuugagacgagguuucucucuguaucccugacugcccugaaauuccauuuguagaucaaucaggcugaucucaaacuccaagaucugccugccucugccuccccagagccgggauuaaaaggugugcagcucauggcccugcuuauaguuugucugucuuuuuuuuuuuuuuuuuuuuucuuuucuaaacgggucuugcaagggauggaggcacaggccuuucuuuuugacuguauuaggagggucagauuucaacuaaaacauguuaagagguuuagcuaagagaccauguuuuuuuuaauuuuuuucaaaguuuggaaauuguaggugccuaaacuaggugugaugguaugugccuuucaucucaacacugaggaggcagaagcaggcagauuucuguaaagucaaggccacucugcuguuacacaaggugagcuccaagccagcccagccauaguuaagacccugucauagauaagcuggaugauuggauagacaggcaggcaggcaggcaggcaugcaugcaugcuuauaaauauauaucuguauauuccuagauguugcuuucugacuggaaaucaguuuauuaacauagauauauuaucaauaagcuuaauuucauguucauuucaagaagaaucuuagauaccuguaguaucuguacauuguaguauaguacauugucugcacccagcucaggucacgaacacacagaguaaagccuguccaucccaugcccuuuaacauuugucuucccaguucuugagguuuguucuuuuaaacuuuuuaacuuuggggagagcuggacucuccccaucuguccucaggaggugugguucuaacaagagcuuaucccuugugccucggaaaacugaaaggauaaagagcuuugugcugauagaaacuuggguuucauucuugacccugaucuuucuuggaacaaagcacagguuuccagaaugcuuucuuucugaaagucagaggcuaguggcauucccuggaggaaaaccugaguucuggugucuagggagcgauguuggagcuggugacggugcuuggcucucccuggggauaccuuagaagggaagaacaaaagaacuggccuauuaggauugucugaugcugauucauagaaacccuaggacacuuucaaucuuaaaaauaaaucagcccaaaguaccaccuucaucuuuguuccucaaauuaugagauuuuuaauaguaaaguuuuaauaucucaaaacuuaguuuucucauccagaauguaaagguagagguaauaagacccagcagaguucuguuuuuguaauucagcuaaugcaacauuugagacagcaucuguuaaugagguaaagcauaaaguauggggaaacaagagcuggauucuaaugcuaaauuuuuaaauauaggagaaaauaacuguacaagccaguuagaaaggcuuuguaagccgggcggugguggcacaccuuugaucccagcacuugggaggcagaggcaggcggauuucugaguuugaggccagcagagugaguuccaggacagccagggcuauacagagaaacccugucuugaaaaaaaagaaagagagagagagagaaagagagagagagagagagagagagagaaagaggggaggaaggaagaaagagugagaaagaaaggcuuugugucaguacaacgugagugaguguuuuugugcccuggguucucuuacuaguuuuguuuugugcaguacaguccuggggcugaaccagaggcccagcacauccugagcaggugcucugcuacugugcggccugcauccccaggcucucauuagcuuuacuacauugaacuuuguuuaauguuugcaaaagucauguaaguguuauguuuuagaguuuaggaaaacggcacuaagaaguuaaggaacuggagaggaggcuuagugguuaagugcacucgaugcucuugcagaaaaccuggguuugguucucagcacccauaugguggcacacaaccaucccuaacuccaguuccaggauaucugaugaguuuucucaucagacgcacguguggcacagacuccuacuggcaaaacaaucauacccguaaaaucgguuuuaaaauuuuuguuuuaacaaguccuggagcacgugcucaggaugugcugggccucaggguuccgccccacgacuggacaaaacaaaacaaaacuaguaagacacucagugguuaaagacgcuuuccaaaaaaaccuggcaacccaaguuuaaucccuauaacccucacaaaagugggaggagaaaacucuguaaaguguccucuugucuccccaggaacucacccacacaguaauaauuuuccaaaacaggguuucucuauauagcccuggcuguccuggaacuacucuguagagcaggcuguccuggaacucagaaauccaccugccucugccucccaagugcugggauuaaaggcgugcuccaccacuuccccacaauaauuuuaauuguuaaaugaaguuaacuauuaaaugccugagccauuauuguacaccuagccaaagacuccacauuuuguuccagcugguggaagagaggaaguggagcugaacacaguggaacacuggaauacaaauuaauaaagagacagaaagggugaaaaaugcccaguagaaaguaugaaaagacuaggaacauggagagaaagagauacuggucaguuguuacccucuuuagcuaaaacagaugguuuucaagaugagguagaaacagccuuguggaggguguugaucucugagucuacuagaccugaucuagagaaagggggagggggugcaccgaaagguucugaaccgggaacuagcauucaguaagugagaguuaagaaagacuauucuaauggcacuggguugacauguagaggggaaaggaugaaggaacaaaagcaguuacuuucuugccaaaccccagagaugauauggaaaugucaccaccuuucaguggcagaaauaucaggaccugguguacuguccaggaaggaaggucacagggagggugugcaacagccagacagaaagacuugaagagcaaguucugcaccaaaauaaucuuacucucauagcagacuagacaccgugagaacaguuuauaaauggucauaacuacuccagccaaaagcuuccuguacucccaaaugccagcuucuccaggccacaguuauguaccagauauuacacagauacaugcuccuuggaaaaguuuaggguuuuuuuuuuccauguguaugggucuuuugccuguguguguaugugacuaugcaccacaugugugucuggugcccauggaggccagaagacagugucagucccucagaacuggaguuacaggugguugugggucaccauguacggguccugggagccaaaccugggucauuuaagaggauagcagugcucuuaaccucuuagcucucuucuccagauagaaaauucuuucuuguuguuugguuaguuugauuauuuuuuagagacacagucucacuaugucacccugacuguccuggaacuugauauguaaaccaggcuggccucaaaacucagagagauccaacuguaccuccugaacauuaggaguaaaggcauuucccaccaugccuggcauaacuuuuaaaauuacauuuguaugugugcguguguacaugcacaugugcaccaacaggacguacuuguagagaucugaggaccaauuuguggaguuggaucuccccucccacauuucugugaauucuggcaccaaacuuggcacaccagccuuucauagaaccauuacccacugagccaucucuccagccagccuuugucuuuuuuaagacacaaucucuuuauguaacucaagcuagcuuagaacauguaauccuucggccuccuagucuccucagcugagauuuauagguuaugugcuacaacauccagcaacuuucucuaccauuucauuuuuaaauuaugucagacuuaaaggaaguugcagaaauaauaguuuauucacauguacgcuucaagugugaaguguuccuuauuggucaugucucacaucaccauagaguaugaucagaaccagguagucaacagaggcacaguagggcuguuaacuauuguuuuagggcuaggaaguagccuaguggcagaguuuuagcaaaguacuuauacggccgaagaaccaggcuuggcuaccauaggaucuuuuaagugaacguguuaagugaggggggagaggguuagaaguugaaugaggguuagaagauaagugugagaagaacgugguagacuuccuugccaagccagaucuacagaauguccuucccuuuaucugagugauccuuccacauuugccaaguagcaaccacaggauucagggcgugucauauuacuuggguuacucugcuauuuggcuugcucuguuuccaggggaagagcaggggagggaauccacggccucugcuguuguuaccaaucaaaagcaaccagcuccguaggccuccccugugacucugacuuaaggcaggggaaaauaauagugacaaauugacagaggccaccuuugccagcuaucauuaaguuaccauagaacuggagauucucuuggucacacaguuaguguuauacuggaaaugguuuuagauacggauuguuuaucuugcuacaagaggagauacugaaaguaagaaagugcuuaucauaaagggugcucuguaagcaaugacacaauuuagauucugcugcuuuaaaaggauaaaaugcaacucagugaagaaaucagauggaaaggggcuuuaaguguggaggagugaaaaggccagguagugguggcagcacacaccuuuaaucccagcacucgggaggcagaggcaggcugaucugaguccgaggccagccugguuuacagaguuccagaacagccagagauacacagagaaacccugucuuaaaaaaacacagaaguguggaaggaaacgguauuuguaaagguuauuuguacugaggauuucaguaucuaugcuacuuauuucuaaacugcuaacaaucaacuccaggaccuguccagguaucucaggaugacucuugcugugauaaagcaccaugaccaaagcaacuugcagaggaaaagguuuauuuaaccuacaguuccacaucacaguuuaucauugaagaaaggcagaggaggaacucaagacggcaaaaaccuggagucaggagcugaugcagagcccauguagaggcacugcuuacuggcuugcuccucacagcaugcccagccugcuucuuauagaaccuaagaccaccugcucaguugugggcccuccgcucccacaucagucacuaauuaagaaaauguccuacaggagcuguagaauugccucagugguuaaaagguugagagcacuuguugcucuuacagagggccuggauucaauuccaagcacccacauggucauucacaacucucugauccaggggaucugagaccuucuucugaucucugagguaccaggcacacauaugguacauauacauacaugcaggcaaaacacuggugcacauuaggaggaggaaaaugccguacaguuucccuauagucccaucuuuuggaggcauuucugaacugggguuccuccauccaggugccucuagcuugggucaaguuaaaguaaaaacuagcccaguugacccuugucagcuugacacacaaacaucacuuauuaagugaaguuuccuuucuuguccccaagaucucacguuaauguuaccauuaccacaauauaagacauuccaaccuuuuaaaaauucaaacacuuaaagagacuuuguauuuuuagagagauuuuugaauauuaaaaaaaaaaagcuggacguuuaaguguuugaagaguucaaaaucuuucaacuguggacucauguuaaaccaaaaaauauuuaaaugaccgggcgugguggcacacaccuuugaucccagcacacggaaggcagaggcaggcagauuucugaguuugaggccagccuggucuacaaagugaguuccaggacagccagggccacacagaaaaacccugucucaaaaaacaaaaacaaacaaaaaauacuucuuuauuccaagagagaaccagggcacagucugaacaaagcaaaaccaguuuuagcaguguaaauaauugcaguguaugugauucacucacuaucuuuugggcuccuccaaagggccugggucacuucucuggcucuacucugcagcacacacagcucgucuucuaggcucuggcuggcuccacuccacugcugcagcuguucuugguggucgucccguggugcuggcaucuccaaaauacuggggucuucugcugcacuuucaccaguagucucuccuaggcuucauagccacgauucaaguucuuuuugacugcuucuaaggcugcacuuucuccaauggccucucagugccaagcuucagcagcucuucauggccucuucagaccuuccaaaccagcaucauucuuacacauuacuaaguucagcugacaguacaagguucaacaucauagcuuguguguguugacccugaggcaacaauucccagauuucaccugagugaugcugaccuuaaacacggcuaguuucucaacaccagcugaccagcaucaguugucccaguaaagcuaaaguuucacaucaguggugcuggucuccuguugaucacagccgauucuucauuucccauuagucagaaccuagcaaauggccuguuaaagagucucuacgagacucucaaacugcccucugaaacuccgcaagccagcccuuguuuucauuucucucaacauucuuucuuccaagcuccuacagaacaccccgcugagcucuucaauacucagugacuuuucuagcccaauuuuccaaagucuuccacaacccucccaaaaacaacauggucaggucugucccaacaauagcucauaauccuggcacugauuucugguuucagauuacuauugcugugaugaagcaccauaaccagaagcaacuugggaaggaaggauuuauuuagcuuacacuuccacaugacacacaguucuuuauugaaagaaggcagagcagggagggcagggaccggaggcaggagcugacacagaggccaugaagaaggaagugcugcuuacuagcuugcacuuauggcuucagccuuucuuauagaacccaggaccacuggccaggguugggcugagcccuucccaaucaaucacuaauuaagaaaauggccuacagcccugucucauggaggcaucuuaguugaggcuguuccucucagaugccucuagcuuguugaaauugacauaaaacuagucacacagaggaaaguacacugauaagugagcuacaucaccagucggguuuucugaaacauaacauauagaaaacagaccaaccuugaauuugauauguaacucaggcuggcccuaaacaaacagcccugccucagccucccaaaugcugagccaccacaccuggcucagaauaauacuucuuacuagggcauaauugggacaccaagauggcucaguggguaaaggcacuugcuaucaagccugaccagaauucaauccccagaaaccacauuguagaacaagagaaccaacuuccacaagucaucauuggacuccacuugaguacccacacacauacacaaaucaaauaaauguaauuuaaauguuugaaauagggcauaaguuuuagaaguuaugaccuaggagcuggagagacagcucaacaguuaaggcagauacugaucuugaagagaauuugaguucgguucuagcacucaugucaagcaccugacagccuccuauagcuuugccuccagggaauccuaugcugucuuuuggccaacauaauaggacagaacuaauacccaugacaugacaugcacacacaccacaaaaguggaaaaaaaaagcaguuaagguguacugggaauguuuuguacauucaggcuacuauaaugaaguacacacacaaaaaaaauuguuuuuagacaugguacuagaaaaauggcucaucaguuaagaacauuugcuacuuuugcagaagaaccagguuuggcaacuccuaaccaccuauaacugcaguuccagggggaaucugaugauccuuucuugggcaccaguaugagccuacaaacacucaggugcgugugagcgcgcgagcgagagcgcacgcacaaauaaauugauaggaggguuggggcagauaagguggcucagugagugaaggcgcuugcugccaaaccugaugaccugaguucagucuaguuucuggaacucacaugucaggaaggggagaacuaagacuccgcccaucaguuguccucuggcuuccucacaugcagcauaacacucacauauaaacgcacagaauagacaaauaaaaugagaaagcuuuuagagauguguguguucagauacaugcauauuggagaacaacuuugaguuccccaaggccaacauaauaggacaaaacugauacacgugacaugacaugcauacccacacacaaaaaugaggggaaaaaagcagcuaagguguacugggaauauuuuguacauucaggcuaauauaaugaaguacaacagauagggugucuuauacacaacagaaaugccugguguucuggaagccagagcucugagacaguaccagaauaguugauuucuucuggauuaugggucuucacagaguggaaguacagggagaguucucugaagucccuuuauaaagaccaaaacccacuccugggugcaccacucucaugaccuaaucguucucuucuguccuggccugucuccauucugagcuauagacgggcauugcuagaugcaucuucccacacccccacuccuuccauugcaucuuucuuguucccuaugugugugucucauuucuuuucucuuucccuucucugaccuccccacuuucucuuguucucuucccuuuuccugguuucucucauucuuuccucuucaaccggccaaugagguucuggcauguucagucaaccuguucauuauauagaaauuuaugugacuguuuccauuuaaaacuaagacuccuagaacccauguguucaucccaaaacaccugcgagaagauauuuaaagcucuuauagcuuauuuccuucauucacaucucucaaacagacccggucuccauuccucuaacucaguguuucucaaccucccuaaagcugcaacccuuuaauacagugccuccuguugucaugacccccagcccuaguuauuuucauugauacuucauaacugucacuuagcuacuguuaugaaucauaauguaaauaucugauaugcaggauaucugauaugugaccccagugaaagggucaaucaaccucaaaggggucccuacccacagguugagaagugcugugcuaauugcuuucucacagacccuaaguuuucccuuggggcuuggcuaccuuccuccaccacugccuucuguauuucccuuccuucuggcuccagcuccuggauuagcuccucuaaacucuuucauuccucgcuugcuugcuugcuugcuugcuugcuugcuugcuugcuugaugcaugagugcuaucucugcaaguauguauguggaccacauguccaggugccugugaaggccuaaagagcgcuaaagugagcuaagagccucccauucuuuuuuuauuauuauuauuauauguaaguacacuguaguugucuucagacacuccagaagagggagucagaucucauuacggaugguugcugggauuugaacuucggaccuucagaagagcaguugggugcucuuacccacugagccaucucaccagccccgagccucccauucuuucauguucuuugcuuccuuguuuaucuuucuggaaacucgauacuuugcaagcuuugacuuugcucugaaacauauuauuuuauccugaaacuuauuuuuuuauuauuuuauuuaguguguguguguguguguguguguguguuggggggaaacaugugacuaccacagcuuacaugugacagccagaggaaaacucauggaaauugcuucucucuuuccauuuggauaccagggauggguugucaaguuugguggcaaacaccuccaccagcccugaagcuuauuuuuaaagcuguugguacuuuugcgugugagggcauuuuacuuggucugucccuaaugcaggaguccuaauaccaagaagugcuggccuccaaggggagccucucucuguucauccuccucacagcaccaggaagucuuugcaaggagaugaccuggcugacccagagagugcuguuuauaaauagugucccgcaccccuccuuuaaagccugcuggccuaauccucacucuaaauuggaauugacuugaccuuugagccucaaaacucaggucucuuuuuccucuggaaauccugcuuaacaaaaagcuacuaaagcaaaauguuuuugguuugguuugguuugguuugguuugguuuuguuuuguuuuguuuuguuuuugagacaagaucucucaaucaaucgugcuucagccucccccaugcuaagauugcaggccugucaguugcuuguugggguaguuccauccccgucugucugucugucugucugucugucccucuucccaguuccucccucgauucuuagaaugaacccagagaccccaggacauugagaagccagcgaagcacugagccccagccucaucugucacuccuaaagcuacagaaccugaaggagccuuagucacuuccacucuacugcccucagauggaacacucguguuuaucugcuuucaugucauuuuuaguagauaaagucugacaagucccuaucacuguggaaugaaacacuagaucuacacaauggcaguuuucagauuaggguacauuaaagaacuggaaguuguugugauaaccaagauacuuuuuuuaugccuuugcguguuugccuucauguauguaugugcacauguauguaugugcacauguauguaugugcacagugugugugcagugccugucgaggccagaaaaggguuccagauucccugggacuggagcuacaggcaguugugagcccccuguauguccaguucugugacauucagugcggucuuuugacuucucugggcaccugcacucguauacacaggcccacacaaaaccacacacacauacaccuaauuaaaaacaagggguggggagaucgcucagagcuuaagagcacaggucacaucaggcagcucaccuuuagcucuggccccaucagagagaccuuaggcuuccauggauacccacauacauacacauuauuuuaauucuuggcauuauaauuacaccauucucccucccguucuuccaaccccuccaugugcuuccccucuccagcugcucucuugcaacucauuaccucuuuuuucuuaauuguugggagauacacauagcuuuaaaguaauagaaaucuuuugcaucccagaguuuucuugcugaccagggccgggggcauuuucucauccagaugcagcuugagcuaagacuauuucuuuaaggcuuuuucgagcuguagcuuuuugcuaagaaugccuuggcugccugugagucagagguuguagaaauaauugcauuuguauuuggucuuuucuuuuaacuuacagucugaugugaacguugcugcaguggacacaugggacacuacugugagguauugagaggccuuugcagaguaggccaagcaaggacaaugucuucuaaaaaucuggagcuuaagguaucugggccaaaucugagcucagagucgguugacagggcaacagugucagcuguucucuaucuaagauggagaagcucuaccuuacauaugcaaggauagguaggcagauuuuuaguacuuaaaaucaugugcugagaccuaaguagaaguuuauacguggaaguuacauuuaaauucaguuacuuaaaauaaaagguaggaguuuaacucaguuguagaguuucacuuagcaugugaaaagcccuggauucuauccccagaacaauagauuaguuaacugauuugaaauguagagcagaggaagugaacggaauagguuaagaagaacucaguggcccagggcauggucaagcacuucggagaacugguuaggacccacauacccagaggaaaaaggcauucggaacucuggcuccugaccuaaucacucgaaaaaccuagccugccggacugcccaggcuuaucuuguguaucuucuguguaacagaaaaauguagaccuucucugggugaaugucauccugucacccauguagcugugcuaugcaggggccccagcuguccucgagugaaacaguggaagagugugacaaagauaaugccaggaagguagagggccagggccugcaccaaaaggccacacagcaggaaugggcaaguucagaugucugugcaaacucacacagaaagcucugccucaaaugcaugugcaaagccaguucaggaccccagaacuaaggucuccauuguccaagccuacgccaugugcucgccucagcuguacaugggagaagagagauccacaccuccuaacugcugaggggcagcacagcccaugccucucagaggagugggugacauggccuuuguugucaaacagaaaaaaggcacagauaagcuuccucaacugcucagccacuucacagaauauuccuuuacaucuuuuacagacaacuuuuuugcuuauuugcuuauuugcuuauagcaauaauuuucuuugucaaucauuuuuaaaaagaaaaaagcuuuuucauugaauuauuguguuguuuugggggaggggggaauaaaggucagucuagccucuaacucacaauguagugcaagcuguccucacacucaguagguagacaguguaaaguugaacaccugauuucccuuaaaagcaccugcuuugggcgugguggugcacgccuuuaaucccagcacucaggaggcagaggcaggucgauuucugaguucgaggccagccuggucuacaaagugaguuccaggacagccagggcuacacagagaaacccugucucgaaaaaccaaaaaaagcaccggcuuuccaggucuguaccaccauaucuggcuucuguucuguuaauuccuguuuuugaaucuuaggccucauagacuauucucuaauucucauaucuuuuuaacuccauuuauuuauguauuaugucugugggacugggcaugcacuugcgccacagccagauggggaaaucaagaggacagcuugcaggagucagcucucugcuucuacauguguuccaaggguugaacucaagccauuaggcagcaggcccuuuuacccacugagccaucucuccacaucccuuucugugucuuuacucaccuguuuucuagccuuuacccuuuguuuauuucuuucuuuuuaauuuuugcuaagagcuuucuucaauuuuucuuccagccuuugcauuagauuucuugacucuggucccaaaacuuguuuuuucuagaagucuuucuuguucucuggauguguuauuacuaucuuauuuauuguaucaaacacagaacauagaaaauaaaaauauauaaguuagaagccauuuuugacuaaaacagauauucaguugauuaucccauaaauuguagcagccaugaaccacaaaaaaaaauaaucaacuaaaauauagaaauucugugauauagaacaccuggcaguuguguuauagcaugucuuucucauuuuuaaagauugcuucugugugugcuacuuauguugcaugucugugugugucugugugugucggggggggggggggcagaagagagcauuagaucaccuggagcugaagauauuggcaguugugagccgccccauauggguucuguaagcugaacucuggaccccugacaaaagguacaacagacuuuaaccacugagccaucucuccagugauaucuuuuuauuauuuuuuaauauucuuuuuuaaaauuuugcaucuugaucuguauuuuuucucuuauuuuuucuuuguuuucauaguaaaugucuugauuucugaugauucuuggcugacuggguugcguguguaugccugugugucucucuccauguguacauaugccacaguacuuuuguggaggucagagaggucagaggacaucuacugggcaucuguucugcacuuccaccgugagaucuagaggucaagcugucuccuaacacuuaaaaggucugggagagcugugcaguagugagggaggcucaugaacuguaacuguauggcuuaguccuuuggugguacccugagaucugaccuguuauauuuuuaccauuuuuuggcugaugagacuccucugacauauuuagauuuuuuucacuauucuuucuucuagcccuugcuaccaguucuaguugcuaucuuugaguucuuuccuuucucucaaugcugagauuugaagaagggccuugaaacuacuaagcaagcuccccaccacugagcuauaucccaguucaugucucagauguuauguaacaugguguagauuaaaaaccucuggagucagcugggcuugguggcgcaugccuuuaaucccagcacucaggaggcagaggcaggccgauuucugaguuccaggccagccuggucuacaaagugaguuccaggacagggauuguucucagagccucagucuccuuaaucauacuugaucagaaauuggaugaaccuucgggaugccgaaacagggaagauacucuggcaaggaacagaagaccugucugucccugguguggaacaugaagguacuuugcagccccuugaguguacaaacuaugcccacugccagaacagacccuggcaucaaggagcuaaguaagcacgcagcuacuagacaggugagcccugcaggugaaccgagagaacacuucuuguuccauuuuuacauuuccuucucucacuucccaaauccaccuuagcucuggaccauccccagaucuggaugugauggcauguuccuguaaucccagcacuuugcagauugagacagaaagaucaggaguucaaggccagccucagcuauauaguuaauuuaaagccaaucuggaccacaugaaaccuugucucaaaaaggaaagaaaagggaaguuauaauauuucaacuuuuuccagaagaaaauuuucauuuuuaucuuucuggaggaaaaaaggaaagguaaaucauuucaagaaaucagagcauaaagcaggcucugacagcugcacagagagaggauguucaucacagccaaaagcauggugaggccuguggagacaccuaaucugguguuccuugacgacgagucuccugugcugaccaauuagaucccucugccuuuagcuggaacauaaugcaguuaccaaggcguuuaaugaaagcuaauuauccaaacaaauucucuaaggcagccaaaggaacucccaggauccugaaguguuguaucugugguucucauuuagaauaguaccaaucucucucucucucucucucucucucucucucucucaucagcccgugugcccaagaaaauccucaagugcaaggcagugucucgagaauugaacuuuucuucagcagaacaaauggaaaaauuccgccuggaacaaaaaguuuacuucaaaggacaaugccuagaagguauucugccccaugugugucuggagcugggggggggcagcaggcaggcagugcucugaaagcacugaccuuaucacuaauggacucuacauucuacagcacugggaaaccccagugaauacgaaccaaaacaagacuggacaccaaguaaagugggcuuugaguucucugauaugagaagccugggugcccguaccugugccugugccugugccugaugugguguuguuacaaugugaucuuggaagaagcaguuuaugaugaaguguaguauaggguugugucuauacaucauaagcugugacugggaaggacucugaacugaguacucaaaauaucagagaacacguagacacuggagugcugccuaccucugauuuacugcagagcuugcugcuccuaagaaaaugcugcuucuaaugucuccuucccgauccuugucuauuaaacccauaaggaacagcccagugucccugaguguagucguguacgccuuuaauacgagcacucaggaaguagaagcagguggaccucuugugaguuugaggccagccuggucuacaagugaguuccaggauagccagagcuacacagagauacccugucuugaaaaaccaaaaaagaaaaaagaaauaaaagagaaaaaaagccagccuguggcacaaaucagaagagagucugugagugucccuguguccuuucguguaacucucugauuuaggagguaucugauagguuucuuuugugguucuggauagggaaaacccacucuaaaggagagggacacagccuauaguuccccaugcccauaaguagcaccugcucacuggcuuuuccuucuuccuucagagugguucuucgaguuuggcuuugugaucccuaacuccacaaacaccuggcaguccuugauagaagcagcgccugagucccagaugaugcccgccagcguccuaacgugagugagggcccaguagacuucaaaauguaucuuagaacaggcauucaggcaggcgggacuccagguccuacucacaggcagaaaaguagaaagaacaaacaggccgggcagugguggcccacaccuucaaucccagcacucgggaggcagagacagguggauuucugaguucaaaaacagccuggucuacaaagugaguuccaggacagccagggcuauacaaaaaacccugucucaaaaaaacaaaaacaaaaaaauuuaaaaauaaaaauaaaaacauugucaguaacugccaccuaaccuuuuucucuugggacaagauagagucuuucaaauauuucaguaggcccgggguuguauuucagugguagagagcuugcuuaacauaggugaauucuaugaucuucacugccaaaagaaagucucaguauuaguguugccuaaaaaguuaagaccuacauauaauugugccacacuaguucaucuggcaggagauacucccugaaagccacagcaaguggauaaaagagcuauaaaaggggcuagagagguggcucuccagcuaagaguacuggaugcucuuccagaggauccaaguuugagucccagcauucacaggcaauucucagcucucuguggcuccaguuccauggaacaugaaacccuccucuggccuccacgggcaccaggcacauguguguugcacacaggcaaaacauccauacacauaacaauacuuuuuauucuuaauuuuuuuugagacaagaucucuauguaguccugacuauccuggaacucacucuguagaccaggcuggccucaaacucagagauuugccugucucugccuuuaucuuccaagucuuggcaucuuccacaacacccagccuuaaaauaauuauuuuuuuaaauaaaauauuuuuuaaacccucaaagggauuugauauggcaacaguauuccguuuuauagaugggagcauucauggcucagugggaguguucuugccugaaugcacaggguccuaggcucaguuucuggcacagccacggagauaaccaucuaaccagaaaaguaaaugccaucacucacuggacaggugccucguguaaggcucuuugguuacaaacaacagaaucaaauccuggugaacagaacugaguuagaccaagcagacgccugggcagcuuggaagggacaaggccaagaaucuuccucaaggaguagcugaggaagggugcuuugguggggagagggggcaucugguuggcaugaauagaaugcuguaacuccugggggggaaggugcggggggggaugucacucagcugacccagacacuagaagagggauuguucacaaaggauggugccacuacccaaaaucaggagaguacugcgaggcaggccacacccuagcugucugcuuuacucaguauuguagaaaaagcugccuuccugaggucugcccaggaucugcagccauccauuaggaaccaagccagagguauccaugagaccuguaugcagagcacucugcaaagacaucagugcgccaagacgaagggcaugcucuuauuccugacuuuuucaguugagaacaaacuggucacacgugagacuaguuaacccugugaggcuagcccauauagacacacuugaauuguauuuguaguuaacccugcagacucuagcccauauagacacacuuuaacuguaugugccuugccuuguuuuuguucugagacagggucuaacuuugcagcccuggcuggccuggaacucauauagaucagguugaccuggaaucacagagaucuaccugccucuuccucccgagugcugagacugaaggugcgcaccgcuaugccuggcuuuguucuccuuuugaaauggaacuucacuauaguccagaguaaccgugaacucagauccuccugcauuggccuuguggacacugggguuaugugcaccaccacaccaagcucuggacaaggacuguaauggcccaagcucuagguguccacgugccaagcccagagcacccaaauggacaccaucuguagacagggcaccuuggccuguggcacucucuuuacccucuugguucuuucccacaggggcaaugucaucauagagacaaaguucuuugacgaugaucuucuugucagcacauccaaagugaggcuuuucuauguuugagagaauuugugugcacuucuaagaauuuggccgggggcaggaggaagcugaacuuguucucugcacaccugacugggauacuccagcugacucacuccuucaacacagaacccaccugugcaccaggaaaccagcucugaauagacggccaguggcuuuucucccaaaaccuccaucuucacugacaagacuaaacucccaaccccagccaaaggcagggauaagccucgacuccuuccuggcgcaaacaugggaacaaacccucccaggagccacgcugcgccugucaccugccugccuccuccuugggccccacaggcuuucuuuagccucugguuuugaaaaaauuuuaccuuucugacccauuuagguuuuuccuaccacuuguauuucauacauucucauaccuuuaacuuguaaaauagacuaugauauuauuauuacauaauguaauuaaggcauuaaaauauuccuacagucuuuagcaugccgaugcuuccaucuccuuu

SEQ ID NO: 269 - RNA, 1177 nt, Mus musculus
cucucucuuucuuuuugguuuuugagacaggguuuuucugugugcccugguuguccuggaacucgauuugcagaccaggcuggccucagacucacagagauccaucugccucugcuuccugagugcugggacuaaaggugugugccaccacaucuagcuuuauaguguuuucuauauuuguccauuagccuuuaucucaacagguucaugucaagaguaaaagugacaaaauccacaguuuccugcuauauucguuuaucccaagcagacagggaacuacagaagagucuguuacuaaacuucacuauggaaagccacugaggguuuauccugaaugucaguguguaaggagauacagccuucuguguuuacaaagcacagcagggcgacucacuuuccaaucccugccaguugcagagagcuguuucuucacuucucaacgcacccuacuugcucacacucaaaaacaaaccccacaaaaccucgguauaguuuuuacuugaaggguuuuccuuuugcacccaaaacuuccuggguugguuuuuccccuuggggccacagaaacccaugaccccguuuaugcuuccagucuauccguucaccacuguucacacagugguacgugguucuugugguguuguuuuugauucauucuuuuuuuggagucagccuagauuggucuugaacacaugacaaucucuugcuucagucaccaagugcugggguuauaaccaugauuuaaucaugccuuguaugaauucuagaauuuacguucaccuuaguuucuaaccauagccaagcaauuagauauuggaagaugugaaacaggucuugagacaaugcaacagguuguucagagaaccaguuuagggaagccuaaaccuccagaggcaggagcuggguaaaugaugguuacaucccacaaagggaggcacuuaggaauauuccauauuguacagcagagauuaaggucaacagaauguaaaacuggaauauauuucaucugcauuuuauggugacaaauaguccaucaaaacacacagcuucuagcugaaggugcuggccacacccugaguucuaacaguuccagcacucaggaggcagagacagguagacagccuggucuacacaucaaguucugggucagccagagcuacacuguaugacccugucucca

SEQ ID NO: 270 - RNA, 26474 nt, Mus musculus
uaugcgcuccaucuuuuuaacuuggguuccagugugccgagcagugugcacauauuugaaauccuccuaugggguugguuucugaauccuguuacuugaaacccagcaggaaggucuucuuuuaccccggagacgugacaacccaccgacaguuaacuucuguuuacauggaacucaggagucugcaaaccaugguaagacugcaaaccaccaacaaaaccacauauuaagccacgagagauaacagaacaaaaugaccuccucaaauaguguuaguuuauuagucuggaguucauuuuuacuuguuuugcaggguuuauguuauauuucugcuuuggacugggugagcuaaagauuguuuauacucaauguuaguacaggaagacuuaaaagauuuugccaauccaaucucuuuaucuuuuguuuuuaaauaugaggaaauagagacccggugaggcagagacuggccagagagcacagcaaauugacacaguuaaaaucuggcuuuacaucuacugaccugucaucuaguaucuacacuacacuagggagguaauauuuuuagaagcauggcaaugugauuguuuuucuccuuaaugaacaguuucugaacuaguguugaaacacccagaaaauaggaaagcauuuauuucauggauuuccugaaaggagcuggugugacaguccuuuauccucagacuagauaggucuugcuauuuuuauuugcuuuuuugacauucaaguugacauuuaaugauuguuuuucccccagaaaguagauaaaguugguuuaacccucuguuuccuuggagacgccuguguccuuccucuggccuucuuuccuguucuuguucccacuccacccauuugaucacccacccauuuuguuuguuuuucuuccaaguaacucaacaaaccuuguuuugguuuuugguuuugguuggguacugaauuaaguaaaagauaggccacuguuauucagaagauacauaacugauuagggagauaaggagauucaagauggaguugacaaguggcauaaaagaaaagauaucagaaugccacagaggauuacuuguuggccuuuuagucaagaucaaguggagaaugccuuagagguucuggugacgugccuuuaacagcuggcaaaacuucaugguggaaaugacauuugaacuuaaagcagugguucucaaacugugggucaaaaaucccuuuggcaaaccgcuaucuccaaaaauguuuacauuaugauccauacaguagaaacauuacaguucugaaguagcaaugaaaauuauuuuagggaugggggucaccacagcaugaggaauugguuuuuuguuguuuuuuuuuuggggggggggggagacaggguuuuucucuguguaguccuggcuguccuggaacucacucuguagaccaggcuggccucgaacucagaaauccgccugccucugccucccgagugcugggcuuaaaggugugcgccaccacgcccggcaugaggaacuguauuaaagggucucugcguuaggaaggcugagaaccucuuacucagagguugaggauuuuccccucauguuaauuuuuuuuuuuaauccugaauuaucuuuguuaaugagaugugccauacauugggugagagaagauauacacacccauaaguaucacccaaaucaagaagcagagccuucccagcagcuaccacguaugcccuuuuccaccauaauacauccgcauaucugcaggcaaucaacuuguuuccuggcuuuauggcuauguggauauuuuauguguauuugaauuuguauguggauuucacuuauacgugauuaugcaguaugugcggcauauagcugacauguguuuguagcauuuuuuccaauggcaaguuguauguauagucacaguucaucucugagagaguugauggggaucugaguuuuaucuuaugagauauguuaugaauuggguuggguauucuuccucuuucucuuuuucuuucuuucuuuuuucuuuuuugguuuuuaaagacaggguuucucuguguagcccuggcuguccuggaacucacucuguagaccaagcuggccucggacucagaaauccgccugccucugccucccaagugcugggauuaaaggcgugcgcccggcugaacugggcauucuuguaugcuuccuuuguggacacuuugcgcagauuuuaggaaaagaguuguuagccuuguagaacauaugcauggucagugauaguagauagugcuaguuuuucaaagugaucauggaacugaggcuuuugccugcuguguuggaaaguucuaguuguugcucauucuuguuaacccugcauauuuaucauaagucuuuauaauuuuagucauucuggcuaaacacgguauuucguuaaaguaugcauuucuauuuuucugaugcuguccaccuuaaccuugaauggucuuugugucaaugugacuuuuuaaggcuuuugccuacuuuuugaaauuaggcauuugucuuccuacugauuuguaauuuuuuuuuuugguuuuucugagacaggguuucucuguguagcccugacuguccuggaacucagaaauccgccugccucugccucuggagugcugggauuaaaggcgugcgccaccacgcccggcuguaauuauuuuuaaaaauuuuauuuauuuuauauaugugacuacacugucaaugucuucagacauaccagaagagggcauuggauuucauuacagaugguugugagccaccauguaguugcugggaauugaacucaggaccuuuggaagaauagucagugcucuuaaccacugagccaucaucucuccaguccccugauuugcaguucuuuauguagucuuacugauuccuuuuucugacacauacuuugcaaauaucuuuuccaagggugugguaggucuucaucuccuacuugugucuuuugauauguaaauuaaucuauuuguuguaucuguguuaggaauugaacccagaaccuuuccuauggcugacuaggcaagagcuuuaccacaccacuacucccauccccaguacagauuaaaaaaaguuuagauuuauuuauuuaauuuuaugugcaugaauguuaagcuugcaugugaguaugugcaucuuaugugugcuugguuuucuuggaugucagaagaauaccaugucugauaccuuggaauuggaguuauggaggguuguaaacugcuaugugugugcugggaacugaacccagguguucuacuuaacugcugcaccaucuuucuaguuccauuuuauuuuuuaaaaauuuauuuuuuuuagguuuuuuuuuuuuuuuuuuugagacagaguuucccuguguagccuuggcuguucuggaacucacucugcagacuaggcuggccuugaacucauaucugucugucucugccuccugagugcuggauucaaaggugagcaccacuacugucuggccagaaaugauuaauuucaauguacuauaauagucuuaaaaaacccuucaucugccggacguggugcugcacgccuucaaucccagcacucgggagucagaggcaggaggauuucugaguucgaggccagccuggucuacaaagugaguuccaggacagccagagcuauacagagaaacccugucucgaaaaacaaaacaaaacaaaaaacaucgucuuugccuucagagagccuggauuacaacauugccauuuacugacuuagacuguuagccuuaguuguuagcauacucggaaaaugauaauauuuuauacaggucauaguuuuauaagaaccugacaaaauaaauauggacaacggucacauagaauaguucacuaaguaguguugccauuaggcuuauuguuuuucggaaccccaggggagccgcuguugccugagggcacacuuguagggaaaguucagccaaagggguggguuuuuggcccaggauagugauggugacggcuacuacuuggacccuagaaucaccaagggcacacuccucuccucaagccucauguuuuacuugcuuugccucccguuuccggagcugcaacccugaggggacccucuucuccuuccucagccucaaucuaggugggagguggcgaaagcagagcgggaacauuguguaggcggaacucgagugcagcagugggaggcuuccgggggaacagcaccggugacgggucggcggagacagaaaagugcuggacgccgggccgaucauggaagcuugacaaccugcaggcaggcucugggaggccgagacaucggcgaagagaacagagagucggcggggacagguaggggagggcacgagggcaggcugugcuagucuaggcuggacuuccagcuucgcucaggcaggcguucccaagaaagccgauggccacaccgccccgcccccguugcaggacgccuggaggcuccuuacucugugcugguggcuacgagcaagaccgccaguccugacguccacucuaguuggcgauccucacauuccacgcgguggcugccuucggucugccccuuccgguagaggcugucuucuuugacucuuuuugauccaucagaauagcguccucucgagaugggaauucaucucuacucugucccuauccgccuucuugaggagccucccauuucaggagaaaacguugaucaucuuauucuauccacucucaauccccacuugcuuugcucuugaaguugagaucuucuccccaucccauccacaucuccuucccacccuacuucugcuuaguaucuugacugagagucacaucuauucuuuuuaguugugucugcuugggguggggacccggcuuuguuccuccuuuucuaacuuaaucuucucuccugucuucuccucacuugacuuuuucuccuuuuuucuucccccucuacucccccuccucuccuccuccuccuccuucucuuccuucucuuccucucccuccuucuuccauucuucagcuuuauccuccccccucuccccucccagaacucuuuguuuucuaguacuucacuuuuucuuuuucugacaggaccuccuuaaguaaccccaagugaggcaaucuacuuucuuuuccuaauauccugaaggggcugugcauaacuccacaggaaaacaguaucuuuugcaccaaacauguuuugacauguuuuuuuuuuuucuuuauucacugacacaccccuuuuucauuuuugucacacucuuucaguguguaucauuucuggaagacaggucuuacgugggauuccuuuagaguccauacacacucaguuuuuauucauauuauacaauugaggaacucuucuguaccuaacauucuccaagaugacaguacaguaucugcauuggagagaugguucuucaguuaagagcaugggcacccacaugauggcuccaagcaucuguaacuccagucucuggggaucugaugcccucucuggcuuccuuaggccacauguucaccccucauacaugcagucaaaaugcucucauagagaaaauaaauuaauuauaaaacaauaucugcacuguuuuccuuauauccuguuacaaagauuuuguacaaauucuggagucauguuuguuaaaaugucugaaucaucaggaggucaaagauguauuucccuacuuaaacagaauguauuuucuagauuugaauugucacugcuuaaguuuguaaauaguuuucccauagucuuugcuuaaaugaugcuuuauuucauuacugggcacauuacaaccuagugccuuguaugauaugcuaagcaucacauuguggaguuuuugauuaaaugaaguguggcucuugccuucacucuguuucugacgugugccugccugcaggugggauucuaaugacacaaaauuugccucugugcauggguagcauucuuugucucuuagcccaaaccugcaagugagguagauacacaauauucauaaauaaacuccuuuguguccuggucagcuuuauggacuuaaaagguaauacuacugagguaacagauagggaaguguacuuuagaauugaggacagaauaucuuuaacuccaggcugaauucuguucaucucacaaaguggcuauuguaucucaauucaggaguuguuuuuguggagauuuugaaguuagaguauccuugugucuaaaccagcuuaaauucacacuuuggaaaggagaagguaguggaugacugacccauuuuccuuuuggacagaucucaagaccagagaauggcaggugaacagaaacccucaaguaaccucuuggagcaguucauuuuauuagccaaagguaccaguggcucagcccucaccacucucauaagccaggugcuagaggcuccuggaguuuauguuuuuggagaacugcuggaguuggccaauguucaggagguaagaauaguuuucagacaguuucucuaucuccucuaugcuaugcuuuuuuugauucuccagguuuccagcgaauuucaacacugaagucuuguagauuuguuugguauccuguuaguggaaagauggggauuggugggccagggguggagaucaaggauaaugucuuagaguucuuuuagucaguguuccccuugaacuuggaucaauuagauugaguuguuagcuaucugaaagauaguaggaaaguccaaucuugacauaaaguaauauucuaaguguuugauuguuacagucagaguuuuucgucauuguauauuaguagccagguggaacaaagagaugcaaagcaauuuaugcuucucaaccuccacuugucacuuuagaugcuugaguuuucuuugcuuugagaaaauugcaggcauauguaagcacugaagggaguucucaggugauuccguguguugguggggcaggcucucuucccuuugccaccucaggcuucugccuauguaggauggcacuggcugugugcuucaccacugucuacugaucuaggcccagguacuucuuguuaaucauuuguaggaugcugcugaggguggcccugguguucuugguggugguggucugcauauaggaugugguuggcaucuguuagguaguuuaacuucauggccacaaugacacgauugccaucagcaaucucagagccaauuuuaaccugagcuguggguccaggcuauuugguucaguauguaugucuacuuauuucucuugauugggaaucuagagugcuuaugaccaccucacacauggcugaagauucgugaauuaggcuuauuuuuggggggauugagucucauguuuccuagguuggccuugauacuguuccuccugcugccaucuaccaucugcugggauuauaggagugugccacuguuuggguuaggcucauuuuccagcagaaaagaugaucaguguuucuucagguucgagaaaaaccugaaugaucaugccaaguaauuguuuuugugcuuguugaaaauuggcuaagaggaaaaagcaagcuggcaagaccuuauugacuuaggcagccaaagaacucuuggaguguuugcccuagagaaaauguucuacuccagcuaacucuguaguuaucugugugaaaaguaggggcuggauucaguggucuuuacugaaucucuuucacucugauccugggacuugaggaaguugauaacuugagagggaagcuugaggaugcuaacacacucacauugguacuuacuggugcuuagcaaaucaccuuuaucuguguacgguuuauggauuuccuguuuugagucaggaauaagcuaauggcuuuucacuguucugaaauuauggaugcaauuauuggaacuuuuuuuuaaagauagcuaaaauugaacaguguuguuccugucuugcuuuauggaguuugguaaguuggaugauaugcuguguguaugaguuacugaggauugaacccacagucuucugcaugcuaagcaggugcuaugcugcugaacuauguccaagcccucuuuuuacuuuuauuuugagacagggucuuucuaaguuucccaagcuggcuuugugcuucuucuguagcucagacuagacuugagcuagugauucccuucggauuacuggccuguguaacgugacucaguuguucuuugcauuuuuccuguugaugucuuuugccaucagcaucaaagaagcaauguuuuguuuuuguuuuugagacaggguuguacagcccuggcuguccuggaacuuacuuuguagaccaggcuggccucgaacucagaaauccgccugccucuaccuuccaagugcugggauuaaaggcauacaccacuaccacccagcuucaaagaaguaauuuaauggacauuuuuauuuggcucaggcugauaauucuguuacaguauagcuuuucugucacaccuuacauugugcuaauauuuccaguguuuauaauucauauauaguaucaaaacuuggaacuagccauacaguuugcucagaugugauugauaguaggugccaauauauauuaaguuuggggcuggcaagaugccuuaguggcuaaaggugccguauaagcuugaugaccagaguuugaucuucugagaaccuucauaaaggugggagaagaaaauggacuucaugcugggcgugguggcgcacgccuuuaaucccagcacuugggaggcagaggcaggcggauuucugaguuugaggccagccuggucuacaaaguaaguuccaggacagccagggcuacacagagaaacccugucuuggaaaaaaaaaaaagaaaagaaaauggacuucacaaaguugucugacuuuacacaugugcaaugcauauaugagcacacauucacaucauauacacauccugcaacaauaaaacaaauaugauuuugaacucuugauccucuuguauucaccugaggaauuacaggcaugagccaccaugcccaguuuaugcagugcuggcacugaaccuagcugcaagugcaggcuaggcagagucucccagccaucaggauuuguucuaaggaggggagaucugaggaaaacucggcaaacugccuccugugcauagaucuuugcgguggaguaaacucaagcaaaggggcagggagggagggaaggaggaaacuacuugagcaucuuauauguugugcaaaaugucuuucugaggaaggaagauucacuuuugaacuuaaguaaucuuguuuaguuuuuauccaagaaucagaguuggaaaggaccuuagagacuaccaaucaaguaguacagaacaaauggccaugacauguuuggcauuuggucauguguccuccauuagaauauugucaugguugguggaaauuuguuguguggugaacugaaccuuucuuuccucagcuugcagaaggagcuaaugcugcguauuugcaguugcugaaccuguuugccuaugguacauacccggauuacauaggugaguuggcugagacccuuuagaaggcuugucuuaacuguuggagcuguuucuaggguggucgagauuuggguuauaaugcgagugugggcaggguagcaggguguugacuugacuauaucuccaucuucugugcucugaaggcaacuuuauaaaaggauuucccugauaacuguuuaacuuccuagguguaagauggggagugugugugugugcaucuaugaacagagcccuuguuuaguucccagauuagugccuugagaacuaguguuuguagagcauucaacuagcaaaguaaugugauuuuuuuuuuuuuuuaauugagacagguuuuacuauauauauagcccuggcuagcauggaacucaguauacaaaacaggcuggcuuugaauucacauaccucugccuccuaagugcuggaaauaaaggcaugcuucaccacaccugucaguucaguguuuuaaauguuaucagaauuuuuauguuuuugaggggugguggugagaugccucagcagguaaggaaugaagccucucuugacagcuugaguucaaucccugggacccacaugguguagagagaggacugacuccugcaggguguacccugagcucugcaaugcacagcauguuaugcgagugagugcacacgcgcacacacuuuucuuuuuuuauuguuuugcuuugcuuuguugaccagguuauguauagaacaggcuugucuugaagucaaaacuuccugcuucauucuuuugagugcugagauuauaaggaugacccacaaugcccaacuugaguguuaccuaaauaagauugccauguugaagaaaauuggaaaagaauggaacauagaccauguuguuauuguuagacuugacacuagcuauuuuucccugaugcucauguuuugugugauauagauguaauuagaugaguaugcaauucauacguugccuuuuccaggccagaaaauauuuccaauccauauuuuccaaauuuauuuauuuuuaagucagagucuugcuguguugccuuaggcugacuucaaucucuggauccuccuaucucugccuuccaguuucucgucuuauaguuaugugcuaccauagcuguacucucuuauuuuuuuguuaguuuuucauacaguauauuuuaaucauauucuuuucuuuccuucaucuucucccagauccuucccaccucccuacacaccuaacuucauguuuuuucucuuucucaaaaagaaaacaaugaaaaucaaaaacaaagugaaaacugaaaccaaaacaaagcaaaaugcucacaaaaaccagagaguccauucuauguugcugugcuucuccugggcacggagccuguccuggaggaugguugauagacuagagccagugacgcuccauuggagaaaacucauugucccuuuuccagcagguaucaguuacaaguaguuucuugguuagggacacaaccuugugucuauuucccaucuccauguuugaauuuugccugguuugaaccuguacagguuucgugggugcugucauagucucuuaaguucagucugcauccguccuguuaaaucugaaugauacuguuuccuuggagucaccuaccacuucuggcucuuaaaaucuuuccaccuugcugucgguggggguacacaccuuuagucccagcacucaggaggcagaggcaggcggaucuccaaguuugaguuucagccuggucuacagggugaguucuaggauagccaggacuccacagagaaacccugucucgaaaacuuuaaaagucucuccaccucuucuucugcauagaucccugaaccccgaaggaagguguuugaugaagacauacucuuuagggcugggugcuccaaagucuuuccuuuguacauuguccuguuguggcucucuguguuaauuaccaucuccugcaagaagcuccucugaugaggacauugaauggcuuuagaugauaaucugaaaucgggggugggcuagcacggugggucagcagagaguagcauugccucugcucgguccccagaacccagaguggaaaagaagaccugacuuuguuguucucugaccuccacauccacaugcacaguacagcaugugugcucaagcucacauugucuacaccugcgcaaauauaguaaauauucagaaacaagaaucaggagugagggauuugcauauccaaauguuaccuuucuuucuaguucauuauuucggucugucuuaguuucauuuuccuuuucuucucuucucucucuucuuugauaguauaaaagugggcugguccucagggcucccuccucuguucuuuggcauuucuuucuaucucauacauucuggguugcugucacagugaacaguuuuccacuuccggguacccgaguacgugacguuucuuugcccugcucuuuguuguacugucugaggcagcgaugcagggacucuggaggagacugccugcauuagaggcuagcucugcuucuacuaguuguaccucuuaguggauuaaaugauuaugcauaccucaguuuucuuauccguaaaauaagaguaauuauagaagucuuucuuuaggcuaaauauuuccaggauuuagaauuuugaggacuuaaaaagguaacauggggcuggaguuaagaguccaugcugcuuuuguaaggacuggaguucaggccccagaacaguagcaucaggcaguuguauugacaucuacaacuccaguuccuggggucuaaugcuucuggccucugaguguaccucuacacaugugcagauacccacacacagacauacgcacagaauugaaaauaauauuuuuaaagaaagguaaugugguauauguaccuuuuauguaagucucaugggauauaggcaauaguugaaguuaaacauauauauaauuuuuccacaaaacaagugaauacucacaaguaggauuaaaaacaaaaccacccucaguucacgguaggaguugcuacuugaugcauuucaacacaaugcuuaggagaaaggacucagcugggcauaaguggugcaugccuuuaaccccaggagaagcaggcguggcacacaggcuuuuggcacgcuguauguccuuaggcagagugggcagcuuugugcugagcgauagggaaacuugcuuuguuuguuuugggacaaggucgcuagcuuguuugccuuaaguuccgaaguucugaucugccccacucugcuugccaagugccaccacacucagguggaccucugaguucaaggccuuucugaucuauagagugaguuccaggacagccagggcuacucaaaaaaaccccugucuugaacaacaaacaaacagaaaaauucaguuuuuggaauccagaauuaugguuacgagguugaggacauuugaaaucugucuggcgaguggcugggagugagcugugugugcgugcgugugugugcgugcgugugugugugugugcgugcgcuugugugugugugugugcgcgcgugcgugugcgugugugugcacgugugcgugugagagcaucuggcuguguugguauaugcagcuacugcuuugaucgucaaugucaguacuaaaaguucugcucagccucaagguucgucuccaacacuucucccaugaaaccuuuuuuguuuuuugauucucccaacugagauugaauuuguucacuuuguccuucuguccccuuuucuucuucucuuccuuuagccuuuucuuuuugucuuccuuguccucugccugucuguucugguuccuuugcauuuauagcuauugcaguaucugauuguaagacugaggcugggcauggugggucacaccuauaauucuagcuuaaagcagguggaugaggaguccagugucacccugugucaccccuuuagaaacaauuauuuaaaccaaacuaacgcugaugacaggucugggguuauucaguugugucacuccacauagugagugcacuuggagcugugugguacagccccgucaaagcccagauucccuguacgacguguucacugcacaugccaugcucaaugaaggcauguugaacuuaacugagcuucacaagggcagcagcaguauuccauuaagagaguuggcucugguguuuuguuuguucaugccuuguuuugauauuaaacuccugagucuuugcuuucuggaagaagcacgugcucuuccagagaagguagaggcugcugauggaggguugcugagugagcaagugagcaaaugcgcagucacgacagccaucuaguaguagguuuugugggggaguugaugaguuuauccuaaaaauaaauccuaauuuuauuuugugucuugauuuuuguggugggugggacugaacagccaacaaggagagccugccagaacugaguguggcucagcagaacaagcugaagcaucuuaccaucgugagcuuggcaucaagaaugaagguacugucgcaaaccaugcuugucuucaucugaaccccagcucagcucucccguuggcaucaauggaagaacuugcuaguuuuauccuaaaugcuuggcguguacuuggcagauaaaaagauaauuaaaacauguggacagucacucccuguucuguuuuggaaaagcaagcccagcagugacugauugguugagcaggucucucucuguucuggcaugcuguggaacuugaugcagagaaagcacuuugucauauuaagaggggccugcuauuuaaaugcuuuuaaaagaugaaucuuuuuaccuggguggugguggcgcacaccuuucaucccagcacucggaggcagaggcagaggcagagaggcagagagaggcagagaggcggagagagagaggcagaggcagagaggcagagagaggcagagagagagaggcagaggcagaggcagagaggcagagagaggcagagaggcggagaggcagagagagaggcagagaggcagaggcagagaggcagagaggcagaggcagagaaagaggcagagaggcagagaggcagaggcagguggacaccuauaaauucgaggcuagccuggucuacagaguaaguuccuacaucuucauauagcaggugucucuuugacuguuuuuguuaugguaauauagacucacuauguauucacaggcuauucucuacucacugugacuguagcauagguugaaaccucacagucauggcuguccuaccucagccucccacaugagggugacaggugugucacaccacaccuguaagaaguaaggcuucuuucagcuaguuagcaacuuccugagucuccuagugcacagguaaucauacucaugcaggaggaaagacgugcuguguugggcagaguggacuuuuaguuuaugauaccgggaaaugaacuccaggcuugugcauguuagcauguuagggaaauaacuuuuuuuuuuuuuuuuuuuuuuuuuuuuugguuuuucaagacaggguuucucucuguagcccuggcugucgucccucuguagaccaggcuggccuugaacucagaaauccgccugccucugccuccagagugcugggauuaaaggcgugggccaccacugcccggcuguuaauagcauuuucugccucaucugcucacuuuguuuuuauuaauuuucauaugcuaacacuaggcucuaaccuguaagauuccauggcgcacuugaaguucucugcccagcugauuuggaagaagcccgcagccaauagcuuucaccuuuuaacaaagaggcucaccucucugcucaccucuguccucaucuccucuugucugauuuugcuuacaugguuuauuucuaaauuaguacuaacagcucagggauuguagaauauagguuauuagauauucugcucuucuuuuuuuaaacccuuuuucuuucuuuuuucaaacuuuauuuauuuuaugaguacacugcagcugucuucauacacaccagaagagggcauuggaucccauuacagauaguugugagccaccaugugguugcugggaauugaacucaggacuaauggaagagcagucugugcucuuaacugcugagccauuucucagcccuguucuguucuuuuuggucauugguacggggcuguuguuggagauuugauauugguugcagaaacaagcacacacuucagaauaaccugugauugguuuuuuguuguuguuguuguuguguguguuccguuucguuuugccaugccucuucuggguaaacuaugcaaugucaguguuuguggcuugcaaucauucagcauuuuaugcaaagucugcaagcuuccagaagguggcaguguagcacaugcuaagcuauuucucuuuccuguggaagggggguucugcaucaugagaguguggauguggcagcugagagcugggugaagucuaggacauagagaacuggaaagguaccuccuugggugcuacaggauguuguugagugccauagguuccacaguaauaauaaucucucacuaucucagauuuuggugauuaccacugcccugcaucguauaaacagagucuccauuauuaccuguguggguaaugcuugaaauuuuuuucaaugcuugccgacugucauaugaccuauccacaguguauccccuacucugugcugcugaaagaccuggagaugaggaaucucagggaacuagaagaccuuaucauugaggcugucuacacugacaucauccagggcaaacuggaccagcgaaaucagcuccuggaaguggauuucugcauuggccgugacauccggaagaaagauaucaauaacauugucaagaccuugcaugaguggugaggcugggagauggagggagaaucuaguagguccuuugugccucucucugcagcacugugacuuucagaagugagcuugaggaagccaaagcuggggucuuuggacacugaaacagagagugggacugcauuugugauuacagcuguguggcauuaggaagcuuggaaagauuccuggugccuggcuuauaaaauugauuuuaaaugcagcugggcuguuuaacagugggcuauaaaauauucauguggaguuacagguagagucucugcguucugacugugcagcacuaaaucugcaccuuauaaacauacaccaagagcaggaaguuaguguuugccagugacauguugagcuaguagugcuagugaagcauuguggggaagacaacugugaauaggccuuugugaucuggaacaccgaugcauacaauauuugacagucaaggcagcuggguguggugguacauuccuguaaccccaauccuagcacuuaggaugccaaggcagaaggauugugaguuggagaauguaucucuuuauucuccccuccaaugaauaaaaggaauuuaguaaaaagaacugagacuuuugaguauauucuuauuuuaguagaauuggaugcuugcaaaagugauuacacgauuuauauuuguuaugagcuauuuauuuaagugauuuggagauuaugaaaccagagcauuuuugggaagugugaggaaguuuugaggaagagagcauuauugagaguggagagauuguccccacauaggcguguggcauguuguaugucacuaggcagagugggcagcuuugugcugagagauagggaaacuugcuuuuguuuuuguuuuaucaaaacaggccuuguucucuagcccaggcuugccuggaacuaacuauaacuaugcauuccagguuugccuuaaagucagauuugucugacugccucccaagugccaccacacccagauguuuuaauuuuauuauauauauaaaauaggcaucuugcuuacauguauagaagugcacuguguguuuaucuaguacauagaggucagaagagggcgucagauucccuggaaccggaguugugcaugaucaugagcuaguguguggguguuggaaacugaacuuugauccuguguaagagcagcaauuguccuaaccacugagucaucucuucagccaccagaagagauucucagagcuccuauuuauauguuacaggugggcuggaaauagaauuauuguccugagaagguaaaaacauggcagaauguuggacauuuugcauaguaguaaacaguaugugaauuuucauuauauugcuuuucaaaacguuuuuuauuuuauaagacaagaucucauuuuguagaccuggcugguaucaaccaggcuaaccguaaaaucagaggucugccugcuucugccucugcuuccugaaugcugagauuaaaggcauguguuaccaagugagaagggagaagugauuguuaacuaggaaauaacuucaaauucuaaggaaaaaggcaaucucuaaaauacaacauuuauuuuuuuuucuuuuguagaaagggaucagucagugucacuuguacuuugucccucuuucagucuuagucuauaaaacuguuucuuaugggcugcgaggacuggaaauuagagcuguaguccaagaagcugcccaaaagccuccgcugugcccuuggccuguguuacauauuuagaugaccuuguugggaaggagggaggggaccaacacaaccaccuggcagcccccugcuaaagaaaguccuguaaagugcuggaaggguuuggagggaggagacugccugggcuucacugcagcucagggcuggcuuuucccauugcaggugugacggcugugaggcaguucucuugggcauugagcagcagguucugagagccaaccaguacaaagagaaccaccaccggacucagcagcagguggaagccgagguaaagaaaaccagggcauuuuuuccuuuccuuggggugugccuaggaauuaguuugcagugccuucauguugucauuacuuuggugugaguauaacaaauagccaguaaacacgccuugggcuuaguacugggauauagggaguuagcagggagugagcagguuuagaguguagaaugcauacaucugcacuguacauaugauguugcagcuacugaggagaagaaauguugugcugugugagagauggcuaagugguuacguggacuuacugcuuuuaccgaggacuuagguuuggcucucaccacucacacagcagcucacaaccacccaaaacucuaguucugggucugcagugccgccuucuggccuccaugggcucuuacaugcacauguacacagauguacauucaugcacacgcacaugcacaugaauaaaauaucaaaaacuacuaaacuuugaaauaaaugugaggaagaggccagguuaccucugccauaccaguuaaaauaauacauuaccuacuggccuucuagaaguuagacagacugaugugaacagugagggcaggacucagggcuuuguucauugccuggaaccaugagcucaucuggcugagccauacuugagggcuuacuguaugcucaccugaacacagcacaucucuacagagguaauuaugucauaugcuccuguguucuucuucuguuacgcuuggcccacauuauaaccauuuucucaauugaauaggugagauacauuuuuuccccauuugucuuuaaacuacauuguuguucccagaggggagaaacuagauguuuuccuuccaagucuuuagaacaacaauuuucuggagaguugugccuuccaaagccccccucugaguucagucagcccuaugacaaacugccugagaauucucuuguauuagccuuuuaucaaaaaccauuauuaaguauauucaguguaccuggggagacauaaugcaacaguagcauucccgggcuuugcagugucuccgagcagcuacucuggagggaaaggaacgauggcuugcagcaccacaaagccccuuucauugcauuugcuuuuggaaucuauuuuucuuuauauuugaaugugccuaugucugguguuuugugggauauuaauaucuagcuguuguuacauguucacaaaauaggcuguguuccacccaacuuagguaauagaacaagaguaagugguuugguuuuguguguuugugugugugucuguguguguguguguguguguguguguguguguagaaaaucccucaggaguuguuacaguguguuaaaacugugucuccuggguaccucuuagagagcaguucucaucaucucucacgucucuguagcauuuccuguggucuuggcuucuguuugcuuucuuugcuuuugcuuacuuuucaaaaaucagcccgggcccaggcaggcuucaaggcuuucuacccuccacccucacucagccucuggaguucugggacuaucuuaccuguuugucucccacaccugcccugucuucuucccugucucuuccccaaaggcaccuuucugcgccggggagcucuuguuucucgcucgucuuuagggucucgaacauugucagguuacaguuuugugaacagguguagcccacuggaaugcuccugggcccugugcuuugaaaagcucuacaaacccuagcuuauuugggugaaggagguggggcagagauggucuauaagccaguccucugaggaaggaagucagaaggacccuggucagauuuaugugaagauacauuugugggaguacuuguuaucaaauuggggggggggagaggggcacuagauaccuucaaaucuuugaggcuaaaguagguuugacugguuugggugggcagccugaguccuggauguauccacccucaauccuguacugccuggcaaagcacuaguugucauugucugucuuucugucuguugucugccgcccucaguguguguguauuuuguguccaggugcauaggucuguaggcucauagaugccagagagcugccucagguaucauuccuugcagacucuacguuuuuugaaacugggucucucauuggccuggaccucuccgaguaggcuggucagugaagcccagggagcugccugugugucacuaaacacugggaguagaaguguguuccaugcuuggcauuguggaugaagaucaaauucgaguccuugugcuugcgugguaaccacuuugcuggcugugcuauuugcuuagccuacuagaugauuuuugcuuuguuuuuuuguuuuguuuuguuuuguuuuguuuuguuuuguuuuguuuuuguuuuucaagucaggguuucucuguacagccuuggcuguccuggaacucacuuuguagaccaggcuggccucgaacucagaaauccuccugccucugccucccaagugcugggauuaaaggcgugcaccaccacgcccggcagaugauuuuuuuaaaaagcagaguucugguuuuuauuaaaaggcuauuuauuuauuuaugaaguauggucucacuauguuguucuggcuagccuggaacucacuguguagaccaggcuggccuugaacucacagagagcuuccugccccugucucccaguauuaggauaaaaaguaugugccacuauggcuggucaaagacauuuaaaaaagagauuuuuuuuuuaaacuuuuuuuuacuuuuguuuuuuccagacaggguuuuucuguuguguuggguguccuugaacuugaucugcagccuagacuggccucagacucagagauccaccagccucugccuuccaaguacuggaauuaaaggcaugccuggcuuucuuuauuuauguguauauuguaugucuguaugaaucuaugccauauguauuugggugccugaggaguccagaagaggaugucagaucccuuccaacuaugggaaguugugaguugccagaugugggugcugggaacugaacuggguuccucugcaagaucaaaauguacucuuuuuuuuuuuuuuugaguuuuuucgagacaggguuucucuguguagcucuggcuguccugaaacucacucuguagaccaggcuggccucaaacucagaaauccgccugccucugccuaccgagugcugggauuaaaggcgugugccaccucucccagcugaaaauguacucuuaacugaccugucucuucaguucuaaucugaagaaacuuuugaacaccaguaaaaucuauccccaaaucuaucacaaaauccugaaaaacacugaaacauugcagguucaagucauuuaagauacuggauggucagucuacguaaugauacugauuuaguauaaaauaugcaucauuuugaucuggaaaucucucucaaagagcagaucccacacaauuaaagaugcuuccacagcaugcagugguaaauaguaggcuguuuaaacuaguaccaacacacuacuuagacuauaaacacauggcuggggagauggcucaucagcaggcaagagagcucacugcucuuccagaggacucagacucaguucacggcacccuggguggcucauaacuaucuauaacugaagcuccagggaaccaaugcucuccucuggccucuggagccauuuuuccagcuccuaguuccaugcuuuggugaacucauuuccauuuauccaugagcagccugcuuugucuuccucuagguuuuugaauaugauuucagauuuuguugcagaggauuugggccgcuucucugggugguccuuauacuuagaacaggacucagugaguuucagggaugaacacaaguuuuguuucucccuccagguuagcaacauuaagaagacacucaaagcaacagcauccuccucagcucaggaaauggagcagcagcuggcugaacgggagugucccccccauacugagcagaggcaacccacuaagaagauguccaaagugaaaggucuggucuccagccgccacuagggccggcuggggcagcuggcacucagcaggccugggucaggucgggaggggacacccagggccuauuuccgucccucucuaacugcagugaguuccagaucugcccaccccucaccaguaccuccccauccauugguaccauugcggaaaaugauugcuccucccuugccuccuucccuaguuguucccuucagacucaggggcucaauggaugccaucguaacaggguccagcacugcccggcuucccugcagggguccuugucucugugaugggcuaccucccucccaguuguucuuugcucucugucauuuugucaggcugguccuaagcuggaggcaguuuacccagccccaagggaugacuguggagguggcuccucucugagugaagagggggccuugcuucuccagccccauguaccacaguauccacaauggugcaagugucucuagccagguagccacauguccccucuccugccuuaccccuguuggcagugccaguugaggccauggagggauguggugcugggcuauguuuacuaaaccuuuggguuuucagccucuuaagcccagccaggaucucucaucaaguuggggcacugggcugacuaaccccuggugucugacaccaguggagggugcuugggucugggggcagcagaagguguuucuccuagcuugguguccucugcuggcuacucuugcugcugucucugacugcacagccuugauuuggcauuucgacccagcuacccacugggauugucugccaacaauugcucucccaagaucuuucaugccuccuggcugccccugggguaggagugguggugcccaagccccucagacuggugaaggaccauugcugcuucuuucucccuccuugucuggcgacccagagcccucugaugacaucauacuccacuccuggccagagaaaaggacuugacuagacuuucugaacuugaacaguuucagguuauauuuuaauuuuuuuuuuuuguacagguugauucuaauacauuucaacaugcuuuuuucuccuuuugugucaauauuuguuauaguccaaucgccggggaugucucacuugguuggaggguguguguguagguguggaggauuauaugggggugggauaggguauguguauguguggagggcuuggggguauggagggguguguguguguauguguguguguauuuuguuuccuaaggggagauggagacccuguacugauuuaaaccuaauuaaguuuuaaaaaguacauuuuaggaaaaaaaaaaaaagaaaaaagaaaaguguagauuugacauaugcgacuguggaguaugggguuguacagcugguggguuuggagggcaguaauuuggguuguucagagaaaugugaugcuauuuuaguggcaugguuaaaaaguggguugauccaguguuaaaguauuccuguguuccuuauuugcugguccauaugcccagauagcacuauaccuaacuguagguuaaguuugauucccaaaauguguuugaucacucccuaaucacaugcucuguggaagaggggcucuguuauuaaauaaauguggcacucccucccugcauuccauauccucacugaaguucauuaaugaggucuugggaggcaucucugggaugaagcccaugcccacauugaucucacuacuaggucuuuguggguauugaucuuucuaaugggauacguuuuggguaaguuuugguaaacaaguucuucucaaaaaaaaaaaaaaaaaaaaaaaaacccuaagaguguagaacaccucccagccucauagauauucccacuacucucucuagaccccagacaggaacacacugugagcaaguuacuguucaucuuuuucccaacuggcaagguaauuuugaaaugcaauuuauuuuuuaauuuaauuuaauuuuuuccaaggcagggaggguuucucuguguaaccccagcuguccuggaauucacucuagaccaggcuguccuugaacccagagauccaccugagagcaucggccaggaaaacacagcuauaucuugccuccauuguucuuacugugaugaguucaguuuugcucccuggaccaauuuuucuccaccccaccauuucuuauucuacaucuuccaucuccagugccuguaugugacaaagaauuuuauaucccagggagauccuuucugguuccaaugucucuuucuaaccaucagcuuuuucuguuuuuaacaagcaggcuucuugacacuugccugccuuuucucucucugcuuccuccuccugccuucgcccccccccccccccccagcugcuuuuucuuuuucaucaaggagaccauugaccuccagcuuucugaccggcuugcacugcugaguguucucucagcuuucauggcacugaugcccccaggccuuuccuguguuucuccgccagccuuaaaaguucuccagggauguguuagguugcuuucuguugcuaugacagaaauaacuugagaaaacgggaagcuucagucaauggucccuggccuccauuguaucugggccguggcggggcagagcaucaugguggagcugaacugcuuauuuuuaggcagcugugaagaaaaugaaaggaaggaccugggacaagauauaucuccccuccagccaggcuccaucccauaucaucuccacugcccuggaccaaaccacaagccuucagggaggagagcacauggcagauuccgacucuaacacagacuccagugucugugcuugcuggggguccacugugacccuucuuugcuuguacaugcccuccauagguuguguggcucaccucuaacacccagcucuccaucugugguuguucacugugagaagcacagccagcuggccauuuccccauguguugucaauaagugaaguuacucauccaaguuucuugugguugccauaauaaaacaccucaggccaugugucuuuaacaacagaaucaauuuucucacaguucuggaggcugcgaguccaaggucauuguguuggcaagaucaauuucuccagaggccugcguccuuugugugcagacgguuguccucaugucuucucuguccucacaggaccuuuucucuguuuacagaucaaguucuuccuucaugaucucauuucacucuuuccucuucaaaggucccauucuaaaauacacucaaaaaggguggaggccuucaaaaugaauguaggcacaauacaguucauaauagucuuuaccuaacugagaauuugaaguuuugauucaaccauaucuuucuuguuagaaccaauccuuuuccuaccucccuugccacuccaggaacuugaaaacugcucaucagcauccuuacuggguuuacuugugugcuaggaaugcagccagaggucagaacauauaagauuacaggagagggaagccaacugaugcuuguaaucccugcacucaaagugaugcaggagacuagccuaggacuagccuaguuuacauaaugagcuccaggccagcuugggcuacaagugugagaguccucaaaacaacaggauagauggaaagaaauuagagaugaguagaaguaaacugccuagucaaaauuacaaauccaagcuuuuuguuuguuuguuuguuuuguuuuguuuuguuuuucgagacaggguuucucugcauagcucuggcugucuguccuggaacucacuuuguagaccaggcuggccucgaacuuagaaauccaccugccucugccuccugagugcugggacuaaaggugugugccaccacgcccggcucucaagcuuuuuuaaguauacaaaaggaaaagggaaaauacccaucaaaccaaugaaagacaaaugagcagagaggaccacaagagcuuaggaucauuaguuuaaauggcaauuuaaauugacaacaguuugcuggaaagaaauggaugaucauaauuuauucaugagacaagguaaucaagaaauuaaagauugggaaggcugcucguggucaagccagaugaccugaguucuguccuggacguauguacgcuacugacuucuucaaauuguuuucuggcuaacaggagcaccccauggccugcaggcccacacuugggcacacgcacacacuaaagugua

SEQ ID NO: 271 - RNA, 26474 nt, Mus musculus
uacacuuuagugugugcgugugcccaagugugggccugcaggccauggggugcuccuguuagccagaaaacaauuugaagaagucaguagcguacauacguccaggacagaacucaggucaucuggcuugaccacgagcagccuucccaaucuuuaauuucuugauuaccuugucucaugaauaaauuaugaucauccauuucuuuccagcaaacuguugucaauuuaaauugccauuuaaacuaaugauccuaagcucuugugguccucucugcucauuugucuuucauugguuugauggguauuuucccuuuuccuuuuguauacuuaaaaaagcuugagagccgggcgugguggcacacaccuuuagucccagcacucaggaggcagaggcagguggauuucuaaguucgaggccagccuggucuacaaagugaguuccaggacagacagccagagcuaugcagagaaacccugucucgaaaaacaaaacaaaacaaaacaaacaaacaaacaaaaagcuuggauuuguaauuuugacuaggcaguuuacuucuacucaucucuaauuucuuuccaucuauccuguuguuuugaggacucucacacuuguagcccaagcuggccuggagcucauuauguaaacuaggcuaguccuaggcuagucuccugcaucacuuugagugcagggauuacaagcaucaguuggcuucccucuccuguaaucuuauauguucugaccucuggcugcauuccuagcacacaaguaaacccaguaaggaugcugaugagcaguuuucaaguuccuggaguggcaagggagguaggaaaaggauugguucuaacaagaaagauaugguugaaucaaaacuucaaauucucaguuagguaaagacuauuaugaacuguauugugccuacauucauuuugaaggccuccacccuuuuugaguguauuuuagaaugggaccuuugaagaggaaagagugaaaugagaucaugaaggaagaacuugaucuguaaacagagaaaagguccugugaggacagagaagacaugaggacaaccgucugcacacaaaggacgcaggccucuggagaaauugaucuugccaacacaaugaccuuggacucgcagccuccagaacugugagaaaauugauucuguuguuaaagacacauggccugagguguuuuauuauggcaaccacaagaaacuuggaugaguaacuucacuuauugacaacacauggggaaauggccagcuggcugugcuucucacagugaacaaccacagauggagagcuggguguuagaggugagccacacaaccuauggagggcauguacaagcaaagaagggucacaguggacccccagcaagcacagacacuggagucuguguuagagucggaaucugccaugugcucuccucccugaaggcuugugguuugguccagggcaguggagaugauaugggauggagccuggcuggaggggagauauaucuugucccagguccuuccuuucauuuucuucacagcugccuaaaaauaagcaguucagcuccaccaugaugcucugccccgccacggcccagauacaauggaggccagggaccauugacugaagcuucccguuuucucaaguuauuucugucauagcaacagaaagcaaccuaacacaucccuggagaacuuuuaaggcuggcggagaaacacaggaaaggccugggggcaucagugccaugaaagcugagagaacacucagcagugcaagccggucagaaagcuggaggucaauggucuccuugaugaaaaagaaaaagcagcugggggggggggggggggcgaaggcaggaggaggaagcagagagagaaaaggcaggcaagugucaagaagccugcuuguuaaaaacagaaaaagcugaugguuagaaagagacauuggaaccagaaaggaucucccugggauauaaaauucuuugucacauacaggcacuggagauggaagauguagaauaagaaauggugggguggagaaaaauugguccagggagcaaaacugaacucaucacaguaagaacaauggaggcaagauauagcuguguuuuccuggccgaugcucucagguggaucucuggguucaaggacagccuggucuagagugaauuccaggacagcugggguuacacagagaaacccucccugccuuggaaaaaauuaaauuaaauuaaaaaauaaauugcauuucaaaauuaccuugccaguugggaaaaagaugaacaguaacuugcucacaguguguuccugucuggggucuagagagaguagugggaauaucuaugaggcugggagguguucuacacucuuaggguuuuuuuuuuuuuuuuuuuuuuuuugagaagaacuuguuuaccaaaacuuacccaaaacguaucccauuagaaagaucaauacccacaaagaccuaguagugagaucaaugugggcaugggcuucaucccagagaugccucccaagaccucauuaaugaacuucagugaggauauggaaugcagggagggagugccacauuuauuuaauaacagagccccucuuccacagagcaugugauuagggagugaucaaacacauuuugggaaucaaacuuaaccuacaguuagguauagugcuaucugggcauauggaccagcaaauaaggaacacaggaauacuuuaacacuggaucaacccacuuuuuaaccaugccacuaaaauagcaucacauuucucugaacaacccaaauuacugcccuccaaacccaccagcuguacaaccccauacuccacagucgcauaugucaaaucuacacuuuucuuuuuucuuuuuuuuuuuuuccuaaaauguacuuuuuaaaacuuaauuagguuuaaaucaguacagggucuccaucuccccuuaggaaacaaaauacacacacacauacacacacacaccccuccauacccccaagcccuccacacauacacauacccuaucccacccccauauaauccuccacaccuacacacacacccuccaaccaagugagacauccccggcgauuggacuauaacaaauauugacacaaaaggagaaaaaagcauguugaaauguauuagaaucaaccuguacaaaaaaaaaaaauuaaaauauaaccugaaacuguucaaguucagaaagucuagucaaguccuuuucucuggccaggaguggaguaugaugucaucagagggcucugggucgccagacaaggagggagaaagaagcagcaaugguccuucaccagucugaggggcuugggcaccaccacuccuaccccaggggcagccaggaggcaugaaagaucuugggagagcaauuguuggcagacaaucccaguggguagcugggucgaaaugccaaaucaaggcugugcagucagagacagcagcaagaguagccagcagaggacaccaagcuaggagaaacaccuucugcugcccccagacccaagcacccuccacuggugucagacaccagggguuagucagcccagugccccaacuugaugagagauccuggcugggcuuaagaggcugaaaacccaaagguuuaguaaacauagcccagcaccacaucccuccauggccucaacuggcacugccaacagggguaaggcaggagaggggacauguggcuaccuggcuagagacacuugcaccauuguggauacugugguacauggggcuggagaagcaaggcccccucuucacucagagaggagccaccuccacagucaucccuuggggcuggguaaacugccuccagcuuaggaccagccugacaaaaugacagagagcaaagaacaacugggagggagguagcccaucacagagacaaggaccccugcagggaagccgggcagugcuggacccuguuacgauggcauccauugagccccugagucugaagggaacaacuagggaaggaggcaagggaggagcaaucauuuuccgcaaugguaccaauggauggggagguacuggugaggggugggcagaucuggaacucacugcaguuagagagggacggaaauaggcccuggguguccccucccgaccugacccaggccugcugagugccagcugccccagccggcccuaguggcggcuggagaccagaccuuucacuuuggacaucuucuuaguggguugccucugcucaguaugggggggacacucccguucagccagcugcugcuccauuuccugagcugaggaggaugcuguugcuuugagugucuucuuaauguugcuaaccuggagggagaaacaaaacuuguguucaucccugaaacucacugaguccuguucuaaguauaaggaccacccagagaagcggcccaaauccucugcaacaaaaucugaaaucauauucaaaaaccuagaggaagacaaagcaggcugcucauggauaaauggaaaugaguucaccaaagcauggaacuaggagcuggaaaaauggcuccagaggccagaggagagcauugguucccuggagcuucaguuauagauaguuaugagccacccagggugccgugaacugagucugaguccucuggaagagcagugagcucucuugccugcugaugagccaucuccccagccauguguuuauagucuaaguaguguguugguacuaguuuaaacagccuacuauuuaccacugcaugcuguggaagcaucuuuaauugugugggaucugcucuuugagagagauuuccagaucaaaaugaugcauauuuuauacuaaaucaguaucauuacguagacugaccauccaguaucuuaaaugacuugaaccugcaauguuucaguguuuuucaggauuuugugauagauuuggggauagauuuuacugguguucaaaaguuucuucagauuagaacugaagagacaggucaguuaagaguacauuuucagcugggagagguggcacacgccuuuaaucccagcacucgguaggcagaggcaggcggauuucugaguuugaggccagccuggucuacagagugaguuucaggacagccagagcuacacagagaaacccugucucgaaaaaacucaaaaaaaaaaaaaaagaguacauuuugaucuugcagaggaacccaguucaguucccagcacccacaucuggcaacucacaacuucccauaguuggaagggaucugacauccucuucuggacuccucaggcacccaaauacauauggcauagauucauacagacauacaauauacacauaaauaaagaaagccaggcaugccuuuaauuccaguacuuggaaggcagaggcugguggaucucugagucugaggccagucuaggcugcagaucaaguucaaggacacccaacacaacagaaaaacccugucuggaaaaaacaaaaguaaaaaaaaguuuaaaaaaaaaaucucuuuuuuaaaugucuuugaccagccauaguggcacauacuuuuuauccuaauacugggagacaggggcaggaagcucucugugaguucaaggccagccuggucuacacagugaguuccaggcuagccagaacaacauagugagaccauacuucauaaauaaauaaauagccuuuuaauaaaaaccagaacucugcuuuuuaaaaaaaucaucugccgggcgugguggugcacgccuuuaaucccagcacuugggaggcagaggcaggaggauuucugaguucgaggccagccuggucuacaaagugaguuccaggacagccaaggcuguacagagaaacccugacuugaaaaacaaaaacaaaacaaaacaaaacaaaacaaaacaaaacaaaacaaaaaaacaaagcaaaaaucaucuaguaggcuaagcaaauagcacagccagcaaagugguuaccacgcaagcacaaggacucgaauuugaucuucauccacaaugccaagcauggaacacacuucuacucccaguguuuagugacacacaggcagcucccugggcuucacugaccagccuacucggagagguccaggccaaugagagacccaguuucaaaaaacguagagucugcaaggaaugauaccugaggcagcucucuggcaucuaugagccuacagaccuaugcaccuggacacaaaauacacacacacugagggcggcagacaacagacagaaagacagacaaugacaacuagugcuuugccaggcaguacaggauugaggguggauacauccaggacucaggcugcccacccaaaccagucaaaccuacuuuagccucaaagauuugaagguaucuagugccccucuccccccccccaauuugauaacaaguacucccacaaauguaucuucacauaaaucugaccaggguccuucugacuuccuuccucagaggacuggcuuauagaccaucucugccccaccuccuucacccaaauaagcuaggguuuguagagcuuuucaaagcacagggcccaggagcauuccagugggcuacaccuguucacaaaacuguaaccugacaauguucgagacccuaaagacgagcgagaaacaagagcuccccggcgcagaaaggugccuuuggggaagagacagggaagaagacagggcaggugugggagacaaacagguaagauagucccagaacuccagaggcugagugaggguggaggguagaaagccuugaagccugccugggcccgggcugauuuuugaaaaguaagcaaaagcaaagaaagcaaacagaagccaagaccacaggaaaugcuacagagacgugagagaugaugagaacugcucucuaagagguacccaggagacacaguuuuaacacacuguaacaacuccugagggauuuucuacacacacacacacacacacacacacacacacagacacacacacaaacacacaaaaccaaaccacuuacucuuguucuauuaccuaaguuggguggaacacagccuauuuugugaacauguaacaacagcuagauauuaauaucccacaaaacaccagacauaggcacauucaaauauaaagaaaaauagauuccaaaagcaaaugcaaugaaaggggcuuuguggugcugcaagccaucguuccuuucccuccagaguagcugcucggagacacugcaaagcccgggaaugcuacuguugcauuaugucuccccagguacacugaauauacuuaauaaugguuuuugauaaaaggcuaauacaagagaauucucaggcaguuugucauagggcugacugaacucagaggggggcuuuggaaggcacaacucuccagaaaauuguuguucuaaagacuuggaaggaaaacaucuaguuucuccccucugggaacaacaauguaguuuaaagacaaauggggaaaaaauguaucucaccuauucaauugagaaaaugguuauaaugugggccaagcguaacagaagaagaacacaggagcauaugacauaauuaccucuguagagaugugcuguguucaggugagcauacaguaagcccucaaguauggcucagccagaugagcucaugguuccaggcaaugaacaaagcccugaguccugcccucacuguucacaucagucugucuaacuucuagaaggccaguagguaauguauuauuuuaacugguauggcagagguaaccuggccucuuccucacauuuauuucaaaguuuaguaguuuuugauauuuuauucaugugcaugugcgugugcaugaauguacaucuguguacaugugcauguaagagcccauggaggccagaaggcggcacugcagacccagaacuagaguuuugggugguugugagcugcugugugaguggugagagccaaaccuaaguccucgguaaaagcaguaaguccacguaaccacuuagccaucucucacacagcacaacauuucuucuccucaguagcugcaacaucauauguacagugcagauguaugcauucuacacucuaaaccugcucacucccugcuaacucccuauaucccaguacuaagcccaaggcguguuuacuggcuauuuguuauacucacaccaaaguaaugacaacaugaaggcacugcaaacuaauuccuaggcacaccccaaggaaaggaaaaaaugcccugguuuucuuuaccucggcuuccaccugcugcugaguccgguggugguucucuuuguacugguuggcucucagaaccugcugcucaaugcccaagagaacugccucacagccgucacaccugcaaugggaaaagccagcccugagcugcagugaagcccaggcagucuccucccuccaaacccuuccagcacuuuacaggacuuucuuuagcagggggcugccaggugguuguguugguccccucccuccuucccaacaaggucaucuaaauauguaacacaggccaagggcacagcggaggcuuuugggcagcuucuuggacuacagcucuaauuuccaguccucgcagcccauaagaaacaguuuuauagacuaagacugaaagagggacaaaguacaagugacacugacugaucccuuucuacaaaagaaaaaaaaauaaauguuguauuuuagagauugccuuuuuccuuagaauuugaaguuauuuccuaguuaacaaucacuucucccuucucacuugguaacacaugccuuuaaucucagcauucaggaagcagaggcagaagcaggcagaccucugauuuuacgguuagccugguugauaccagccaggucuacaaaaugagaucuugucuuauaaaauaaaaaacguuuugaaaagcaauauaaugaaaauucacauacuguuuacuacuaugcaaaauguccaacauucugccauguuuuuaccuucucaggacaauaauucuauuuccagcccaccuguaacauauaaauaggagcucugagaaucucuucugguggcugaagagaugacucagugguuaggacaauugcugcucuuacacaggaucaaaguucaguuuccaacacccacacacuagcucaugaucaugcacaacuccgguuccagggaaucugacgcccucuucugaccucuauguacuagauaaacacacagugcacuucuauacauguaagcaagaugccuauuuuauauauauaauaaaauuaaaacaucugggugugguggcacuugggaggcagucagacaaaucugacuuuaaggcaaaccuggaaugcauaguuauaguuaguuccaggcaagccugggcuagagaacaaggccuguuuugauaaaacaaaaacaaaagcaaguuucccuaucucucagcacaaagcugcccacucugccuagugacauacaacaugccacacgccuauguggggacaaucucuccacucucaauaaugcucucuuccucaaaacuuccucacacuucccaaaaaugcucugguuucauaaucuccaaaucacuuaaauaaauagcucauaacaaauauaaaucguguaaucacuuuugcaagcauccaauucuacuaaaauaagaauauacucaaaagucucaguucuuuuuacuaaauuccuuuuauucauuggaggggagaauaaagagauacauucuccaacucacaauccuucugccuuggcauccuaagugcuaggauugggguuacaggaauguaccaccacacccagcugccuugacugucaaauauuguaugcaucgguguuccagaucacaaaggccuauucacaguugucuuccccacaaugcuucacuagcacuacuagcucaacaugucacuggcaaacacuaacuuccugcucuugguguauguuuauaaggugcagauuuagugcugcacagucagaacgcagagacucuaccuguaacuccacaugaauauuuuauagcccacuguuaaacagcccagcugcauuuaaaaucaauuuuauaagccaggcaccaggaaucuuuccaagcuuccuaaugccacacagcuguaaucacaaaugcagucccacucucuguuucaguguccaaagaccccagcuuuggcuuccucaagcucacuucugaaagucacagugcugcagagagaggcacaaaggaccuacuagauucucccuccaucucccagccucaccacucaugcaaggucuugacaauguuauugauaucuuucuuccggaugucacggccaaugcagaaauccacuuccaggagcugauuucgcugguccaguuugcccuggaugaugucaguguagacagccucaaugauaaggucuucuaguucccugagauuccucaucuccaggucuuucagcagcacagaguaggggauacacuguggauaggucauaugacagucggcaagcauugaaaaaaauuucaagcauuacccacacagguaauaauggagacucuguuuauacgaugcagggcagugguaaucaccaaaaucugagauagugagagauuauuauuacuguggaaccuauggcacucaacaacauccuguagcacccaaggagguaccuuuccaguucucuauguccuagacuucacccagcucucagcugccacauccacacucucaugaugcagaaccccccuuccacaggaaagagaaauagcuuagcaugugcuacacugccaccuucuggaagcuugcagacuuugcauaaaaugcugaaugauugcaagccacaaacacugacauugcauaguuuacccagaagaggcauggcaaaacgaaacggaacacacacaacaacaacaacaacaaaaaaccaaucacagguuauucugaagugugugcuuguuucugcaaccaauaucaaaucuccaacaacagccccguaccaaugaccaaaaagaacagaacagggcugagaaauggcucagcaguuaagagcacagacugcucuuccauuaguccugaguucaauucccagcaaccacaugguggcucacaacuaucuguaaugggauccaaugcccucuucugguguguaugaagacagcugcaguguacucauaaaauaaauaaaguuugaaaaaagaaagaaaaaggguuuaaaaaaagaagagcagaauaucuaauaaccuauauucuacaaucccugagcuguuaguacuaauuuagaaauaaaccauguaagcaaaaucagacaagaggagaugaggacagaggugagcagagaggugagccucuuuguuaaaaggugaaagcuauuggcugcgggcuucuuccaaaucagcugggcagagaacuucaagugcgccauggaaucuuacagguuagagccuaguguuagcauaugaaaauuaauaaaaacaaagugagcagaugaggcagaaaaugcuauuaacagccgggcagugguggcccacgccuuuaaucccagcacucuggaggcagaggcaggcggauuucugaguucaaggccagccuggucuacagagggacgacagccagggcuacagagagaaacccugucuugaaaaaccaaaaaaaaaaaaaaaaaaaaaaaaaaaaaguuauuucccuaacaugcuaacaugcacaagccuggaguucauuucccgguaucauaaacuaaaaguccacucugcccaacacagcacgucuuuccuccugcaugaguaugauuaccugugcacuaggagacucaggaaguugcuaacuagcugaaagaagccuuacuucuuacagguguggugugacacaccugucacccucaugugggaggcugagguaggacagccaugacugugagguuucaaccuaugcuacagucacagugaguagagaauagccugugaauacauagugagucuauauuaccauaacaaaaacagucaaagagacaccugcuauaugaagauguaggaacuuacucuguagaccaggcuagccucgaauuuauagguguccaccugccucugccucucugccucucugccucuuucucugccucugccucucugccucucugccucugccucucugccucucucucugccucuccgccucucugccucucucugccucucugccucugccucugccucucucucucugccucucucugccucucugccucugccucucucucuccgccucucugccucucucugccucucugccucugccucugccuccgagugcugggaugaaaggugugcgccaccaccacccagguaaaaagauucaucuuuuaaaagcauuuaaauagcaggccccucuuaauaugacaaagugcuuucucugcaucaaguuccacagcaugccagaacagagagagaccugcucaaccaaucagucacugcugggcuugcuuuuccaaaacagaacagggagugacuguccacauguuuuaauuaucuuuuuaucugccaaguacacgccaagcauuuaggauaaaacuagcaaguucuuccauugaugccaacgggagagcugagcugggguucagaugaagacaagcaugguuugcgacaguaccuucauucuugaugccaagcucacgaugguaagaugcuucagcuuguucugcugagccacacucaguucuggcaggcucuccuuguuggcuguucagucccacccaccacaaaaaucaagacacaaaauaaaauuaggauuuauuuuuaggauaaacucaucaacucccccacaaaaccuacuacuagauggcugucgugacugcgcauuugcucacuugcucacucagcaacccuccaucagcagccucuaccuucucuggaagagcacgugcuucuuccagaaagcaaagacucaggaguuuaauaucaaaacaaggcaugaacaaacaaaacaccagagccaacucucuuaauggaauacugcugcugcccuugugaagcucaguuaaguucaacaugccuucauugagcauggcaugugcagugaacacgucguacagggaaucugggcuuugacggggcuguaccacacagcuccaagugcacucacuauguggagugacacaacugaauaaccccagaccugucaucagcguuaguuugguuuaaauaauuguuucuaaaggggugacacagggugacacuggacuccucauccaccugcuuuaagcuagaauuauaggugugacccaccaugcccagccucagucuuacaaucagauacugcaauagcuauaaaugcaaaggaaccagaacagacaggcagaggacaaggaagacaaaaagaaaaggcuaaaggaagagaagaagaaaaggggacagaaggacaaagugaacaaauucaaucucaguugggagaaucaaaaaacaaaaaagguuucaugggagaaguguuggagacgaaccuugaggcugagcagaacuuuuaguacugacauugacgaucaaagcaguagcugcauauaccaacacagccagaugcucucacacgcacacgugcacacacacgcacacgcacgcgcgcacacacacacacacaagcgcacgcacacacacacacacgcacgcacacacacgcacgcacacacagcucacucccagccacucgccagacagauuucaaauguccucaaccucguaaccauaauucuggauuccaaaaacugaauuuuucuguuuguuuguuguucaagacagggguuuuuuugaguagcccuggcuguccuggaacucacucuauagaucagaaaggccuugaacucagagguccaccugagugugguggcacuuggcaagcagaguggggcagaucagaacuucggaacuuaaggcaaacaagcuagcgaccuugucccaaaacaaacaaagcaaguuucccuaucgcucagcacaaagcugcccacucugccuaaggacauacagcgugccaaaagccugugugccacgccugcuucuccugggguuaaaggcaugcaccacuuaugcccagcugaguccuuucuccuaagcauuguguugaaaugcaucaaguagcaacuccuaccgugaacugagggugguuuuguuuuuaauccuacuugugaguauucacuuguuuuguggaaaaauuauauauauguuuaacuucaacuauugccuauaucccaugagacuuacauaaaagguacauauaccacauuaccuuucuuuaaaaauauuauuuucaauucugugcguaugucuguguguggguaucugcacauguguagagguacacucagaggccagaagcauuagaccccaggaacuggaguuguagaugucaauacaacugccugaugcuacuguucuggggccugaacuccaguccuuacaaaagcagcauggacucuuaacuccagccccauguuaccuuuuuaaguccucaaaauucuaaauccuggaaauauuuagccuaaagaaagacuucuauaauuacucuuauuuuacggauaagaaaacugagguaugcauaaucauuuaauccacuaagagguacaacuaguagaagcagagcuagccucuaaugcaggcagucuccuccagagucccugcaucgcugccucagacaguacaacaaagagcagggcaaagaaacgucacguacucggguacccggaaguggaaaacuguucacugugacagcaacccagaauguaugagauagaaagaaaugccaaagaacagaggagggagcccugaggaccagcccacuuuuauacuaucaaagaagagagagaagagaagaaaaggaaaaugaaacuaagacagaccgaaauaaugaacuagaaagaaagguaacauuuggauaugcaaaucccucacuccugauucuuguuucugaauauuuacuauauuugcgcagguguagacaaugugagcuugagcacacaugcuguacugugcauguggauguggaggucagagaacaacaaagucaggucuucuuuuccacucuggguucuggggaccgagcagaggcaaugcuacucucugcugacccaccgugcuagcccacccccgauuucagauuaucaucuaaagccauucaauguccucaucagaggagcuucuugcaggagaugguaauuaacacagagagccacaacaggacaauguacaaaggaaagacuuuggagcacccagcccuaaagaguaugucuucaucaaacaccuuccuucgggguucagggaucuaugcagaagaagagguggagagacuuuuaaaguuuucgagacaggguuucucuguggaguccuggcuauccuagaacucacccuguagaccaggcugaaacucaaacuuggagauccgccugccucugccuccugagugcugggacuaaagguguguacccccaccgacagcaagguggaaagauuuuaagagccagaagugguaggugacuccaaggaaacaguaucauucagauuuaacaggacggaugcagacugaacuuaagagacuaugacagcacccacgaaaccuguacagguucaaaccaggcaaaauucaaacauggagaugggaaauagacacaagguugugucccuaaccaagaaacuacuuguaacugauaccugcuggaaaagggacaaugaguuuucuccaauggagcgucacuggcucuagucuaucaaccauccuccaggacaggcuccgugcccaggagaagcacagcaacauagaauggacucucugguuuuugugagcauuuugcuuuguuuugguuucaguuuucacuuuguuuuugauuuucauuguuuucuuuuugagaaagagaaaaaacaugaaguuagguguguagggaggugggaaggaucugggagaagaugaaggaaagaaaagaauaugauuaaaauauacuguaugaaaaacuaacaaaaaaauaagagaguacagcuaugguagcacauaacuauaagacgagaaacuggaaggcagagauaggaggauccagagauugaagucagccuaaggcaacacagcaagacucugacuuaaaaauaaauaaauuuggaaaauauggauuggaaauauuuucuggccuggaaaaggcaacguaugaauugcauacucaucuaauuacaucuauaucacacaaaacaugagcaucagggaaaaauagcuagugucaagucuaacaauaacaacauggucuauguuccauucuuuuccaauuuucuucaacauggcaaucuuauuuagguaacacucaaguugggcauugugggucauccuuauaaucucagcacucaaaagaaugaagcaggaaguuuugacuucaagacaagccuguucuauacauaaccuggucaacaaagcaaagcaaaacaauaaaaaaagaaaagugugugcgcgugugcacucacucgcauaacaugcugugcauugcagagcucaggguacacccugcaggagucaguccucucucuacaccaugugggucccagggauugaacucaagcugucaagagaggcuucauuccuuaccugcugaggcaucucaccaccaccccucaaaaacauaaaaauucugauaacauuuaaaacacugaacugacagguguggugaagcaugccuuuauuuccagcacuuaggaggcagagguaugugaauucaaagccagccuguuuuguauacugaguuccaugcuagccagggcuauauauauaguaaaaccugucucaauuaaaaaaaaaaaaaaaucacauuacuuugcuaguugaaugcucuacaaacacuaguucucaaggcacuaaucugggaacuaaacaagggcucuguucauagaugcacacacacacacuccccaucuuacaccuaggaaguuaaacaguuaucagggaaauccuuuuauaaaguugccuucagagcacagaagauggagauauagucaagucaacacccugcuacccugcccacacucgcauuauaacccaaaucucgaccacccuagaaacagcuccaacaguuaagacaagccuucuaaagggucucagccaacucaccuauguaauccggguauguaccauaggcaaacagguucagcaacugcaaauacgcagcauuagcuccuucugcaagcugaggaaagaaagguucaguucaccacacaacaaauuuccaccaaccaugacaauauucuaauggaggacacaugaccaaaugccaaacaugucauggccauuuguucuguacuacuugauugguagucucuaagguccuuuccaacucugauucuuggauaaaaacuaaacaagauuacuuaaguucaaaagugaaucuuccuuccucagaaagacauuuugcacaacauauaagaugcucaaguaguuuccuccuucccucccucccugccccuuugcuugaguuuacuccaccgcaaagaucuaugcacaggaggcaguuugccgaguuuuccucagaucuccccuccuuagaacaaauccugauggcugggagacucugccuagccugcacuugcagcuagguucagugccagcacugcauaaacugggcaugguggcucaugccuguaauuccucaggugaauacaagaggaucaagaguucaaaaucauauuuguuuuauuguugcaggauguguauaugaugugaaugugugcucauauaugcauugcacauguguaaagucagacaacuuugugaaguccauuuucuuuucuuuuuuuuuuuuccaagacaggguuucucuguguagcccuggcuguccuggaacuuacuuuguagaccaggcuggccucaaacucagaaauccgccugccucugccucccaagugcugggauuaaaggcgugcgccaccacgcccagcaugaaguccauuuucuucucccaccuuuaugaagguucucagaagaucaaacucuggucaucaagcuuauacggcaccuuuagccacuaaggcaucuugccagccccaaacuuaauauauauuggcaccuacuaucaaucacaucugagcaaacuguauggcuaguuccaaguuuugauacuauauaugaauuauaaacacuggaaauauuagcacaauguaaggugugacagaaaagcuauacuguaacagaauuaucagccugagccaaauaaaaauguccauuaaauuacuucuuugaagcugggugguagugguguaugccuuuaaucccagcacuuggaagguagaggcaggcggauuucugaguucgaggccagccuggucuacaaaguaaguuccaggacagccagggcuguacaacccugucucaaaaacaaaaacaaaacauugcuucuuugaugcugauggcaaaagacaucaacaggaaaaaugcaaagaacaacugagucacguuacacaggccaguaauccgaagggaaucacuagcucaagucuagucugagcuacagaagaagcacaaagccagcuugggaaacuuagaaagacccugucucaaaauaaaaguaaaaagagggcuuggacauaguucagcagcauagcaccugcuuagcaugcagaagacuguggguucaauccucaguaacucauacacacagcauaucauccaacuuaccaaacuccauaaagcaagacaggaacaacacuguucaauuuuagcuaucuuuaaaaaaaaguuccaauaauugcauccauaauuucagaacagugaaaagccauuagcuuauuccugacucaaaacaggaaauccauaaaccguacacagauaaaggugauuugcuaagcaccaguaaguaccaaugugaguguguuagcauccucaagcuucccucucaaguuaucaacuuccucaagucccaggaucagagugaaagagauucaguaaagaccacugaauccagccccuacuuuucacacagauaacuacagaguuagcuggaguagaacauuuucucuagggcaaacacuccaagaguucuuuggcugccuaagucaauaaggucuugccagcuugcuuuuuccucuuagccaauuuucaacaagcacaaaaacaauuacuuggcaugaucauucagguuuuucucgaaccugaagaaacacugaucaucuuuucugcuggaaaaugagccuaacccaaacaguggcacacuccuauaaucccagcagaugguagauggcagcaggaggaacaguaucaaggccaaccuaggaaacaugagacucaauccccccaaaaauaagccuaauucacgaaucuucagccaugugugagguggucauaagcacucuagauucccaaucaagagaaauaaguagacauacauacugaaccaaauagccuggacccacagcucagguuaaaauuggcucugagauugcugauggcaaucgugucauuguggccaugaaguuaaacuaccuaacagaugccaaccacauccuauaugcagaccaccaccaccaagaacaccagggccacccucagcagcauccuacaaaugauuaacaagaaguaccugggccuagaucaguagacaguggugaagcacacagccagugccauccuacauaggcagaagccugagguggcaaagggaagagagccugccccaccaacacacggaaucaccugagaacucccuucagugcuuacauaugccugcaauuuucucaaagcaaagaaaacucaagcaucuaaagugacaaguggagguugagaagcauaaauugcuuugcaucucuuuguuccaccuggcuacuaauauacaaugacgaaaaacucugacuguaacaaucaaacacuuagaauauuacuuuaugucaagauuggacuuuccuacuaucuuucagauagcuaacaacucaaucuaauugauccaaguucaaggggaacacugacuaaaagaacucuaagacauuauccuugaucuccaccccuggcccaccaauccccaucuuuccacuaacaggauaccaaacaaaucuacaagacuucaguguugaaauucgcuggaaaccuggagaaucaaaaaaagcauagcauagaggagauagagaaacugucugaaaacuauucuuaccuccugaacauuggccaacuccagcaguucuccaaaaacauaaacuccaggagccucuagcaccuggcuuaugagaguggugagggcugagccacugguaccuuuggcuaauaaaaugaacugcuccaagagguuacuugaggguuucuguucaccugccauucucuggucuugagaucuguccaaaaggaaaaugggucagucauccacuaccuucuccuuuccaaagugugaauuuaagcugguuuagacacaaggauacucuaacuucaaaaucuccacaaaaacaacuccugaauugagauacaauagccacuuugugagaugaacagaauucagccuggaguuaaagauauucuguccucaauucuaaaguacacuucccuaucuguuaccucaguaguauuaccuuuuaaguccauaaagcugaccaggacacaaaggaguuuauuuaugaauauuguguaucuaccucacuugcagguuugggcuaagagacaaagaaugcuacccaugcacagaggcaaauuuugugucauuagaaucccaccugcaggcaggcacacgucagaaacagagugaaggcaagagccacacuucauuuaaucaaaaacuccacaaugugaugcuuagcauaucauacaaggcacuagguuguaaugugcccaguaaugaaauaaagcaucauuuaagcaaagacuaugggaaaacuauuuacaaacuuaagcagugacaauucaaaucuagaaaauacauucuguuuaaguagggaaauacaucuuugaccuccugaugauucagacauuuuaacaaacaugacuccagaauuuguacaaaaucuuuguaacaggauauaaggaaaacagugcagauauuguuuuauaauuaauuuauuuucucuaugagagcauuuugacugcauguaugaggggugaacauguggccuaaggaagccagagagggcaucagauccccagagacuggaguuacagaugcuuggagccaucaugugggugcccaugcucuuaacugaagaaccaucucuccaaugcagauacuguacugucaucuuggagaauguuagguacagaagaguuccucaauuguauaauaugaauaaaaacugaguguguauggacucuaaaggaaucccacguaagaccugucuuccagaaaugauacacacugaaagagugugacaaaaaugaaaaaggggugugucagugaauaaagaaaaaaaaaaaacaugucaaaacauguuuggugcaaaagauacuguuuuccuguggaguuaugcacagccccuucaggauauuaggaaaagaaaguagauugccucacuugggguuacuuaaggagguccugucagaaaaagaaaaagugaaguacuagaaaacaaagaguucugggaggggagaggggggaggauaaagcugaagaauggaagaaggagggagaggaagagaaggaagagaaggaggaggaggaggagaggagggggaguagagggggaagaaaaaaggagaaaaagucaagugaggagaagacaggagagaagauuaaguuagaaaaggaggaacaaagccggguccccaccccaagcagacacaacuaaaaagaauagaugugacucucagucaagauacuaagcagaaguagggugggaaggagauguggaugggauggggagaagaucucaacuucaagagcaaagcaaguggggauugagaguggauagaauaagaugaucaacguuuucuccugaaaugggaggcuccucaagaaggcggauagggacagaguagagaugaauucccaucucgagaggacgcuauucugauggaucaaaaagagucaaagaagacagccucuaccggaaggggcagaccgaaggcagccaccgcguggaaugugaggaucgccaacuagaguggacgucaggacuggcggucuugcucguagccaccagcacagaguaaggagccuccaggcguccugcaacgggggcggggcgguguggccaucggcuuucuugggaacgccugccugagcgaagcuggaaguccagccuagacuagcacagccugcccucgugcccuccccuaccuguccccgccgacucucuguucucuucgccgaugucucggccucccagagccugccugcagguugucaagcuuccaugaucggcccggcguccagcacuuuucugucuccgccgacccgucaccggugcuguucccccggaagccucccacugcugcacucgaguuccgccuacacaauguucccgcucugcuuucgccaccucccaccuagauugaggcugaggaaggagaagaggguccccucaggguugcagcuccggaaacgggaggcaaagcaaguaaaacaugaggcuugaggagaggagugugcccuuggugauucuaggguccaaguaguagccgucaccaucacuauccugggccaaaaacccaccccuuuggcugaacuuucccuacaagugugcccucaggcaacagcggcuccccugggguuccgaaaaacaauaagccuaauggcaacacuacuuagugaacuauucuaugugaccguuguccauauuuauuuugucagguucuuauaaaacuaugaccuguauaaaauauuaucauuuuccgaguaugcuaacaacuaaggcuaacagucuaagucaguaaauggcaauguuguaauccaggcucucugaaggcaaagacgauguuuuuuguuuuguuuuguuuuucgagacaggguuucucuguauagcucuggcuguccuggaacucacuuuguagaccaggcuggccucgaacucagaaauccuccugccucugacucccgagugcugggauugaaggcgugcagcaccacguccggcagaugaaggguuuuuuaagacuauuauaguacauugaaauuaaucauuucuggccagacaguaguggugcucaccuuugaauccagcacucaggaggcagagacagacagauaugaguucaaggccagccuagucugcagagugaguuccagaacagccaaggcuacacagggaaacucugucucaaaaaaaaaaaaaaaaaaaccuaaaaaaaauaaauuuuuaaaaaauaaaauggaacuagaaagauggugcagcaguuaaguagaacaccuggguucaguucccagcacacacauagcaguuuacaacccuccauaacuccaauuccaagguaucagacaugguauucuucugacauccaagaaaaccaagcacacauaagaugcacauacucacaugcaagcuuaacauucaugcacauaaaauuaaauaaauaaaucuaaacuuuuuuuaaucuguacuggggaugggaguaguggugugguaaagcucuugccuagucagccauaggaaagguucuggguucaauuccuaacacagauacaacaaauagauuaauuuacauaucaaaagacacaaguaggagaugaagaccuaccacacccuuggaaaagauauuugcaaaguaugugucagaaaaaggaaucaguaagacuacauaaagaacugcaaaucaggggacuggagagaugauggcucagugguuaagagcacugacuauucuuccaaagguccugaguucaauucccagcaacuacaugguggcucacaaccaucuguaaugaaauccaaugcccucuucugguaugucugaagacauugacaguguagucacauauauaaaauaaauaaaauuuuuaaaaauaauuacagccgggcgugguggcgcacgccuuuaaucccagcacuccagaggcagaggcaggcggauuucugaguuccaggacagucagggcuacacagagaaacccugucucagaaaaaccaaaaaaaaaaauuacaaaucaguaggaagacaaaugccuaauuucaaaaaguaggcaaaagccuuaaaaagucacauugacacaaagaccauucaagguuaagguggacagcaucagaaaaauagaaaugcauacuuuaacgaaauaccguguuuagccagaaugacuaaaauuauaaagacuuaugauaaauaugcaggguuaacaagaaugagcaacaacuagaacuuuccaacacagcaggcaaaagccucaguuccaugaucacuuugaaaaacuagcacuaucuacuaucacugaccaugcauauguucuacaaggcuaacaacucuuuuccuaaaaucugcgcaaaguguccacaaaggaagcauacaagaaugcccaguucagccgggcgcacgccuuuaaucccagcacuugggaggcagaggcaggcggauuucugaguccgaggccagcuuggucuacagagugaguuccaggacagccagggcuacacagagaaacccugucuuuaaaaaccaaaaaagaaaaaagaaagaaagaaaaagagaaagaggaagaauacccaacccaauucauaacauaucucauaagauaaaacucagauccccaucaacucucucagagaugaacugugacuauacauacaacuugccauuggaaaaaaugcuacaaacacaugucagcuauaugccgcacauacugcauaaucacguauaagugaaauccacauacaaauucaaauacacauaaaauauccacauagccauaaagccaggaaacaaguugauugccugcagauaugcggauguauuaugguggaaaagggcauacgugguagcugcugggaaggcucugcuucuugauuugggugauacuuauggguguguauaucuucucucacccaauguauggcacaucucauuaacaaagauaauucaggauuaaaaaaaaaaauuaacaugaggggaaaauccucaaccucugaguaagagguucucagccuuccuaacgcagagacccuuuaauacaguuccucaugccgggcgugguggcgcacaccuuuaagcccagcacucgggaggcagaggcaggcggauuucugaguucgaggccagccuggucuacagagugaguuccaggacagccaggacuacacagagaaaaacccugucuccccccccccccaaaaaaaaaacaacaaaaaaccaauuccucaugcuguggugacccccaucccuaaaauaauuuucauugcuacuucagaacuguaauguuucuacuguauggaucauaauguaaacauuuuuggagauagcgguuugccaaagggauuuuugacccacaguuugagaaccacugcuuuaaguucaaaugucauuuccaccaugaaguuuugccagcuguuaaaggcacgucaccagaaccucuaaggcauucuccacuugaucuugacuaaaaggccaacaaguaauccucuguggcauucugauaucuuuucuuuuaugccacuugucaacuccaucuugaaucuccuuaucucccuaaucaguuauguaucuucugaauaacaguggccuaucuuuuacuuaauucaguacccaaccaaaaccaaaaaccaaaacaagguuuguugaguuacuuggaagaaaaacaaacaaaaugggugggugaucaaauggguggagugggaacaagaacaggaaagaaggccagaggaaggacacaggcgucuccaaggaaacagaggguuaaaccaacuuuaucuacuuucugggggaaaaacaaucauuaaaugucaacuugaaugucaaaaaagcaaauaaaaauagcaagaccuaucuagucugaggauaaaggacugucacaccagcuccuuucaggaaauccaugaaauaaaugcuuuccuauuuucuggguguuucaacacuaguucagaaacuguucauuaaggagaaaaacaaucacauugccaugcuucuaaaaauauuaccucccuaguguaguguagauacuagaugacaggucaguagauguaaagccagauuuuaacugugucaauuugcugugcucucuggccagucucugccucaccgggucucuauuuccucauauuuaaaaacaaaagauaaagagauuggauuggcaaaaucuuuuaagucuuccuguacuaacauugaguauaaacaaucuuuagcucacccaguccaaagcagaaauauaacauaaacccugcaaaacaaguaaaaaugaacuccagacuaauaaacuaacacuauuugaggaggucauuuuguucuguuaucucucguggcuuaauaugugguuuuguuggugguuugcagucuuaccaugguuugcagacuccugaguuccauguaaacagaaguuaacugucgguggguugucacgucuccgggguaaaagaagaccuuccugcuggguuucaaguaacaggauucagaaaccaaccccauaggaggauuucaaauaugugcacacugcucggcacacuggaacccaaguuaaaaagauggagcgcaua

SEQ ID NO: 272 - RNA, 5094 nt, Mus musculus
agggcucccaggaggugagggccaggugaggugcggaccauuagaagugaguaguuuaguguaagacaacgggaucagaugguuugagggacacaaagucugugggcaggaagaaucacaggagaggguagaguccaggaauaaagaggacagggucucccgccuuggccccaggucaccaugccgcuggcuauguuguugcugcugcugcugcuacuguccccagacucccaaacugcccaugggcauccacuguacacgcgccugucccccggcgcccugcaaggugagccgggcugguccgagggaaccacgggaggugggaggggcauagggaaagugaggucaagggaggacaagggaaaugagcuuaucucucacacuuaggagggccugugguccuucugcccaccuucugcuggaaggaggagccuggaacugggauauaggaagggaggguagacagccucacccaggaagcagagacagcaacacugccaagggguuccagagauaacgguguuagaagacccggggcagcaugccuugggcccaaagauggauaccuuaaccauauuaccuggaugucggugggcagugguuuuccucugaaaucuuuaagaaaggagcuuuucagagauuccuucccaauuguagcaccaucugcccugagggcuggcccuuggggccugaccucucuccccaucucuacaucccugguagucuaagaguucaccacgcuucucugggacuccccagacaagguucaggaagacuuagacugaguggggcucucugccaagggaaugugacuuugugucccaugucccucccccucccaguuuuaucugcccaggggacucaggcauugcaggcugcccagaggagugcccagugggccauaaagcgcguguugauggagauccagcacagacuacaugaaugccaagguuguaccagaagugcuaccccacccagcagacucacauugguacaggggacuccuccuuuuguccauguccagcccuuauuuuuagguuccaucguccuuggggucagauucuuuuugaagguccaaguggaagggguaugccaaacuugagacacagcagggaggaggggagagugugggcucagguggucacaguucauggcugcucaaauaguuccaugugcuagaaggcgggccaaguggagagugguugaaagaugaggcccagcccccccccccaauaaagcgaaagauccgcaagagggcgcagcgaggcucaaaggauuguuucucaguaggaccuggacgcccuagaccucaagccccccuccuccaggacccaccggagccaggugaaacuaaaagacuccaagggcugaaagcgaggugggccucaacgugaagauaacuaaaacuuuugcuucaugacgccguuucugccauucuaguacaauguggagaaagacaucaaggcguugccaacacgacccgggcucacggccgcauagucgguggcagcacggcucccucgggggccuggccuuggcuagugaggcugcaacuuggaggguugccucugugcggggguguccugguagcagcauccugggugcucacggcugcacauugcuucgccggguacgucgucgagauuccaggcaccugcucagcagggccacccaauccgaugggagucuaagcacccaugggccaaagcagagcagagcaggucucugcugcccccuagcggaagcuagcucccaaccucgggccuuaaaaugccgguugcgggugggggugggggugggggugagggaucccaggguaggagaacaucacacugaauuuucccacugcagggaaucugcaccuucccggucucccucucuuucccuugggucacaacagccacacuuacaggcucacuggauggugugggugcaugagggucugggccucugagggggccucacgccacccucugucccugauuggugucacccacuacuugcgcugcagugccucgaaugagcuucuguggacugugaugcucgccgaggggccucagggggagcaagcggaagaagugcaggugaaccgcaucuugccccacccuaaggugagaagacacgcccugaguccucagagcugggaauagcaucccaaacccucuuccuugaccuugaaccgccaccugcucucuaguuugacccgcagacuuuucacaaugaccuggccuugguacaguuguggacgccugugagcccagaggggccugcgcgccccauuugccuuccccaggguucucgggagccuccugccggcacccccugcgccauugcaggcuggggggcucucuucgaagguauugccaguuagggccuggauaagcuagcugcaagggguagugaagaaccaaugggggcggggcuaggggugguggaaguaagcugaagaggugggguuuggagagacuagaaugaugcuccaucgcauaaaccacgaggaauuaaagagggcaagugagaggggaucucgaggcgcagccucugccuuccaaacccagaccccuuacauucuuuccuguagacgggccugagucugaggcagugagggaggcccgcguuccgcugcucagugcagacaccugucaaaagguccuggggccugggcugcggcccagcaccaugcucugcgcugguuaccuggcagggggcaucgacucaugccagguaugagcuaaaacugacagggggcccugggugcgucucuccccuuggcaagauaacccuguucucucugggucuagcugaaagcuccuaccuaccgcuaaaucuuccuaaauaaaauggaaacaaguaguaaucacagacgcagccagagccaauccuucccuaccagguacuaggcagauauaauucgaucgauugugaaugcauugcucucuguuggcucuggucccuuagggugacuccgggggcccuuuaaccuguuccgagcccggcccgcgccccagagagguccucuuuggagucacuucuuggggagauggcuguggggaaccagggaagccuggggucuacacccgugugaccguguucaaagacuggcugcaggagcagaugagcggugagcauccccuagcuaaugguaccucggauaggucugggcaagccgguuuccaucccgcuacucgggucucuguggaggagcugcggaugagugacuuguagauccacauacaaggggugaucuggcaucugcuugcagcgggccccuccacucgcgagccuagcugcagagaacuucuaaauuggaacgcucgggaagaggagccguucacggacgccccgggccucugugccuucuaugcgcgccagugccuaggguccgagagcuccugugcgcgccuagcgcuccaacagugucugcagcgcaggcgacggugcggucaguccuguuuaccccugccagggugggggaggaggaguaggggugggagguuggagggugggggugggagauggggugcgagccccaccauucggugggccccuuacaccucuaaaccgcucgcagagcuacggucacuggcgcacacccugcuuggucugcugcggggcgcccaggagcugcucggcccccggccaggauugcggcguggagucuccgcgcccgcucgcuccgcgccgucgcuccaggagcuucccggucacaauccccgagaacagcgguuauacucagguauccugagugcccccagccaggccuaggccccagagucucggaaucauguaaccucuccgaggcgugcccacuaacuuccuguggucuccuccaggaucgcgaauugcgggaaccuggcuccagaaaccaaagccggagcggcgcccggaaacaaaggguaaugucgcccccuaccggccugcuggagaggagcggccaagaggcuguuucuagagagaagcugggauugucugcuagaaaauuccaaaugacaacagagaaaaccggcgcucacucccucucuuccaggaaaacagauuccuuuuuagggagacauguggcacuaaguccuugauggugucagaggcacacagccuugcaugaucacgaaaccucugccagccucaguuuccccaucuagagcacacaguucucucauagucuggggaucuccccuucuugcaggcugcccugggcuggagccucugcaacagaaguuagcggcuauucagcgagcgcaugcuuggauccuacagaucccagcugagcacuuggccaugaacuuucaugagguagguccccaggcugcccaggcuccuucacaguggccugugaaagcugaccugacuggagcucaguagaaggaagagacagggggauccagccuuuccggggcggagugggggugagggugagcuggaauaacagguggcuaugaagaugggagguagagagguaagaguggaagggcucauuagagcauucgccugaucuggaaauuagauggauuucugggagaugaaggggcagggcaaggcucuaaguagcuuccaaagcuccaggaggcaagagcaacccucaggucagaaacccucaggagugguuuuuuggguccuaaccuccucccucugcaggugcuggcagaucugggcuccaagacacugacaggacucuucagagcuugggugagggccgguuugggggaccagcguguggucuucaguggccuagugggcuuggaaccuuccacacuggcucauagucucccccggcuacuagugcaggcccugaaggccuuccgcucagcuucccugacagaaggagagccccaggcacccuggauaggugcugaucaaggacagaggcugggaaaggagcgccagggccaacuccagccuccuguucccugaaccaggcaacccugugauggucacacuguccugggggcuaaagcgguugugugagacauacaaagucucucuauuccaguugaucuuggauguguggauagaguggggauccuggaucucacucaucuucuucaaugugucaccagacacgcauggcugcuuuaauaaauguuauuuauacucuac

SEQ ID NO: 273 - RNA, 8448 nt, Mus musculus
ugggcauagacaucauuacuaugauauaaucagcacugagaacaaggaaacaugagauacagugaaggaaaauagcugcauagcuggcugcauauauuuaauacauuaagaaguaggacgguguagaugagucuuauucugucagcccuguuucagcaaucuggaaauugucaaugcuuuguccauugauaugaauaucuaggucaguccuguguggacucuuagagaccacagguguuggauguucaggaacagucuugucaaaauucuccaucuugacuugauacucaccuuuggaaccucgagucauuagagcugcaaaucggugauguaacaugaucucagagggcagguaggauguccuccuuuggcagauuuccccagugccuucuugcauugcugagaggaacacaacuaauucaaaguguggaggagucucauguuggagcaggguagcuagaggacuugauggugagauaguaugguaauagguuagcgggaagaugaagaauggacauuccucagaacugaugccaucaagguggaaguccacacuggucugguaaaguucaccauuuucucuuuccugauagaguacagcagagacacgaacguuggucagagggcugggccggguguuggccacuuggaagauaagauuagguuugccaucuuugugagcuacaacugcuaagucagugaaucgaauugagaaagcucuauuuuuuggccgugcaaucuucgccacaaaggcaccuaaauuaaaaaccauugaaauguuuuuguucuauuuuuuggaacagaaaacuuuaaaucucaauacauuuucugaguaugucaaguaguuacauauuucucacauccacugagaaagaaauucaucccauuauaauuuaggguaaucauacuuuaaaagaauuaagagccaacaacaacaaaaacuccaugauuucaaaauggguaagaaaaauuugauuugucaugaagaaaugaaaaacuuuaucuuguaaguuacaaaaguucaagaacugagcgugguuccugcuguguaacucagguggaaaugaagaguguaugagaggagggugguauuaggaggaaaggcugaagggaggagagaugcacuaaagaauuuuuaaccuugaaacuuguagaaaaccuucuagaagguuuugggggaaacuggccauaaagugauucagucuaucuuuuaaguaucuguugugucccaccccagcuauaggugaggaguuccuaagcauucuuguggcacagagccuguuggcuggcuggugaggcauaugguaaucauuauaacaauuguagcucuuuuuaaauuauuauuuuaaguguaugauguuuugcuugaauguauauauauucaccaaauguguuuccagugccugaggaggccagaagaaggcguuguuguaagcugccacauguguuuugggaacugaaccuagguccucuauaaaagagcaacaaguauucuuacccacugaaucauuuucacagacccaauuguaagugcuuauguuacagggacugugaggauagcagucuauccucccaucacuuuauucaucaucuguccaucaguaaauccaucuauuuaaucuauauaauuuaauaugcauaucaugcauaucauaugcauauuuguauauaacuucauaauugaaggaaaugacaaauuuaguuagggguuagcacaaaaauuuaagcaucuucccaucuaaauacauagguuaucuuaaauuuaucuaagagcugagccaaugcagauauucuuaaagaaguuaagugauuuguuacaggaugcagagccaguugguagcacacugggucaucuuccaugaugcucagugcuuaucuuuuauuagaguauuaguguguauuuuuuaaauuguguguuacauagaaagaagcaauccuaugguguagucuuauguuaccagacacauaagugacuauuuauggccacagucacacugccuuuuuuguguaucuguaacuuuaaaggauggcguugaaugugguguugucagcuuccuuuuauugaguccauguagaauaggugaucuuggaggagaaggauguaucauaagaaagauaaaaaguaagcuauggggcuagugaaauggcucagcguugggagcauugacugauuuuccagaggaccugaguucauucccaguaccuacuugucagcucacaacugucuguaacuccagaucugacauucucacacagucauauauguaggcaaaacaucaauucacauaagauaaauuauaaacaaaaaagccagguguaugucagguaacaugacuuaaaauuuacauuuaauuuccuuacucagaauaacuucugugugaauuuacuuuuacgcauuuugauauuuauuuuugcauauuauauuucugcaaguuaaugguauaugaucuuuuuucuaauguaguuccaaaauucuuuauauauauuacuauuguuuaucccuagauuguuucauucuucuuugacaucaccugcuuauagugaugcaaauaaauuacuuauaacaauauaacagacuugucuuaaccaacuauauacuuuauaaaaggcuuguaguauuaaaaaaaacaaaaacaaaaauaauuaccugugauaaaagccucuagcaugaggccuaggagcauuuguauggcaaguaaggcgauugcacuuggacagucaccacugggaaacaugguaccauaaccaauuguaaguugugucuccagagagaaggagaaugcagcugugaagcuggugaugugcuucacacagauagugugguuuucaggugggacgucguggucuauuuccagaucaccauucaucucagcuacagcauaccagaggacugcaaagacaagccaguggacaacaaaagaagcagaaaagaccagcaucauccagcgccagcgcauguccauuaggauuccccaugcaucucggagauacacaaggccccuuugagcaccauccaucugaagugugcuguggccgucuuuugugaccauccuccggugucuuugacucaggagaggagcauucacuuuacaauuacugcuguccaucgcaggcuguguuucucugaaacaagagggaaguguuagcccguagcugauuuagaguuacauucaugaguuaugacacuuucucagugucuacaugagagcaguuacugcucaagucauuuguuaaccaauuauauauuaguuuaggauauuuuuuauacuuuccuugauugacuguaccauuugauacuuuguuuucuaaauauauuuuagaauaccagagggugaggcuuauaauuugugcuuucuaaaacaaccuacuuguugucuuuguaaaaauuuaggccuuaaguauuuauugaguuaacuaaguauauuauuucuaaauaacaaauuuuuaaaauuugcugauaauuaugaguaaauuaaauaugauaauuaaagagacuaguuuuaaaaacauaaguguuuuacucuauaaauaaguaaaagucauuuggaaaguuagcauuaacugucuacaaauacuuuguuuuccugcaguuguugguguuugaacccagaacucugggccuuaagcaugcuaggcaagcacucugcauugaucuagguccccaucucugcauauuuugaaguuaaacuuuguaguagguuaagacuuauauuauacuaagcuuuuagagauucauaaguuuuuauuuuccucauucauugauucauucauuguuucauucauucauucuguguguguguaggggcauuacaugugucccacagcaugcuuuugaaggauagagggcaaccugggaaucagcauucuuccgccucguguuuugaacuccagucaucagguuaauaccaaucacccauacccacuaggccauaucucacugacccaagauacacaauuuuaauguaugucuuagaauuagccuauuuaaaaccuugcaaaaauguuuauaaauuugcuaucauggauauauuaauauauuauuucuguccuggcugcugaauggauagcuguggggcacacacauucuuaguucauauuaaaucuugacaaaguaagaaauuccuuguaaaguaccucccuaacauuauauguguguguguguguguguguguauccuuuguauaacccuacuauaacuccugcacaccaaagaaagacauuccaacuagauauaucuagauaauaccucuuaccccggugcuaggaauggacccugggacuuugugcgugcuaggugaguacucucucacugagcccuccuuccagcuuugaaagacaguagcuuuaagaauaaguaaaccaaaagacguaauuuuaagaacuuaauaagcaaaaauaaacauuaagagaucagaugacgaauuugaaaagauauuaguguaaucagaucuugugacuaguuuucauaaagggcuaggcauuucuuuuuguuauuaauagacaucuacuguaugaccaaccuuggacaugauaaauauauauuuauacauauaaagacuuuuguaucauaacucgaugaccuugcuuucauuaagggugcuucuuccaaaguagauacugugauagugcugcauacccacuugugcuucucucucucauccccacuccccuguuuuguuuucuuagguaguucaggcuguugaacucuggauuuucugccucaauccucucuagaagacuggaauacaauuaagugcuaucaugccuugcugcuuccuuccuuuuguaugauacuuacaaagguggugugagguugcuuggguuugaagaguuaguuuuucugggacucugggguuuuguagacuguuuuucagcguuacuggauuuggacauuggauagcuagguauguaugacuuucucuuuuguucugaggcuguugcaaucuuuuuugaugguacccggggcauucuucuuucauauuuuucucagauuugagcuagagccaauugaauacuggauaguucuucaauuuagaucagaugagcauuucaguuucaugugauagauuuuaaaaaacaaaaauuucauguuguaucacuuacugcccuacugaguugucauagucaucggguguauuuuuuguuguuuggcaagugcugacaagugagccacuccucagcccauauuuaaugcuccuuauuuuguuagauucuuaaaauauuuuaaaagaccucuuuccucuuagaaacaaccacagagccuuuguagacacugugaagauacuuugauacucuucacccaucuuuccuugugcucagaagauagacaugacuaccuccauuuuucauauggaaccacugaaguguguagaaaggcaagacguucuacauaccacaugagggcuuggaauuuuuuggauuauuauugucuggcuaaccacgacaaaaucaguuaauauacuuuuauuuauuuauuuauuuuuuuagaagaagcuguauauucagccuuuacacuguccucuacuccaaagcuggucuuugacaguuucuagcacuuuaauuaggugcuugcuuugcuuugcuugcuuugcuuugcuuugcuuugcuuugcuuugcuuugcuuugcuuguuuuguuuuguuuuguuuuguuuuguuuuguuuuguuuuguuuuguuuuugagacgguuucucuguauaguccuggcuguccuggaacucacucuuguagaucaggcugaccucgaacucagagaucugccugccucugccucccaagugcugggauuaaaggcgugcgccaccacuaccuggcuguagguguucuuuuuacuccuguaacucagguaacuaacuuaaaccaucccagcuuuauauacaugguuguuaugguggaaaugauuuguaauaauagcugauauauguuuuuccugugcaaaguaucauuccaaauucaagggaggcuaaaaggcaguaccuugaguaggguaaauaguuuugcuuugucguucguugcugauaaugcuuuacuuuuauaguaaauaccuacuuaugccauucccauuucauaaagaaagugagacaauaaauuuucugagaucauaaaauuagcaguuuccaaguauuauucccaagcauacuaagucuagaauuagugcuaaaacccaaaguauuugacucugguuagccagagucuguguucaagaacagagaacagagacuagggguggcagcacgugacuuuaauuccugaacuccggaggcugagacaggaggaucucccagccucaucugcaccgcacuuuaaacuguaggccaggcaaggcuacgggugagaccaggucucaaaaagcaaaagcaaaacaaucagaaccaggagccauuguucuauuggaauauacuaaggguucccuacucacagaagcaaagcagaaccagcucacucuuaagucucacugcuguggaaagcacagugggagaggagucuuucuguacacacacugugccuucaacaguaguuauuucacuugggucuuuuuaugauugcuguugguuaucuaugguuuuuguagcgacauuaggcucucuacaauuucauucuuucccccccuccagcaacugaauaacauggaaaaaaccauuggcagggaagucaaaaggcuaguaucaaaacagugaaacauuuuugguuuuguuuuucccccacgaaacaauguugacuuuugaugggaucauuuuggcaagaaguugagagaaguaaaauuuugauccuuagugaauuacccugugcauucauauagucagucacugccguguaguaaauucaggguagggagcauggccugaaggcgcugacucuuauguacauagcucucucguuuuuuugggcaagccaccauguccccuuggccagauaucauuagauuaagacaaagaaugugguuaaaagggagauuaaauaauaugauuucuuaaagucuaccugccaguuuguaaguuuauaucuaguuucucaacuguuuucuauaggaugguuucuguaugauuuuauaucugcuuaccuggccuuaaguuuuuuuauugcugcugcuggauguuuauaggauuucccccccuuccucuucaaauguaagugucuaauggguagacauauuuucaaauaauuuuuacaucaucacaagcacacaaaugcguaacuaccucuuuuccuccucccuuucuuccacccccucucuuuuugagauugguauuauuacaguccaagcuggucucaaacucggcuuuuauaaccagaugucuuugaacugauguugcuacuuguuaucucccaaguccuaggguuauggguuugugcuguauacuuaacuaggagugcauguggaagguauuuaucuagacuuagauuuuucugugauuuucaugaacuagucauagcaggaaguagaauagacaacuggaaaauauauguguguaucaaugugggggcuguaaaauauguauaaauuuauaaauuguuugaugggaaaaguacuuauuuuaaaaaugguaguuugauagcuucauuaaucaucaaaaugacaauguugcucuguucauuaggugguagcucuuaaacuuaguuuucuguugcugugcuucuagaggagugcuguaauuccuguuccuacaguuaagauagaggcugcacuuagaaacgcuaaaugaauacaguguuuguucaugccuuaugcaaacauuuuaaaggcuguguugaaagucucauaagcaccuuuccuggccucuauaauuagggcaaacaauguauuaacccuauuauguaagcuuagagaguaguucauauuuuauuuucuuauauauagaaucuauguuauuaauaaucuccugcuuaaaaagaaauuuuaaauuaggauaugcagcuuuuugaagauuaagaaaauuaaaaucauaauaguucauuuuuuggcauuuauuuccauaugcuuauuuucagguguuccuaauuccauccaaacaacaacaacaaaaccccacacauucuuuuauaaaaccacugaauuuuuaucuaggaucuuuuccuacccauuuacacaguauaacauuaguauggauuuacuaaaacaacuaagagcuaaccuuuuacuaaugcuuucagcauggcucuuugccaauucuaaaauuuaaggaaaagaacaaaccuuaguucugacuaucuagguaaugucuguuuaaagcucuacuguaagcaaucuaguucugccccuaucugcugucagcuuccuuacuuguuccccugaaggaaagaauaauggugaagguuauuuaaguacucaccgguuccuuuguggggccagccuaccaaagaaggucuuaaggaagcuagcagccucuugucuuuuugacccggugguuuuaaccuguagugucguuuguagguucuccucuuggacugg

SEQ ID NO: 274 - RNA, 5284 nt, Mus musculus
augcagagucgccgcgggccggccugugcggcuccuuuauuggcuucaagaagcggaaaacuuccuuagcgcgacgaccacgagugccagcaccacgcagguagccagcagggcagcgaucacgauggcugcaauggcgccugguccaagcgauccuauggaggacagaggaccauguuaccccuccccuucccaaauccagcccaggccugcccuucaaugccuucuuuaccucucauccuccucccuccccucuccuugcuccgcccagguccuaccuccauccugguccacccuggcaggaggggugcuguccucuggugcuggagcagagguggggaacggagggccagagacagcaaauuccugguuguggcuugugcucuccaggggaccuucaccagagggcaauucaauaggcucguuccacagggugggaucgggcuccuggggacccucugcugcaaagucaaaaauagacaguggagcucagguagucugugggcagggaugccaacucucuccaccagaucaacuaagggaugcccuacaccagcucccacauuucacaagguaaggcaccuggcucagaaauucucuccuaaguuugggaaaccauucacaugugacccacaaaacaccuguugagcauugaagccauuagaagacagauugauagggggcagagagccagggacaguugcaaaaaguggggguugcucugucccccagggcagauacagcucagcuaucaccuggggcaaaagccuagucaaggaccuuugaggguaccacuucucagacgaaggcugggagaagccaacccugggccucuagcagccccccuacccgucugccccuucaauccaagacagcauauugcugcuugcaggaaaugggggacagaugaaggggagguggccagcaaaggcaggcuucccacacuccaucggucucagcacccugagcugcauuucaucaacaguccucuaccucuggggcugggagucggcaugguuugggguacucagggaucccagagugaagcaaaaagauaggaaacacaggauggauaccagucacauggccugauguuuccacugccucagccuucccucccccuaaacacacaccacuauaagaagcccagucuguaaagcccagagcaccacccacuaggccagugucucccccaugacaaguucaagaccaggcugguaucaggcucuaagguccccuuagccugucugucagguaucucagcugguccccugaccaaggcuugauuucaucugggaaggaaagccaggggcauucagccccaagcagguuccauacagagacccaauggauaucauucgaucaucuaauuaauuagcugccugcggcacagggaucauuuuauuccuaaucagaguaaagaaagucaagguucagguuaaguggagacagccauggugguccaaagcccuggacaggcuagugauggcucugucuucccaguguccuccaguaaagcuguaccucucuuaccagcucuuccacaacuugcaggucccuggaacuccuuugagcuaagggcuccaucuuugggugccucugucccucuguggacaggcucagaauaaggauagcccaggauagacccaugagacuggaguguuccuguucaugguuuccccccaucucccaggguaaacaggacacagccaaagcccgacucuggucaaccucaaaauaacuaagcccuucaaaaaacaaaaacaaaaacaaacaaacaaacaaaaaacgccaaggucuggaaaggagaaagaagugugaggguuuguucuggaccaggacagggagggguccuguguucuaucagagaaucuggguaaggcagguaaauacagugcugggguuacugucccaguuugaagccacauucugguugggaaagagacugcccuuguucucaacaacagaggucaaaugaugucggcaauuuugcuucugcauuugggccuggguagcuauguggcaaauaguggugacuggugaccagguaaaaucugugccagaguucagaagauaauuuuacaacuuuuuuuuuuuuuuuuuugguaaaauugaaaucuuugcaccauaaaauuuuggcagaucccuuaggauuuugguagaucccuuaggauuuuggcaggucccuuaggauuuuggcaggucccuuaggauuuuggcagguccuuuaggcauuagccuaaagcaucucacaagccugggccggacuugagacucagcuuguagguagggacuaccaucaugugccccggggcgucccaaaacuagacccccuuuucagaaaagacuggcaaaaggcccacgaagaccuuugccuccuacugcagaagccucccucucauagaguggccccagccagccucccucuaagcguggagagugcucugugaggccacagugaccugcuuagaggaggcaguguucauagucugagaaccacaaugaacgaccucaggucucaagcaaucuagugucaggcuccuagggcuggaaaaaaaaaagcaaguaugccugccauucaacaggccuugaggucugggcuucauagacugccugucugucccgagacucuucacgacacacccaaaauagacaaacaggcuggccccucccuaucccaccucuacuggccaaagcucaccuccaguaccaggcgucugaccagggaggccgcccaaggcuucugagugccagggccagccagccgaaguggugccuacuuccuggccagggacugaguuugccccaacccaccaaggaaggggugcaccugugggccguagccaaggcguuaucuuguuuuuccuaugcaagccauguucuccagacuuagaacauuaagaaagagcagcaagccagcucccuuccagucaucuggugaagccaggaacuauaggccagugugccaggaggagaggggugaggguggggaggaggaggccugggagguguguacaggggccccgggagcagaguguagagggcagaggcaagcguugauggagagggcaggcacggcaggagauuucuguucuguccaccuuggccacaaggacacucaaacaccaugacagugagcaaggucacaggaguuucuguucuggcagaggugacacggugucagugucacaagcuuggauaccccaggcuguccccuuaaccccaccaccccaagcuccucugccuuuugguaaauaaguuuguucaacgguuggucugaccacaggcccccaggccaggcgcccaugcucacagacggccuuugugcagacaugaagagccuuuucauccccacccuggccuccugcccacucaaccuggccugcuccccuaccucaguggcuguggccaccagcugaggcgggaaggguggcaggcuggaguaccccaggaguaccccaucuccucuuuccugcuaugagacugcagcccaggagagacagggccacagaccucguacacaccugugcagaccuaugcguccauggcuaguucugagaaccuccuaucuccccacucccagaauagccagaaccccaaaacccaaggugggauuugcaugcucaugccugcugugggcccgccuguuccuaggggagaaggaagucguggaaaaagagggaggugaggucaggcgaggucuuggcuauucccaaagcuucugugggaacagaaagcccacccacuagaguuguguauguauaaucugaccggggcucuggcuagaggcuuagguuggaagaaaccuaacagaaaccuggacaggagccacuaggaaggcuccagcugcaggguccugccaggcaacagccucacuguggcaggaagcggugugggucucagcuccaaguccuaggcaauagaaaaugccuccucccacuguaaguccuaacucagggguacuucaggcuacauuaccgagcacagcucccacuccagaagcugggugugucccaacauaugagaagagaugguucuccccaaaauccauucgggcuuugaacccugcucacacucugaacacugaguguugacuggacauuuggccauccucagagcccugcauugagcccuggugaggccuuagcaucccacuaugagggaggcagcguagugggugccaccuucuacagauuaggaaauggccaagagagguaugagccaggcugggcagagucaggucuuuagcuauuuccugggguguugaggggagguagaacggcccacagaccaccgucaccauccugggguguggccgcgaguuccgaggcuaugcuucuaccacagaggugacuucuuuccuuuguagacacacagacaccccuaaaguucaggcagcaauguuguaagacaaccagggaacccagaggccuuucugcagacuacugaacaacugcgcgagauuuauuuucucauaaucaaagccuaucugugccuaugucccugcucugaagcagacccagagcaggccugccaugcaguguuuuuuucagaccccagagaggccaccuagggcucaguccaguuuccucacuauccugcaaaagacucuaagaaauauuuaucucuauggggacagcaccuaggucguaagucagaaggaaaggguuugcagaauuuaaaggaaucaugagucucuggguuuucugcccagagggucucuggccuuuagcccuuugccuuaugucugaugaguccuccagccucccagguccagaagucuccagguguucuagcggcaaaguauuaccccaagaacaucagacagccaaauguaccagacccugauacccaagucuuuuucaauggccacccauccugcugcuaacauacaucaucuuacucgguuucuaccagccagcauugugggagucucccagaaucaccacagcugggaaucccaccuugugugaggggcuuguaccccauagguacuggaggaucuggucccagugguaguuauuggcccugagaaguugguagcagcagagcugagggccugcgccccuuaccugugagcaccgcaggggccaggaccccagagaugagcagcagcgccacgcgcagggccagacaagaugccauccuggcagggagugagcagucuuaugggacacagaggacuaggcggcugggcucaggcagcgggaaagaggcuucaaagagcugggaaggguuuucaucaaugcaaacucuguccuccugggacaccgugcccgccccu

SEQ ID NO: 275 - RNA, 1281 nt, Mus musculus
aggggaagauaaagggcagagcaugcuggauuuguguauguaugugucuccaaggacaugaauucguuacaguaaaaacuccauugcuaaaugugcagaauacauccugcuuuggaugcuagagcuaguaaaaauaguguccacgggggggugggggcgggggaacuggugaaaucagaauacaguccagagucuaguuagucucacaccagugcaaaugucucagccgacaaacguaccacaguuauguaagacuucaacuugaggguaacuggugugcuguacgugaggacacucugcuccgucuuuguaauuuuuuucugaaaaccuaaaacuccuuccaaaauaauaaaaaaaaauuagauuucauuucagagcuucaaaauccaguauaguaagucacugcugaaguuaaauugcucacuuuaaugucuucuucauuaggacacaauauacaugcagucagcucuguacagaucacagaauucaucucuggagcagaccaccuaagcagcuaugggcaaaguagcaacaguacuucaggcacccagaauucucccucuuccucucuuccaggugacugcucccucauuggaaguacccaguguccugacugacuuguuauagauuccuuucuuugccuguccccuucauaggaauugcagucucuugucaaguauguucuaugucagcuuccaucucucagugcacugugugaaaguuacgaaugccacaguuugaagugacggcucacuauugcauagugugccaguuguccauucaguuucuguugauguguggauuacuuccaggucgacuguuucucuaaggcugcuauagacagacuucccgccuuugauggcuccaaagccuccuuucgcugacacuuauuucagaucacugcaucacagcuuggcaugcguagcuuuagggaauccuaccuaacaauuuuccaaagugguuguaccagcaaccccucuucaaagauauauagaugauucagugguccagagcccagccaauccuugcugcuauugauguuuaaaaucuugaucauuuuaguagcuaaguuuuaaucugcauuagcucauggaccaguauuguggugagcaguucccauguguuuagcaaccuuuagaauauccucuuugggaaaggggcuguucaaagcauuugccuauuuuuauuuggacugguugguuuucuuauuguuucuguauuauagauaggggguccuuugucaaacacgugugucauaaguauaucccuccuacugacaac

SEQ ID NO: 276 - RNA, 1061 nt, Mus musculus
gguuuuuccaguaaaggguaacuaacuggccucggaggaaaagcgcacugcagcaggaugagcaagcccgugccagccggaacugccaaggcugccccacgguggcaaccugcuagccaccaccuguccagccaccugccugaggaagcccuuccaacaaggagggcucaccucggcaagaaaccauacgcaguuuucaagaggaaccagaaaggaaaagcaaagggugcaacuuuauucuuagggaaagacaacaaaaaggcaugugucucucugcacugcaacccgagcggcuggaguucuccacggagagaguucugagcccagcgggugaggagucccggcuuucccaaggagggaggagggugaaagggaggaagagagggagggagagagggagaagcggccacuacacgcgcaucccuucccuuucggaacauaggggugaggaccccgcagcgggcugagcaguggagggagagccugacgcaggugaguacgggaagcugcacccggugcucagaccuacagaccccccaggccucggggagcacgcgccugcggcccccgcagcgguccccgcagcggccccagcagcacgccgggccucggucuccucagcggcggcgcccaccugcgcccaguccccgcagaccgguccccgcggccccguccucgcggcccgguccccgcgguccguuaagccgcggcgcgcucggccccguagcagcgaccgcaggaccucgggcccggcagggccugggcggccgcucgcacacggucacgggccucggcagggaccgcggcgugaggggcgcgcgcccggccgacgccgcgggcucaccuucugccggaucuggcccgacguggacaccuuacggauaagcuucugcggggagcccggcucagccucggguucacugucggacgacuccucaggcggcggcggcggagguggcugaggaggacccggcggaggggcgcccgccgccgccgccaugcugcccggccagcgcgcgcgccgcgggggggcggggcggggcggggaugggaugggccca

SEQ ID NO: 277 - RNA, 1056 nt, Mus musculus
ugagagacguuugcgucacaagggaguguggcgccggccgguaggcgggcguucagcagcugccaccgccgcuccagcgccgaggccgcgggccggccagccgccaugguggacuacuacgaggugcugggcgugccgcggcaggccucagccgaggccauccgcaaggcguaccgcaagcuugcgcucaaguggcacccggacaagaaccccgagcacaaggaggaggccgagaggcgguucaagcagguggcgcaggccuacgaggucuuaucggacguccgcaagcgcgagguguacgaccgcugcggcgaagugggcgaggugggcggaggcggcgcggcgggcagcccguuccacgaugccuuccaguacgucuucuccuuccgagaccccgcggaggucuucagggaguucuucgggggccacgacccuuucuccuucgacuucuucgggggagacccccuugagaacuuuuuuggggaucggaggagcacccguggaagcagaagccgaggggcuguacccuucucuaccuccuuuaccgaauucccaggauuuggggguggcuucgcuucguuagauacuggauucacauccuucgguucuccaggaaacucgggccuuucuucuuucuccaugucuugcggcgguggggcggcaggcaacuacaagucggugucaaccuccaccgaaauaauuaauggcaaaaaaaucaccaccaagagaaucguugagaauggucaagaaaggguggaaguggaagaagauggagaguuaaagucccugauaauuaauggcaaagagcagcugcuucgcaucaauacucaguaaagacuaaagugucuuuuaaggacuaucaggacuuuuuuguuuaaacgcguuuucaagggaacucuacuuucagaacaacuguauuccagacauuauaugcagcucaugucggugccucuuguuauuguugggaucgcagggauaggaucucucuuggucuuuaugccuguuguaaauaucuguaugccuuuggcacuuauuaaacuuaauccugaggcagac

SEQ ID NO: 278 - RNA, 6572 nt, Mus musculus
agaucucuggcagcaucagagagagagagauaccaugacuguggugugcuggagcucgcguuugcuucugcuucuuccguaccuucuguuguguguguucggucccucugcaucccacgcugggaggcuguuaguguucccuauggauggaagccacuggcugaguaugcuuggaguuauucagcagcuccagcagaaggggcacgaaguuguggucauagcaccugaagccucaauacacauaaaagaaggaucauuuuacacucugaggaaguucccugugccauuccagaaggaaaaugugacagcuacuuugguggaacuuggacggacugccuuuaaucaagauucuuuucugcugcgcguggucaaaauauauaugaaagucaaaagggauuccaguaugcuccuagcuggcugcucccaccugcugcacaaugccgaguuuauggccucucuggaagaaagucacuuugaugcucugcugacagacccuuuccuucccuguggcuccauuguggcccaguaccugacugugcccacuguguacuucuugaauaaauugccaugcagccuggauucagaagcuacccaaugccccgucccauuguccuacgugcccaagaguuugucuuucaacucagaccgcaugaacuuccuacagcgagugaagaacgugcuccuggccgugucagagaacuuuaugugcagagugguuuauucccccuaugggucacuugccacugaaaucuuacagaaagaagugacuguccaggaucuucugagcccugcaucuaucuggcugaugagaagugacuuugugaaagauuaccccaggcccaucaugcccaacaugguuuuuauuggugguauaaauugccuucagaaaaagccccuaucccagguguguauuggcgccucuccaggccuguuguucuuugggagaaaggaacuuuccauagguaugugcugaucucagggaggcuuguaugguuucaaguguucucucuuguuaacuucuauccccuaagucucacagucuugaauuugucuguccuuggcauccuuuucugacuuaccucuuuguauacaguauucugagaaauacauaucuuaggcauuuuauccuggggaauucaauuuaaugcagccagcauuaauugucagaagaaccacuguguuugggacacuucucagagaacagagcuguguacuacgaagcaucccuuuggaacucauguucuugauucaggcacuaguagcuuaagucugaugcaauuguucuuuaacccuuauggauccuggcaggagucacuaccuuuaugguccuuguuaucauucuaaugucuagauauccuaacagaaaacuaaauauugcagucuuucucuucuuccaguagggcaaagugucaucccucugucugagcaagagacaaucuugguaaaagaaagcaauucaggaccacagucauacauguugagucugaaguaaauagcuaauaaggagaucagagaagccagagauagaaagauacuggcaaaagagaccaaucauggaggcaggcaagcuuguacuugguucaagggaaaggcgucuaacagguagucuaaauggauucuaggagagcaaaagauguuuuguucagaguucagaaccaacuaugcagcucuuaguagaauguaagaaauauuuaauggucucgucagcuggagugaaguauccguagagagaaggucuuccuuuuggagcauuugucauguuuagaaagaaacaagucugagaucaaagaucauuugcagcuaacauguugccucacuguuuggcugucccaaggacugugauguuguggcaagguuuagggcaucuugugccaaguagagggaacucaccucuguugaauccacaaaaguugaugcagagucauuguccaagcugccucuguagcucacaagcuugcgugcuaguuaagccucggcugaauccugcuaucugacuguggauguuuaugacccuacagagcugcuuuugugccaaucacacacuacuggcugccaaguaggggugggaggccaugcaggagggaaaacuagacugaucucuuuccagauagacuguaggugagcuaugugcuaucuggagguagcaggaaggcaaagggcacuaggaugugagcugccugcccccaggaaagaagucucugaggagggaaggaaaacaagaggcaauccuagacaaggaaggcuuuagagcaaccaacucuaguaugcucuuaaaagagaucaaaauccagagccauggcagaaaagccuggccuggccucucucacucuuuaaauggguccagugggugagaccaaggugccacugcugugaugauccagggggcugcaagagccuggcccucagguguguggaagagggcuguuccucugggaagguugcccaggguuugugauccucauguguucaugauagaguuugguagucaucucucuguaucuuacauguagggauaucaggacaugauuugcccaggaaaauuuagauuuaaggaauaaaaguaccagguuccaggcagcuccucagcugcgggcagccuggcaugucauaccaucaugcuaauguucuccacauucuuuggaaacagcugaguccaucagagacucuuggugguuaguuagcuuauuaauaauguacagcaugggagaacugccaugcuacuuagagucuguuuucuguguggggccacaaguaggaacauguguauggaccugugucauguucauggauguacauucagguguaugcacacucacguaugugccucugcuuuucuuaugggaagucagcacauuauauggauucugcaucuccagggaacccuacagauaacccuguaagacauccuccugaauugacaggggaugaggagacaguugccaugaugaugcuugucuauugcacacacccuuucacugacuuccauaagagggaaguaacuuguaaucuaaugugcuuaggucacaaggaaugugagggacaagagaugaacuagaaauaucuuuuucuacucuaggaauuugaagccuaugucaacgccucuggggagcauggcaucguuguuuucucuuugggauccauggucucagagauuccggagaagaaagccauggaaauugcugaggcuuugggcagaauuccucagacgguaagaugguucugcauggcuccgucauagcuguuuugagaacucugguuccagagucaggggucuggaaauccucugacauccuccaauguuguuguuguuguuauuauuauuauuacuauuagcauuagcauuaguaucuuauuauuauauuuuucaauuucauucagguacuccuacacuauggucuauuucacucagauuucuccuuuucucuaagaaacuucaaaguauuagggagaaacuaguuaaaaauaagcauggaacucuuuuucauaccaaaugaggauguuuuaccaaaaagauuuaguuuugguuugcucuuccuugguuagcucuggacauucacugguuuuguuaagaaaguuucccuuugcagugaagaaaagugaagaguuucccagugccuggcuugguggcuucucacacucaaaucaccaggcuucagcaucaagauacaguguugucugagcuccagggacuuccuaugcaccagaccucccacaugcagaggccauagguguucuuuccagauaacuggccuuucuagcuaguauugcaauuaaaaaaaaucacauuguguucuuuuauuaaacauugugcuuuuugccccugugagguccuguggcgcuacaccggaacuagaccaucgaaucuugcaaagaacacaauucuugucaaauggcuaccccaaaaugaucugcuugguagguugggggcaucugacauggaaaaucaaaccaggguuaaauuaaaaaaaaaugacaaacaugaauguuuuaaaugacaucuuagcuugauugugguccguacacauaagacauugcauacaucacuccucccccucccccaccccaauuuucuacaauggucacauguagauaacagucccugggguauucucagaauccagacucugugagacuggcgagcucagcauccuugucuguuguacuucucaggucauccaaagacucgggcauucaucacacacucuggcucccaugguauuuaugaaggaauaugcaauggaguuccgauggugaugaugccccuauuuggcgaucagauggacaaugccaagcgcauggaaacucggggagcuggggugacccugaauguccuugaaaugacugcugaugauuuggaaaaugcccuuaaaacugucaucaacaacaagagguagguaauagaaaauaaaaaacaaauaaaaccaagaacccaaaaaaacccuacuuguauucauaccuacagcauuuacaagcagcacaauaacaaauacauuuaaaaaaaucuauauuuauauaagauaaugugggaguuauuccuauuuauaaaaugacuacauuuuaucauaaaaguuuuuuuuaaaauauaauuucccuggauuuaaaaucuucaauuaaaaauaauaucaccagaguaggcaucucaucucuaagauccuaccaagagagaaaugucccauuaaaagauguguagggguggugcuggagagaugcagcacucuguggguggguaagagcucuugcuguguaguacagaggaccgagucaaccuccagcauuuaugugagaugccaggccucagcacaguggaagggagaggcaggagaauugcuggggcuugcuagccaccugccuagaucuagaucccaugagaaacugucucaaagaaauaaagugaagugccacagaggagaagauugucuuacagcccuugagugaaagcauagacgacacaugucugcacagacacagaugugugagugcacaugacugcacgugcacgcacgcacacacacacacacacaccaugagauugcuugaucucuacuugaaauuuaguauauugcugucaagguuacuggaacuauuuuguugaaaagcucuggaaagaccagcauggugacagacauuuauaaucucagcacuuuggugacaggacgauugcuacaaguucaagaagaguucaaggcuauauagucaagauucuaucuuaagacaaagccaaccaaacaaacacaaauaaacaacagcaaaucuccagacaacaauuuaaaagguagggagguggaaccauggcucggcaguuaggagagcacuugcugcucuuccauacaaccuuacuuuguuucccagcucuaggggaauccagugcccccuucuggccuccauggacgcugcacucaugugugcacacacauagagacucaaacacauaaacacaauaaaaauaauaucuuaaaagcaauaccacaaaauuuuagaagaaauaguggccagugguagauuuaacccagcagcagcauuugguguacucaugagaacauguaugugaaaguuucaggcacaugccuuagccuguuuucugcugcaauaacagaauauccagaaugccaugacuuaugaaggaugaaaguuuauuuggcucacaguucuagaaguuguuggucuaaugcugccucuccacaugguagaaaccuggagguucaaaggauguguauaugcaagagacaaaaugcaaaugacauccaugcuugaucacaaccugcucucaaagugacacguuccagcucuggggacaaaggccgccaucucucucaauggcuucucaccucccaaaaguucuaacaccucucuguaccuucaccucggggaccaaaguucucacacaugagcuuguaggcagcacauucaaaccacacuacccuuucaucuguaguucaugccuccucaacuucauuuuaccauaaggaaggcauaauauaauuuccuacaaagaaaucacuaaaagcaaaaaaaaaaagaaaaaaagaaaaagaaaaagaaaaaagaaaaaaaaaucugguuauauuagaaguacgcuucucuucuuaacuggagucaagcguaagggaaugcugucuguuacauggguguuccaggcacuaacaauugccuuguguucagcuacaaggagaacaucaugcgccucuccagccuucacaaggaccguccuauagagccucuggaccuggcuguguucuggguggaauacgugaugaggcacaagggggcaccacaccugcgcccggccgcccaugaccucaccugguaucaguaccacuccuuggaugugauuggcuuccuccuggccauuguguugacaguggucuucauugucuuuaaauguugugccuauggcugccggaaaugcuuugggggaaaggggcgagugaagaaaucacacaaauccaagacccauugagaaguggggggaagugaaggagaaguauuaguucauuaucugaucaguugaaacuuggaaacaaguguuaaauccauauuguuuuuguuagggaaauaauucaccauacauuaua

SEQ ID NO: 279 - RNA, 18829 nt, Mus musculus
ccuaugugaacuucuuuaacugccacuaucagagaguaaagaaacaaaaguuaauuuugucuaaagaauuuauuuagccccaacuaaccagauuauggccauuucaagauaugaucgaggggaaaaauuguuaugugguauuuuugcauuuguuggucgguugguugguaacaaucuucaaaguccaggaaggucccugacaggaaggaaugcucuuugggagcauccuguucccaucucauuccccacagccaugugauuccuccacagccagguggcacuuuuuuuuuuuuuuuuuuuuuuuuuuuugcaggcccagaaaaagccugcuguucucuguggcuuccuguuggaaacaacagucuucaugaaaaacaaucugucaaggaucagaauugcugccugcaacuuggcgggugagacacguguccagguucaggggggaucuugaagccacauaguuaauccuggguuuggaugggggagucaaagcagcugaggugggaggagggcgagcccuagucuagcuugcaacacuaggucugccaguccuguuucaugcuccccugaucuugcacacugccaacuucagccagauaagacacuugacugaugucuucacaggucaaugugugccugccucucuuucugggaggcagccagcccugugggccuggcgaccccucacuggaguuaaggcaugacuguacaucuaucauuucaggaauuauuaugaagcagcugucugcccauuaucugaaaaagauggaccuugugggacuucgcaauuguuaaguagcguggacucagugguagaaauggauggcucacuaggggcuuggugacccuuggcugugggcuaaugggggaagaaggaguagcugggccuagagagaacaauugaauguagggagagguuuccagggagagcauuuggugggcaccauucucacauguuucugcugucccuguuaguggugucaggccaccugacaggucuguggaggguguggaaaaaugagucggccugccucagucugcagugggcugagugcaugugguccugacucaaagaccugugcuuuuuguccccucucagcucuccaggaccugcagcuagacucagacgcuggggucaggagggcagccuuggagacccucaaaguccuggacagcugcaaucagcacuggcucuuagcgucacccagaggacugccguaaguggcccugaugcgagugaacugcuucaucggugucacaccugccacagcaaggcaaaucacuuuucauuuguagaaaaacuguuguaaaagaauggguauccaacucuccucucccucugaaauauaucuccacugcucucccgagugcaggcuccuggcuguguggccaucacaucccagagccaaccacggggcaaagggcagcuucagcccuguaggccucuuccuccucagcugagccuuuguggggguggacaagcaugcucucccauguguccugauguguacucacagcggggcauggugacaggcaaggggagaucaaacuacugcccagccuguccccagggaccuuguuccuaaagcaaaaaggcagaugcaugcauagacacugugaagcgcuacaccugggagacgguacucacacaaagccuacccuuccccuuucucagagacccgagauuaucaguguuugggccacuggaucaggagucuaguggggcccgcccggaacaguuugguggggcaaccaaaaggguaauuagucccauggcuagaaaucuggaaggggaagaaaagagagcaaggacaacuuucucauccuuggguugcuacugaggccagggcaggaaaaaaugcucaaggcagcaccuccacaggagagaugcucacccugucugaagcaauucacuugcugaggcuucucacagcggugauuucugcaaccuuuccgcuccaauagaguaaauagagaagugcugguaccgacgacucuggcugugcuuguacacuagcccaggaugugucacguaacauaugcacacacaucugugcccagggcuccccuuccaccugggcagaacacuuagaggccaaagggugaccagcagaaccgagggcaggggccugucucugaugggacuuuucuuuuaaaaaggaauagaauucagaaaguguaaaaggucuaagcucucuaaccauuguaaaauguaacucugcauaacaccagaaaacuaacaaaucacagaggggagguuauuugugaucuguauaacaugagauggggugguguggacucaagaggaaacccaauucuaacagaggugaauagaacagugagugcccugagaaccccggugaagucaggauagucagggcaguaugcccaaccucaaaugaaagcagauugggguguggggcugucagcgcucaacaagcaagcacgaagcuuggguucauccuuagugccucaaaagcagagaaaaaaaaucaccacaggugaaggaagacacaccauguuugucacugccagcagagagcaccaaugggugagaagcgucucuuacaucgcucuacuggguagccauuuguaaaggcuauucggcaaguuauacuguauucauucuaagaguguggcaguguugugcacauacacauguccacaacccaugugggccccuccagauaacaccaguuuccuaucacuaucacaaaauacucgaggcuggacacuccuaaucuauauaacgguuuaacuuaguuuuagaaacccaaggccaacucuugugguagacgagagaucuggugagggccuggugucagauaugaggauaugugggggcagagcaggcaccacuugcaaacaaacaaacccacucacucacuaccaccaccagcaaaaaacgcccaagcagacaaacaguaaacuagagaauugggugaagucaggccugggcuuuuguaaccacucugggaaaucaaccucagcccacaggugcacgcaucuaccagugcuacuaccuggggacacaccuccaauauaagaagugcucccuuggggcaagcuccugucaacugugaagcaaaccugcagaguagccaauauucuuugaguuaaaagcagagaaguuaucaguuagcggcuccuuuagcagcgcucagauacucgacuuccacccuugcccaggccagcucagccuccuccacuaggggauuccggaccccuguguucucaggaagggucaggcccaaagaaggguuggucucgcuacagaggucaugccuacucuggagguucaugcacugccaaaauaggcauccugcaaggugccaggcucucagauuuauugcuauaccaacacgaguucuucaaauucagaugaagcccugaacccagugcaguguugucugggcucaacacuguguaggccaggaaggcuacauggagcccucacaauaaaaaugguaccuuuuuuuuuugagacaggcucuuacucuguagugacccucuuguuuuagcuucucuaacgcuagcauccugagugagucagcguacccagccaugaacuuuguugucacaggaucucgcuccaccucccggagguguuuugucuauagccagaaagaaaccucaacagaacaggccaaaccugcacccucaucucagccuucuccccuuacagcaauuuauuagcaguuugcugucagcagcuuggcugguggccagaugauggucaacuguuacagcugacucacaaguacugcaaaugggggugggggaugggguggguguggaggugggaacucaggaaccauuguaagggaaggacaggagaaaagccugcucuucagucuuacauugaaaaacacaagaggcaguguacuaacaacugucccuagauaguuggucacuugaguucuguuaccacccacgggguaacugaaauuguucaggaauacuagcuauuggcaacuagacaccaccucaaguagcaucagaggccucgugggugcugcauggcugcaagaacauuuggaaagaauucagaauuguuuuaaauauuucuucuaaaagcaucaagaccuugggauuucuucuugugggugaagcucaggcaguuucagcuggcugucucuuuaaaaaacggaacagucuuauuuacuuucaaggaucacugugucugggggcucaacuguaggugucacgagcaagugauguuucaaaacacaaaauguggagcauacucuagacggcaugccagagucagagaagacaaacagguccgcagggcagaccgacauugguaaugcuaaccauauaccuuuauuugcaaaaccaccccaggcacuuuccacgguaccagcugcccuggagcaugaagggcagacagcugugguacagcaugcuugaggugcaucugaugccagcaaggugaucgggacagagaccccuucuaaaagcagaacuagaggcaaggggcaagacaaaauguuuaaacuuuaaauuuuuccuaucaaaaaaaaucacuuuuucauccugacugcccaguguaaaccccgaggcaccuguguuaugcccacugugggaaaucuccuguugucaaagaacucaaggcacacuacgguagcagcaaugauaaugguugcugcugucccggcaguuugcccuggguaugucagcccaauuugagugaacuuagaggagucagcagacacaaacugucuuccuaagagagacugcccacaucaccaaaggguccuuagcuagauagagcaagguauauaaaagccuuacuggucuagcacaaaggaggaagaacuagcuccuaauauccuucauguugucacugaauguagagaccugguccccucuccaaguaauuuauagcugacauagaaagaaacagaaaaugaagccauuuaguguuuaauguggcucaagauggaacuagagaaggcaucugguaaaggcccuaaggauaggcuaguaacuuccaggggaguggugaggaacuccuggguaccagggaagaagcucuaggcacuaugacugccacuaaccagcaacuugauucuauucucugcaaagucgaagucccugcuaguaguugggcaagcgaggucuccgggcugcaggaaaagcaagguuuucuccagguagagugccaggcaggugggacuucaaaggcagggcacgcugcacacauauaaccccagcuucuuaggaaggcugaggcaggaggaccacaaggucaagaucagcuugggcuauauagcaagacaggcuuuaaagacaaaguagcaagauuucguuggcucuggagcugaaggcaggcccagaugggugggcaagggacacagcuguauucuugggacagcuggggacacaggcuggaaaaggaugcagguucugaacuaaggucuccagcgaccuuucuucucaucagaaucucagauuaccccaaggugaccuagacacgaguccacucucacagucacuuccauagugauuucuggagcaggccaccaaggcacaccacgauagcaguuuggucuaggaaagucaagggggcucacgagguugaggcagcuagacaaacagcucaaggccaagagcaaagggagauagcuggugggaauacccugccagggauuccugccacaccaggcagccagagacccaguucaaccagggaaauacaguucacaaaguauuuuuauccauggaaauaaaucagaaaacaaaacuagccucagcauuuggaaaggaggaucaggaacucaugguuaccuugacuauccaaggaguccaaggucagcccaagcuaugcaagacugccucaaaaaccaaauaaaacaucucccccacccccacaaccagcgcucuuaagacuaagccgagaggugugaacagcguucugucaugacucaacucauggauuuaacaccgugcucuccugaaggacacucaccuacucagaagcagaagugaggaaggugaagaugggggaguggggaguagagacacuguaaguaauucauguuaagaggaaaacugccacugagaauccccugaauaagauaaagagacacaguaauggccaaggcuggcuagagaagcccaaggcaccaacaucccacaagaaaggacagagaugaugcugugauacggagcaggggagguggcuggacagaggccaaguggcuacagggagcugcaauggaagacugcucaguacacaggaugcccuggggaccguccuccaaaaggagaaacaaaagucucugcugaggucuucuuccucaaagcagcugcugacuacacauaagcaucauguccaacagacaaacacgcaaucagcacucaggacacucagggccagccugaugcuccugagguaucgugaaacuuggccuggugagcacaagcuaccggguaugacaacuugcaccucuuuguuggcagccaagagucucucacaaguguacuagcagucugugcaguugaauccugcaggacucuucugugacagccaggagagauugaccguuucugggaacucuguuguggggagucuggauuuagucucuucaagugcucugauugacagggaagagcugcagcagcuuucauuggcgauacucugccacacgaagucaccuucgcccgcugcggugacagacaauacuucugauaaagucuguugaauucuuuuuuaagcucaucauaguuauccuucccacagccuggagagccuaugcuuggugcugaaauagcuguacugggccacacugccuuaccaguagguucagaauugugcucuugaaggccagagcucagcugagaauggcuggggcuccgugacgggcugcccucuggagagggacagcuccuuagaagacagcucuuuguuuugacagacuuuccauuuccccucaggucuucuaaagcuucaccuggccuuucugucuuuucucugccgaaaggugaacugggccugcagguuucuacauccugacggcugccugggcucuuagaaccacuucuguacacaucgacagcccaagacucuguggggucagucaggcgaggcuguuucccagaagacaggcaauauuccugaugaagcuugucaaauuugauuuuaaucucucuauaccacuucucuacuugacuuggaagcauccuuggucugggaaccaccuugacgggugaaauuagccacuguaaugucaucacccuauuuucucgcucacgguuuaaguccaaguccuucugcggcaucaucuggagcuccuuccaagcuggacuggauuuauggacuuggcguuugcuuccuucaagagaaacgcuuuucaguucuaagccugucuuguggggagcaacgugcaguaaauucccguagucucuuaauauuccggccucuuucccgggcucugagcaggacgcaggccccuuccuggcacuccucugggagggcuugcuccgggggcaguguguccuguucuugugcagccccugcuugcgugagggucuccuccggagcuuccagcucugguugauguaggucuugguggagaugaugcaggauggcuuugagcgcagcagccuacucauggaaugcaucaugccuucauacaaaucgcugauugucacauugcaaaggucaucaaccucaaaggacuggcugcuuacgcuguugcugcuggucccaaguaaggagaggccaucacuucuagccacaauggccauaucagcugggcaaggguaugagggacccuggccucuagaggacaaagcagauacuucaggaccaccagagcucuuugcagagauagcauccuggcauccuaggagagaaauagacaaagucaagagaaaccaccauucaauccacccauacuuacccaccgggcagggagcucaagagggcaucacaaaccaugacaguuuaaauaaauaaauaaaaccccagaaggguuaaggagcagacuuuauuucagcagucaaaauuggauuucuaaucuuccacuccagcuuugcaaaaggacucuucuccccuuacacuguuucgagauggcuuccgcuuaaaagccaauacaauacacacauagaugaaaaccucaaaaaauuaauuagaaaaauucuaccaucguaaacauuuuaauaagaaaagccaacaaaggggacagaagagaugucucagggcuuaagagccuugcugcucuuccagagcauccgaguucgguucacagcaccauaccaggcaacaaaugccuuuaauugcagcuccaggggcaucuggccucuguagucugugaaaccugaauacacacacacacacaccccacaaacauacauggcaaaaaaaccaaacuguaaauaaccccaaacuccugaccucuagagggagggccaggaaggcgguacccacgcagcuaugacuucuacauuacacgaguacuucauagaucucaaaaaguaaaacccaaccuacagaaacaggaacagccccaaauggagcacuugagacaggcuaccccagugaugaccacugaagcagcugcuaaacgcagugggugcugcccgagccagucuaauacaaaaguggccacaaaggacaucgugggucaguuggaaaaauuguagcaugccaaugagaaguuuuuggcacauucuaaacuugucauaaucacugagaagcacccaguccuugggaaguacaugugaaacauuuaggggcauguacuuggcuauauauaugacccaaauaaaucaacaccgccuguguacauacaugugugccaggggcaucagugagaaagcaaagaugaacgcgaccugugaccugugacgcacaaggcagacagauggcugcugcucacuccugugcugcuagauguucaaaauguucaaacuggugagggcaaagaccuauccagcaacugguaucaugacuccagagagaacuagcucaucaaggaaaccugcagcauagccuggguacaguuucuagagcacacacuugucacugacaguuugucgccgagacacacacccaugugaaacauccaccagagguggugccaagggccucaagucuccaaagaggaaagacaaauuacucccucauacucaccagaggcuggugugacagaugaggucacggaaggaacccaagucaugacugugucuuuuccaccucucuucucugcguucugaaaucagagccagugaucagaaaguuuuagauguuaagaccuugcauuuauggaucugggcucucucuaaaaauauacuguccuuggauaaugucaguuauucccacuucaaaacaagugcguaccauaacgugacaguggcuaguuagucuucaagccacagaaggaacagguggcccaaaacaucugagaacucugcccacaaacacagacuuuugugacagcuacuccuggucuggccaucgguggcucucaucuaccacuuggauuacucggaauggccaaaggccauagagaucgugggcagaggccagacaaacuugggccuaauuccaaccuuuuccuuugaucacauaacaaccaaaaguauacuacuugcuacucuaggugcagggaaauauacuccgaggacaaugaagggaucuccaaacacaggcuucugcuggccgccagcauagaaagaguaacgauuucaugggaacuugcagccaccaugauggggcaaguauuuguuauuugacacuacucaggcauguggcauuaggauauuaggaugugcuuuguuuuaugaaagaugcugacagaacugggcaacuagcagugacaucuucaaggggaccuccaacuccagcuguacgaauuagcauuagaugucaacuugucaaagcccaagaguuaccugaagagucucaguugaauaacagucuuuaucaggugcuuugucggcaugucugugaaggacugucuagauuacuaacugaccaagaauggcccagccuacugugggcggcacccauggcaggugguccuggacuguagaaggaagaagcugagaaagcgcugcaguauagcagagcgagccugugcugggagagaggcuacuccuacagccuucuucgugccugccuuucacucaccucacaccaggagcagcaagcaggggaucaaagaggaggccuccccagggaaggugggggcugcuaauuccucaacugugcagcuaagaacuguugcugcucuugggguccaugggccccacuggaucugagcuaccccaggacaguggacaagucaccuccagcgugacucucaucuucugaguuccccugaugcugucuaggccucugggguguucacugaagaagagcaaaggucugacagcauaugaaaacggaaaucaaggagauagucacccuucucagguucugaggauggcacaccgaauccugacgacugcaccccaaucuguuguuaacgucuagucaagucagcacauacacacauagauuaccuuaaaauacucuucaucuugaggcaauauauccaccugggucaaguacuuccuucuuaaaucaguuuccaagguguuuccgggcacugcaggcugauaagaaagagacgucagaauauuccguuggaauguagguaccccagccuugugaauacuggagcaaucugaaaucucauaaaugugugaauacuuaaagucacuucuccacauuugcugugguauggccucucugaacuuccacagacccagcaucugauagagcauuuacccaggaaucagagaagguaaaaugaccgagaccacauagccuggagaugucugugacagcugaggcuggagacuauuugaauaccuuggcugaggagacaggaauaugaauguuccugcucaggggcucuagggacccuggcucucccacucucuccugguaucgggaggguuccaaccuccaaagucacagggcugggaaagugcucuaaugagugagcucugugagaaccaaccagccagggaggugagaaucaaaugguacaagaagguacaugacuccagcccuggggacacucagggaaaggagacacaggaguacacaacauuuagguuagugaccuuuugagcacacagauuuugaaaugccgauuuggaaacacuuccucaugucacugucugaggguaaagcuggcugggaaucccacccacaacaucuaguggccagucaaggaggguggcauacaacgaauacccuccugcucagccaucagugugagagggacacuggccucucaggaggaccucagcaucugaaugggugacuggaguuauggcagcagagccguaggggacacugaaaaagacaugaucucuggcggcugcggcuguaccugacgcugccuaggaucaccagaggcuucucucaucgcugagcugcaagauggccaguucuccucuaagcucguauccgcaccgcugcucucugaaucuagaagagaaaacuucaaucucacaggcacuucuuguagccucccccagucuugaguaggcuggcuuugaccuuguugccacagagaaugagaccaccugggguggagccuucccacuuagauggcucuauguuucugucaccugcugcugcucuucuccaagacacugcuaccugcugagaggcccuugagauauuccagagacagcaucuggaagauugucuacaggcuggcgacaggcaccaagaauggguugggggggggcuccccucuuuauaagcacagacucuuaguaaacuuuggggcuuugaucagaaccugucuuggccucguccuuuucucgcugucuagucucauucagccccagccugacuuucaggaguacccgguucguguggccgugggcggcucacacuucugguucucacucgggagauauggcuaccuacggugaagaucccuguuggcucaaaaauguuccucuggagucgggugugggaagccacaugugccguugcagaguggcacugacaacugcuggccaccacgcauaaguuuggacaaacaacuaauguguacauaugcaguaaaguuuuuugcaaagacacugccuggcccaggcaugauaaugagguucuguaagguacugagaguauaaccaaucagaugugagacaugcaaaugagguaugauaaugagguucuguaagguacugagagagaguaaccaaucggaugugagacaugcaaaugagguaugauaaugaggcuuugugagguacugagagaguagccaaucagaugaggaacaugcaaaugaggcguagugcauaaccaauccaggugugagacacaccucuccuaggccuauaaaagcagcaccaguucugggcucggggucuuuucgccucuacaaucaagcucucccaauaaacgugugcagaaggauccuguugcagcgucguucuuccuggccagucgagcgcgcgcaagagucgggaagaugguuuagggguuaaaagugccuguggugguuugaauaugcuuggcccagggagugacacuauuagaagguguggccuugauggaggaaguggucacugucggggugggcuuugaagcuccauucagugugcaagagacaaucuacugguuuucuuuggauaaagauuuagaacucucagcuccucuagugcuaucccuaccuggaugcugccaugaugauaauggagcaaaccucuucuugugagcuagcccuacugaaauguuguccuacgagcugccuaggucauggugucucuuccuagcaauggaaaccuucacuaagacccuacccuucaugaggaccagcgugaguucaguucacagcacgcauaauggguggcucacgaccacuguaacuccaguuccagggaaaucugaaacccccucaugcacagagcuuaaaggaaagaagaucccuucgugcccaggauugccaggagccuagaacccugggcagggaacuauggcuaggcaggcuaagggaaacacugaaacaccccaggguacucauggccccacauccaaagccgcccuuaaggagccauucugaauagcuuugaacagcaggggaggcuuugcagcuaaguguucguggagagaggauguggauuaauaccagagaaugaggaaaccuugcaagcagccaucaccaccuucucucugcuuuuacuugggggaaaaaaaaagucuucccaacuccccuucugugacacagacucacuauguagcuuuagcuggcucagaacuuacuacgagaccuagcuggccucaaacucacagagcucuaccugccuuugucuugaaagugcuuggauuagacgugugcugcagaguaaaguccuaaggauggacucugcagccaggauaaacccugggaggacucucugggcagcggcaaacccaagccagcaagggggagcaccuuucuggaaucugacugcaaaggacugaauggaagaagccggggagacaggaagagcacagccugggagcccuguagaagggagagaagacagacacuggcuacaaagguguguguguguauguguguuggggaguggggauaggguguuccuuuccauaggagcuggugcucacaucaccauccuuaagggcaaauccuaagacucacuaaacguuaacaccacugcgugagacauggcuccccaucuuccaaggaccuaggaggacauacuggggcaauuuacgauaacuuauguuuuuaaaaauacugcuuagcaaucuagauaaaacauaaacagugaggaacucuuguggguacacugcggcaguggagacaagugggcccugucccuacccucccuuucuaauaaagcaacacucauuggcucccaggacuuguguacaggguuaucgauacucaccaccuucuggagcuugcccauuuaaucugucaaucaccuucacaggagaaacacaaacuugauuaaguaacagaacguuucuagccacuguauaucaagauauucacaacccuugcaggacacacagagaacaggaaguuuuaucuuccuguaccuguuuaauaaagggccucaagacucccagagguaguggagaacuccaauggucacagagagaaugcagcagcauucaggaacucacagggcugaccugggaucuauaugcaucgaugcacuguguguuuauggccacacaguggcuucugcagcucuugcuggguggagccagcaugcacugccccagggaagccauuugugcuuucuaaagccugugaucaauugcuaggcuccauuagggcaucaacaggugcuucuuagagaaaagacugccaccgggaaugguggugcacgccuuuaauccuagcacuugggaggcagaggcaggcaaauuucugaguucgaggccagccuggucuacagagugaguuccaggacagccaggacuacgcagagaaacccugucucgaaaaaaacaaaaaacaaacaaacaaaaaaagacugccuacaguuuuacaacagcacggggagcaauguccuuucaggugcuagcucuacgggugcuagccugaaguggccagguagcacuuaacugauccugccuccuggaccccaagcaagcugagaccccaaaguucugugguuuccaaugccugaagggcagaacuuuugacauucaugggagcaccccgcccucagagaccccauauugcuuauuugguaccuacaaagagagcccacaacaaaccagcauggggcaauggagaguccacucuaacuuccugccuuccacaguucucagaguggcauauuggaaccagcauuaacccuuugucuuggggguggaggggaucaccaauaauaaaccccauuaauacugugggguccccagcuguaaccacaggcuaugcgugcccacuuuucuagucuucagaaaagcucuagcauuucuacagaucucaggcagaagaucuccuacacuuuaaacaaaaaccuuaaauaaguauucuugauaccaggacuaccauccuaucacugggcuguuaaagaaggaggucucuguauuuguaaagacagcacauucuguggccuugacugaagaugccacaagaacuggggcacgcugcuccaucaauccauggaauauaccagguguguucauuuccacgccucugguggcuucccccaugacagagcugaacagcaauauaaacacaggacugccacauccucaaguacuuacaucuucacaaagcaagagucacaacagagaaaggugccagggccaaaugccuuggaacugaugagcuacacagccaguuccagguuaauuugggugacagugugagauccugucucaaaaaaaaucgaaaggcagcuacacuauguaacagcugaugaugacgacaagagcgccuugggaaggggcaugagguaauuuccagacagacacugaggugguacgagugaauacauccacagcagcccagcuaaccuaagauuauuauagccaguucugcccuccuauggcuauaauaaucagccaaggaagcuuaacuccagaacugcuauuaaugcuguguaacuuaauuuugauguuccauuccgggcaauggguuuccccaggaaccaugguugccugagacuccguuagaccaggcagcuuuucacuaaucaccagggcaaaaggccagucucacagcaggaaggcaaaagguguugaugccacccagaaaagcagcauuagcuguauuuacuagcaguaaagcccuggcacccggagacccucagucuaggggcacagaaagguggaggccaugcgauucuguacgagaucuccuccuccucuuucuccauccugguuacagaggaagaaaagaggcauuguuuuuuuuuuuucuuaaaggaaaugagauuugggcguuuuugguaaggacccaacuaaggagcucccucuaggacauucccugagaguccccaagcugguccagcaucgguacacauggcuugcuguggacuaugaugaagaaauagcagacaagagccaggagguggaagaaacacuucucaguuuaucuucacacaggagggguaagggcagaggaggaggucaucccaucacagagcacaccggccuccgggcucucuggcgcugggaugcagucccaccaacacacuagaguaaagcaggaaggcggcaaaccugauggcaaauaccugaguguauuccuugucuuccuucuucaucagcuuuccuccccaaacucucaacccuuaagaaacaaaggugacaauugaagaagcaaucugaaaugcucgcauuuccgcuuaaaacgcuuugaugggaaaccaaagcgaaggaagcgaaaggcaagcaagcguucagagcaauccaggcauuggcagcgccgucagucaguuuggugaaggagaaaguuuuuaaaaaaaccaagauuggacaaacuugucacuaauggcagucucuccuacccagaaggcagcaggucacccaauuccaccauguaccugaggggcuaacacagcucauauuccaaauacauacuguucuuaaguuauauauuugggagguagggggagacacguagcauacauuuaaccucaucuugggagucagugcuuuccuagggcgaucuagaagcccaggacagagaagcccacguacagagaacucuggagcuugaaggagcgcaucagccccgucaccccccagcuagcagaaccagugagguacacucaguccuucuaaaucccucaaggaaaacacaaguuacuuagaaaaauggugggucuggagauuucagauuauauuauuauaacagaaacagaaaaaauaaauuacacagcacccucuaugcuccagguuuuagcaaggacacaccguuucguauuugcaacccguguggcauguaacucccauacccucuuaaaagcccacaggacagacuuaccauguccacuguacagacagauaugcgaagaggaaaguucagaugacuaacccagcucucugcucaugaaguggaaccagcaugugaauucugggaggucugauagcacugaccacugugggacaugaccuuuccagaggacacugaugcucaacuacaacggcuaagucaaaucaaggcuuugcugaauggcccucuccguggaauucuacauuuaaucgcauaaagugcuaauguugcauguuugaaacugaacucuacaauacgugcuaagugcaugcccaggugaacugucaacacacacaaaugauucccuccuguucucugcaguuagcucucugcuccagucuccaccuuaaaucuggacuucagucuacugcauguuaggaaaggccgcgccaaaaacgugucucucagaacaaucaacaagaugagggauucauggcaagcuugcuaggacauagauuuguuaaccgacaacugcagcccuaggugucuauguguuggccagaccucagggagggcucuuauaccaacuuguauagucucaaacucuucagcaacuucacuguucucauauaacugacaucaguuauauaucacugacagaauauaucauugaagacagaugggcaguccaaaauacuccagacacugccuaccccuucacaaacagccgcaagagcacagaaaagccaagagucagacagcacacuuauggauuccuauauugcuguguccugaucccauccagagaaaagcaaccucuuuguagaauuaguucaguuucugcuuauuuaaaaugcuuacccaacacgugcccugaacagccaauaagacaaaagacagacugcacuuguagaccccuggcagacugugauccgaaauccgauuuuaucaauaaauucagacaaacaucagggaugggucuuagggaaggauacgaccucaucaaauaacaaacuuaucccaguuagagaaccgaugagguuuaagguaguaaguacacucacaacauuaaauaaaaugcgucagagguggcagauaauggggacuguccaaaacagaugggucuacauuuauacagcaaagcccaugagagcggagcaguccugggugcuguuccaauggccugacagguacucuggugauguuauacacaaccauacggcuuacccaugauugucaacauccuuauuuuacagagucacuuguaccgcuaaucaauuagcucgaacuuccaugccaggcauuuuaaaaaaccaggcugcacugugucuccaggcauuucuuucagagaaauuaaauuggaaaucagcaacucagggauucaaggucccuaggagcaagggggacaaaugcagcauugcaaauucuaggcccacuguucuggcccagugccaacaggaagggagggcuucguacccuggggcgucucguagguuaacguccucaucuccaccaacgggucguccucaaagggcugguuguacugcggggaagggagagcuggucagacuccggggcgcuggauccccgcccaccgcgcccugcccgccucggccgccgucccagccuaccuucgcuaucagccgcuucauuaacgucuggaagcggcuacugcuuuccuuaagcugcugaugcagccugcgguccugccgacccauagacuccauggcguacguggcucucugcccggcacugcacccgcccaagcccguccacagaucaaacguggcgccccgcgcgcuaauagggucuuucaaaaguauuuacgcaaccgauccugcccgcguuuccggccgccgcucccagggagcacuuccgguggaaacgagaag

SEQ ID NO: 280 - RNA, 18640 nt, Mus musculus
ccgccccccuccggagcacaggaaggaaugaagaaguuccaccugagccucccaaccacacuggcuuccuuguggucccagcugucuagaguaagagaucgauggggucuggggcagagggugggggugggguuguaauucagacauucuauagaaucaauaacuucagacaagaguucuuguagagcagaaaucaagccugagaaacaaaccacauggguuuaagaaguuguuaaacuggccaguccugcagugugaguuccugcuaccuggucccaggcaauauucaaagguaggaaaagaguguccgaucagggggccuuauuguaaaauuagacccauagaacacuuuguauuuaaaaggaauugagaccuagucuguuggccugaaguuccuuaagugaagcacaagacugggccuguugauggccaaucauggauugugaagggcucauagggccccaccccucccugaugaacuauaggcaacugauagauugugggggagggaagucucugccaucauuugugugugugccaaaagggugagcccaccaggucccggagggugguuccaaaccugggccacucaggguccugcuuaaaaaucacagguucaccaaacaauaaggagcauggaaagggcccugggaaggaggagaaaggggggaagggaugacuggaugggagagagaugggggacaggagggggacagauacacuguauacacaaaugacggugccaacaacaaaaucaauguaaaaaaauaaccucuaaaaauauuaaaggaaaaccauaagacuuuacaaaguguaaagucuauccccacaaaaugugaaaaccuagggccacaaacgcccuugagguaaauggccucacuaguacugcucagagugaggaaccaccaacccagaggccagauaaacgcaauggggacuguggaaaauuacccaccaauaaaaaggggcaucugugcaacaguauggauauguuuuguaaaauguguuauggugcagugggagggggugccuuagcggccauguugaguccccccccccuuccagguaccagucauagucuaggauaaaaugaaguuuauuuaggggcaugggaaggagagguugaagaggggguagaggcagagaaagagaggggacagagaaggggacacacacacacacacacacacacacagagagagagagagagagagagagagagagagagagagaggucagagaacaugagagaggagaaagucuuuuuauagcaagccaggcuccuaaccuggcuguugcuagguaacuguugggcaaagccuagcagaaaugcuaacaagggaccccaccaucaguagcagcagcaaaagguaggcaggaagaaaagacacacgugugauuuuauuuuuaugaagguucuaggauagcaagacuguggagacaaaggcaggcugcuggguggggagaagagggaugguuugcaucuuagguggcaaugcaaguggugaaggcaggcacccaacagagugacuuuagcaaguaguuaacugaaccauaauccuuuguugguuuuuuguuuuuuuuuuuuuuugguuuuucgagacaggguuucucuguguagcccuggcuguccuggaacucacuuuguagaccagggcuggccucaaacucagaaauccaccugccucugccucccaagugcugggauuaaaggcgugugccaccacugcccggcucugaaccauaauccuuacaaaggcaaguaguuuaaaccucaaggaaucaacuuaaauaaaguagaacacacuauaagaggugacuggacagagucagagagcucacacuucaccugcacgggagagagggaggagagaaggagcuccccacgagugcauccacggcucagagagccccagaugaaaagccaaacagaggcagacaacuuccugucugcuggacaaagggacugaaaagaucuuuaaaacagaaguaaaggaagccgugaaaacucauggcugagugggcugcucaggaaccaccaugcccaauagugccuccucuguaccccaaguucuuccagccagaaccccaguuccucuuccucgcagucaacagaaucuaccaucucgaugugcccucuacccucuccuuccugucucucaacuuuccucuccucuucugugcccucuauccauauuacuuauaugauuccaugugauuuuauguguguauaugugugugugugugugggggguuauaguuaauaaaccaccacaucauauaacacucaccuguuguuccauguuccauccuugcccucugcauccaucugggcauuccuagggugguguucccaagucuuccaguaggcucugcccacucucauacuaucauucucucucauauucucucucucauauucucucucauauucucucucucauauucucucucucucucucucucucucucucucucucucucucucucucucucucucucucucccuucuucuccuccauucuuuucuccccagcccauuacagaugcccccucauggcaccgcccaccacaccucuccauuuggaugcucuauguacaucucagccccauguggccagcccugacuuccuuucuuccucuccaaccugccuugugcuccccgccucagaaacugaggucugccuccuccuuguugccauuccuccucgucuccauggagucagccaucagaugcucacaguucuucuccccaggugguauaguuccacucagaaguaucuuccaugggucccuguauccgagcacucagcauucccagcugacggugauguuucuggagauuguggaacccuagugacauggagacuaguggagagaccuagcucacuagaggccaacuuucagaggucauaccuuucuguggucagaaccuucucacugauuccugggaagaggucagcucaggaacuuuggaaaauuccaccagcccccucccuccuggaagagaaaggucauagaacacauaggcaccccuccccucuggaagggaggggcuaauuacauuccucagaccaggggggggggugugggguagggguggggggacaaucagccaccugccauuagggaaggcccagagcacacagacacauucuaggaccauuggccaccuacagacaaggaacguccuugccaccccauucccaaaagaccaaucaguuuaaaggucacacuguucugccaaucacauugugccucauggcugcuacucugagagguguauaaaaacucgcugaucuuucaauccuuugugugcagggugaugccaacaugcuggaacaauaaaaauuccucuugcuuuugcaucgguucccagcuccccguuguucacuuggggaugggucuugccagaguuaaggcuugccagagucuuacacugguguacaccaugcgauacauucccaccacagcucccaccccugugaauucugccacucuuucccuaucaugauggacugaagcuagucagaaaccaugagccaaacugaauccuuccucccuuaagugguucuguaacguauuuggucacagcgaugagagacgcaaguaacaccaggccucuguccauucccacggucacugcucuaagccacaguccugacaucuuucucccagauuacugcaucaaccuuaugacugcucuuucccacagccuccccuucccacaaucccagagccagggauuuuugauaugcaaaucugaucaugucauuuccacacuuaaaauauuuuaauggcuccucgcugccuagaguaacguucaaauucuuuaccccaaauuauaaggucauucauaauggaacauggaugaaagauuuauaucacugcucccugugagccgacuugcuguccucuccauacucaggcaaauucuaaagcaggucaccugaccuaagcuaugcagcugcucagggcuccgaggggccuuggaaguagaagcugagaacaucugaucuaacaaguugcugaagaacgaagagacagggcuccgauccccuacuuccaaauacagugggaccugacccuuggcuuuagcugcccaguaauuccagacagcauugccacguggguccauggccuuggaacauggccacagagagacaucacucugguuggugcccacagcuaccaaagacaaaucaaagccauugcuugaagagcuuguauaauugcuucagauguaggugaaggcacaggugugauuucaaacuguucauaaacacagcuuguguaucuagacccuacccuuuccuuuggauaaaauaaacacaaguucccuuucucaggcauauaugauacccacauuuagauacccucuuucuucuuaaucuaccaguucuuauucuguaugugcuucauuaguagagaaacugaagccagagagcuuaaguaacaaguacacaccaggaguuaguggaaggggcagggaaagaaacuugggcuucccugguacuaagccucagcaaguaaccacuguaugacuaaggcucuuuagaaaggaagcagguugggggcuggcucaguggcuaagugcacuagcugcuuuuccacaggaccuggguucaguucccagcacccauaugacaacacaugacaaucugaaaucccaguuccaaaagaauccagucugugauuacuacacacaugggguacacaggcauacaugcaggcaaauacacauacacacaaaauagauaaguccaaugagaaaggaagcaggugucucaggcaggacuuuauggaagcggaguuugagucagaaauucaggcccacauaauggaguaacuuucggggaccuagacuugagaugggauuccaaccaaaggaauguaacuggguaaugaauauggaaagcggcuuucuugauuagcugauauuacguaagacugucauagugaacugggaagaagugauucuccugcuggccuggaagcaacagccagcugcugcugcugcugcugcuccugcuccugcuccugcuccugcuccuccuuuuccuucuucuucuucucuucuucuuccuccuccuccuccuucuucuuuuuucauuuuuuuucauuggauauuuucuuuauuuacauuuuaaauguuauucccuuuccccauuccacccccaccccccaccccguggaaacccccuaucccauccucccucccccugcuucuaugaggguguuacuccacccacccacucccaccuccccacccucgguuccccuacacugggucaucuauugagccuucauaggaccaaggaccucuccuccuauugaugacaaggccauccucugcaacguaugcagcuggagccauguguaugccuuuguugauggcuuagucccugggagcucuuaggggacugguugguugauauuguuguucuuccggugggguugcaaaccucuuccaacuccuucgguccuuucucuuuuuuuuuuuuuuuuuuuucgguccuuucucuaacuccucuauuggggaccccgcgcucaguccagugguuggcugcgagcaucuggcucuguauuuguacggcucuggcagggccucucaggagacagccauaucagacuccuuucagcauaacagccagcuucuuaaggccucuggagaggguuccauugugguuaaggagguauggcaugcucuuagggagcgcccucugcuggcaggaagcaguaaaauagaaaccucagccauuacaggcacuaggucaguacagagcaggaugaaggagagacaacuagggggcagggucuuccucuauccaccccuagauuacaguucugugaaacccugucuacccauccuucgaaagcguaaggcgacggcuauguagcuuuuagucuaccaagccuauuaaguuuguuauucucaagggaaaauuagcacggggugacaccgaacacuggguuagaucugugaaucgcgggcuaaugaacauguauguauacuuaaauauauuccagaaacccaagggcuauuauuauaccuguaggaaaaggaauuagaaaacuauugucuagcauggcacaaugagucugcugagaauaaccuguaauuaacugcagccgaguucauucugggauuccuuacaaggcuccccacacacaccauuuccagccggcguggacaccagcauucagcucagaacaagcugcaaccacacuuuggcucucuaauuuguuaauaaaaucaucuaucucccaucuccaaugauugugcuacuguuuuauagcauaauuauucuggcccuggauuuuagugguaggaaacggcccauggcuuuuuuuuuuuggauugguguugcauguucuauugugagauuguuaguugaggccaaggggaagacaguggaggcuuggggaaaaccaguguuucagagcucacagauaucuagaggcaagagggagugucuugaggcagacucacauggagaagcuacccuaggagaaugggauaaggggaaagcuuggccgaagccugcauucugacuuccauggauaaggaaggcagggcagcaggaaaaugugugacuggcuagcuggaucacugcaccagcucuggacuggaggaguggcccccagcugcuccuggcacuaggcuggaucagacaggaauaccguccccagguccuaugugcagacagggaaggucacucugggugaagccgguacauagcagagauacagcuguacucugugucuucuuuaagaaugggcaagcccugacaggaccacugccuccccagacccagcagaggagcaucaccacuuucacaaacuugaaaauggccuguuguucaaaggaaacacauugcaagcucccaguucaaacaaaggugggcuggcugcauuuuaaaugccuucaucucauuucucacuuaaaaaaaaaaauccauaaaaacgacacuggagacaguggucugugguggaggucuggccuggcaugcacagagcccuggguucaacccccaguaacacacacacacacacacacacacacacacacacauuuuaaauaaaaucuauaaagauaaucagauguacauagcaugagucugaggucagcuugaagauaaaauuccuaaacugugugagggagcucagacaaacacacugugucaucuaaaggugcaaaaccaaaauuaaauaauuucgauucuuuacaauucccaccugccaguuaguugaguuugcucccucccucuccccucccccuccccucccccuccccucccucccucuccccucccucuguccuccccccuccucccccuucuuucuuccucucucccacucugggaaaaacaaacuaagaagcuggcaaaaggcagacaguucuccugaaggaguuaggugauagguuugagcccaguacucucccagcaagccgcugggagccacagaccucugaccacugggagccacagaccucuggcugcugacugucacucccuggagcacagggaagcacagaggcugcuguggucuggggucuccccacccaagagcagaaggaguugaaggcugguaguccuaccugcagaggaaggcacagcacucgcuaaaaauuaacauccugacccucuagccagcucaguuagggaaaaccaaaggacuguuggaacaggaaaggagccaaguuaguucuucaguaaugagacgucaucauugccacugguguugagugccggccuacagcagggcuggucuucagagcauccucagauggaauauuacagaauggcuucuacuguguagucaagggcaaagugcaggggcugguuuucugccucugguuaguguagcuuauuagaauuugucuaaaaaccucuguaaaucuaucuaucaucuaccuaucuaucuaucuaucuaucuauaauauauaauaaauuaauauaguaaaaucacucaauauauuaauuauuauauauaauauaaauauaauauguauuaaucuaugcaucaucuacauaucugucuuacauaucugucaucuacccaucccucaucugucuauuaucuaucuauccuguguguguguuggcuuacaggugauuccacuaggcuccucuuagguaccugugccaucaccugcacgggccaguuucagguguucuacaaaaggacagcuugccaccccaguucugucacuaucuguucccacauguuuccagccggucucucucucucccccuuucuguccuucucucugcccccgcuucucugcccucauggcucugcucaucugucaccccugucccuucuccacacccucacuccccucucuucccccaaauaaaccuccuuuauaccagaucugcugcaugcugugauuucucaggggacaccuugacaugagcccaccagguagcccccaugccccauuguauuauauuuuauaacuguguuuaucauuauuuuuaccuaucuuccuacggucucucaccuaccuauucuucacccaucuacuauuuacauccaccuauaugucuaugaaauccaucuaucuaccagccugucauuuuuuauacuacuuguuuacaacaaauaucuggaaucuaccagccccaagggaaacagagagggcaaacucugucccaauaugucugaaaaugcuuaaccuccaagagcggcacugucuucauuuuuuuuuaagcgagcaagagcccccaccuccccaaaccacagacauccaccggccugggcccucccucaccagcuccugccuagagauaggaugcaaaugaggugaauaauuagcuuuaguaauuggaaacgugagggaagacacccaaaaccucucccagaaauaccacuuacauucugaggagcagaaaaauucguucacaaauuacuucccaccuauucuaucagcauuucauuucugacccauuuauuuauuuauuuauuuauuuauuuaugccacacgccauauccugcuguccccugauugcuuaccuggcaacgacuuucuuugaugaagacaaagcuuuuccuugccccuccuuaugcucccauuagcauaaauaucacccccuucagugucuccuuucaccaagagcugcuguucugccuaccuuguugauuugcagauuucucuucugugugugagcacacagcaccgucuuuccugcagggucuaguccugucuguccagguaucccuaguauccugcacagagccugcuuuuacgcuuguccauucacugccaaggaauccagucagcuggccuauauuauuccaaacacuccaaccucaguucacagccugcuuccuucccucugacuaaaagcccaagauccuaggucagggucaccacacaggacaggcccaauguggggaaaccacaguacugcaaacacaauagaaacuugacugcgaagucaauccaguuauuugguacaagcuacaucuucccuaaacucauggcuuuaucuauaaacgcguuugucuacucucugucucaacugcuguguuaaaugcuaggcagagggcucugucugucaguguccgaugcagaacugugggaaccugagcucagaccaccgccccucccccaccccugaccauauuaaaaagccugcugcaagguccgucugaugccacacagcauggguggguggaagacauucagaggccugucagccucauggccuacucaccucagcagcuacggugauguguaaguauauggugugauuagagagaaagagaagccgaacuggagacuugaggguggggagcccaaugugaguagccugaguccuguagcagcaggggucugugucaauguccauguuaucaccaaaggccaugcagacguccccuguaugggcugcugccugggacccaagggcugugcagagcugacccugccucuuucugguuguggcacuuuggaugggcuacuggagcagagcuggagagcuugucccuguggugugaauucagguuagcgggugggcugaccaacucagcuagcguccaggcccagguccagggcuuggaguugacaccacaacgccuaccccauguaugaacugcuggagcucauaaagaggccgguccuacagauccaaagcugauaacugagaggaaccccagagaggcuccaguaccaauagugccucgaaccagaccaaugacucauuccauaaacacuggcaaguaaagaugcuuagucaaaagggcacaacagugugauacaccaugacacacugcagcuugcagggcgagaucuuccuucuuuccuuccuuccuuccuuccuuccuuccuuccuuccuuccuuccuuccuuccuuccuuucuuucuuucuuucuuucuuucuuucuuucuuucuuucuuucuuucuuucuuucuuucucuguuucuguuuuuacuuuuuuguuuucuugagggcuggggagaaggagguuucaagggccaagggcaggcagauacagagacagggagauagaugaaugggacucgggguucacgaugugaaagucacaaagaaucaauaaaaaaguuaaaaaguaaauaaagagccugcugugcaguagacacaugccuaccacccccucuguagagacagagacggcagcaucugucggagcuuacaaguccgcuggccuugccaaaucccugagcuccagguucagugugaggccccaucucaaaaaauauugguggagaagcaacucaggaagacauccuauauugauaucuacaugaacauacuauguaugcacacacccacacaaacaccacacacacacacacacacacacacacacacacacacacacacaaugccuauagcccccuaaagcccuaagauguuaugaugccugguuuuacauaaauaaaaucugucauaaaguaguugaguguacacuacuauucuuuuaaguauaaacagaugacaugaauguguagcgcucaaugguucuuacaucguacaaccaaaauaaaagggugaaagaggucagaagggccaccagaagagcuggccaggcuucccaggagcaugguggugugcagcaaggaccgcagagaacagcuggcagcauggagggcugucccaagcugugaugcugcugggugcaaagucagcccacggugccaaccuguggguaccacaagacaagauugucauuuuuaaaagaggcaucauagaaagauggaaaaucaaaggcgccuguauuucaguggagaagccauuauacaccauauaaagaaaucaaacaugagugacuauuuuaaagauuuauugcaaaauucaauuccagguauucaggguacuucaagcucgcaauuauuuuucugucacuguguaacugaguaauucuaacuguucauuauacagucuccgaaggaaaauugcuggcuggucagcacguuuccaucuuugguugaccuggccacucacuacagugugggcagggggcuuauuuucucuuccaauuugccuaaaaauauucucacacagcccaaggagaaaagggaucuaggccugacagccauuccuucugaagcagaaauuguaaccaaguucacagagccugacaacucacugcugugcauaaaauguggcggccaaaacugugaaagacuaaagguuuguuaauguaauuaccgcaggagaacuuuacacauccucugcaguggguuaaaguuagaaccggaagcccuaagguuguuucuguuucaguugcuucuucccguaccauugaauucucaauuguaaaugaugacuuugugacaaguuucuauucuuuccaagucaaauagaugugcaucucuggggcuggccacaguggagucucagcacugugcaugcuuucaauaaguagauguugagaguaagagacagugcuuccuagaaagaggccagcccaagaagagaaucaccuagagacggacagauggacagacagaaggacucucagcaucaccccgguuuaaagucuggaagugguuuccaugcuauacuguaagguuaaagagcccagcauucagaaaggccagcauggcaaaauacagaaaggggagagcuacaaagaggaaugguucuagugaaagccagagagaaaccuccaaauguuuugauuuguguugaucugagugugugagagguaacugaguccagaaaagacucuccagaagguggaaucuagaacaacucucuaaacucacguagggcucuucucuccaucacagaaagggcuuuugauaaugaaacaauagauuacauccucagaaaauaauugguuugauggaaucaggggagugguugucuaggcauuuuccuagauucaaaagaauccugggccagcccuagaaaaccuugaacacgagccucaaaacuauugacuagaauccaugugacuucagugagaaaacaaaauucaaagaaucccaaaaaguauaacauucuugagacucauggcuacaguaucccauguccaauaagacuccccacccaaaggggugguagacaaacugcucacaugauagagaggacugaacuagcaggaaagggugauuaucauaaacggucaccacacauucaaguccuuacaggaaccaugaucacaauaaagugggaaguguagcaauggcacugguccaaguaggacacccagagaugaagauaaaaaauguagaccacuggaugagauggacagcacccagccaugcagaagaaaucagugggcacaaacacaauaaggcaaacuauuaaaaaugaaauuaaaaagagagagguguagccagaaugcuagugacauagggaaacggcagagcaucuaaaccacauggaaagaaucacagaauacacuaauacacacauacacacgcacacacacacacacaugcacacacacauaugcacacacacgugcacacguacacacacacacguacacgcacucucucucucucucucucucucuguaugugucucucucucucucucucuuaccucucucuuucuccugaucaaaagaaaccuggggcuggagagauggcucaaugguuaagaacacugauuguucuuccagaauaccaagguuugauuuccagccccuaugugacagcuacaauuuauaauuccaguuccaggggaaucuuuugcccuuuacuggccuaucugggcacugcauacauauggugcguagacauccaugcaggcaaauuccuauacacauggaggaggaugagaaguuggggggugaggggaggaggaggaaacagggccgaaaagauggcucaaugguuagaaugugcacuuaucuuacagaagacucauucaguucccaguaccaugucagguggcuugcaagugucuuuaacuccaccuccagggggaucugauucauuuuucuguccucuguagguguguaugcucacucaugagcacacacacgcgugcacacacacacacacacauacaccacucauacauaaaucuucaaaaaaggagacacagucugcauguuuacaucuaauaguaagcacacagauaauacauuuacaaauaggcauugagugaauguugucuaauuuuacuucaaaaguucuuuugcugugucauggcuucuuucagauguuuggacugagaacacggaaccuuacucauuccuaagaccucuuauuuaugugaagaugaucgaacauagugaaaauggaaagaauaauaaaauaaauacuaauguauucacagacacaguaccauuuacaacagccaaguuauugcagccuauuacagcauuucucaguggauaaauggguaaagaaaauguguuuuaugugaaccauggaauucuauucugucacuauagaagaacacaauuaugucauuuguuagaaaauggacaccacuggagaucaugauauuaagugagacaggccaaauuugccuaauuuguaaagccuagacuauuuccauaaauacauaaaagccuuugccucaauacuggaaaaaggaacaggcugguuggggagagaaaggggagacagagacagaggagaauacaauaagugaaugugaccaaaguacaugauacacuuuuuuaaaaaauguauuuauuauuauaaguacacuguagcugacuucagacacaccagaagagggcgucagucucauuacgggugguugugagccacuaugugguugcugggauuugaacucaugaccuuuggaagagcagucagugcucuuacccacugagccaucucaccagcucuauaugguacacuugaaagagauuuucccuggccuugaagagcuccuuccucaguuuacuuucucuugcugugagaaacacaacauccaaaagcacugggggagaaaaggguucacuuaucuuucagcugaggagagguuggagaccguacuguuagaagggcaagcccuucacagccucccacccuaaaaaagccaauuggccucauacuacagagccaguccuuacccccuucucccuguuucccgccugucauccaaaaaugcagaagaauaucaacucaguguuauucuuaauaaaguguauuucaaauuuguucagucaaacuuagccaggguuccaacgcccuacuuaaaauucaacuaaaaaguuaccuauucaacacuaauuaacauuauaaagucaacgccuacugcuuaaggcuuuucucuuaguuguuuacuaagauuaaaaaaaaaaaacagucuuagccaaauacaguuuacgggagaucaggacagggacucaaggcaggaagccagagguuccugaagcagaggcggugaaguaguacuggcuugcucuuuagggcuuguucagccuguuuucuuauaagcaagagccaccagccuagaggugacagcgcucacaaugagcugggcccucccccaucaaccaccaaucgugaaaacacacuacagacuugcccaguaacaggcagucuggucgaggaguuuucucaauugagguuucuuuuccuagauaacgcuagcuugugucaaauugauuaaaaaagcaaagugaaacaaaaucaacaaaaaaacuaaccagaacuaccccacagguugguggagaagcuuaaggaaagagagucuccgucuuuacacccaguguggacauaagcuuaaggcacaaaggcacaccccgcccccgccucaguuuauccucacuucauacaaagacuuucuccuugaaauauuuuguucaauucaucugacuugaucuggccuugguuacuguuuuucucccucaaauguaaagccagccuaucagagacuuuuugacaaacacuaaacucucugugcuuuccccuucaggaaaacaaaacaaaacaaaaaacaaacaaacaaauuaccaacaaugagcauaaaauuugccugcuucccaguaaauaccuuaagcuugaagagaacucuuucuaccaaauaaauaaauaaauaaauaaacaaguaaauaaauaaauaaauaaauaaauaagugagugaguuucuugccucaagcuguuacgacaaauuuccaucccggauaaaacaaaagcaugcaacucucugagacuugugucucgcgcuugugaauaucacucccuccuguuuugcuguauuugccuggcgcuccuugaaucacuauagcuuguggaaaaacugaagcuauuuaaaaauugaugaauuaucccucauuagagucagaauagcccuggaguggcugaaacuugagcaggauuagaagcaacacaugaggaguuuguaaccaagcaggucuccauggcgacaugugauugagccgaucauaauuguaagacauuuauuuggggccuuuuucuguuguuguuuuuuuaaaucccgaagaaaagucuaacacaaaagaaacuggucucagagucucuaggcauauaaauuggcaaagguaaaagccauucaagaucgcuuuacucauucaaaaaaaaaaacaggcacaaauuucaagcccggggaaggagaucuuagcucaucggcuaagcccagauucaguucugagugagagcaggaugccauuaaaagugccagcuuuacuucuuguaguuuggguuucggaauagcccacagcaucuuggauaacccacacguaugcaaauagugguucuaacgaucguauuucuagcucgcugucuguguuguucuuccaacaguguguucugaauuuuaaaggugcgauaacaagaauauauuuccucugaauccagaagucagccuggguccuugaggugaccuuguggucuacuuucuagagucuaacugcagguaagcaccucccaaggcaccccccgaaaccuuguccuauaugguccgagggagccucugauaaguuaauacaggagucgcugcaggcucucucucucuuaguaacuuccaguuugugucgcuuuguuaauucuccuagaaacuguacagugcaggcaacgcaaggcuuacuucuuuauuccuucuggacaaugucacacaagagcacugcaucugcauccuccugcccaccucucccccuuccaaaucuaucuccuccuccccacauucaugaccucuuucauuauuauagcuacauauauauauauguguguguguguguguguguguguguguguuuauaugcauacauauacaaccuauugaguccauuuaguguguuuucaaaauugcaaagaaguuacagaaggauuucgggguggggguguguuuuguauuuuguuguuguuguuuauuuugguuuuugguuuuacaagacaggcuuucucugugcagucuuggauauccuggaacucacucuguagaccaggcuggcuuuaaacgcacagagauccaccugccuuugccuuccgaaugcugacauuaaaggcauaggccacuaccaccuggccagucagccaguacaaaaagauuuuaagagccagaggaccagauacgugcugcuagauagugcccccuagaggugacagggaaaguuuacccaugaacugucaauaguaugguugccugaaagagauacccuuaccaguacuaccaggugacucgcugguguagauggggcagauuucacaaggccucaccccuagaaaaaggcagguggucaauggcuaugggaagagggaaaaaucagacuuaaaaagucagguuuccccuacccccacugcccaaagauaauuaacuaugugacgucuuuaaccuauggaagaucuacuaaaagcccuugaccauggcuaggcauuggccauggcuagccauuggcuguauacaccacaguuccagaucuccagggccagaggaucagaagcuaaauguuauucucagcaacuacggaguuugaagaguguagaccacacaagaccuugucucaaaacaguaaaacaacacacccuuguugaagcuguguguaaggagcuggugcucuguggaaggcguucugugagguacuccccuguugcugcccaucccagagcaagcuggacccuugugucucacacuccugugcacccuggagucacuugaaguccugcggcacccaacuguugcuucagccccuugcaggcaggcucugaucuccuugccacucaaguggccaccgccaccucaggacacugggaaguccccagcugguucuuuuuuuuuaaauaauuuuuaauguauucuuugagaagcucaugcaauauauuuugaucauauucgucucccacauaguucuuacgagcgacagaucugcacgguuccugaaggagugagcuccagcucagggugccugcugcuagaccguguucccccccuccccccucccccccgacaagaagggagagcgugucucuguuguuuauuucugggauacagaauugauaauggcuuuacauucuguuuaugcuuuguaagaauguucucucucucucucucucucucucucucucucucucucucucucucucucucuuucucucaauguauauguggucuucagaggucacccccagaugucaauccucaggagccaucccucuuuuuugaggcagggucucucguuagccuggcucucgccacauggcuaaucucacuggccagugagcccuagguacucacgagacccugccuucccaacacugagguuacaagccagcaaugcugugccugugacuuuagcaugggcucuggggacucaacuugggucuucaugcuugugggggaagcacuugaccaccugagcuagcuccauaaccugaaauguuggaauuuuaaaacugacaguauugcauguguuuucuauguacgcuauuuuaaauaaguauuuacuaucuaugacagcaggauggcucuacucagcaugcgguuacaucauggaguucuuaguaccgcaucgguccuccuccacggcaucugccucugugcugcuuccagcccggucuucccguccgucugcaguggcuugcuucucauccaugccuuuccagaccucucccaacucacccuuuguuuuguucuuuuaucuacccuugucauccagagcacuuagcugccgguucugcuuuuauaaauauuuuuaaaaaaauaaaccccuucauuccuucgugaag

SEQ ID NO: 281 - RNA, 2939 nt, Mus musculus
gaauccugcuucaguguugacauccacugucaucuuucugacccuuccucugcaaggaucuccgagccuuggugagagggagcaaguguuagacagguguucccuucagagcuggguacuucccaguuucuuaugcucuggguauugaccaguugugggugucuauuaaucuguccugcaaaaagaagcuucucugaugaggguugggagcuguacuaaucuaaggguauaaagauuaauucagggggcaguuuguuauuauaucccuauaggagaacaauaguauuagguucuccccucaggccuauaaccuagcagaacauguguuuuuggcuuaguuagcaacaccagacauagagugcgucuuguagaacgagauuuaaauccaaccagaaagugguugguuacuccuauaacauuugugccacuaaugcauauauugccaugugccaguggauauaucuugguaggcuagucauuguuacagcuugugggauccacagcuggguaaaacugucaaauauuuuuaguucuuggucacauaaauauaaccuuccagcacuaugacugcuagccaguggggaugaaaucccaggucaguaccagccugauuucuucaugucuuacguauguggugaccucagcuauagggccuacugucagauuuagaaguuagcuaagaaugacagcaguagguuauaagaagugucuguuuuaggagucugugguaucccacuaaucaguaacuuuuggggggcuggagagaugggucagugguuaagaacacuguuguucuuucauaggaucuaaguucaguucccagcauccaugucugguggaugccuguaacuccagcuccaggggauguccgauguccuuuugggcguaaccaaauguggaaccugcagacacaggugcaugcagacacaggugcaugcagacacaggugcaugcagacacaggugcaugcagacacaggugcaugcagacacaggugcaugcagacacaggugcaugcagacacaggugcaugcagacaccaaaucuggauaggugugucuucauugaugcucagcuaggaaggcauugccuuggugguacaaggugacacaggcuuggagaccaugacuagaguguaugcaggaccaccacaguaaccgaagugagaccccaucccugucagagacacacccaagugucuccuuguaacaugacuaauaagcaugagaaauuacaaaacaugaaucuuucaggaaaagguaugccugucauuggaaauauuaaaaaaaaaaaaaaaaucaccugccucacaaaaccaaaccugucacuucccaggcugucuaguuagcccuucuccccaccguggccccuuaucaaggccuuuggguugucaugacaggggcuuuucagccuuaggggacuuuugaagaaacuguuucuguguuuacauugcacaccagcauuugccucugccaugguggcuuuaaaaccucgcugcuuucuggcaucuacaugauuguuugcucuugggguggggaacaaccuuggggaagaggaagauguuucagcugcugaaacauucaguugucucagugagucgauuuugcccuucuuggaaaauaaagacagacaaaaugguuguaagagcccacugaaguccccaaaugacaauacguugaggauacugucuguaggccugggacacaugugauuuucauucucuacccuguuuaaaacacgaucuuuaaaaaaaaaacaacuuuuuucuaguauucuuuuuuucuuacucugagaaucuucuugacuccugaaucuuugccauuuaaggaaacauuaaugauugguuucacacugagcccagcagauuucuggggguguccugcaggggcguggucugcugugggauguagcaugugccauccucuguccggaagugagccugggaccugccucaccuccaucaagccuccuguguuagcuuuccuuucccucuggcuagucaaggacucugggguggauggguugagguguaccagccgguaaccaacuguuuguuagguaaagcuugucgcucuuuuaaggcuacagccucuauuagcagucacacguuguaauucagcuugccaauagcagagccaggauccaugugugagccuagggcuggcucauucagaccagcaguacacuuccagacauaccaggcacugcugggaaacccaaccaagucucucaaguugagacaccuccccaccuccaucauuguucaaugaucuguauaccuguguucugcucgggucuaccauaggaggacuugacggggggaagggcaccguccuucuauguccucuuaaguguacaugcauaugugcaaguuugacgacucuuuaguggcaucuuaagccccagcauuugaggaaucuuggaagauagcagggagucugcucagucccaugaugcaucuguguuauugaacaucugugcccacuggagugcaggguacuuaacccauguuaugccaguucaucgugugguaaccaucccaaaacauggcuacuguccuguuguaugacaacauuuuuccugggaagauacaacacacucaccacagaaagggaucuaucccaugacagaccaaaguaaagauauaccaccaaauccaacuugaacuaaugaguauuacugggguuacuuacaugaguggcugaggggucacuuacaggagcagaaaugacacaaagacagcugcaucaccaaagcccaccccagugugagugacagcucacaaaaaccggggaucuggagcacacugcacagccugggggcagcucaacaggucagagagugucuauucugagcgacucaguuggucuaaaccucuucagagcagcuccacugguuuguuucuuccaggcagcuagcugguuuggucucagagucuu

SEQ ID NO: 282 - RNA, 3226 nt, Mus musculus
aguuuuuccuugccuuuuuuuuuauuauucacaagacugagauuguuuaaaugucauaacuuauaugaaaauaagcuacauugaaauaaauuaaacacaacggagacgugcuuccgacauggcucagauaggauauacaaggccaggaaagacagccaggcaaagcaaacgagcagagcagaguucuagauugcuccaaaaucaaccgacugcucugcacucaacucaaaaagccaaaauagaaacaaacaaacaaaaaauaacaauaagaagguuaaaccgcaguguuuguccuugugucuccuguuuaccuuugggcacguaugggaagguggucgcugaaggcgacagaguacaguggugguuuuguuucaucuggaaaguguaaggagagagauuugauccuaucccuuucaaaacacugcagcugagauccagucuagauagagaucuauguacaaaguaggguuguauaauaaauauuuaguguaucuucugguguggcuguagcccccuuuaagcccgucuaaugaauauacucucaauuugcuuggauguccacaucuaggaggugccucugaguucugcuuuaaacaguggagucugacacggguuccuucagguguuagggccucuccauggugguguccacccuggcugggcccucagggucgggccugcuccagcugcugguguugacuucgaauagcgaaccugcuaacgugaacagggauggggacgacaaucuugggguuccgagagggcucccccgucuuggaauuggcguugccugccuugacacguuuccacuuggcccggcgguucuggaaccagauuuuuacuugcaccucgcugaguuugagggcgugggcgaucugugagcgcucggucagggagagguacuuuuugcaguggaauucuuucuccagcuccagcagcuguucgcuggugaaggcaguccgccgccgccgguucuugccuguggacguggugcugccugcugcaccgccgcucugcggggucuccuccagugcguggccggggucuucuuccuuaugagcagucugaccaggcaaauugucaucugagcuguaauccacaucgcucuccagagagaagcucuccuccuugcccuucgggucaucuuccaccuuugacucgucuuucccuugcccucggacagccccgacugaaagcaaaaccaaacggcauuuuauuacauuuugaacacugccuuccccagucccuucccacuugggcaccucaccccuaucuccccccagcagauugucuuucuaccacauuaacacauugcgauuuccuggccuuugaggaaggggguggggggagcgugagaaaaagcucaaaggagaggaggagacaguagaggcgacggcccuuugcccagaaccaucacucaaggggcugccaugucucccgcucacccucccagccucuaacagcuuaaguaucaggaugcugcucggaccugaggcccaagagaauauccccuuuguuucccugggguccaggacuguuugaagaccaagggggaguucaugauccuccccaccaccaucugaacaacuaaaauuaagugagccucaauuucacagcagaugugagugguguagggccgaugccagcccgcagcuuucuugagacauaucauuugugucuccuuaggagaaguuuuccacccuagaguuccuagugcgugcauguacacacacacacacacacacacacacacacagagagagagagagagagagagagagagagagagagagagagagagagagagagucucgcaggaaucugauucucuuggaugaacagagaacccagugaagauauuugagucuggacucuauuggguacauaugcaacugaaaaaagaaaaaaaccagcccaauaaggccucucuuuaagguugcaacacaccaaggacccucaauaaucacagcgugugugugugugugugugugugugugugugugugugugugugugccaaacacgccaccagauguguggccuggaguagcuagcaggagagcucuaaacgccuccuuuccccaggauccugcuuguugcuuggcguuaaaugccccauuggaaagcuccggugggcaucaccgcaacuccuccagcuauucccgcagaggucgggcgggggcgcggccucgucccccgggucucggcgggaacccggagcuggcccgcccccacucccucccguccccgcguuccggcugcgcgcgccgccgacucaccgagcgacgccugcaccgcuucggccgcagagaaagcgagcagcgagcccuccuuggccaagaaggcuuugccgucuuccgcauccgcuuggagcgccucggcuuugucgaaguugccgccuccgggcaguggcuguggagcgaacuugcgggcagccgccgccucuuggugcuggggcgacgcagagaagccgccgggcagaguggccaugagcguggaggugagcgccaugcccugcgccaggcuggagcagaagccggugggcaggcuggggaucugguggugagggugcgcgggcggcagagcgggcugcagcgcugccuggggcagcgcgggaggcgguggcggcgguggcggcagcaccaccggccgguagggcaugaacaugggguagccgguguagacgaaauggccgggacugggcugcggcgggcugccgaucagcgagucuaugcugaaggcgguacuacuccccagcgggcgcugcaucaucaucagcgacggcgggaacgcugcgcucauagacgcguucgggagaagccagggagagacgaaaaguccccgugucccgccgccgccuggaagcccuccggacgcugggaguaccaccgggaacuccgggcaggggcugagcggugcccagagcgcagacgccgccgccgccccucagugcaggacccgcagcauacccggccugcacgggugcagccaccgagcgcgaugaggccgugcgcccgggauggagagggcgccggggaccucgcguucgccggaaccgcucccggcugcuagcccgucggaacgcgcgcgcuucgcgucugcaggucucggcccagcuaccagcagugcgugcguccguccgucuguccguccugcaguccgucgucucccacgggcggcuggggagcgcgcgaagccggcgcacuugucucuggcgggcgccgcca

SEQ ID NO: 283 - RNA, 3226 nt, Mus musculus
uggcggcgcccgccagagacaagugcgccggcuucgcgcgcuccccagccgcccgugggagacgacggacugcaggacggacagacggacggacgcacgcacugcugguagcugggccgagaccugcagacgcgaagcgcgcgcguuccgacgggcuagcagccgggagcgguuccggcgaacgcgagguccccggcgcccucuccaucccgggcgcacggccucaucgcgcucgguggcugcacccgugcaggccggguaugcugcggguccugcacugaggggcggcggcggcgucugcgcucugggcaccgcucagccccugcccggaguucccggugguacucccagcguccggagggcuuccaggcggcggcgggacacggggacuuuucgucucucccuggcuucucccgaacgcgucuaugagcgcagcguucccgccgucgcugaugaugaugcagcgcccgcuggggaguaguaccgccuucagcauagacucgcugaucggcagcccgccgcagcccagucccggccauuucgucuacaccggcuaccccauguucaugcccuaccggccgguggugcugccgccaccgccgccaccgccucccgcgcugccccaggcagcgcugcagcccgcucugccgcccgcgcacccucaccaccagauccccagccugcccaccggcuucugcuccagccuggcgcagggcauggcgcucaccuccacgcucauggccacucugcccggcggcuucucugcgucgccccagcaccaagaggcggcggcugcccgcaaguucgcuccacagccacugcccggaggcggcaacuucgacaaagccgaggcgcuccaagcggaugcggaagacggcaaagccuucuuggccaaggagggcucgcugcucgcuuucucugcggccgaagcggugcaggcgucgcucggugagucggcggcgcgcgcagccggaacgcggggacgggagggagugggggcgggccagcuccggguucccgccgagacccgggggacgaggccgcgcccccgcccgaccucugcgggaauagcuggaggaguugcggugaugcccaccggagcuuuccaauggggcauuuaacgccaagcaacaagcaggauccuggggaaaggaggcguuuagagcucuccugcuagcuacuccaggccacacaucugguggcguguuuggcacacacacacacacacacacacacacacacacacacacacacacgcugugauuauugaggguccuugguguguugcaaccuuaaagagaggccuuauugggcugguuuuuuucuuuuuucaguugcauauguacccaauagaguccagacucaaauaucuucacuggguucucuguucauccaagagaaucagauuccugcgagacucucucucucucucucucucucucucucucucucucucucucucucucucucuguguguguguguguguguguguguguguguacaugcacgcacuaggaacucuaggguggaaaacuucuccuaaggagacacaaaugauaugucucaagaaagcugcgggcuggcaucggcccuacaccacucacaucugcugugaaauugaggcucacuuaauuuuaguuguucagauggugguggggaggaucaugaacucccccuuggucuucaaacaguccuggaccccagggaaacaaaggggauauucucuugggccucagguccgagcagcauccugauacuuaagcuguuagaggcugggagggugagcgggagacauggcagccccuugagugaugguucugggcaaagggccgucgccucuacugucuccuccucuccuuugagcuuuuucucacgcuccccccacccccuuccucaaaggccaggaaaucgcaauguguuaaugugguagaaagacaaucugcuggggggagauaggggugaggugcccaagugggaagggacuggggaaggcaguguucaaaauguaauaaaaugccguuugguuuugcuuucagucggggcuguccgagggcaagggaaagacgagucaaagguggaagaugacccgaagggcaaggaggagagcuucucucuggagagcgauguggauuacagcucagaugacaauuugccuggucagacugcucauaaggaagaagaccccggccacgcacuggaggagaccccgcagagcggcggugcagcaggcagcaccacguccacaggcaagaaccggcggcggcggacugccuucaccagcgaacagcugcuggagcuggagaaagaauuccacugcaaaaaguaccucucccugaccgagcgcucacagaucgcccacgcccucaaacucagcgaggugcaaguaaaaaucugguuccagaaccgccgggccaaguggaaacgugucaaggcaggcaacgccaauuccaagacgggggagcccucucggaaccccaagauugucguccccaucccuguucacguuagcagguucgcuauucgaagucaacaccagcagcuggagcaggcccgacccugagggcccagccaggguggacaccaccauggagaggcccuaacaccugaaggaacccgugucagacuccacuguuuaaagcagaacucagaggcaccuccuagauguggacauccaagcaaauugagaguauauucauuagacgggcuuaaagggggcuacagccacaccagaagauacacuaaauauuuauuauacaacccuacuuuguacauagaucucuaucuagacuggaucucagcugcaguguuuugaaagggauaggaucaaaucucucuccuuacacuuuccagaugaaacaaaaccaccacuguacucugucgccuucagcgaccaccuucccauacgugcccaaagguaaacaggagacacaaggacaaacacugcgguuuaaccuucuuauuguuauuuuuuguuuguuuguuucuauuuuggcuuuuugaguugagugcagagcagucgguugauuuuggagcaaucuagaacucugcucugcucguuugcuuugccuggcugucuuuccuggccuuguauauccuaucugagccaugucggaagcacgucuccguuguguuuaauuuauuucaauguagcuuauuuucauauaaguuaugacauuuaaacaaucucagucuugugaauaauaaaaaaaaaggcaaggaaaaacu

SEQ ID NO: 284 - RNA, 3059 nt, Mus musculus
cgagcgacgccugcaccgcuucggccgcagagaaagcgagcagcgagcccuccuuggccaagaaggcuuugccgucuuccgcauccgcuuggagcgccucggcuuugucgaaguugccgccuccgggcaguggcuguggagcgaacuugcgggcagccgccgccucuuggugcuggggcgacgcagagaagccgccgggcagaguggccaugagcguggaggugagcgccaugcccugcgccaggcuggagcagaagccggugggcaggcuggggaucugguggugagggugcgcgggcggcagagcgggcugcagcgcugccuggggcagcgcgggaggcgguggcggcgguggcggcagcaccaccggccgguagggcaugaacaugggguagccgguguagacgaaauggccgggacugggcugcggcgggcugccgaucagcgagucuaugcugaaggcgguacuacuccccagcgggcgcugcaucaucaucagcgacggcgggaacgcugcgcucauagacgcguucgggagaagccagggagagacgaaaaguccccgugucccgccgccgccuggaagcccuccggacgcugggaguaccaccgggaacuccgggcaggggcugagcggugcccagagcgcagacgccgccgccgccccucagugcaggacccgcagcauacccggccugcacgggugcagccaccgagcgcgaugaggccgugcgcccgggauggagagggcgccggggaccucgcguucgccggaaccgcucccggcugcuagcccgucggaacgcgcgcgcuucgcgucugcaggucucggcccagcuaccagcagugcgugcguccguccgucuguccguccugcaguccgucgucucccacgggcggcuggggagcgcgcgaagccggcgcacuugucucuggcgggcgccgccagcaccuuuaaaucgcgcuccucuuucucauucacauuuugccagcugcccagcggagcucgugucacgugggaccgagcaccaacuccuauuugcuauucaggggaaggcggggcgaaauuagggcuccgcccccuucacccaggcgggccgcaaaugggcuaccggcgccacgguuggagcgugcuggccugggagcuggagccuuugcaccgcgcggagcaaacuuaagagggacccuugcuaccuacccgacucagacccuagagucccuggcaucccuguggaggccucaugagaggcggcuuggaacuggcacccgccaccgaugggccgggaguguuuuacuacagcagaacccugugugaugcucaccuuaaccaggggcgcucugguugugccaaggguccgggcaaggucuccggauagcguuuaaggucuugccucugcaggucugcucccagaggugcgccugggccugucagcccuugcucacacgacacggaagcugaaugguugcuugcggcccgcugguggcagcggggcggccggcgguggucucccucauuccugguugggcccuccgugagcgaucccugcucauuuuucaugacauucuuaaucaucgcaccuauuuacccacuuugccagcguacaccaaaauaacagccacgauaauuaugauaauaaagcgagucuuuuaucugcuccaucuucagggaggaauggggggggggguugcgacgccucuggauuguauaacgugagauuauccugaugaaagcuuuaugauguuugcucaaauaaaagcugcguuuuguaaauaggcacuaauuaagcacguuggcaacggagggagcucucacccuggcucugcgcagcgcgaggacuccugggcacgcgguuccccuuugcggacugcuggauggagcugagucccucaagauauuuccccuguucucgacaaugguaaaaagccgggaauuuggggguuaggagauuggagggauugcggcgaaaggaaaguaggcauuucuggucaucuuuucuuauguugaaacaaacuuucaaaucuuguguuccuuuuaaaaugggauccuuucguggcgaaggcagauccugccaagcgcguugggcuuccucgggucccccugccuguucuucagauuccuuggucuagacguccuuucggaacugcugacagcaccaggccaaggagcaaaggagggcauuguuauauaggucauuaaaaaaucaguucacccggaagagcucuggcuggggaguuggcucauguuggacguguguuauguaucacaagcacauuuaauugggagauaaagauaaaucgaucuuuaugaauuuaucgacccgauucuuugaagcucuucuuucucggucuuccucuuucucccgcucuaaccccaaggucccccggggacgucucaauccuagagaucuucucgggccaagaaucuugccagagagcaacugcccacccagagagguaagaggggacgaugaguccuuugcaucucuuggccagaagaaaacucgcuggcccggcugccagccguccuccucccccaccaguguccccuccccuccccuccaucacccggacaaagacaucucaaacgccuuuccccucuccgggccgcaguaauagaugguuucggcagcaggcgguuugaaaggaauucauuagggcgcugccuguguugcaucccuucacuucacgcccagaacucgagauggcuuaggcagugugaggggaaauuaauucucuuugggauacacgggaaggaggugucugugggauacccaagcucuagucccuguuugcccacaaaagaaguuaaucgaagcccaaggcaaaaggcugguuucuucaugagcauaauaaauacucccucuuauuaugagauaccuacagugacagucuucaaugccacuaccuuguuguuauccccucuccucaacuucuagaauaaccgcuuccuugauuuacgcaaccgcagccagggaccuucgugcuugccugcaagaggacugggugagcaguuacucauucaccugacucuccugccuuccauuuugcacuuucacugu

SEQ ID NO: 285 - RNA, 3059 nt, Mus musculus
acagugaaagugcaaaauggaaggcaggagagucaggugaaugaguaacugcucacccaguccucuugcaggcaagcacgaaggucccuggcugcgguugcguaaaucaaggaagcgguuauucuagaaguugaggagaggggauaacaacaagguaguggcauugaagacugucacuguagguaucucauaauaagagggaguauuuauuaugcucaugaagaaaccagccuuuugccuugggcuucgauuaacuucuuuugugggcaaacagggacuagagcuuggguaucccacagacaccuccuucccguguaucccaaagagaauuaauuuccccucacacugccuaagccaucucgaguucugggcgugaagugaagggaugcaacacaggcagcgcccuaaugaauuccuuucaaaccgccugcugccgaaaccaucuauuacugcggcccggagaggggaaaggcguuugagaugucuuuguccgggugauggaggggaggggaggggacacuggugggggaggaggacggcuggcagccgggccagcgaguuuucuucuggccaagagaugcaaaggacucaucguccccucuuaccucucugggugggcaguugcucucuggcaagauucuuggcccgagaagaucucuaggauugagacguccccgggggaccuugggguuagagcgggagaaagaggaagaccgagaaagaagagcuucaaagaaucgggucgauaaauucauaaagaucgauuuaucuuuaucucccaauuaaaugugcuugugauacauaacacacguccaacaugagccaacuccccagccagagcucuuccgggugaacugauuuuuuaaugaccuauauaacaaugcccuccuuugcuccuuggccuggugcugucagcaguuccgaaaggacgucuagaccaaggaaucugaagaacaggcagggggacccgaggaagcccaacgcgcuuggcaggaucugccuucgccacgaaaggaucccauuuuaaaaggaacacaagauuugaaaguuuguuucaacauaagaaaagaugaccagaaaugccuacuuuccuuucgccgcaaucccuccaaucuccuaacccccaaauucccggcuuuuuaccauugucgagaacaggggaaauaucuugagggacucagcuccauccagcaguccgcaaaggggaaccgcgugcccaggaguccucgcgcugcgcagagccagggugagagcucccuccguugccaacgugcuuaauuagugccuauuuacaaaacgcagcuuuuauuugagcaaacaucauaaagcuuucaucaggauaaucucacguuauacaauccagaggcgucgcaacccccccccccauuccucccugaagauggagcagauaaaagacucgcuuuauuaucauaauuaucguggcuguuauuuugguguacgcuggcaaaguggguaaauaggugcgaugauuaagaaugucaugaaaaaugagcagggaucgcucacggagggcccaaccaggaaugagggagaccaccgccggccgccccgcugccaccagcgggccgcaagcaaccauucagcuuccgugucgugugagcaagggcugacaggcccaggcgcaccucugggagcagaccugcagaggcaagaccuuaaacgcuauccggagaccuugcccggacccuuggcacaaccagagcgccccugguuaaggugagcaucacacaggguucugcuguaguaaaacacucccggcccaucgguggcgggugccaguuccaagccgccucucaugaggccuccacagggaugccagggacucuagggucugagucggguagguagcaagggucccucuuaaguuugcuccgcgcggugcaaaggcuccagcucccaggccagcacgcuccaaccguggcgccgguagcccauuugcggcccgccugggugaagggggcggagcccuaauuucgccccgccuuccccugaauagcaaauaggaguuggugcucggucccacgugacacgagcuccgcugggcagcuggcaaaaugugaaugagaaagaggagcgcgauuuaaaggugcuggcggcgcccgccagagacaagugcgccggcuucgcgcgcuccccagccgcccgugggagacgacggacugcaggacggacagacggacggacgcacgcacugcugguagcugggccgagaccugcagacgcgaagcgcgcgcguuccgacgggcuagcagccgggagcgguuccggcgaacgcgagguccccggcgcccucuccaucccgggcgcacggccucaucgcgcucgguggcugcacccgugcaggccggguaugcugcggguccugcacugaggggcggcggcggcgucugcgcucugggcaccgcucagccccugcccggaguucccggugguacucccagcguccggagggcuuccaggcggcggcgggacacggggacuuuucgucucucccuggcuucucccgaacgcgucuaugagcgcagcguucccgccgucgcugaugaugaugcagcgcccgcuggggaguaguaccgccuucagcauagacucgcugaucggcagcccgccgcagcccagucccggccauuucgucuacaccggcuaccccauguucaugcccuaccggccgguggugcugccgccaccgccgccaccgccucccgcgcugccccaggcagcgcugcagcccgcucugccgcccgcgcacccucaccaccagauccccagccugcccaccggcuucugcuccagccuggcgcagggcauggcgcucaccuccacgcucauggccacucugcccggcggcuucucugcgucgccccagcaccaagaggcggcggcugcccgcaaguucgcuccacagccacugcccggaggcggcaacuucgacaaagccgaggcgcuccaagcggaugcggaagacggcaaagccuucuuggccaaggagggcucgcugcucgcuuucucugcggccgaagcggugcaggcgucgcucg

SEQ ID NO: 286 - RNA, 12935 nt, Mus musculus
ggcaaguccggagcccugagagaucucaguugcuacaaacugcucagcacugaaggagccugcagcgcucaccgucaggaaggcaaaccacagcccaggaagcccugagguaaguaagaaagccuugcuucugcgacagcuuugccgagcaacuacggcaaggggcaggacuccuguucuuacgagaacugggcuuuuucugagaacucuuggaucccugagcugggggcuuuagagccugcagguccggauuggaaagcucaaagcacgcugcaugccugcauugcaagcuacugcuccugauuugggggaucugaguucagucauuuguggagggaaaccucuguguauguuuguuugcuacuggacucugauuuguuucugugaguacuuaaguuccaggaagcagggaaacuuugcagagaaugugggaugccccauugagguugcccaaagccagcuuaggggugagcuuggcaucacuguuugcccacuccuacuucugguuaucagauuggcuguaaaaaccacaagcgcacuuccagaaaggcaugugauaugcccagaggcauccuucagcggaccagacaacugggcugagcauucugagucuaggaugaguuuaaacuccgugcucugggggguggggauggauuaauucacagcuccugaauucuggaaguuguaaauugaauguuagcuccucuucaucuuaucucuucauggcaccccugcuaaucuaauuuugaguauuuauuguucuccuagaaaguguuguccaacuucaauugggacaaaaaaaaaaaaaagcagacacuaagaaaucuaguauuugaauuuaaaucuacucuccaagugaacugugaguguugcugacuuuuguuagggugcauaaagguucacuggguggcugggagugagggagacucugaggucaggggauccuggucagccaagacuccuggcugcuagcuacuaggaaaaugaggcacugugaaaggcagacuggcugucucuuccccuuucucucucugucucuccauucauuugcucacaaacagauuaauuaauuguuucgaugugagguaggaucaagcaucuuuuuaaaggugucuuggguuaguggcaucccugagaccccagucugugcuguggccaguauggaaacuuuguuuuucuuugaaggagcagaugcuggcuuuguggucuuuauuuaguucaggagaauguggagcucaauggauaggaccagaaaggagggaugggggugguucuguuuuuuugugccuggcucguugcagauuguaaauggauaaagcccccaaguccccgucuuucucccaucugaauagaagccugccccaaaugaaaugaaaacccuguuucgaucgggagcugugcacaggcuccagcuuggaaacauuuugcucuaauuucccccagucugagcggugaacacuuugugcugcucucugcugagcucagcugcugccuccaggaggcagcaggggcuggaaggaucugucugggagcagagguguaaaagcuggggaaguccgacugcuugcuagcugccuguuggguuccuccaguuuguuuuuaaaggggcaugcacagugcaaucacacacauauauuuuaaaguuccagaaagcuacacggcugcaugcuugugcuuaacugagucagggcuuuggaggggaguuuauccaguauuauuagcaaacccuuagggagcuaagaaaguauuaugauuucuaaucagacccagagcuggccaaggguaggcuuucuaaaugggauaaaaaaaauggaagaagaagaagaaagaaagaccaugaaacacccugguuagucagaacaguggcuuuuugugugaggauuugaggcagagugcucuaauuuucaaaucuacacagggaaguugguugcaguuacucagagcugagucugaagggccacuccuuuauaaacuuuuagagucacggaggagggggaaagggccccaacaacuuuagaacuuuuacuuuucugagaucuuguagcaaacagaauggaauuugggcccccaaaggcauuuguacuuuucagcuaagcaaccagggauucuuaaggacaaucagguauuaaaauguuucuugucgccuguuaggcugggugcaugccugugauuccagaacuccagaggcugaggcaggaagauugcuaugaguuugagaccagcuuggguuauguugccuacacauuaugucucagaauaaaauaaacaauaaacaaacauaaagucugguaauugaaaucuaugugcuuagauaaaauugauagacaaguaguaaugacuguuuucaaacuccccaggcacuggggcaccucucugcuguuacaauggaagcaaacagccuaaagaaagaagcaagugggaccaggugucgggcaaggauauuuucugcagggauuagccuucugaugccuuccuuguuaaaaauccacucacuuagaauuguuugaagagagaugguuagccuacacucccucaaacuucacuuuaaaaaaaaaaauuguuucuuauaaacacaucccagagacuguagaauuuuauggugacaauuuugcagagaacaaggagguuggcugugggcaguguuuuguucucccagcccacggcugggagauauggagacugucucagguggccuugagccacuccagguggagcccugggcagcuugggaaagcugcguuugaaggcugugucugcuaaauagcuggcgucuuuuucugucaucucugccagccugaagguugguauauaagaagagccuaagcuuucuuaguguggcuugggaaccugaaccuccuauugucuugcccagguccuaaacuggugggaaugcagacucuggcucuauccugccagcuggcagccuuuguauguacaggaacaucuagaucucucugcuagaugcagcucugcucccuugggcugagcacaauggcucugauccgguuucuggaugggacauucauucuaucugugagugcucccaugguaguagaaggcugucucauguguuggugggaaauucagccaagaacccuggggauagguggccuguaucagaaucaggguguggauuuuucucuccguauuuauuauuucuuugaguuccugaauaauucaaagcaguuccuuacuuacaugaacugaggucacucagggccacaaugaauguguggucaggacagcauuguuucucauuggcucaguacugggggauagacaagagucccuuucugcacucaagacuaggauuugccugggugggugucacgcugguuggguguguguuucaaguagacuuaaguaggggggucgauuaaugggcaacauugcagccgucaucucucugauggacaguggccucacgguucugcaaaggugacagucagacucuccugcuucagugaaaggcucucuguagacugucccagccaaaugaaaacacugugccuguaacacaggacccaaguggaagcuguugagcacagcuccuacuggcuggagcauggacaagcuacagcccguuaguuacuaaugugugcaucccucguggcuuaucagcugcccugaacuguuuucaaagguguagauagggaagacaggcuggauaaauaccuaccuccagacuugaguccacagagaauuucuccaggaaguucucugugggacacaggccacacuuugcagaaaaguaaacuuuucuggaaaaaaaaaaaaaaaaagaguaaacuguaaaggaaguuuucuuguuuccuaguagguucuaagucccuggggcugggaucacauugucuuauguggcuucuguccaggcagcaagccuauuuauagggcaucugggucaggccuucucaacuguguggcacuucugucuuuaaaccuucucugucccaaagccauggcguuuccuuaaaccugcccuggcauagacaggcuaaggccagaucuccuugcccacaggucaaggcccaccucugcucucuucucuccuucauggagacagugacuugccucucaucgaugcucuaugaugucccuggcuugccuccauucuccugaaggcuccccaccuuacuacugaaggauguacccaugcccaggagagcaguaagcuuuugugccuccuggauagccuuguuuggaugguggguguuugggggagguggauauggcuugacagcuucacgugucccagagcagugccuucaagaggagaucaacugaugucagcugggaaaggguugcagcugagucucucuggauaaccagugcaccucaggcugcuggccucccgggagcacgacugacugagcgcuuuuucaggucacuuugcuccacugguugaacaaaggugaaugagacccaguagggaggaaguguagagguagcaaugaggagagcuuugugaugcauugggaugugaagccuguggaagggaggggugaggcagaggcaggcugagaaggcucuucucuucuccgauggggauguggcgaacacauugaggcaauuuggugaaccuuauccaggcaccugaacacacuuggcagucccucggaggaucuaucuggggauaaggacauauggauugcagcccaaaccaccaccccauggagacucuaaauuuggaugcuucuaauucuggugcugucccagcaugcuagggagcuuaggcgagccaguugaaaacagcuggauaccgcaggcagcuggguguuauccaggacauuuuaugaagaguagcgaaccuuagaagcgagagucagaucuuugaggaaggaucuuccucuucgcuguugguccugggaggcguguggcuguggacccauggcagaacuggacagaugggagugcugucugugugcagauaauugacaaagucauugacagacaagagugaaugagcucgguaggagucggccucuggaggaggcuuucgguuuuggugaagucuguggcccagaaaaacagagcaggaaccuuugaugugcaguggcucauucccuccccuguuaaaauuuacauaauuuugauguaagcuuugcaauaauuugggcguuucuggaggaaggcgaggcugccucugugauugccuucuauuuacuuucccugcccaaagccuuacccucauugugggucuuugugucuuucuaugcauguauuugcauauaaaacacucauaauuuugccuuuucucccacaucaaugggauugugcugagggcagcacaucugcuucuuagccuucugcucagcagcacacauucauuuacuccccuuguucuuaaaccucucucucucuccauccccgcccccucucugcucacagcuguguuguauuccacacauuagaugugcuugcucgucugcuauuguuggauauuuaugcugcccacgguuuuugcugguaaacaaaugucacuucaguagauaccuagaaugcaugguugagaccacgugggcaucucaagaagaaguuuguaaacuuguaaaaccauagaauaaagccaucauucuaaggcucccuaacucccugcaguucuuauccaggugugguucccaggaagcaucugaaaugggucucauccaugccuuccuagggcuggacuuuugaguguucaaagaugaggccacaugcagaggacaccccacaaaucacucuucaccucuggccuaaagacaucagggaaggaaccaggcuugauugcagcccugagugacugggcaggauggggaaaccuuuuucuggucuccuugguugucaguccuccguguggccagcauaaacagcaagagauggccaagagacauuaacuuuggacucaaggagcagguuuguaugaaauauaacuuguuccucaugaacuuccugggaaccccucugucugcuggagggaggccaggucuccaugcagggcucucugggaggucggcagagucucccuuuuccccaauuggccuucacuuucagauuucucugagagcuuuguccaggacuggaguccaaggaucaugggcagaugucccucaguuugcugugucaugauucuguuucugucaagaaggcugaaggucauuugcugagggauaagcaagaaauggaggagggcuauuggcuucaucaaggggcagacaucacugguguuaagagggcauacuccugaugucuugcauaggugcugugacugcagaccacacccaggugacacacaguuucuguuguccccaagaagauggauuguccugucauuggcucuuuucugaaaucauucuuauuugcuucuaaaaccuaaugcaggaaagauguccaagugaugaaggucaggcugagguggcccuuugauaucuucguuuuuguuuucuuuagucacuuguuugaagcacaaagggucugguugcugccuucugccuggucuccaggagccuucuguggcagggagggaacauccaaucaggcagcaguggucaggaugagguucucugccccuggacugugcacugcccacugaaggugacugguugucacagugccacgaggagucaccagcuuaagcccuguccuucagaaugggacgauaacagcuccgucccugucugagacuuuccacagugccaagggaccucagaaguagggacaaacaggaggcuggcgaucuguaccugcccccgaaauaccacugugauucugggacccaauggucaugagaccaagguucuuuucccaaugguaaaaaaacaaagggcuggauggggauccccaagccccugcuaccauccacugcuguucuggaaccugagagaagcugagauuggcaggugcacaugagaacgagaguugaaucugcagggacaguggagggaugcagaaggcagauaccaucuccaucuguccccugcaccgcacggggccuucuuggaccauuuccagggcuaggcgugccugggcacugaaggcaauggaggggguaaggggcugccuccugguguggagagaacaggaagacagguucaggacccaaggucaagcuaccuaggcuuggggccaguucuuucuuuugguuuucagccuccaugacugacuacuaaagccauagucuggaccaguagcucaaggacaggcucacaccacugccagucaagcauccuccggucccuagguccccauuguaguccuuccuuuauauagugugggccugggaaggucuuuuuuccaaccucugauguucucuagagacucugggucaggguagacugagaggucuguucaaaccaagucuccuguaguucaggcuagacuucuuagguagcugaggaugaccuugaacucucgaucuuucugcguccacuuccugagugcuggguuuauagaugugugucacccugugucuuauuuuaauguaauagaauaagaggaaaaaaggaucuuugcccuggagucgugcaggacagaauucuugccuugguuccuucccagucauaaguucagaguggaaagucagugccugugugugugugugugugugguaugugugucucuauguguguguguauguaugugucugucucucucuguguaugucuauuugugugagugguguguguguguggugugugugucucugugugugugucucugugugugucuguguauuuguguguguguguguguguauugugugugugucuguguguguauuguguguguguguuuguguguguauugugugucuguguguauugugugggugucuguauauguagcaguucuaggcaacuugggguuaacacucuuuccagaggccagucuggucaguuacagaggccccaucuuuuagaagguacucucugcaacccagacagcuguuguccucuuguaguucucaggacugggacuuaggacagaacuggcacuuucuaaagugugugggccugggguccacaugccaggacaucucugaggaccagcauccucuccuaccauaggagauccucugaauaggaagggaaugaagcugccacagaagaccagaucuucuaucagcagcugaggacacgggggucuaguuagguuaccaggaagcccccucagagcuugcaggcagucuucuuuaacugggauuuaggagugggucaccugcuguggguugaagacuugaggugaucauggguggcaucagaugucaucucuuuucaagauccuacugcugcugucuugaaggagaaagcccugucacuagcuauccuccaccagcccuugacuucccuucugcuggguccuuaauauuccuaagagcacauugcuggcauucuaguuaguggggcugggcuuuccuaaaggggauaauuggccacuuuaaacuggacaguccucucuucucuaguccuggaaggugcuggaggggaaguuguguggaguaacugcugcuucccagauucuggguugugcccucuguccugggacaguagccacgggugguuaaaucuuagcuuagacaugacugagaagccauaauuccaacccaggaaugugcaaauccuggauuuggugguuuuucauaccgcgggguuagccaccgccaccgaggcauugacccacuaaaugcuguccugugggaguucucaugcauaaccuggaguccaucccaaaugaaccugaaagacaagcuuggcucuauuucagccaucaccagugauaggugccaucauuaggaccggaugucucuccauucuagucaugcaguguggguugggggggggguggcggggaaugacaagggcaauugucccagaacuauggacagaugggcaauagaagacagcucccagcaguuccuauagaguauguggagaaaucacccuaggcauagugcuacccuggagccaaauucucacuaggugugaugugaugacagcuaaguguuggccucaggucaggcaggucaguggggacgucaaucaacagagcucaucaacccuccagagauacagcagguggcuggugguuuauauacuuccagucuuggcuccuggcacucuggagucaauugagugggcaaggaaugggaacccaggcgaagucugagagcuggaggcagcuggcugguugcccgcggcuaaaaacucccagcaagcaagcccugggucugcaaguuugggguacaguccuauggcggggcacuccacacuugcuggcacucaggggaagcagaggauccggagaggauccagguuggcagauggauauugcaaagggggcuaaagaaacagugucccacuuuuaaacgcaaaucgggagaggauuuggagugcuuccauuaagacaccaaagcagcacacuuaacaauucucaugccaggagcaaaccaacccugccucucuugggaaugucaguaaaauggcucuguggacuccuacugaaguacaggccaggccaucagcacugcuguggccagggcucuacuaucugacauuucuuuggacccuguaucaugcugauuucacaccuaggacacagccaagcugaugccuccauaacacagccaugaaaagccacagaaaacaaacacagccccuccccagcaccauguaaccuuagcugggcuguguuugauuuucuuucuugcagccuaaguuaguuguuuucuuuccuuucuuugugaagacaucgaagagcaaaagcaaaacccgugagcauccucaguguugacugagacccgagguuucucaugaugaucucuccugcuugccuuugcuguaggucacuuggucgcucuccucaagaccauggaugugcacuuguuugacuaugcagagccuggcaacuacucugacaucaacuggccauguaacagcagcgacugcauugugguggacacugugcagugucccaccaugccuaacaagaacgugcuucuguauacccucuccuucaucuacauuuucaucuucgugaucggcaugauugccaacucugugguggucugggugaauauccaggcuaagaccacaggcuacgacacgcacugcuacaucuugaaccuggccauugcagaccugugggucgucaucaccauccccgucuggguggucagucucgugcagcauaaccaguggcccaugggggagcucacaugcaagaucacacaccucauuuucuccaucaaccucuuugggagcaucuucuuccucgccugcaugagcguggaccgcuaucucuccaucaccuacuucaccggcaccuccagcuauaagaagaagaugguacgccguguuguaugcaucuugguguggcugcuggccuucuuugugucccugccugauaccuacuaccugaagacggucacaucugcuuccaacaaugagaccuacugcagguccuucuaccccgagcacagcaucaaggaguggcugaucggcauggagcuggucucugucaucuugggcuuugcuguccccuucacuaucauugcgaucuucuacuuccugcucgcuagagccaugucagcaucaggcgaccaggagaagcacaguagccggaagaucaucuucuccuacgugguggucuuccugguauguuggcugccguaccauuuugugguucugcuggacaucuucuccaucuuacacuacaucccguuuaccugucagcuggagaaugugcucuuuacagcguugcaugucacccagugccuguccuuggugcacugcugugucaaccccgugcucuacagcuucaucaaccgcaacuacagguacgagcugaugaaggccuucaucuucaaguacucggccaaaacaggucucaccaagcucauugaugccuccagagugucagagacagaguacucugcccuggaacagaacaccaagugauccaucauucugcagaggucggggggacacgugcauguugcaaauggggcggcuggguccugugguuucuucaagaaagcaauguagcuuugggucugguugcuugagugguaugaagaggagaaggcaugugaccaugcuuccugucucucauucuccagccaagauggcugccgccuggaugcccauccugacagcuggcagcuggcagcuggcagcuggcagcaggcagggcugugcugugcugugcugugcugcgcugugcugugcugugcagccagagcugcguaucaaagccagcaccaggacaggcucuuauggacauguguacaguagaaucuucuguguuucuucaaguuuuuacuuggugacuuuuuguauuuaaguuuuaagacuuuauuuucucacuauggauguaccuuauaaauguauuugaaagcuaaauauauuuuaaauauuguaugggagguguaaggcuguuguauucagaccauguaggccucagauuagcuggacuugaguuuugacuaaggaugacauuaauuguuagcugauuugaaauuauauauauaaauauaaaaauauauauaaauuuaugccagucucggcugaaagguuuuauuuacaauaguuuuauaucugugcaauguuuaaugcuggcacagcauaugaaacaacaacugcccagcaaugcaguuuguuacaugaaccauauuguagaguuacacuucgggcugcaaacccgugaacaagggaaacagagcguucuguugauuuguaaguuauuuuuuuaauaaagauuuuguuuccuaaaaccucaugugugcuuuggguuugaaagcauguuugggcuuuggauggcaugcauagcacuaacacauggaaaaacaugucagacacaggcaagaagaagauguucagugggagagaacggccagagagcccaaccaugggacuggguggauggaucugagcagggugggugcuauuccuugguuccugaaggaacauuuucaaaaacauuugaguucaggggaggaugagcaggucagagguaggugcauuucaauggcuguugagugaaacuugcuguaaaaguugugcugcccacugucuacucaggaaaucauguccuuaucuuaacaaacaucugccugccgucuuccccagccacauguccaucagaccauccugcugagggcaugagguuaggugucagcgagcuguguaugcuguaugacucuccaagcccaaagcaccuucaggcccagcacucuagagucagaggcagguggaucucugugagguugaggccagggccaaccugaucuacacagugaguuccaggcuagccaggccuguguaguaagucugugucucaaaaaaaaaaaaaaaaggcuuuggaucccuccuaagggaaagcaggguguaagaaaguuccuggccugugcauugauguaugcuacgaagaguuugaaaguguccuuuagaaauggggguuccuacccucacuaauucuccauggagcuaaaggaacaccaggcaggagcucagagauaggcuggcuccccaagcugccuuuaccugucucagcucugaggacaaucugcuugggggcugcuagcccaugcacagauagaucaaagccaggagcacugaucuggagagccugcagcugcccuucuauaggaaagccccugugcacauggacuuucccagucacagccaguagccuuagaggucccaaggggcauguugaccaugucagcugcagggcaccaauauccuguaaagggcuugaugccugauaguuuuaccuagggcuguaacuuguauuaaugccugcuacauccuuugauguuuaaacaaccggccuuaauccaaagaacauuuugcuugaauagcaauaauacacaccaugagauaauaguauaacaauaggcaaauuuacugauggggguggggagauaaggaaaaauggccaggcaaagucagggaaaauuc

SEQ ID NO: 287 - RNA, 1369 nt, Mus musculus
cuuuaaauuugagcuucccaaaggcaaauagaguggagaaaucagagguggggcagagccaucuuagauccacccaugggugaguaucuugggaaagagagacauuuccuugucucuugggagacauccuuaggagagagaccuuuaaaggauugggaaagaggcugugggaaaacuaacuuccuggaaaugaugugcacggauauuuuaaguguaaaagcaaaugacuguuccuuggaggucuuaccugcaccguucuguaaguagaccauccuugggguauacagagaggaaaugcauuccuccaggagcgcuuauuuauccuugguuugggcuguauccaggcaaaugcuuuuagugccuuuccacacauccagagaaaaguauccaacccaaccuggaaaagucaagccaacagagccaucccaggagugggggauccauuucagauguuuggggaggagccccgggucauagauuaguacugauccgccaggugccuguuaguaauaggacauaaugagaccuguuaacugagucccacugaggcagagcaggaggcagccuuggauguaacugccacucgucucauguagcaaaggccagguguagugaccuguagaaagguggggugcccaaacuuucuggaaucuugucuuaaguggccaguguugucaguacccuaguguccggccuuucaacaggcccuguuggccucgugccaaguacucacugcugaaucgcugcauacauuaguguacagauaagcaaagccagacguuuagcauucaacccugcucugugcacuguguucacuugcuugucuuuagagggaacgucguguuaacaaacacccccaaagcagaaauggggcugauuucaaccgaugaaacgauugucucguggccacuagauacaucaagaaaucacugccagugcugucuuaccaggaccugucuacaucauagcuuccugcauagagucugagagcugcuguguuguagggagugugugguauggugccgugugugugugugugugugugugugugugugugugugugugugugugugugugugugugguuguuguuuucuucguguggacagaagagaaacauugcucugugaauugucuuuuaagguggaacugggcacacugagagaaaagaagaaaucagacagcuccuguguucuugguagaccaagcuagagcuccgggcacuuuuggcucucacuaugggguuuuggcagcuuuaguaacaucaagcaaauagcccgugaacucaguugauuguuagcccccaauuuaaacccaagaccaucugguucugaagccucucccuuaggcugccuccagcaggacaagug

SEQ ID NO: 288 - RNA, 1110 nt, Mus musculus
caaaaucuggcuccaguugagucacagcaacagguggcuguuccucugaacaaggguugcuagcacauaaaugcuagagguauucaaacagacugcaacgcggcagcaugucugccggaaaggcagcccaggccuuccugacuauaaucaagagccgaugccaaggguacgaaugucauuuucucuuuuucuccucucuuucuucauauggauuuauuuauuuuuuugucuucauuagcagggaaguuacacacagccagaggaauuucaaggucgggagaacaaaccuauccuggggaagccagcaaauuccuugcugauggagcccucugauuuaucuggaaggagaggaaaucacaggccugcauagcauagagugauaaccuuggguuagugcaauauaaaccucaggcguuauuuucugcauccccgccugaagggaccuugguguguuaguccugcaaauaaaagccaaaguugugugacugguacccagauguccuggaggccccugggcuuggagaagacuuguucgaggaccugggccucugcagcucuacucugcuaugcucacacagagcugauacaucuuagcaagcaacagacaaccugagagagcaugaaucccuucucuaucuggggcaaagcuuuucccuucaagaugacuucaaggcaaaauuugauugauuuuaagcagacacgucagaugaucagacucugaagagucacacuagaaagcugaaguuuuucuugguacgcugucaugaagauuuagguggagagguggcucagagguuaagagcacuagcugcucuuguagaggacccagguucaguucccagcagccacaucagguggcucacaaccaucuguaaccgcagcuccagggagccuaagucucugaccucugaggcugucauacagagacacucauauaccuauaaauaaauaaacauaaguuuuuagaaagcaauguuguuugggcaguguguuuccacauuuuuaguauuuuuuuucaagauccugaaagaguuaguaguauuaguucugcauccuucaaaauaugucuuucuaaaaaccugugaaaauacagccugagguuuuugugca

SEQ ID NO: 289 - RNA, 10387 nt, Mus musculus
gaaaaaggugugugugugugugugugugugugugugugugugugugcgcgugcgcgugcgcauaguagguguaggugagagucaggcugcuaagugaauuguuagaagaggggugugugcauaacccaaaccaagaagaguuucagguuuggaguuucuuggacuuguauguaacacuuuagcuuagaagaaguacaguucagcgcucucgaaacacguggagguccaacgguuuuacuguucucccacggcaacuuugguuguggaaaaauguagucccguuaucauuuccccgugcggauaauccgagccgcagccgaacccuuccggaucgcagggcucugacucagaaagccgguucguccuagccuggggcggguccuccagagcaccgagacguuggggcagagcgcucgccgcccuuguauuccgcuacggcgucgcucgggaagugacgacacgcucgcccaugcguacugagaggcagcuccuuuaccucaucgcgggcgcgacgccccgagggccagcuugugcuuuggucuggcagaggugguggcggcgagagcggccgggaagaugccaguggcggugauggcggacaacgccuucaguuucagaaagcuguuggaucagugcgagaaccaggaacucgagguagcgccgcaggguggggcggucgggugggcgccguuuccaggguaacgggccgggccgcggccugcggggcgcacacuccggguucaucaagagaugcugcuuccauuuguaacguuaaguuaaguucgcuaaauaggcugggcgcaguggcacaggacuccggugggcacacgucaggcggaggcgagaggauugccggugaauucgaagccagcuugaacuaugaaaaccccaaaaauaaaaaauaaaaauaaaaaagaaagaaaaaggaaaaaaaaaagggagggcgggggcucacggacuaaaggagacagcagcagcuugcggaugagccuuuagcagaccuugcugaaugaauaaagauugaagagagacaggccucuauaacuaccuuuugguagucuucugucuuaagcuuacuuaagcuuuuaagauaacggccagaaaaauagugcauuaagaaccuguuggaaguaguccccccccccuuuuuuuuaauuugagaccugaccuuccgagguaaugucacuuacauauuugugacuauggaaagaaacugauauccaacugcagauaaaugacagcucacaacagaucuaaacucagguuuuaaccuuugauacuucccuaagcauuuuucugcaucuauaguagugcuggaaaacuuacuuuuuaaguuuucauuuucucuuuucugaaaguguauuaggaagugaggcuuuccccucuuuuuucgcucucuaggcuccuggaggaauugccacaccgccaguguacggucagcuucuagcuuuguacuugcuccagaacgacauguaaguagcaccuuuuaccuaaaacgaaaagcuuccuugagaugaugcaggaguacaugcagcagauaggugucuuuuacuguaauccuguuauaucuguuucccuuuuugucauaauuaagaauaaauaagcucgauauuuuucuugucguguaugucuuacauacaccuaaaaacaugguaaguucuugugagaaauuagcaucaagaaccaauggaguuuaaaaaaaaaaucauguuuuuuuuuucuuuuuacuuauauuuacucagaaacugggugguggcgcacaccuuuaauccucccacuugggagccagaggcaggcagaucucugaguuugaggucagucuggucuauagguccagcuccaguacagccagggcuacacagagaaacccuaucuaaacaaacaaacaaauaaaaccaaagcaacuguauauguacucaguaggagcaaaaaagcuggggcugggaaggaacacugggagaaccaggggagguagacauguuugaauuagucuuccugggugggaggcaggagcuugagagggcuagagaauagaggccuggugcaguuccaaaccuacugugauauuuuuacagaaacuacacugaguuucuucauuauacauauaaucgugugucuuacgacucacuaggagaagggcuccagauuauaacagcacaguguaugccuguauugcgagggauacccaaagccucgaaauggacacauuguuuguaccugagugguuguguguaagucugugguuugaauguguuguuaugguuuaggaucugaauuguuaguuuaaaaagaacuccuaaaaaaaauuuuuuuaauuaaccugggaaaagguuauuucauguccuccuuuuuuuuuuuuuuuuuuaauugcuuuuccucaacaaauucauauaaaacugaguugugccauggccuguuuugguguuucggccuguaauuuuauguauugacugaggugacuauuuuguaacucaucuuuguguaaaucaggaauaaugcaagauaucuguggaagaggauaccaccugcuauaaagucuguaaguaauccugcgguguccccuguugcuuuuagaauacuggcauuuacuuaaaugacagccuacaaguccucuuucuuucccauauauaucacaggaaccguuguuaagugaagguuaaaguuccaaaccaucuguuucucuaauggaaugguucaugugcugaugguuucacaaggccugccaugcugaugugaacuggccaguucgguacagagggggcugaggggcugaggcauuucagcagacuacuugauuugcuguaaugauagcuauuuguaaacuggcauuguuuacacagauauucacugcauuaagaucacuguuuuaauuagaugucuuacuugggaugaagaugaaauaaaugaaguaaccugugaaaagugucuugccagguagaaggaaguaagauuuauuucacuugcuuccuuuuccauucuguuuguaagacgggagcugcacucaauaagaaugaaacagcucagcugauaagagugggagcccugcaaguaggcucuaauugacagggccuugauaaucagcuuucugcuaguuuucuuccauggagaagugcuagcgucuuaaauuuaaacagcagugccuacaauaauugaucccaagucuucauucugaaguauauuuuacuuucucaugcuuucauuuguaguugcaauaaaaacauuaauuauagaaauuguuaauauaacugcucacagcauuuuagaaucaggcagagccaaccucuggacauugcaaagcaguguuaucaucugcagaguucauagucuagaacuggguaugcaaguuaccuagaagaaaaggguucccaguuuauaccuguucuuagcccuguggccugcacgcuggauacaccugucagaaaaguaauuucaucuccuaaaaugaaugaauagaguauauuuuaaugauacagcuaacaaauuuugucauuucugauauuuuuaaagauaugaucauuauuaauuacagugaaugcuuucaaagacaacaauuuuuauuucaggcaaauucugaacuugggggaauuuggucaguuggacagcgaaucuggcaaagagauuucccugggaucuauacaaccaucaacgcccaccaguggucagagacugugcagccaaucauggaagcccuuagagguaguguuuccuugugguuaagucauguugcguucaggcuguccuuggagcguguacugauaaacuggacagcucugauuugggacucccuuugagacuugagcuagaucuaagcugauugugauucuucgucucaguacugggcauucuggggaauagaccaggagcagaggguguugcuguggauuccaggucgcaguuagcucauuggcaguaucuuuuauccucuucauuauuacuuuugugguaacagaaaguuugugacagagucucgcuguguaguccauacugcccuuuccuuuuuggguuacugguguguuucacguguggccuugugaaaguguucuuugcugcuaacaugaaaccaggcaauaaucgaaaggucgugguaucugcaggucaagacuuuuugucuguguauuugaaaguagcaacuagacuuuggacuuugucaaccuuggucuuugauaacuguuauguccccucuauacaucuuguaaaaggaaccgucaaggagccucgaggcucaguuguguaagguuagaggcuggcaugguguggcccugacacaugauagcucugccccugccgccuuccuuucucauguugccaugcuuugggucuuucugggucacucgaguucuuuuuauugcucaggggauccaauccaggcaagcagcauuguauccucuaggaguggacucacugacauuucugagccacccagcaugggagcuaggaaacagauucugguccuguaagagcagaaugcauacacacucuuugugggcccaccacacacaucauacaaugagcucuuacguuguucuuccugucaccucguuucuguagugaacacuugccuuuaguggguauuccuuaaguuagugggcugguccuucucagcaugguaaggacaugggugugccaggcagcagaggguaaggauugcugggagcugcaccaaucagcucuuagcagcaguaccuggaccagcauucaacaguguacacaacaaaacagagacagcugcugugaguaaacaugagcaggauuucaggguaggugggguuggaagggggaguauggaaugaggccaugugaauguccuggagcagccugagagcuagucuaggaaacaucacuagggaagucaccagaaguaggauugucuaggaaacaucacugggggagucaccagaagguaggauugacagauuggcuucagccugguaacuauguggugaacacgcaagcugccuucuccagguuggacuacaagcucauuggcaggauuuggguaggagcuccuaacucauuuagcaaguguucuuauguguauuuuauucuuucuaguaccaccuugcaccuaugaaauuaagagcugcuuccagcuugcuggagcuuggucucuggagccaggcucuugaauuuucauucuggugcauccaccugcuggccuucauuugcuuguuaaaagacaaaauugaagggucauguguaaacgcuggccuugccugccucacacacuguucuguucuaugcauaaagauuuucuugagacugaaaugguuccaauuccuaaaugguacaugcaucuuuuucucuguaaaaugccacccugggaauggcagucuuagaacagguugaaauuguucagaguuugaaguuuugcuucucaguguaugauaaacuugcuaguuaagaacaaccacagccuugacucuugaaggucccacagcguccccaaacagcaccacgagcuggggaccaagaguuaagacacacaccuguuggggcagaguguauucaaacgauagcaacuugaguucuauguggccagucaguucuacuaggaaaucagacaucugggcugaagagccuggugugggagagcuguuacagaaagccagaaagggcuggcaaagcacugaggaguacuugcuccagcagccacuccucacacagagccugagggaugggauuggcgccuggagaacaggacugauuacagggcuguggagggauggcagcuagagcaaguuggggagccaggguguggcugcugauugucacuagaaugcagacugucugucagcauccacugucagccugcuucugccuguuagaccucuccugccucucugcaaccugcugcucuucuccuccauucacauuuggguccugucuguucucuacuccaaaaauuugaccaaaauauuugaguaagacagugauuuuagauggugugagguuuggugcaugaucugugcugccugcguguuccugccacugcugccuugcuuuuccacugaaugccuaccugucauagggaagucccugcaccucugagacauucuaaaggucagcuggagguugguaaacucaagcaagggacagugguggcaucaggcucagugggaaaugagggaaugaaacauagugucagcguguuguucaugugugugacugcacauaccauggugugcaugcaggggucggaggguucucuccuuccgucuuuacaugggcacuggggacaaacucaggccuccaggcuugguugguagcaggcaccuuuacagagccauuguaucugcaguguuugagaccugugagaaagccuauggcugagggcaugccccauuugguuucagcagugcugucaguaagcccauguucacagggauacuucaagggccgugcuucagacaaugaaucaguggggcccagagcucaagaguggaauguguucagcccucaacuguggacuauaaaaucugaauauuucuuaauccgguuggcagccuucuggaggagcccuuguauuaccaaaagggcaccgaccaggaagacuggcuguguuggauggggcaguugucucauucaggaaguuucuuaauguggguguaugagcacggggaaaugcagaaggcuguuugcagggagcacucuugugcugggggcuggcagcaccuucucuugagagucagaccuucaggcuugguguuuaguaugcacacuuggaaguuaggagcaggugcuaggguaaggugugugcaccugccccgagggaguccuuuauuggagacccuccggagaggacaguggcugugucccuuuuuauuucccuucuucuaguguuugcaagggaaauaaagcaaaggaaauuuaaaaggcucauaccuuaaauucaugaacguuugcuuuccugugacuggagucuuguagguguugguuucuaugucuguagcuuuugucccuacacaaucugaugugagaaauaugugcugucaucggggucccucauaccuucugggcaugcagggucugcuugccuggaaacaaaaccuggaugacugagcuguguuuaagaguccuguucacuuccuuccuguugccaauccuccccuuucacaauagaugcaacaaggagacgcgccuuugcccuggucucucaagcuuauaccuccaucaucgcagaugauuuugcagcguuuguuggacuuccuguggaagaggcugugaaagguacuuggagcucgcugguugcuauaggggaacagaaauccuauaagccauagguucacucuggcucuggaacucuagaacaagaaugguuuugcacuuuaggugguggguuuguuuaggaagugauaaaaagcacaucucacaucgaaccucuauguagcaccuguaaucacgcccaggagcaugccuguagcagcuguguggaaucugcacagcuacuuaagaaagcauuucucaacuguccaaguuguccagguuaccccucaaaacuuuacaaagacccaugugcugagacucuuaacccagugguagcacacugcaugugcuugguugcauuguuuuauggugauugacacuuuugguucuccaaccccacgaguguuccacggggacagcgggugcuggagguuuauggguggcaguguucuauuuugugggcagcugguuuggggauggggcauuaaacccaggggcucaugcaugcaccugcugucauuauuacuaauagaaugcugugagggccaucauagaacuuucucgugucugucuggaauuagacuacucagguacuacuacagaagaccaaguaugucagggacuauaucggccccagagaggcuuuugguauauuucagaauaccuaaacuaaguucucuguaguaacccucuaguaacugcacagcaccugaccugagcgugcugagagaggcagggcugggucaugcagccggcgcuugugcccuucucccaucacugugaacucugcacuuucaggcguguuggaacaaggauggcaggccgacuccaccacaagaaugguucuucccaggaagccagguaggugggaccucagacacaugacauggaagcaguggacaguugacaagagagcagagugacauugaaggucaccuacgugaaaccccugugacugacuagaucagucacuuagcucuccuuucaggucaguccccugcccugccccuucagcucacccucaggagaccagccauauucauuccugugugugcuccuucauccuauguacaggaguguccuuucugcagucuucagagccagguguucugcccuucucaccauccuccugcaucaacccuacuucccuuccccugcucugcgcaucugcuguuuagacagaugucagugcucagccccacaguuguagguuauaaggaagacugaacagcuaaaguguuuaaagaggaacacauucauaucuccauucgagaaccaaguguuuguugugcgggugaggcguuacggccuugacauggcuucucuugcuuguaugaaacugucuuuuucuucuuuuguuuagccucaggaacccuggaugucuccuugaacagguuuauccccuuaucagguacauguuuucacguggacauuuuaaguguugcauuguuugcugaucuguccuguaauguguagugauacgcauggcuacaagaagggaacuguaggcuccccugcagcuuagcuggagugguggcuccugauguccagccacagagccugccuauccuccuuugagagucucuggguucuggacuguauucugagggccuccucagccugguguguccaauccagcauuagugcaauguucugguuggaccaggcacaugagaugcacuuuagaacgguucguuacucaagucccccaaguaggggcuguccagacagagcuggggucugaagagaugaugcacaccagacauguuugagucuuuacauagccugcugcagcaucagcagcuaucccgaccaugucuaucugacacaaccaggcugcuaaaauggagacuucaugccugcuguugagaacuguccaggccucuggcaggugugauuuuuguguaaaaucgggugcacuaagaaaguuaaagaccuccacaggcugguggccaggggaugcucuucuaaagcgucuaucccucuuugucaugcagagccugccccaguuccgccaauccccaaugagcagcagcucgcccggcucaccgauuauguggcuuuccuggaaaacugauugaccacucugaguucaagauccaccuucagucccugucacuggcaaacagacauggaguuuuauucugaguucagaacagggugagcaccucuguguccuuugggugugauaaaaugcacauagaagaugaagcgcauuguacaguuuucuccucaggcacuuuugaauguccuuggagcaguuuucauuuguauugaucacuuugguuagagccaucaguauuacacaucgaguuucugucaaggacuggacuccgaacacaagcuguccugcuucaaguagcagagggugcuguagcauacaccacgcuccugugugccgcuggccucuagcugaaaugaugugcuugggauuugaggaggacugucccagguggugcccuccccacauugucacucacgcucuggagagugugcucuuccuccuaucccagaacaaggaagcagugauguagcaucagaaagcugcgugguggcggacccuggaggggagcuugucaaugcuccauuuguuuucccagugugugcaagcauccauugcgugagacagacagucugcagugagaacucaacuuagguguucucggggaaacuccaaguucugaugccuccuuagagaagaagggagggagcagagugcagugugugcugugcugaaggagcuccugaccugagagauggacugcagcccuccugccugcugcgcauccagauccugaggagaaaugccgaaugcaucuauuuuuguucuuguauggcagcccuugaagauuugaggugguuaauguaucuucagguuaaaacggcccuaguucauuuauucugcauuuguucaauaaauauuuaauugaauucguaaacuuucaucuaaagcuggcucuagaaauuucauaucuuggucuuaacugugggcacauuauaaguuuguccuuuucucaaaaaauacuuaaaguuuaaaaacuuuucuccuuuuuauuuuuugggaauuuuauacacgcuuauaaccuguuuagaucaaauucacucuccuuuuccucugacccccuccccuagaauuuaauuaaaaagaaacugucuuaccucugacuuuguaguggguuaccua

SEQ ID NO: 290 - RNA, 77116 nt, Mus musculus
cucauggcacauucaauauacuuuauuuaaaaguuucuuuguauaaauuuccuaaaaauuuuaaacauugaauuucaccuccaagcuccaagacaacaacauugaaaaacaacccgccuuagaggaccaccaaagagauucucgauuaugacuuucuuugaauuuucuaauggaggcauuugucccagcaaugcacacaggaaagaggucugauuucuucuaauuagaucauuugucagaggauuuagaagaauauugaucgaagucuaauccagaaaacugggaccaugagaagguuagacucuuguuucuccaucuaagccgugcaacuacagaggaaugaaccaagcagaaauguacagaguagcugugacguccaggcuauguucuaggcacaggguuugccuggcacaggcguagcguggaacuccagagggaaauugaauuuauaggaauguucacauaaacaccagcaguggcuagcuauaacccaaggguccaaguauacgguagaacugccuggagacggagagcaggguccauagacacauuuagcaccauauugacaggucacgugcagaggguuuccucccgagguugagugucaaucaaagcaugaaaaggcaccgugcugaggcaucuacccagggcuucuauagaaacgaguuagaaauggcugccuccuccuucucccagagguacguguugccugaaggccaugcuuaggcucuugucaaacuguuaacucuggguauggagagcauugaguguggagagaaggagagaagaguggagggagaagacagaggaagaagaaaagaagagaggucaguaaacauaaaauauacuauauuuaucauagcaugaucccacagccuccagucuguacccuuuccucacugguuccugugguccuuguggcuucagguuugggccguguggaaucugaacucugagccauuacuaauugaauugcucacuaugauagagagacuuggauagccuuggugucagcauuacuguuuauaggaagcaaagcuauuuuaaaaugaauauauauaaguguuuaucauuggucuucuguuguugaucauuauucuauucaacaaucauguguacugugacacuucuaaagugacaaggaugugcuaauguuccugaugugcuugguuggcucuggguuucccaaccaccaaagauacacauaugcuuucaagaaacaaaucagucauuccaaucacuaacuuccuguggcuuuuuuuuuuucauguguguguaaaauuaaaaauuuuaucuuuuuaaugguucacugguccaucuuaucugaggauuugauuuaacuguuuucagguuuuccauaaccauuguaauucaggcauuucucagcagugaggccauuaacccugaucucuccucuuuaugcauaauagaaaaauaaaacccaagagagggaggggccacuuaccaggacuacacaucuuuucacauucuuccugggaguggaaucuguucucguugccuccacaaccuccauaccagaaucucuugcaacuuuugcucucuaggucauagugccauaguaacuugaaguccacacaagucccagcaucucuggacagcuuacauauaucuacaggagcaagaggagaaaggagcaucaguagguuugugccaacgccucagccuccagacuccauauuggagucugugguuggaucucaaugcuacuguagagaagaauuuccuggugggaagguuuuaaccuacccgagccucuguuucuucauuauuaaacugacauagcagucagucacagguuugcaaagaauaaacaaaaaguacagcaagaaucucaacuauuagcugucacugaauaacaaaaauaaaaugacuaacuucuccccauuucaauuuugaggucaucugcucuccaguucuuucugucuacacuguccagaccauggacuuucauacuccuugguaaauagcauuaaauucuguuagacuauacauuucaagaagauaaguagauugaaaauguauguaaauuguaauugaguauucuuuuuugaaaaaaaguaaauaaaaauaaaaguaaauauauacacuuuauuguuuaugcuuguguucuaugucaguuccccuagagcuagagucagaggcaguugugagcagccuaacaugggugcuagcacugaccucugaccccugcaagaucagcaaccacucuuaaccaccaggccuucucgccaggccuucaacagauguucaucguguuaagugugugugcagauacaguauagccgacuacuuuucuucccucucacauaaaacuaagauggagaagaagcuccucaggccgcagaaaugccccagggcaagacuuugugggggccagaagcuugguuugucuccaguuaaggaaguucaggguuugaaugcacacgccugcuggagcccaguugcaaaauaaggcuggguccccuagaugccuacagagguaaauugacaguuugagaacagcaagacuucuguuuacagaacuuucuggcaaacgcuggaguuugcugggaaagacgugugcauguaaaauguuuuaaucuagaagucugaaagucuaagccuucuuucaacaaaggcucaggaucagauaaucugcacguuugugggaguggcuaccaaccugacucaaggcucucccucacaaagcgcccuccuugcuuuccucgaguaagacaauacugaaggacuuguucagucguugcuaaguggcuuuaauagacaguaaccuuacuacuuaaaaguggcugcauuguaauauuugagagcuaagggaagcaaaggguaaaguggagauuuuaaggaagguuugcuuugcuugguuuucaaaauacaaauucuaaccauuucaaacguaaugcugcaaagucuagagccuugaaaggcaagguguggaugcuguuggaggucuaccagcagaaucaaccuucaccucgaggcagggucuucuggaagcacaguucucuagcaaaaggacacgcuugagcugggagacauggagucagacuccucugcccuugucgggcuuugucaagaagacacagacauucaccugcauccucagacuaccucaccaccaucagugggaaggagacagauuuuagauucacccgcaaacaaaugcucugcggccuugacaggaacguggguccccguuacaaacaaaacccaaaucuccccucuuugucagacaguguuacaugucuguggagaaaauccuucccugauucuggaagcagcaacuccacauuuaaaaacagaacagccugacccagauuaguguuuaaagauuauguuguuuacgcuaacuaaacacuguuuauacagucucagccuucagcggcacacauaaagaaaccaacuuaucccugaaucuugcugucuaggaguuccuccaagucucucaaugaaacaagaguuugcuggaaauuuuacauuuuccauacucagagacgaaagcuaggaagagggaaucagauuaaacacacagcuuucugugucuuugaagugaauguauucugggucuucuuuggcugguguuugguuuuggggguuuuuuuccccuaauuuuacuuguuauugugcaugggaacaugacaggagaggggugggccguggcaugaguuuggcagucaaaggcaaauguugugaaguugauucucucuuuccgcauuuacaggggcucugggguucaaacuuggguucucaagcuuacacccuuggugcuuuacccacugagcaaucucccugacccugugacaguaucuugaaggaaaauccaagaaaaccccagccacagagauguggcuuucuuuugaggucagcauucauguuggggcauccuuaccaugguggcuuaagaauagaccagaauagacugugagcugcaggguagaaccaggcaggagacaaaagucugucuguagucuuugguguggacagcagaaacugaugagcaguggcgucuccucccccgccuccucuaccuccuccccuuccucccuccucccucuucuuccuccuuccucuucuccuccuuccucuucccccuccuccucucccuccucccccucccccaaccaacucucacuucacccaccuacuucacuuuuccaguuugcauuuacaccauagcauuaaauuucuucaaggcuuuuuauagaaucucucagcaguuguaguuaauuaccaccaccuguauggagccccaccucccucagucccaaaaauuucuauuggaaaaacucccuauucuucugcuagccuuucacaggaaaggcuagagacauuggacaccaugcagucgcuugcuguuaaaugacaaugguaguagcucuuccgucuaguacaguuacaaaggcaguuacaaaggcugcuuaugaaugaugacucagaaagaaagcacguauugagaggcauccuguuccuccugacuggccagaaggcaucagacaaucuccaugcuaagcaggggcuugcacucugaggacuaugaaacaguaccauaacuaaagucucacaggauuuugaguucucaugucaguuaauggcgccuuuggugccuaagucaaacaaauugaucacuguguagucacuuccucaaagcuaguuagccaagccuccauucugcuaaaugaaaguguuaugugaaugugaauggcucccauuggcucaaauauuugaacauguguuuggucccuggucuggcuaguuuugggacaacuugacacaagcugaagucaucugagaggagggaacugcaaguaagaaaaugccgcuauaagauuggguuguaggcaggccuguagggcauuuucuuaauuagugauugaugguggagggcaaucccauuauagguggugccaucccugggcuggugguucuggguucuauaagaaagcaggcugagcaagccaugcauagggagcaagccauuaagcaguacuucucccuggucucugcaucagcucuugacuccagguuccugcccuguuugaguuccugucccgacuuccuuuggugaugaacagugauauggaagcgugagcccaauaaagccuuuccucuccaaguugcuuuggucaugguguuucaucacagcaacaguaacccagccuaagacaguccccgguugcucaggagagauuaggagguauggucuugcuggagaaggugugucacggguaagcuuucaagcuuuaaaagccuuccaucagccccaaugaguucuaagccccuuguuuguggaucaugauaggaucucucugcuacuccagcugccugcagccuccuaccucuguuccaucaucacagacccuuauuccucuggaacugugacccccaaaauaaacucuuucuucuauaaguugccuuggucaugaccaagugaccacaugacaagaacaugucauagcaauagaaaagcaacuuauauagagggagggaggguuacagguucucagacuuguaucccaaaaacagcaaucuuuccugucacuaacagacacacucugugcucagguauccaggaaaguggaauacaagaccaagccuagauguggcauuuugagaacugaaaauauaucugaauccacauguucugcaggauccagucugguuaccuugggucuccuaagcagugucuuauagaugacucgguaagugaaugaaacuuuauucuuugcagcacuacagaccacaagucaacccuagccaguuucaacauaacacagaggaagugacugguggagccgugcauaauagccaugggcucagaagcagcuccagccagcuucuucuaacacuauggugacaagcuugguuccucugcuuuugaaaccaagaccauguagagugagaugaaacccagcagcugaggaccccuuuggaacugaucccauggaagucaugugauuuagucucaggcagguggccucaauuucaaaggguuugcaagccauuaagcaguacuucucccuggucucagaaugcuuucugaaguccauuaggggaccuaguacugccacgacuuaccuguuuuagugagaaacaaugguucuguguucaccaugagguugaugguugaacuggaugcucggugugcugccugaagagguggaggcuggguuuucucuauaagaaaagaaaauacaaccaacuaguaguugacucggaaacuaaaaguggcaacagagauccuacuaucuuccucgccaggauccagguccccauuucccacaugccaccuagacaugauaggcuaaggcagagcaaaucuggucucccccuuaaagggucccaggaaccaagaaugagagcauauggcacagggaacccugucuccuaugcuguugcugugauuuugauuuucaggguguagccuaaguacccaagauugauggauuguacuuaauugugucugugcuucagaauggacucaaggcaucauuguuuuauauccuguuugguauaccauguagaaaucaagacccaagugcucucaaguugucaguacuuacucguauugaaacuuccuugguagauggcccugaccugagacugcagguaggagaccacuacgacaugguacagcuguccagccaguaggccuccgaugacacggucagugacagugagguuuugucucagaaccaaggacuggucgugggccgagguuacagugaggucauaaaaaaaggagcuggaaggcucgggccgcucccaguggagucuggcacuguucuccgugacuucagagaccuggacuucucgggacacucucgcugaaagaucagagugcagaguuuauaaaaguaaaacuccucacaacaggagcacaugugggagcuucagaagagaucugggagauguugguggacggcuggccugaagcucgccaagaaagggagcuaguguccccuucaccaguaacauccuccaccagccugccuggcauguaagagcauagugacucaaacgcaucuuuauucaucaacaagguacauaagugacuaccuucauuuuuucuaucaaaaaucccuugugaagaagauacuuugaaauguaagcuccagcaugcuaguaggaaguuacaugugcaguacaagaccagcucuaggauugcaaacaugaaaaaucaugguguuguaggcuaugacaagaacauacugucucagcucucugucugcucauagguaaagauaauuccuacuuuuucaugagcacauauauucuagauucaucuucauuuauagauuaugacauucuguagaaucuucuuacaucuucucagaaaagcuaacaauuauaccccccugagucucauuaacucauccccaucccccccccccuccacacacacacauaaaaucaggaaagugcuuuucuugggucagaaugaacaugcuggucagccucugagggagaacugaguuucugaggugucauuucucacuuuauugaaccaaccccugauacugccacaauacucagugugaggccccuuucugugaccacaucccuuuuggaaagaaggaauagauuagcacaggaccagcuuugaucuuucugagucacauuagaaggggagcaaguuuaguuccagcaaaaaaggaaguauggaaggaaggaaggaaggaaggaaggaaggaaggaaggaaggaaggaaggaagaaagaaaggaaggaaggcaggcaggcaggcaaagaaaaaagaaaagaagagagggagggagggaaggagggagggaggaaauaagggaaggagggagggagggagagagaaaaagacuccacucugcugccuaaccagaacaaaauggcaagcuucuccuuucucucucacucggagucaggagcacucaacgcauagcccacauucuacaaugcaaccaaggauaccuguggguauggcccaacauaaaaucauaagcuuacuuaaaauauuucaaaacauuucuuguauggcucuauuacaggguucuugagguugaacuuuauagaugagagcaucauaggaccucgucagcugcccauggauggugaggccaugggacccagagaagagccuacuaugcugccaugugauuucuaaacaccuaucuuuauacccacagauaagcauagcuuucaccccucaucaaagaugcuucuuuuugcagcagaaacaauucaucacagugagaaaauugggagaacaacugaccauggaguguccugcucuaguugauaacaucuaaaacacagccucuguuccuaaggcucagggaauaccauggaagauagggacagaaauauugaagagccagagaaccaggauggggcucuacagcagagaagcuacagccagggaagcagggcugaacguacaggaagcaucagucuuccucaggaccccagcauccuugagagguuguacaagggaaaacugcuucacgaugcagagaaaagcaauauguggacaacccuaugucuggcuagcaucuucuaaggucuauuauguaacuaugcccaccuugggucaucagccuacccuguagaccagcuuccagggccauguccuuggaguauuaaaugcaggcauaaaagauggugucucuaagcaggcuuucuuacccaagggcuuaguaguggcuggcuugguggcagcugguuuggccuguugccugggggccucuggcuugguagcaacuggccuuauggcagcagcaaggggucucguugcugcaggcuucgcugcagcaggcuucgcugcuaaugcaggucuggcuguggcuguggcuguguucguggccacagguuuggcugccacaggcuuguuggcagaggcugguuuucacacgcggcugauuuaguaaggacuggcugagcaggcauugguugagcagcggcuggcugagcagggacugcuggcuuagcagggacuggcuuagcagcagcuggcugaggaggggcuggcugagcagggacugcuggcuuagcagggacuggcuuagcagcagcuggcugaggaggggcuggcugagcagggacugcuggcuuagcagggacuggcuuagcagcagcuggcugaggaggggcuggcuuagcgggggcuggucuuacagaagcugucugggcaggggcuggcugaacauggacuggcugaggaggcaccaacuuagcagaagcuggcuuagcaggggcuggccuugcuugggcugguuuugcggggucuggcuuagcaagaacuggcugagcaggggcuggccucgcuggggcuggcuuagcagguggcagguuuacaauugcuguugguuuggucguugucacuggcuucauuguggucacaacuuuggauguaagacuugaauuagcaguauguggaggguuucuguuaaaaacaaaucaaacauuaccuauagccauacuuuugcaugcuauagagucauaacccuaugaucuacagggaacuugcuguuuaacagcaugaaggugcugguuucuauaaaccuucuauaauguuacauauacuauagcucuuacuuucagagucugccucuaagaaaauauugcacagaauauuaaaauagaauuauuugaaauaauuacauuaauuauucauaaaucuguuaccccauuuucaauggaaaagaaaaggugcuaaguaaaagggaaaagaauaaauauuuaacaauguuuuaauuuaaacaaucaacugaguuguaugcaacaaaaucaguauuauuugcuugcacuaucaaguaucuacuuauuaggugagguggguggcucacacuuguaauccuaacacauuggaaagaugaggcaggagaauugccacgaguuugagaccagccugggcuacugaguaaggucuaggccaacaugaacuagucaguaagaucucaaaaagacaaaaagaaaggauagagacaggggaaaggauguauaauguaauauaguccccaacucuguucaugcuugccacacuucaaucuaggcucugggcauauuugacccauaaaaugugguuuaaaaugacaaugugcuaggccuggcuuaugucucaagagaacuuauauuuaguccuuuucuaaugaaaacccuccugaucaacuugcaaacaagcccaggcuaugccacuggaagauaagaaaucauguagagcagagaugaaucuucccacuaagaccagguuagaccagccugucuguagcugagaaauuuaucaucaucaacauaaaggaggcugggagacagacagacagacagacagacagacagacagaccacccagcuaaacccagucagaaauuucuaacccacaggauugcaaauuauucuuguuuuaaguuacuaaauucuggguacuucauuauguaacaaagcuaaccaauacaaaagaauguuuaagaacucacacuauuuuagggaauucauauuucuauauuucaauaucucaauccaugaagcuagggauuggcuggagagccucuacagcuacucucgugcuaugauauuugguuugacaaucauaacuacuuacaucuguuugugaccaaacuucacgccauucuucacugguugguccccuuggaaccaaucacacuguuuccugagaucuggaggcagguaaaaugcauuuucaccuagagaggggaaaaaaaaaaucaaacuucaugugaaucauauggaaauuaaaaucaguuugauuaguuaguugcauaacuacuuggaugauucauuuaaagguaacauguccucaauguggaagagcagaccaggcuaggaugaaacuuuauguagauaguaggacaguuuccagacacucgcugaacaucgaauuacaauccaguuauguucaagguucuccgaaugcuuucugggauacacucuagcuuaauccuccuaaggcagaagcauggaucccuggguaaagcugaggcuccccuuuccuucacaucuucuccuaaaucuuuugcaggacagacuuucaugaugugaauaguguguuguucgugguccucagcuuucugcugagcgaugacuacucagcaugggcaugcugucuuacaaugacgacucagcauagacaugcugucuuagguuuuauagaucucccuuauuuguuuaauaugugaccugagcucauucgccaugaacuaugucaggucuaaacuaucuccagggaggauacagucucaagagaucacagguacagggacaaaagacccauaagcugauuaacagaugcucuaagccuacaguccaaagguggggacuacugaaaauuaguuccuuggguaacugcagagcagcugcagcagcuucccuucauaagggaagaagaaaugaagguaggaugaguucugcccagaggcaagcauggguuuggcagcaaauccuaaaucaaugcaaccccuucuaaaagcuucccucaagccaccugacaggauaggcuuccuuauggcacaaccagcauacuaggucaugcauagucauuguguguuugguccacuugcaaaccuagucguggacucuuuggaagaguaucagugccuuauggauagaaagcaucagacaaacgggcauaauaagugagcaaaggaagacaagggaugugucuguguguaccuuguugacucucuagcuccuaacucaaggcacagguuaggcacauguauaauuguguguguguguguguguguguguguguguguguguguguguuggaugaaugaacaagucacaucagcacgaagauguauuuuucuaugacuguucacccagacuugugaccugagaguaugagccagaauaaagccauaggcagaacacacuauguguggcacaggacuuacugcugacaaaggaugggagcagccucccaaagcgcaucagaggcuccucguugagcucaguugauuuguccacaaauuugaagaagacaucauugggcucacuggcaaagcuguagaccuccuugauauucaccuuccugccaaugcccagaaccacaaagaaguaacccuugcacuuggccuggaggauggcucucugggccuccuccagcugcugccucugcaugucaccagucaacaucagcaccauaauuuugaggucccguggguuuggagcacuuucaaagauguucucuauaguguauucaauggcauugcccaggcccaugguucccugaaguugggucauccuccggcuaaggaaauccaacagcuuuuccuuggcaccauagucugucagugagaauuccaccuucacaggcggcacacuggcauuguccacagacucguagguugacugcugcacaacagccacccuggcaaaguguugggaagccuucgggucugggcucagguccagcugucugaucacauagccuauguauuucuucaucucauugaacuggaacagugugguagccucugagcuguccaagaugaaagccaggucuauguccacaucacugccugcugcccuccggucccugaaggaaggccuccagcugccgaagccacaggaugggucgauauugcaaaugucuagaaaaaaaaaucacaguggucaauuaccauguggucccagcagugucccaauuuucugggacucaagugacuacaaucaucacaggagauagaaacuucacugcggaaaaggaugcacgcccaaaauccaugcacuugaaagggcagaggcaggagaaucacuagcuugaaacaaccuaggauauauacuuagacuaugccucucugccuuaauugugcccagauuucaguuuuuguucccucguuucacuaaaugaaacuugucaaugacuuaaagucuucauagugcucugugagacuaaaacauuccugccacuugcuauaccuuaaauaaaaguacuuuagggcaaacaugugggcucuagauuccaagaucagaacucccuugaguggucuuuacauuagucaaugcaaugagccuugagucuuaacuuaacauuaucacucuucauucaaaagucccucuguagugacaacuuugguggcuaugguuagacagauccccaugcccagauagaugagcagcuuacccaagcaaacauggcagguaaggacauucuucaggaagucugugagaucccuccuugcaggcagaaccagggcaugucccacugcuguguuauugaucugguuuagacaaagggagaugucaggaggcauacacacagaaggagccguuaugaaaacagaguaacagcagaacaaaauaaaaugagauaaacuugcccauggcacagcgucuuacuguuuggacuccgguugcucagaugauuaauuagacacuaaacaaaguaucugguaugccucugaugaacagugggggcuaaaauauuaugguggugguuuuaacaguggcagcaaacacugaucugcccuuucccuauccucuccagguuagacagugacaaggcaaccaagaauaucccucuuuggagaugaaaacaucucucccaucacaguggugggcguggcauccauguaacaaguaacugauaugaaugagcaaggggauuccuuucugaucuguggucacaugugcuucugggucccucagcccacacaaaauaaaaugagcaaaacuguucccucacaaggacucauggccaggagcccaaguuuaauacugaacuccaaacccagugucuggccccaaaccaggcugcaguuuggcagaauaaacaaugagggacaguggcacugagcaagccauagcuugcugacacagaaaguggugcucccaacuggcaaggcacagagcccaaaucacacagccucaccucacaagagagaaacccaagacacagaaagggguuacauaccacgguguaaggcagguggcaauagggacuaagaacaccuaauucuggccaggggcuccuguccuuuguaucuauuguccauguuucuugacuagugucacuaguaguggcccugaauauaguucuggucaguuacaauuaaagauauacaagggagaaggggauguguccucuguauagacuggcugggagagcuagcuaaggaaaggucugcacagugagggggugggggugggggagugggggggguaggaaggagccugaggccacucauacuuugagguccucacugagagccuauagguucuacuggcuagcucaggagagucuccuccagaacagagcggggcgggcuauacccaggacaugaaccucaggaucuaguggcccagcugcuucuccauauuugagacccucacuaacuccaagaucuucuaacccauaagguaaaaauaaguaaaagcuuuagcaacauguucuaggaagucagaacagggucauauaaaacucaaacugagccacuugguaaggagccagaacuuacccucuacugagagacagaauccacccacaccaacagccccuacuuggcuagcaagaacacagagccuugcuaccuauccagcgcuaccaccauguauggcaggaucuggagggaguaaguuacaguccuccagagguuggugcugaugcugaagccacaggcugcccuagacaccucacaagagaucucaacugucccagcccucucagaccuuucagaagccaauggacacaaacucuauacagagaacauggcauuccuuagagcuuucucaaagaugagagggagggggagccaaagcauagagcacagaccugcaaagcguugaugagcugucgguccuccuggcuuguaaggaacaagggugugauccccgcaucggaaagcuugaguacggccucucggagcuggggggaugcccuggugggcuuguugcugaagaaaacagccacuuuccucaucaggaagccacuccucacacguuugaauguauuccuggccacgaaugacauugcggucuccaggcucugcugcuuagaggucaaggccacuuggagguucugaauacugucuaagagggcagacuucuucuuggagucagcaaaccggaucucuguagucaccucauuguuauaggugaccacagccacgcgggcaccccgcggacaguugcucucugcaauggucagaucgcccacaaugcccagaagcaccucucgcauccggcugaagguguccugagucacccccucagagguauccagggcaaaggcgaguucuguugggaauacagggcacuccaggggcccugugggaaaugaagguucagagauaagcucuacucaccgcagaggaucugucucuccucagaagaaugugaagucaccaauacucaccguagcagcaagcuauaaaggaaacaaagagaagagagggugagagccaggucugcagggugagcaugguuaaaggugaaggaaggcaucaugucccccaggcaacagaagagggagcacuuacggcauuugucucugaugcucuggaugagggcgcauugcuggggaggaaaucagaguguuaagaagagcagaugacaggcguguaaaacaacaguucgcucuggacacacacuacuuacaucaacggagucgccucgguugcccuugugacccuguaaaaccaagcaacaaaagucucagagaggaagcaaauggauguggugugguuuaagaagggaaagaagacgggagaagugaggguuggcauacucaaaucacagcauguguggaacucaacggccuguacaaugaguguguguucagaauuauaauaaggggcuggagagaugacucagugguuaagagcacugacugcucuuccagagguccugaguucaauucccagcaaccacauggugguucacaaccggcuguaaugggaucugauguccucuucugguguguuugaagauagcuacaguauacucguauacauaacauaaauaaguaaaucuuuaaaaaaaaaacaaacaaaagaauuauaauaaggagaaaaauaaagaaaccaaaaggccacucuuuagccacaggaacagagugggaaguaauagaaaagcagcagacacugcauagccuugagcucccacgcgcccucugucuacauuggauuccaccacuggggcagaagaaacccuaggaggugagcucgcuuugaauaagcacuacuccucccaccugguagcuuguuguucacccauggcucuaaccacaacccuuucaacuacucugggcaaucaaaacagcuuccccugcggacacagcuuccuuuccgaugcucacucugcauagccugccccugaggaagcauagguaagagauuaucacauuguccccuccaugucaaaagcaccucauccccuaggcacuaggcacagacucaugaccgacuucugugguuuguccccauguuuugucaaccugauggucaagcuuuggagauacuuggcuggguuucccugaagcaguuucucucggcuaguaaccugaaaugacuggcucagcacaccuuauuaacugcaucaccccucagccugccuccaucacacgcaaaagcucagccuucuacccuugccuuugagcaacccagucccucaaagugguuggcccacuccugguuugucuugucuguucuuccucgaaccucaugcauuucaguagaggggcaaaccaaauauggaaacugauguaucaguuuccauguaguauccgugacaaagauuccuccugggcucuggggaacacaugacugauggauuuuaaacacugagucaguggcuuccuugggaauuuuauaaacaaagaaagugcuccccaaacccagauuuggucucguugugcagcuucuacauggugcaaacaacuguacugcagcuugcucucucugaacaaaccuacagugagaaauuauaaaggcaaauauuauaauauucccuggaucacagaauagcauauaaaccauaguuauagcucaaugggagacuguuugccugguaggaauggggccuuaggucaauuccuauuaccacaaaaaugcuacuuauuuucuuguuuaugguucuaggaagaaaauucaggaucuuguccaugacagguacaugcucugccacugagcuagcuaccugguccccauaaaacauuuuccaaagcuuauuauuucaaaacucgucugcuuuuuacccauugcagugucagaagguaauaaguuuaguaaacagauaacacauauguaggggauuuuuuuuuuuuugaggaaagaagaugguugggcauuuucagagauuagauguaaggagccagucaggcuuucucccaccuagugacucauuagcaauuggauggauacuuacagaugguccuggguaaccagggucucccuuuuguccaguugccccuggagguccugaauuucccuagaggagguaaaagauggaacauucuuagcuccuguagggagaauggugauagaaagaaucuauuccaaacuacccaucaccaaugagaagucuccaaaauucagguguaaggguaaggaccccaaagagcuucuuugagucccuauucuguacagucuggcaggcuugcgaaagauacacgguugucccaaaccaccacuaaaaucccucugaguacccaagggaauaaguaacugccaaucaguuagauaaguguucauggccaucacucaccuauucaaaaugaucuagauggacuaucuuuacugaucaaauuuaccguauaauuauuguuauuaacuauauuucuggcugaaaacagcugugagaggcauuauuuauaucuggacuaugaauugagauucuguuuaauuaauguuggaggggaagugaaugaucauuaaugagagaaaucuagauucaaccacgguuaaaguaagagagaucuuaucagccaaggaaugaggagacugugguccaggcauggcuagagaugcuacaggcuuccuaagaaggacucauuaagcccuacuuccucacaucugaauagucaugacaccauccagcccaagaccuaagccuccccaagcaccaugaugagauaaucugugggcuaaugacuuuuaagacaugccauagaaagagcuaucaagcccuccccacaagaggucauggcugaaggaggacauauacagaacacaacucucauaggcugugaggacauugguuugaaacuuggaauucccuucugccaccggucugucacugaucaggcugagaaggaagaggauguuuuuuaaaagucucaggaucccaucacacggccacgagccugcucauucccacucacacacagcaaggcgugggcgaacuuacccuucgaccucugaugccuuuggguccuggugguccaucugccccuggcucaccaggggugcccugggaagagagccaagaagugacacaucaaggucuucaacagaagguccugauaggggugggugucccuggguaggaccccaacagagugucuggaccauaguuucuaaauaguuaacagguucacaucuacaaauggcugcaguguuuuggugccauuuacagacagccugguuuuaugucaucacuggcaugacugccaaauggguuguggcauuuacaggucucagauucuuccucuguccacauaacuaacaagugccggggacagcaagcacugccaacucuguccacacaggagggagcaucuuagaaugcucagacuuucccagcauggcucugucaugaguggcagaccuaagacuaaagcugagguacucugacuucagcucaugggacagcucaggcuuauccagaagccaugcagacaccccauuacuccaaccacucaccuuuggucccggauacccagggaagccucuuucucccuguaaaagacaacaaacaccucaguaucaggucccaacuuaaagccaucaauucuaauacaagaugucagaagccauccuuggugacucucaacaaugagggcgucucuagaagcuucaacagauacauacuuuuuugccucugcguccuucacugccaaccccaucucucccgucaucucccuaagaggaacagagaggguguuacagcaagccauugcaucagacacuucacacccaccaugucacauucuccccucaacagagggggagugcaugaguguuuggggaccaaagggcaagagaaagaagccuccaucucugugcccucuuccacagguguaaacaaagucguguuuguagagauacucagaucuaugugaggauuaucugaacuuaaccucuuagauaugcugagucuuuugugcgcaggucuuacucuccgguccccaaucccuucuuguccuagacugacacagccuuccuccaaaccccuggacucuguauccucagcucugugcccaccauugugugaggcauucacagugaacacuguuaacugucccacaaugagaggagcguguugggaagacauaucaguauuuuaaagcuugagauuauaaugaucuggugucugguucuuuuauggaaucuucaggaagagcgacucauuuuaggaaaacucccaauagccuauagauuuccuuuucacucacaaaguugccagggaaauaaaacucauuuugaaaugagaagcuuucaccacggucagccauauccucaaucauccaaacagagcugcaaaccuuuccaagucuaaggugcuuucugcgucguucaucccagucagugagccccaugggucaccgaguggccuuaccgucucuccucgggguccacgguucccgaugcuucccuucggcccuggcucuccuggcucacccuacauggggagaacaaggaugccucgcugaguggaggccagcucauggggacccaagcuccgcacuugcuguacugaugucggggguagugauguccagggguaggugccucauaugucaucuuuuagguuuccgugaaaucaaauuuuaaucaugauaagccaagcacagcaagacaagugccacaugcugucucacacaugaagcggcaaaggcugacaucaugagagaguggauacucaugauugguagggacagagcauaacuguguaacagguuccagcgugcaguuuaggcaggaggaaugaucuagugggcacuguggaugacucaaguuuacaacaauuuauuacauauucagaagagggaguuucaagugcccccaaugcaaagaaauacccauuucuaugaccuuaccauuauauguauuaugaaauuaucacacacauugugcccuauaaaugggcacugcuauacacauauuuuuaaaaugcuaaaugcaggggcuggugaaauggcucaggaaguaaaagggauuuugcugccaagccugacaaccugaguucaagccccaaauuucacaugguggaacaagagaaccaaaucccaccaaacugucuaaugacuuauacauauccgguaugguauguauacaaccacacacauaauagauagacagacagauaggcaggcaggcaggcaggcaggcaggcagacagacagacagacagacagauuaaaaacuuagcaaaaauccaauaauaaaacaaaauacugaugugugugugaucuuaccauguggaccaggcuggccucaaacuuaaaguaauccuccugccccaaguucugaccaagugcugagauuacaggccugagccaccgcaaguggcucuguaucugcccuuucuguuuguuucauuuggggagggguguuuugggaccucuauauagucuuagcugauccuggaacucacuauguauagcagguuggucugaaauucacugagacacaccugccucugccuuccaagugcugggauuaaaggcauggaccaccacuaguuguaacaugcguaugugaacagugggggaaauugggguugugucugugaccauugaugcacagggcuuagguugaagguaaagaggcagaggagagggcaggcagcggggagguggcagcacuuaguucagcaaagccccacuguuccccagacaaaccuuccuccccagaggaccaguucugccacguucuccaggagccccagccguaccuccgccucccuguaagguaaggaaagggauguacaugaagcaacaacuguccagacuaaagacccugacuauccccugucacaggccacccacacgucccaagcacuuaauggugcccaacacugcccacuuaagcccacagagucacagagcgacuccugcagacucuacaccaucagccacccccucaccagccccaccagccaacacaguccaguugcuacacucagaugcuuacucgagguccgggaauuccuuguuccccaaucaggccugggggaccaaugggaccaggugggcccuggggaggaaaaggucaugucacgggugagugcaguugaucugagucucaguaaccagagugguaacaacccaaaugccaaguaaccagugagugaaaaaggcugcucuuuauccauguauggacuauuacucagccagugagaggaacaccacuaugucagcugccagaacauguccugaauucagggaacuauacuaugugaaagaagccaaacauaaaauccaccuaucaagugauaccauuuauaugaaauguccagaacaggcaaauucacaaagacagggagaccagugugggccagagguagggagcaucaggguugaggguuaccgggguggggaggggcaguaaagaggaggggcaguagggauuaguggcagcugggguggggcaauaggaauggagggcaauagggauggagggcacuagggguuaaaugugacagacguuagggcgacagguguggggucuauaagggugagggaagauguggaaauggcagagguggaggacaauuugaaguugaugggggccccaaagguagagagcaauagacagcgacuauacauugcuuccuuugggguuaauaaaacauuuuuaaauuauuacacaauacagugagugcucugagugcuguggaaucaucgcuagaggcagaaucugugucucgugaccaucaccuuaauuuaagacaaagccaccaaggaucuaggagauacuacaaggccugugucaugccaggauacugaccugugagccucugguacccugcucgccuucgaagccuggcuggccaggaccaccucuguugcccuuggaaacaagacaagcagguaaaccaaaccagcucucugcucuggacuggggaaaggggacccucacacaggucagcagccugucucucugagccugcacaaauugucacuugccuguuucacgggacagcuuugauaaacaaggauguuuuggacugugucucuggcacaggcaagauggccagacacauggacauuccuggcagagagcuccccagacaucugaggcuggucaaccuuuucccuucccuccccucacuccagaaaccacaugaaacaccuuuuaccguagaagaggcugaguuugagagaaugauagggaaaagggaggguuauauaagcuguuggccagggacacuaacuucaucccugggcugacugugucuaggagacuccuggaagucuagauaagagacaagagacaugaaaagccaguccagcggccuaccuuagcuccugcagggccccuucggccagagccacccuguggaagaaggcacaugucuugagggggagaugcggaugcugaauccugacacauguaugcacccacuguagugcaaacucuaugccagagacuagucccgacaccuaggaggcuggugcgcucaucccuccuccccacuccccagcaguuucuacuucuaugcugugccugugaguuacuccagugaacaguugggaaugacuucugaucugccaaggaaaauaauggcuucuggcugcagaauccuagccaguucccagagaagaaugagaaacaggaaugagaaccugcccguugcucuaacuuagcagaguugagaugcuucacugcggugaagggaguccugggcucucaacccuccccgccaaacacaacaagagcaaccccagcgcacacacgugaaccugaaaguugggcucaugucuuggcagcuucuuguggauguuccagaggugagccuuaguuugaaaaugugagccugccgcaggaggacccagggauuccccaccucaugaauguuccagaggagaguugggggagggaaucugugggcaugcuaaacugucucugcaaggucagagacuuggucaaccuaggagucacauucucuacccccagggggaucagcccagcaguuggccacucugcagccaccauggugcuggccuccuuccuggggucggugugaauacugagagcugcucaggguccugcacagagcagcaaccaagcccugccccucccuaaggaacaugcucuuccaucaggcuccugccucacugcucacuggcagccugcaggggccagaagaggccacugagaagacucuaacacccuggagcacaucuuggucuaugucuggcauagcagagaaggaagugacaaaaggccucucuguugguccucacccugaggcaaauuuacuguguuccaccuccugccacuuagugagccucuaaauugauuccaacaggaguuucugccucaccccaugguagcgaacaugaccguacccucagcuggacuuucagucauguccucagaccauuuugagagccauguuacaaaagcguguagaaaagcguguucuugucccuguguggcuuaaccauauuaaccuaccgccacaccccagacuuuuacacccgugcugaggaacaacucaagccuauuugcuaagcauuuggcugacugggcuagcuuuccagucuaauguucaaacuuuugaaggcaauaauuuaauuuuuguuuuuaaaaaguuagaagccacuugagcacaagggagucacuccucugggaagccucagaccucaggaacucucugugauggucagcuacugagcccagcaaugcugaggacccuguccugagcggaccagcccugccccccucaugcuuucugcucuguucauuucugagcagagacccacccuaggcacccacuaacuuccuggacuccccuaaggauuauaaccuccuggccucuucguccucuucuucgaugcuacuaggacccugcucuuugcuuacuugggcccugguagcuuucaagcagcuucauacaggaucacggacuucaccuuggcuuccacauuccuucagugaguauggaacaagcuuuucagugacacacacuccaaaauguauuggaaacacaaaagcuaagccacauugcuaaguucccuucugugaguggcacaaauacagaagcaauuauaugggcuccagaaaucuguuucuucauccuucuucuccaugucucccccaccagccagacagaauuaauguuuccauucugauguuuuagcuacuuagugggcaagaguugaccaaauacuugaaaacagcagagaccuuuuuuuuuucuuucuuuuuuuuuuuuuuaaguguucaauguucucuacagagggaaaggacaaaggacugaaggagagagaaaagacugagggaaggugagcgaugggugccagaggaagcuaagaaugaaaauguccuaucagcaacagaucugguauaaagacccacagcuugccucccuccaugggaagacaagcaugaccgccgugcucacuacccaugcucccugaacccuucggagcugugagccggcaaacaaucuaggacagcaacauuaagucaaaggcaaaagccuacuuauuuuauauugacacaaauggccuuguuuuuaguacuguccguacagcauaaaguagacagaugguuucaggaauggcuuuccccugccccaaccccugguagggagcuggaccauagcagagugccaggcacugugcaccaaucacuugccagugagcagaacccaacaucccaagguacuuacguccuucccagggucuccugggcugccagggaugccaucucugccugggagacccugaaguggggguaaaaaguuaacaugaaauucucaccugcagaggagcacauuaaaccccagaguguguuucuggagacacggcguggaagggucuauccccaggagagggucugucuacaggaggacagaacuccagacacuccugggaagcaucaggcuugguagggucacugucaccccuuuaagacuuuggcuucaccagagcucucuacacacagcugcagggcacaacagcugccugggagcagcccugaugcccagucccacaggggcugccuuuccaggcacacaggugccagucuugggggacauugcugcuggucucacagacucugcaguucaugggggcugcagcuggugaggcaggaaugaugugagagucaguuugccgcccuggcacauagggucucuggguauagaucacuguaccauggggccgaugucucccgucucuccuuuggguccucucugcuggcugucccguccugagucacccugaaaacaacaggauuuguccaaugagccccauauaaggaaagcugcagccauuagaauucuuaguaucagauugaagagaaggcuuucaaagacaguccuuccagacaucuccuauccagcuaauacccagagccuaaugguggccccaauggaguagcacaaauccuucccuccuggggacacucagccucacauuccauccucucccacagaggagggugaccugcagaacaggucaucucagcagugguccuuugcuuaaaggguuuacaaaugugugagccagaaaucugcauaggacacauccuaaggcaaacauguccagaaggcaucucaggaagacccuuaaagaugcaccuacugagugacuugaaaacgcuuguuguauuggaaacaaaucaucccaaugauccccaaauugaaacgacaggauaaaucuuguauuuuaucggcaauuucaaaauguaaacgauccauuuucucuuuccucauaagccuccucccguuaaauccaaaauaaagauaucuuccuuaccgggucaccucgaaucccgacaucuccucucucgccuuugucuccuuuggguccuuugucacccuaaaucaaucacacaguggaaguuuaaaacuagauauuucugguaacaaguauuuuauugaguauuugcaaucuauaacaugaugccaugaugcauacauacauacauacauacacauauacauacauauauauauacacuguauauauaugagugguugcuauggugaagaaaaugauuguaucuauugucccacuauguuauuucugugaucaauuaguugaugccuacuauuccaaccagaauuucuaauacaguaauguuugcuaacuauaaccuucaagcugcaccuuagaccucuacauuguucaucaaaaucacguuccuuauuuuguaagucucaucaaaacaccuguuaccauuuucccaguuggcaugaagcuugaaaagaucgcuuauuuucuaagauuuauuuucuuuacaaguauguauaugugucuauguauguguagaccuuagugcaguaucugcagaggccagaagggggcaucauaucucccagagugagaguuacaggcaguugugaaacauucagucugagagcuaggaacugaauuaggguccuccguaugaccaauauauguggguauuuuuuuuuuuuuuuugguuuuugguuuuugguuuuucugagccaucucucuaguucccaaaucaugucaaaauauuuccgauguguuuggcuaguccacaaauguuuccuggagagccucucggccccaggcauuaagaaauguguuuucaacugaacaaaaucagucgccacccuguagggcaugcuuuccaacaaggaaaugacauauagggugucacaguugagaggggacaucacucauacaucuaccaggaaaccaugggaagagugcuaacuggucgcuggaaaagguguuaugcuccccacccccuccgggacagggagaaaagagcacaccuacccuucuuccaggacuccccuuuucuccagaagaaccaggcagccccuugucucccuguaaagacaaugagaguggauuguacaacguggugacagcuccauggacugcuggugaccaggaccucgggaauagaugcaguugggaugugggagguaaaaacacccaccucuucaccauccagaccauccaagccgauuucucccaauucacccugaguagaaaaaggcagacagugaguggaacaaguuaucccagcaagggagaagaagaagccucaggggaguuuucauuaaaacaaacaaacauuuuaguaccuucucuccugggaauccucgagaacccuggaagguaagaggacagcagaaacaugagugauauagagccuguuccucgggacagaggccaagggaugccccuucaccugugucugaggauccccaguucugaggaucuauacauuaaacauacacucuggcuugccuccucucucacugccagcugguguguuauuaagugaauuugccuagaggugaacacuuggguggucuuucucccugggagggagaggcaacuccaaagacagaaggccaguuucauaacuugcagugggcuggcccuucccuucucagcccuguucuccgagucagcaaggagcggacccuggaaucccgcgcaguucuuuccccaacuccucccagggccuggccagaaccuugcacuucacgacugacuccuggcugcuaaauguuuccacaggaaacuaugucuccacccagacuccuuuccagugauagucugugcucuggacuccugaaccacccagugcagagcuaccuucgucgagagacccuggcuacugggcucuggggaucuucaucccccagagcaucaagcaucaagcaucccccagcuugcuacccucccuccccaaggcacuuggagaacucauauccucccagcaugcucugugcugacuccccuacacaugaauccauaccauaccuucacuccccucuggccuggacagcccuggaaaccuugugugccauucacaccagguggaccucgcucacccuguaaagaaaacacaggcauuuugcagguuggaauccacugucuggugucucuucucucucucucucucucucucucucucucucucucucucucucucaaagaauagcaugcagcacauagagggcuucacuguaaacaggcuacauguaccaacauccucaccacccccacccccacccccagcuccugucuaagcaagaauucacaacuucacagucuggagaguagacucugggaugguugcaguguccaggggguacuuuucuuuccuuugaccacugcgcuguauugucaugguuuccagcugucccauggcaacagagucagcacugacauccuuaucuggucuggacaccugaagaccuugcuuauucucccaggagccccuccaucccauagcccagagaugggccuuauccuauggucccagagccucgcagaauuagcagagucucgcuacauaauaguucagcagcucaccauccuccugccccagccucucaaaagcugggacuagcagugcauaaaccacugacuucugcucagacaugcagugggcacggggcacaccauaccucaccuuccuccacucugaaacagagcaagucuccccacacacuccacacacacauacuugucacauucaaagaaccucucuguccuuagugugggaaagaaaggaaaauaguuacauaaguuaagagaaaaaucuuucuccugaugagaacgcccuggccaccagacaggcuacaaacuccacuauccaguccccauaugggaagaacaggagguaguaaaaacuugaggggcagggaagcuuuuacucacagguccgccuucgucucccggguagccucgguagccaucuuccccggagauacccugaaauaaaacauguggguccccaugucauggcguuucgcauaaagcaucacagcagugccuugcucgacagugggcguugcccugagcugagcauggcacucacucacucacucacucucuauccagugaugaucuucccauugggauagcucaggcucuuucuuuucccagagagcuguggcucacuuuuaagguaaccacuaagggucccacugacccacaucgugaggcugccuagguaugcucggguuuucacauuguuuuguggaaugacagacccacauguuaaagagcaaaccaucccauccaguggaagagggaaacauagcaggucaucucuaucaccaguaagacacuagggauauuggucagcgagaaguaccuuggagcccagaauuggcaauauugccaggguccuucugacucucucauauccgucuagucacccagccaaauagugucagagcugcaugucuaaccuguggugugaagaguaccauugccauaccuuuggcccaaugcugccaaugggcccucugucuccccucucuccagagcacuugcauggaaccccacagcaagcuuucucagcaauauuguccugccaaggaaaaaguaaauaaauaucaaaaagagaaaacagggaaccaccaagggucugggauuaguccuaaucugccgcagugagcuaccucaugccacucccucaaaggccagguacagcugaggacucagcucuucccauagggugggaagucauugguggaagagaaaagaaaaaucaacuauggucauucuuauccuagacuaggcucauuuuccagacguuucuaauacagacauucagggcuuggauuuucaguauaaccucuauggugguuugaauaggcaugguccccauagaaucacauguuuaaaugcuuggcccaugaaaaauggcacuauuaggagguguggucuucuuggaguggguguggccuuguuggaggaagugugucucugugggggugggcuuugaggucuccuaugcucaggcucugcucaguaacagucuccuccuugcugccuguggaccaacguguaggacugucagcuccuucuccagcaccaugccugccugccugcacacugccauuuucccugccuugcugauaauggacugaauuucuugaacuguaaaccagcccccaugaagugcugucauuuauaagaguugccuuggucaugggucucuucacagcaaugaaacccuaacuaagacaaccuccucauguccaaaccucaaauauaaaauccaaccaacacauugaagcaaccugaggucaaagagcauucuaaauuagaaaucuacaccuugagguucucugagccacaguugggaugguggaaaucgggacuggccugagagagucccuggagaagccagggguaggcagcacguggggcccugggcucugagccaggaccuccacaaucugggucaccagccaccucuguaucccucccuugccaagccccugaccuuacacaucccaaacacagugccauucacugaauuagugcugacugugugcguucuccccuguucuagccugaagcugcuucuacccaauaaaaacaccccaauuuuuaauacagaaagaggaagagagggcagcacucccucccacuccuacagccuuagucacacuaucugagaaucccuggcuacacucccacccaacuccccaucccaggaggcaacggcucucacuaagagaagagcccagaaagggagccagggagaggacuucaccuagaaguuggcuccaucucuuucccugcauauucucuauuccaucauggagaaaggcagauggcauauucaggacucauacagcaauaaagcaagccuugacggaguccgugauaaauccauaugcccuucccccagucaccaggccaguaagauaucuggcuuugcugucuugagaugccaaaaauuucaaacucucucucucucucucucucucuguguguguguguguguguguguguguguguguguguguaaaacucuuuaaaagauacaaagacucacaagcugcucugccaguucauagucuaagucaagcagguugagccucaggggccugucauacaugaagccccgcccgaacuccagaugcaucagccgcuccagguuagccacacguucaagacccaccaggaucagggcuugggcaccugugagaaaggaaccauuuaauguaccucaccuaggcacuggagagcuggguuucauuuuuuccugacucugguuuuacucuguuaggugauuugggggagcagggauugggggggggggaauguuguuguucagcuauauuuuuucauugugguaggggaaugcaagugucuugugcacacagggcagucagaggacaaccuucaggaauuaguuucuccaucuacccuuggaaagugaacucauguuaacaggcuaggcagugguugacuuuccccacugaccgucucucugguccauguugcucacuuuuuggugguccagggaucaaaccaccaaagugggaacaugaaguaugcaugcuaugcacacuuuccacauccgagguauauccccagcccuuuauaccauucuuuuuagagaaaauuucacaguuaacuauuugcuauaauuuacauguguuuaaugaaagcaauuugcuuuguggaagaguugggauucuaaaguccucugaguagcugaagugacaucugugacaccacgucaccucugacccugcagacuggaagugugccaugggaagaacugaagcauuaacacaucuaaagucaggccacagcaguguccucaccgcuguuuggggaaggaugagcuaauaaauagaaugcgcuuagaugggucuggagagauggcuccagugccuaagucugugcucuacucuggaaaaugccccagguuccguuccaagcacccacaauggguagcucacgacugucuguaucucuagucccaagagauccaaugcucuccucagccucugaggacaccugaacacacuugguauacacacacacacacauacauacacacacacacacacacacacacacacacacaauagacagacagauagacagacagacagacagacagacagaugaacagauagauaaauaagucuuauuuaaagauaaugugcuuggauaguucugcuuccuuaacuucuuagcaguggcucucaaccuuccuaaugcugcaacccuuuaauaugguucuucauguugcugugacccucagucaucaaauuaauuuuguugccaccucauaacuguaaucuugcuguuaugaaucauaauguaaaaaucugauaugccaagaaucugauaugugcuaccccuaugaaagggguucuuagugcccucagagggaucgugacccacagguugagaaccuuggcucuagagccuuuggcauuggcaacuguuugguaaucggcacugggauguuccaaagcucauguacacacguaaggcugcucauguagccauuggcaagucugcuugaaaagugcuugcaugauuuauuuuauauuaauuaugugcauguuaagugaucaacacugguugcauuauauuaauuuaguggccuguauacuaagcugugaucauugcuaacugauggugugaugacuuucugcucagcucaucccuagugucugugacggccuugaaugaacuaacacuugaacucuuuugcaaaagccucgugcauuuuggguguucccccugaucagagugucugaagcuggccuggcacgaaagcuguuccuggcucagaaguagcuucaguacccuuaugucacaacccaagcagggaaagaagggccaagauagcaggacaagagcuucugaugguccaccccucaggauugcauugauggaucucucucaguacaguggccaguccgccucgggcggucaggaggggcuucucacacggagggagccugggaccuaccugcuugccggaguuccucagaugcucuguauaagucagccaugucuccaucugcuccauccgugaagugaaugacuaccuguaagcaacagaggagucaaaucccauccauauugcuagggagcaugauagacaguuggaagguucaaaucccuccucuacagcugaggagaauggagaccaaggccagggcaguguggaacauaaaggaauguacaucuguguuuguuugauauuucaaaacuacaagcaacaaugacaagaaaaguaguuuauuguauucucauccuuaugagauacaguuucuagaaauugugucugcgugugugaguguguacauguguauguaugcauguguguccuaggauggccuguguucccucaaaaacugacuuccagugccuuagauggcugcacuugcaggcaggaccuuaagcagccaagcugugugagaucugaguggccccuaaacuaguccaacaggugaccuccugggagaagaugacugagccacuagcagccaaagggaugaccaugugaggacccaaggagaaggcugacauuuacaagucaggcagccaggcuucagagcuaagcugcccugcccaggccuuacucgagguuggucucccagcuuccagcacugggagaaagaaacccuugugguuuaaggcaccgugccugugguguuuuguuuggcagcguaaguauaaaaaaauacagagugcacauaauauaacagaaugugugugugugugugugugugugugugugugugugcacugugauaaaugugucuguuuuauauaugugcaguauggugugugcauauauguguauguuauguauaugugcauuguggugaguguguaugucuuauguauguauaguguagcgugauguguguauaugugugugucuguuauguauuugugcuauaugaugaguguauauguuucguggggggcaguauggagauauguguagugugguuuguguuuuguugggguggggaaggcuaaggagaagcuaauaauaagaagaagaagauauauaaaauuauggccaguccuuagcaaaguaacucuccuugaagucaggugcuaacaacccuggcccacccacugugaugaacacuaaucacucaggacagacucuaagaaggcagagaagcucagagcacugcacgggacuccuggcccuggccugcuuaccuucacaguaucaggcgacgacugccugaacuuguucugguacaacuucagcgugucagcugugaggacguaugggcgcugacugcgcauguugcgaaacuucucaaacagcuccggcugauacucggcaaagucaaaggccuccacuggcccagagggcguguucgccaucacggauacccucacagugggcagcugguugccacugcagcugauccuuuguaucuggcugauucuguucaagaugauguccaccuuggacucaaggcccuucugacucacaaacacauucugaucucgagauccaucaaaccccagaaugacuuccagauugcaggcuagugaagagaggggcagguagagagcaaaaugagaucucccacgugggagcccagagaagcaagaucugacucugccaggauccaaagcugugggcuauuucaacauguuugcuccuuuuggaggggguuaguuauuugggcaaauaguguacaucugguauuuacucaaguugguguuuaaaacugaaaguacuuucagaacacaaauaccccaauccaagcaaccgacccaauaaacauauugagaggcuuaucuauacucccagcaccagccuauucaggaauuucaugaauuccaggucagucuaggcuccaaaauagacuaugucucaaaaauaugcuuuuaaagauaagagucuaaacuaucuggggaaucaaauagugggagaaaaaaguaaagcuuauaagacuuugacucuuaugaauacuaaggacacaaauaaauguucaaagcaaccacaaggcugaggaacccucagagcggcacuaaggcggcucucagcaucagcaggaagagggaagcugugcgugcgacaauuaccuuuggagacaucggucacaccagggcagagggucucaugcauugcaucaugcagagucucgagcacugucucacucaguucggacaguuccugcacgcugcccacccggaaggcuguggcacuguuggaggcuaucuugcccaccuccucagagucgauguuccucacgccaacggcaaacaccuugacaccuuucugggugagagccaggcucacauccugagcauccuccacugacuucccuccggugaucacgaaggcgaucugaggaacccgcucauccaggcggcuaccagccuccggcacaaagugauuccgcagcaggugcucgaugcccacccugguguuggcaugccucccuccuuuauagacgacuuuguugauggcaucgauaaucugccuuuugguagaaaagucccucaggaagaauucauccguggggucugaguuguacuggaccagucccacucugauggaaucuccgucuucauagaccguguccacgauuucagaugcaaaacggagcacuuccuggaaacugucccuccuaaaauugauggaaccauccagcaggaacacaaugucggccuucuucuucucuacaagggaaucacaaggaaaaugaggagaguccaggccuccaaaaaaauaugaauacauacaaugcaaauccaaguaacuaaugucuccacuacgaaccugugaucucagguguuucagaaaaaugucacugaaccuuaccuuuuuggucaaaaaguaaaagauauccucuagcaggaaugaggaaagacgaauuaagggcagagcaaggaagggcuggaggagaacuacuauagcaugggagacaccccggauuguagcaagaggaagccagccacuuuccaguucuagucaguuaaucaagacuagaccacugugggagauuggggacagugugagggaugcaagaugugccgccuaacucugaaguggcaguuaaagaacaaagagggacuguggauccuucagaaaagccagcgcuguuugaaugcaugagugucugaaugagcgucacccagaggagcaaggaaagggggcagggggaguuggagggccugggauuagagucucauaggugaaaauuggaaacauggagaggcuguuguaacugggacaauccugguggccauaccaguccaaagaauaaagugugccuugaccacaauauguaacucaccacaagggugagucaccugacuccaaggcauguccaguggugcacagacugacuggcucuagccaaugaaugugauaccccgagacagcuaccucaagccuuucagugacccaacaguuaaccucaggaaaauugaaggcuugaugaccuuacacguugggggacaugcuucccucuacaauuucaaaugaacuauaucccccaguauuugguuucuaauaucugcagacacaaccucgagagaagagaauuauugcaaagaaagggauuacuguuucauuccaaacaguugacaccacauucgagaacugugcgucaaauggcuccuaccuggccgggaaggagaagguaaaucuaccccaggaggcugaggaguagccccagaggguccaaaggaaagcaugacccucucuucuauguugggcagcucucugaauucccgaacugugaagaccagccuggggucauuggugaugguuugcaaguccguccuaucaauguuccgaucuccuauuccuaagcucacaauccccgaugagcuuaugacuugggcaugccuggccacaucguccugagacuucccacccaggaauaagaccagguguugagggaccccaucuucuauccggcucccagcagacuucacgaagagguuucuugccacaaacuccagggcucugccaguguuuaggggagacccuccuuugaaccucagacgccguauggcuucaagcacacugcucugggacuugugggucuucagguagaacucagggaagacaucauugcuaaacugcacgaccccaauccucacuuuacugggaccaauguugagucugcgaacgauccugcugacaaagucucggauaugagcgaugccaucgggcuugacggcaucagagcugucaaucagaaagacgaugucagccgcaucgcuuucaaccacuguggacaaaagagagaauggaguuuaguuccugagcagcccugcucugacucccauuacaucggcuucugggacuuguguuuguggcacccguggugacccaacacugaagugauauuccaacacauguguugggcuuuugucaguuaguuguuaaaaguuggguuuuccagguuggugguacuuagcaacauaccugauggucugaguucaauacucagaucccagaaaagaagagaaaucacucuuaagaguuguucucugguauaaacacacacacacacacacacacacacacacacacacacacacauuaaacaaaaaauugguauuugaaaugcagcuaauaacuacuucaaauauuuuaaguaauccaaaacuuucucuaagauaacuuuuuuuuuccuuugguuuuggccuugaggccuggauuacuacuaauuuaaaacuuguggagaguguugagaaacuaauccaauauuaccauagccacgggguuaugaaucaccagagagacugggaucgcuggggccacccucuucaucauaggaaaagagaaagacgacugcccucgcuuggcugccaugcccagcucuaagaugaaccccauguggcucuccagcguuuguugcuguccucccuucauccaugggggaaaggguucccacaaugcaaugcuguaugccaagagucauguuaacugcccccagauauuggcuuucuuacauaacuugguucuuguuaaauuguauuuuagagaauccauagcaauuauuaauuuuuuuucuuuuuacuaucaaauuuucuuuuuccacaugacaugguuuuuaacugguggaaaacucaagacugggaauuuuuuacuuuauccugagguguuuuguuuuguuuuguuucacaaaauuaccugcagacuguuacacuaggucuauaagaaacagaaguaauuucaugccccaggcccacauuagcucguuaugaauaugcaaauauucuaagauagaaaugaauccaaaaucugaagcaauucuggcuccuagcauuuugaauuaaagagauuuaacuuguauaaaauuaaccagaauaucuugggagagacgagccacauucuccuguuggagaauccuguuggaguuaaacuaaacuaauagguggccuuggugaauuuugaccuguuauuugcuuugacuccuggcuuucacagugcaauacuccaaagugaaguguugagcugauuacgagaugcagccaucacugaggaagaggaaagcuggggagcugagcugagucacaaccuuaggaucuccugcugagcacaccccaccccaagacuucagcaucaggcagacucucacuaugaugggauuagauaaagauaagaacacuccacccaccaacuaugucuaaauacaaauaguguugucuaaaaccccaaggaugacccacagccccuguucuggugagcaggauugacaguuacacauuuccagucuuucccaaggucuuccuccuuccagacaagacugauggcaauggccacaugcagaauuaccucagacuucuaugaaaccccagauccuggccaaggaaccccugccuugaggcuuucacaguauucucuaauacaagcucaaacccuuuaugccuuucagcaccagcccccaucucccugcucuucacugacagaaaaaaauccaccuaauuaacaguguauccugguauucuugggcugguaggggagacuucaugaaagcaaagaaggacucuccacucuuaauucuuuuaugugcugguuggcuuuugacauaaacuagaaccacucugaaaagagggaaggcuggccucugagcaagccugugggagcauuuucucaauuuaaugaucaaugcgagaggaccaagcccacugugggugguucuacaccuaggcaauuuguccugggugguauaagaaagcaagccaagcaagccauggcgagcaaaucagcaagcagcauuccuucauggcucuugucucugcuccugcuugagcuccuacccugauuucucucaauggucaacugaggucaggacauauaagccaaauaaaaauaaucuuuucuuuccaaggugcuuuugguccaguguuuagcacagcaaaaaugaagcaagcuaagacacauuauuacagggcucauugagccugguuuauuuuauaucaaaacuagugcaggagacacacacaucuuccuuucuauuccuccgucacugaacacuuggguuggcccauuugcucacuguuacacagagugcugaaguacgcacucugguguguugaucuggagucuuucaaauaaguacucagaagugggguauccagauuguauggagacuucuccccagucuuuugagaaaccuccauaaaggucuccauuguggcuaaaccagcuuacacucccaccaggcacacaggagcgcaccguuuuguccacacuucaccagcauuugcuauucuuuuuuuuuuuuaauggucauuguggcugggguaagaaucucaagaaaacgugguuuacacacacacacacacacacacacacacacacacacacaauggaacucuuuuucagccgugaagaacaaagugacauuguuuucagggaaguggaugcaccugagaguuaauguucagggagucacaccagucucagaaggacuaucuucuccuacuugugguuucuagaguuuauaaagauacauaaagccauagaggucuauaugacacaaaagaucaaaguuaacuggucuagaacaaugcugcucaaucauggccccuuugaggguuugaaugacccuuucacggggguugcucaagaccaucagaaaacacagauauuugcauuauuauucauaaugguagcaacauuacagguaugaaauagcaaagaaaauaacuguauaguugggggacuaccacagcgugggaaacuauauuaaagggucacugcauuaggaagguugagaaccaccuaucuagaaaagcaaagaagaggaagaaaggguaaauaauaauauggggagaugugcucagccuacaauauauacuagugcuaaaacguuagcacacagagagggggggcaugcaugcaugcgcacacaagucagcaagcacccaccccacccccaccccuacccccaccgccaccgccucugcaagcagccccaccuccaugguuuuuaccugaagggggauaucggguacuggccaggaucugauggaucugcugugagguuagaguggugaugggcgucagcagcuucugcuccagucugggcagcucccugaaggugcucacggaguacacguacucaggacuuagggagaucuucaccagcuccucuuggucugugugucuggcuauggugagaggggccacaccgaacugcuugaguuccacggcugagucguccaccucaucaucagacuuuccagacgaaaugaggacuaggaacugcggaacgcccucuucuauccggcuccccaguggccucuggaagauguucuucagcacguacuccagggcauuuccgauguagaccugacucccacccuugggccgcagccugcgcacagcguucuguacuucauccuugcugaagugggcauucagaggaaacuccaucuuggaguccucacugaacuggaugacggcuacccggguggugucaaagccuauguccagguacucgacuauccucucaaucaggguacggauguacuggaacucagggccagcauuucgggauccaucgaugagaaagaccacaucuuucuugcugccaacaccugaaaagcagacaugaccauagcuucagcuucaagggugccagaccccagucacccuugaaccacuuccuagucugucaucggaucugugucccauaagugagagauucuaguaucagacgcuauagggaaaacaucaagcaaagaagcaagucuuguguauuuccacaucugagcaccagacaaaagaagaaccagcaagaggcauagaaaggugagcccaagggauggagaaaccaaagaguugugccuacaucagacuggcgaugauguuuuaggaagcagguaucaacuauggcaggaacugcccacuggcucagcacuguccagagacagccacgggacucuggagaaagcacuuucugaggaagggugagcaaugaauugcacggaaggagagacucugagcagagcacauguaaguggugcaggcucuucuguagggcacugagagacccggucugagcaaugcacacuuaucacgagacgaaucauccagaacaggggagaauggaacaggaaugacggggacagggcaaaugagacaugaagagggugugcugagcaaguucaaagggaagggcagaaguagagacaggcccucccaggagaaagaaaagaaaagaagaaagaaagaaagaaagaaagaaagaaagaaagaaagaaagaaagaaagaaagaaagaaagaaaggggaaggggaaggggaaggggaaggggaaggggaaggggaaggggaaggggaaggggaaggggaaggggaaggggaaggggaaggggaaggggaaggggaaggggaaggggaaggggaaggggaagggaagggaagggaagagaagagaagagaagagaagagaagagaagagaagagaagaagagaacgcucugagaagauaaaccaucaccagaagggacccagcgaagcuucugaacguucucuaggaaguggaacucaggucugcagcaaggcacggggagaugaggguggagggagcuugaugggaaggaggaggggagugugcaccgaguggccgcucugacgugugaugugugggagagugaauggaagcaagcacuguggaagcauaugucuggauucacaagaaggggguucugugagcaugcacacaugcacccacacauacaggagcccuaggccgugaggugcaucauaacagacacuccuguggugcaacgggguuugggaauggcugugguccucuaugucagagagagagagagagagagagagagagagagagagagagugacagacacacacagagagagacagggacagagagacagagacuucccccgcaaauguacgugagugugaacauccuaagucacuccauguaaguauaaagagcauacugcucacucccgaacaccagggggaagcugaccccucaagggugugcaaauccacuguacaaauccugccucugacuuucucuaacguauauuacucccugccuuccuugcccuacucccucauguccccucucaugaaaacacugagugaugucugucuccuucagcccugaguguccaggaaggaggcacagcccugggccggcuugcacugugggugagagcaucuuggucucuuuccugagcucagaccuuguucagacuuaugaacaaguuucaagcaaaugucacacacgggugcuacagauaaaaacauuucagaggcuccauuccucuugucagggcagagcaccugugauuaaguuccuccaggcaacaggaggccacugcuugcuacuuagguuggacacucaucaaagguccuccucaggccccucuguagagccuggaucuacaucaugugcaugcccucuuggaugcuuuaaguugaccacagacaugaaucuuaacuuuauugcuugacaucgccaaaaacaaaacaaaacaaaacaaaaauguuccuaguuuuuccacacaugcuauguggcagaggaaacaagccugaaagugcuuucuuuguaccacacagugcaagcaaguagcuaacuaaaagaauccacucccaaucccucaccugcaccuguugagggcgucaaaauggguuucaacgagcucagcuccucacgauuaagcuggaucacccucucagagaugaccugcuguaucgucccaagcucccggaagguggggauggccacagcaaagucagggaugaaggagauggucugcauuucagagaugucagcauucccaaugccaaugccaaugggcacagccccgcccugcuucaggacuacugaagggccucgcacgucauccccugauggcucugcugugaggacaaucaggagcugaggaacaccuucugcuauccugcucccaguagaacuggucagaauguuccuuaacacgaacuccagugccgccccuguguuggggguugggccgcccagcagugucagccugcggauggcgcugaugacacccugcugguccaugugggaauucagguagaacuccggccugguccggucacuguacugcaccagugccacacgcacacggucgggacccacauccaagcucuccacaacccucugcacaaaguccuuuagcagggggaagccacugcggacacccucagagccaucaaugagaaacaccacauccuuuucaccugaaauugaagggaaacaucuggugacucgcacagcacugggagcagcagauaguggccccgaauucaccugccuucucuggcaucuuuaguuuuuaacgaauguaaauacaugacuuacauuaguaagagccacuuaaugugcaucgcuugacacuauguccaaaugaaggcuguuuagugauaagcauagccaugguguauggcuuuauuaucagacaggaacuuuuucaagacaaaagcuacugguaucuaaaccucuauaaggcaucuuacugugaaauguucuagugccuuuauucaccaguauccuuccaagacacaaguuagaaaaucagagaauacuucuguucuuuuguucgccuagaaauagccuguaguuuccacauucuauguaagcucugggagaagaguuucaucuaagagccuagagccagcagcuucugcuaaagauuugaaacuagagacugggaugcagggggucagggcuggggggcaggggguuuggggggcagcuuggugaaccauaccugauacagggccugaacccuguucugcuuucagaaggcucacaaucugugauuggaggucuccgaucuuagggagugacucugcagccaggaugaaugcaggcgacagcacaaucugcuccagcucacugggguuggcguucuuggcuugaaagaugaaagguaccacuccucucugcuucagggagcuugcaggcccggccacagcaucugacgaccuuccagcaaccagcagcaccaggaacugcugcacguuauccucgaugcggcugccagccgaccucacaaagauguuccuaagcgcguaguccagggcguagcccagguugagggcuuugccuguuuuuagcuucaucuucuucacgagauuaaggauuucagcuuucgucuggugcucacugaagcgggacuccagccugacgucaucacugaacugagcuauugcuacccgggucccauccggcuucacaucaaguuccucaaugauccuguagagaaagucucugacagcagggaacugacccaagacauugacugagccgucaaagaggaaaagaaugucccgcuugcucucuacgaggaaaacagauggacacaguaagcgaagagacccugacaucaaguacauucugccucguacugccacgaugugagaguucgccugauucuuaugacaucaccguaccagcaagggaggggaacaaagcccugccaauggccucugcuguuccagagcagcacaaauuugcaaaggaaugggauuggccuggucauucuaacagccugccaccagacauucuugacaaagcaaguagccagaaagccugcccacccuguucuugcagcagguuaaaccacugagaauagacaacguuuucuuguuguuauaaauaaaaucaucaaaaccauuccuuucuauacuucucccuaaagacugucuucuaucucaugugacagagaccaguuacagacuaacuucccacugacaucuggguugauguguguggugguuagaauaugcuuagcccagggaguggcacuauuuggaaguguguucuuguugauguagguguggccuuguuggaggaagugugucacugugggcaugagcuuuaagacccucauccuagcugcuuagaagccaguugucuguuugcauuuggaacaagauguugaacucucugcuccuccugcaccaugccugucugggcgcugccauucuccugucuugaugauaauagacugaaccucugaaccuguaaggucaagaguuaagacucaaaauaauaccugccggugcuuugggagguggaaaguuaaaaccucuacaaacauuuccaauuuaccaaaacuggacuguagaaaacacaggugacagcaagggggcagggggcacaccaucauguaaauaucucaaacaguucugagaacuacuucggugagauagccauuggcucaggcuugcuacccaucugacugguaggucuuguguauccaccacuaagggacauaauaguaaccaccugccacagaaguagcgacacagacucuuuguuguauucaggugcuuuuuaaacauggccgagucugaauaaaggaagauuucgagcuuuaaaggaugccaauacauagucauguaacaaaucaucaucaauuuuucugucuccuuccuucuuuuuccccuucccuucccuuccccugcccccucucccuuaugaacucuagaauguccaccuuguucaucuucucaguaaaugugagacaucaucaugaacagggcauagcugaauguucuacacuuagggucuacauuugccaacacacugucuuuaaccagucccagcccaaaugaacccaccauucuuccacaagucacaggcucugaggugccuuuggcuacugcugccagagaggcaucuggagaaggaaaggggcccacacugcugggagguuuaccuggcugggauaguggaacuuccuguacaccuccacuaacauaugugguuaggggcugaaucagcuguugaggcaaagauggcagggagcggaaaucguccaugagguauaccaggcugggauuaaaagcaauaugcucuaacucagccuuauccgcccgauugguccccacacagaaggucagcacgccugagcgcaccagggcauuggcagcuugcaaauaggcauccucagagggcccggccaugagcaggagcagcagcugaggcacguguucacgaguccugcugccuccugccuccgugaagugauuggcauggauauagcucaaggcagagccugcguucaagccggagccccccuugagcugcaagcgccucaggugagcgagcagcucggacuuggucugguaagugucuagagagaacuccgugaccggagugucacuaaacugcaccaagccaacacggauauugucacuuccaacaucgaggcuguuaacuagguugguuacaaagucacgcacauaagggaaauuguuuuucccaacguugucggagccauccaaaaggaagaugauaucccguuuguuuacgugaacugcagugaagcacagaaaacacagugagacaugccccugagagggcuucccaugugugcccucaugggcacacauggcacacucagaacacagagguagucaacguggcagagcgggucaucugguaaaauauggcaagcggcugcauauuuuccccuugcaguggcuggaguuugugaggcacacugauagccaaguguacaaaaccgagauggcucacagacagacaaagugcuagaguuagaauguuuacaaccaacaucacuagaagaguccuaaaacaguguuuccucccuggaacugaaguccacagggugcuggcccuucuguugcucauugucuccagagauccagucacaggaugcucgccuaugcuggcuggacccucugggacucaccugggugcacauagagggaucuuucuaccccaaaacucaagaaacaucagcccacauggaccuuggaacacagcuucucuaaucaaagauuaaaucaaaggaugucugccaaucaaaggaugugguccuacaacuggagucuucaucccccuauccuccuuucugauuaggggucauuucaguaccaaguaauaggguacccaggagaaagccuccaaggagauguggcagcaccauggguuugguagcaccauagauaguuaaaauagaugucaacuuagacagaaucuaaaaucaccuaagagacaggccuccguguauucuauaagggaguuucuagauugagcuauugaggugggaagauccacccuaaauggagaugccaucuuucugugagcugggguccuuccugggcgagaggaagaaggagaacgucccagcugggugccagcaucugucucucucugcuuugugacuacaaauaugaccagcuaccucaagcuccugcucccaggacucccccaccacugcagacagcauccucaggcugugagccagaaccagccuuccuccacuaguuugauuuugucaugugucuugucgcagagaaguugggugacgaagagauuguauccuguguuuggccaugaagaaaagcuuaucugugggucccauaucuagggauucaaccauugcucaaaauauuugggaaaaaaaucauauuugucccuucucaguacuuccuauauaauuggcuacaaugcuagccuugcauuugcuacaguauauauaggaggauauauacaaauuacauuugggcacuuguaccaucuuaaagaagggacuugagcaucuguggauuucuguauucacagauggagggaauuggccuaucuccuauggacacugaaggauacauagacuuacuacccucccaugccccauuguaauucagacuaacuggauccuauguucaugcauuuaacuuuggcuauaaaagagugggagagagagagagagagagagagagagagagagagagagaauuugagggcucucaagaacagauggucugaggagcaagcaggcacccaugcaguagguucaugcacuguacagcccuucugugugauggucugugagaggggaaagcuggauuccaggauauucaucuucucuucacugaggaugaagguuugcauuuacccaguucacagacugagcgcuucagugucucuagaaauaacucugcacuguccaucauauuaagugagggagcugaaggaccacgggcugggucuucacacccaucuaucagcauguuuuccuguuuaagaggcucccuuauacagggcgaaaacaggggcuaagagcugaggguacuacaucaucugugaguagagauccugucagcuugggaaaggaaaguccugggcugaggggagguuccuggaaagagucacuaauaaaaauagaagggauguccaucaaagaacugagagugacuucuguggccaaaagcuguacaggcaggugacccugugaugcuacaguuuaaaaucacaugcaugugcagagggacauuuucaacucuacuguuucaacccugcaggagaacuaaaugguuguucucaacacaaaacagcagucugucggcuaaacaguauuccagcggguauuucucaaaguuucugccuaccagcccccuccugccuguguaauccacagccgccauaccuuccgugguuccagugagaguccugagaggugccaucaggcugggcagcauguuuugcaagggagcagggcggaacucagcgggaaugaagaccagggaggagucgaaagcgaucucuuucagcucauccucaucggcggccuugcugccaacggccaaggccaugaugcugccucucuucagcuccugggcaggcuggcugacuucaucgagggacuuaccgccugugaucagcaccaggagcuuaggaacccccucagcggcccuauggccggcugagcuagugaagagguuguuucgaacaaaguccagagaagaucccguguacagggcugagccauucagggcccucaucuuccguacagcaguuauggcaucccuuuuguugguauaggaauuuaaauagaacucaggcuugacagugucugcauacugagccacugauaccugaaccagguccuguccaauuuccaaccucuggaugacucugguaacgaagucucggauggcauugaaguuggauggccccaggcuggaggaaccauccaccaggaagacuaugucccucuuguugacuuccaugacuguagauagcaauaauaaaggaugaacaguauggccccugggaucagguucagcagagacacuguaauccuacuauguccaggauacucucccuugcccuggccaaugcccuugggagaacugucacauaugagggaccggcuccuuuccaaccccaccuaccuguaauguguuucagaaguagcuucacagaagacgccaccacuaaagagguaauugacucuuuguugcccaacauaguuuaaaggaauaaaacucgugucugcucagaaaacucuuuguaucacuagccuagaauccacacacaaacgugaaguggaacaggacugcuccauuuucuaugguucaauauuguauggcuuccuuuggcaagcaaaaacaaagguuuacugguuuaucauaaaucuuggaaaaggagccaggguccaccccaccaaagucagccacagcuugucacuuacuucacaguccaggauggaaauggcagucaaugacaugucaugaucuggguuacauagacaaaccacgaaagcaaucaccuuggccagaucacugcuggcaguggcugugaguucacccagccacugucucugaacauguacaaccugcccaagggaugggaacaaugccccuaccagacuugagaugucucaggcuccuccuagacaguaaggagucuaagugagcugagcugggguggguguguucacaaagaagcaucuguagguccuuugugucaaacaacuuaguguuuuacacccagcagaagaaagaacguuagaaauaaaggcaaggaagaguguucuaagaaccagagccaccucucauggcguguucuaaaacacagcucauuccuagucucagggaccagaggccaggaauaugggccagggucacucggacugccauaacgaauggcauuagugugacagagccuccucuaacacucuuugcacccaaaggagacaaagcugaguucugccaggagggaggucuuucugcauaagacuuggaucccagaagcccaguuaccugcuggcgccaacguguaugcgacauuaccugcccuugcucccuaggccacaaacacggauaugacgaccuauucagggaucucuuuucuccuucaguuuggaauaugcagucucgugggguggcaacauugauuguaauauaaaaugucuuugcagauaaaccuagugcacauguguuugaauaguggacuucuuguuucuugugucacugggaacaauaugcacacaaguguacacacauauauguugcacauauaaugcuccauaucuguagcacacauauuuaucacaccucucucacacagcagacugauaggcaaauauccaugggauggccaccccauggugaggcagcaugcuccuucaugaacaucuccagguuauaaccugauaauagucacacuuacuaccucacaaguuuuaacacuucgccauacauuuuaccagugguccaugagaaggacaaauguccacaugugggagacauggaaacuaucuaccacagacucagcuuugaggauucuacaguaugccuuggggcucccagguuccauaagacauguccucuuggauuaugggagagaucacuugguuugguuuguguuuaaaguucuggaagcugcuaacagggagacaccuggaaugaugcuuaggcaacuguaauaaggacugaaaaaaagucccaaaccacucaaagagugacugaguuccuauguucgccucaugcuucugacacuagcugaugagccuucucaggaccgguccuuucucuggaauccucuuucugugggauggaggagcugcuuaauggaccaucucacaccuagcuaucauaccucaugauucucucaaggaugaccaacacuuccucaccaccaccauccacacccugcccccaaucucuuccccagagacuggaggagucauugucucuuaggaaguguccuugaagguccagcuaaucucagccaugaaugaaccucuucagcccuuacuccugggauggacaacaggacaccccaagaccccuauucccccccccaaagcuugugaguuggaaaaggguauccucauucuucccauuaauaucaccaaacaaauccugucaauuagccacucuguccccacccuaggaacugccuuuccuucugugguacuauuaugcccuguccuuggaacccuaucuauccauucucuucucucuauaucugcuaaaggacuugggaauggucaucugaagcccccaggacuugccgugaguauguccuccgaucccccaucgcuguuucugggguagugccuauuacccauggucaccacagaucauauacaccccugaaaucucccacauccugcuaccuuccuagccucuucucuuucagucaacugaaauccccacuucuucaucuacugaguucucaaaucugaucuucaacccuuccucuucccucaggcaacuacucucagccucacaacccccgcccugggucuauccucaugugcucucugauucaccagcccucacuugcccuguccccaucuccccaccagacucuccuggcagaaaaaccguggcgcucuucccuucucuccuuucggcauccagcaaacagaugcacaaucaggaagccugugcucuacagcugggaccucagagcacacaugggugaugacaccaacgugccacagugggagacccccaggaagcugggcuccccguucuccaaaaggaguaccucaggacucugcuuucugcucaguccuccgcugcugcugccauagaagggucugaucucccacuuaaaacugcaauaucugccaacucuuccucccgcaggcccauugcuucucaagcccuucccugugcccccuucacuccagcugagcugucaucugucuaucaggucaggguggggaccucacuuuuugauucaaggccacccugucugcucaucccuuugucuagaaugcccuucucucaacucuucuuucccugaucauuucuguccuauaacuaugcaaaccguucuacuaaguccccugcccccauccucucuaucccagccccucuuugguggccuuguagcuugucacacuugagacauggcuuaguuucaucauuagcucacaugugacagacccaaugacuauaucucucuuucuccucccggugucuccagugcuugccagagugauuagcacauaucagauaugugcuaaagaguuaugaguuaugaguucaucacugagacucaccgugaugucugugaggaaggggcuaaaaugcuaguuaacuacaagaaauccaauacaaggggcagcauaccacccauuuaaauacagauguugaagcgucucuuuuuuuuuuuuuuuuuuuugaagcgucucuuaaggcaaagauaucuucauccaguaaauucuuggaugagaauuuaagaaaucagagcccagagauguuguaugaucuauccagggucauuuaaaacaaaaacaaaaaacaaaaaacaguccucccaaagguagccauggcguugauccuguuccuaaaccauagaacaacgguuugcuuccagugcaugcaggcucagagaagcaucagugagcuguguauuuccccaucacuguuuccuugaccaucagagccagggcaaggcagcuggauggauagcugcagcucaaaccacagcugggcaggacucaggcuacagcugggcaggacacagaccuagaguacccuuucuuccauguuuccccucagagaaucugaacccagauuuaccaaaggccuucccaggaaagugguucucacuaacaguucuggugccgaaguuaggugaaaauguccuggagcccugagcuuccugucacaaccgccauuaucaccagagcuguuuuaaacuuaucugaaggaagcuauccugauucuggauggauuucacacugaggagguguggccaggucucuguuagcaccaugcuaugauuagaacugccaguuaaccaagugccgggcagcagagggcagcuccauacacgagccaguggagagucuuaaaguguuucauucagacuuuaaagaguuuuacuguucauuucauauagugacauguucaccaaaacauuugauuuuaagaccacagucaccccuuuggcuaagaaaacccagccuggaacccugggcuuaaaacagguaaaaacugcuuaugacaagagucauuucauagguccaggcucuuuauagaguuagcaaacguagcuagacacacaaguaguucuguacagaaaaauucgaauucuaggcugcagacacuaaccagagucucccauaagucucuuucauguacucauuuucacuaagccuguacucugcugaacaacgaugggaaacagggucuuguguucaagacugaucugagugcaucccuacucgaagacccggaagaggugaauuggguaccuauggauacugaagccuuugguagcagcugugucccccacuuacuggacaguuugcacugccugacuagcgucaugaaaaugacaccaucugugauggaaucccagacugacagccuucugguguccccacaccuccuguguuuaaguguguaucucucauaugauguugguuggcuugcauuccuuaagugacucuaguugacucugcugcugaagcaugucaugcaaaccaauuuguuccaaacaggaccaggauguucuguaacuaccccauucagcagggacuuggcugagucuuaccuucagagauguaccucauguccacuacaccgagacaggagcaaaaaccacaccccuucacugacuuugggaagacacuauuuaugaguguacugauuuuacccuggaguggcuuucucagaauugugaugaaucccuuaagccucuuucaagaugacuguaugaugaacagauaauguauccauguaauagcucaaagcaguguguuuguuacauuuuauauuuguuacauuguuagccuaaagaccacacuuuccuuacaacccaugagagugcuccacucuggacaaugcaauggucacacacaagccauacagaagccaguacaucacagaaugaugacugacuggcugugaguacuuacagguucucccaaggugaaucacuccaguguccacuuuccuuucaugacaaauaccauauaacacacccccauuccuguauagauggcaaaaaaaaaggggcauacauaccuugugugacaauagcuggugguugcaagacaaugugccuuugggccacaccaacaagguacggcaguauuugcuccuggagauccccaaagcuacggaauuccgggacaguaaacaccaagcugucaucgguagcuaugugcugaagcucugcccuggaggcugccugggcuccgaggccaaacgagaacacacuagccugcuucagagcuaccaccgaaucucgaaucucaucacuagaaggcccagcacuuaugaggaccagcaccugggggaccccuuccuccacgcggcugccaccugcccgagugaagugauucuccacuacaaagucaagagccuggccuauauuggccgacucccccccaaccaagcugagcccuuucacggcauccagaacugcagccuuggagggguagcuauucaaggagaacaugguuaugggcuccucgcuauacuguaccacccccacuuggaccugcugguuuccaacugagagucucucaaggacauuuacaaggaagucucgaaugacaucgaaauuggcauuuccgguguucugugauccaucaauaaggaaaauaaugucagcugagucuugugcuuuaaaagaaagagaugcaaaaaaaaaaaaaaaaaagugaaagcauuagaacaagugaccaacaugcaucaucccggcuaucagacguguuuccuuggaaaccaacaagaaacacgaaacacagacaaacaaaacacaaugucaaugaaggaaugugaagucucuuucaguucuccauucugaguggauaagaggcaaugucucagggaucgugguugaaguaggagccuuuauagcaaauuuuugucugcgauaccuucacaguuaaacuucaaagcaucauaccccaagagaaaucaacauucuggauggauuuuucuucuaaauuuagagggaaguauaauuguaucugauuauaggauacuauguugcaggagagaugauuagguuggcauaaauucaaagguuguuuauaauuuguguucauuucucccgacuccuuacgggauuaugaagauuuugaugcaagugcacaguuuagcaaacaaaagcccagguucauggcccagugacugauaguuccagauuacuuaauucucuggguaacuauuguuguuuuguuucuggaaaaucaaaauggaugacccaugcaagucugggauccaaaacucagacacaguuaaagucuuaauuuucagaucccuugacaugugucggauccuccaaucaucucucaggagcuuggcugcaugauauccaaaggugggacuaggaucagaaaugguuuggcauugccucuguauucagucaaauaauggagaacaauguuaagcagugaugugaagccagucaugacauaauuauccaaccucauuuuaugacauccuaguggauugccuagcagaaccaagauuggcagggagacccuaagccaaucaguguugucaucaucgaaggacauagaaauggcugccaaagaccucuuuuucccagugagggaaacuugaacuuuccauugcuggaacugggguuccauugaggcuuggauaaaugggagcagugagugaaccuacaaaccagaacaggggacuccaaaagcugaacuugugcacuaaaaucauacuaggagaagggaagaaucaaccuagcaaauguuuuaaugaauuaagggugcacgggggacaagagggaccgcugcaugaggaugacuauucauacucuagggcuuugaagcauaguuauuacaccggaauguaagaaaggaccauucauucagaguuuugagugccagcgaguguuuuauauuuaaauuuaauuuuuccuugugccagaaaaucuguuuauauucucacugggggaaagcucagcucgcacguuggaauuuuuucucuugggcaguguucuucuccugagaggagaagcggggagugccuggcuuaggcacgaucuuacgaucuucccucccucccuccuuacugcauugacaaccccuucagggcuuaacccuuugcauggagagagguagugacuuggaauguuguugccacuguccuaacaagauccaagaggacaauugcuuuguuccaguggcuuagaucuuauguguuaguaacugucugacaaaauccacauaagaccggacccuggguucaaauuccaaaguauccacccgucuucagccagacuucugaagggaucucaagaggaugcagaaccaggggaugugaacugcacagaucauaaaaauggcuuucaccauugcauggagagcaccauaaaauguccccauguccccaggucuaagccagugaccucaaaggacauagaaggaccuguuuauuacacauccuaucuagacauuuuaaaagaaguuuauuuacauucaagaugggcaauaaacagaucuuuggucauugcauggcaugauucugccuuccuuauauccaccucuaccauucuuugguacaauuucuaaugguguauauaccacucaagagcucucugggugggagaaugggcugaacaucaccagugguaggucauaaaaugauggauaauuugucaucacugagucagaaccaugauucucuuacacacacaauaauggaacacacagagcaugcuuuguuagccgugagagccgaagccacacagagacccaggcgggggucccggauucuugugugcagcaaggcgcaccaacggccaacaccaauuccaagaucagccugaaaguguaaaguguggaagcuggcugguggucuacaucgugucucgggggucauacccucuguggugcuuucuauggaaagaguucaagauguccauggaagaucacuaagccuaagcccuaguugcccgggcacccaagaaacaucaaguuccuauuuccugugagaaacacaauuuauaaagaaaaugcaugcagggagccucagaauugccuucagcuucucuuuuagaauaaaggucucccaucucaguggcacccauuuccaaagggugacaaagggauuuaaaaaaaaaaacaaaaaacaaccaagacuaacuagcagggcagaguccaugcagaauggugaucccugagccuuuucgugugugcucucacguuagaaucaagaacaguccacagggaacaucuaaggucccugcagcaaccucagucggaccacccaugugccuuuuccagaguuuuaugcagggcucacgauuaugauccuggcugcuccuuuuaucuuacuucagucuugcuauggaacgaacacccagugagacgugauacggaggaauugcagagugcaguuaaucagaaaagacaacagacugauaaugcuccaccccggugcugccagugacuuagacagagaagacagagaugcucucuuggcauaaaaacaaagguuuuuagcuguguagaaauaugcaguggguagacucuuugcucuugcuguggccauuucaguuucuaucauuuauauaaugacuacaucaucuauuuguguuugcaaguuugccaacacauuaacuuuaaaaacgggccauucucuacuaaccacguuuuucaaaugaguaugccauuauacccauauugugaaaggagugggucagagacucuugguggacacacacggcugccccaagugcccccuuggcauucccucugaaacuggaauaccauccagggugaucccuagaauacauauuuguuuccuauaaccuggcaauuguaaagcagugccagaggagagacacgcccucaacccccgaagcagggaacccuaguaguacagauaagugggccagguagucuccucucugucauuugguagaccuuggugaccccaauccuaccaaggcugagaucauggggaaccauggggaagccaaaggaagagcagccuucagaaacagcuccuuaggaugugucauucccacagcccuauauaccgaagccuugcauguccauggcaacagguuucuuucugcugacacauaccaccucucucuucgccugucuuuuucuaaaucccugugaugaaacuggucugacauuguuuucuuagagcugccuauugaucugauuauaaucccaaaggcuugccaccuguuccaucugucuccccuaagugucccacaugcuccuuagagugcuugacucaugucucuaccucucuacugcaucuucaucucacuccuuagcaucuuccuugaaggagacuggcuucaccggaugcuuuaccuccagcccccugccucagucauucucuuggcagaagggaaaagcuaccugugaacuugacucccucuaccaccuccucugggcuguauaugccaugccuccugaguccuggcugcaagaucacucuuucccuagucaagaacccauugugcucuucagccccucccauaggagaccucucuagagggcauagguugcccuuccagccucaugggcaaccccuccaauucuccaacuucaugauuccaaacgcccucuuaaauacaauucuggcuguaccuuccauacacgcucaacugucuuaaggacaguccggugucucauccugugacucugagaauucuccucauaugccccagcauuucaccuccuucuccacccugcugggaguccccgggaagguguggcuaagguucuaguagcuccuacucugcauuaccugagcaguucucucguuccaaacgcccagucugggaauucuuuugcuucugaauguaccugaggaguuugaagcaagcuaggggagggacacacugaugagaugcccccuggcuggcaagcucuggcuuuuagugaguguuccugcaaguccacagucauuucccaagugggagccuucaucauaucucugugaucuuuguuccaaauagcuccaaccccaggcucccagaccugacacucuccuccacuccugcccauucuaccuaggagcucagcuuccccaucccagaauccuagggaugcagacccuuccucuucuggaggagaggugagucucucccagcaugccucucuacuccccaccauucuuuccuacuuguguccuucaaggaccugugcucuggcacagggugcccugucccccaccccuagcugaugagaaagcuauuccuggccacuaggcaaaacugcuguuaagcaguagaauugacauucuugucacuuuucuucccucucauucuuuuggacauuuauccauggaaggaaaaucaguagucgugauugauuuaaagacucucagucaccuggucagccugucgcaccguguaauguuaacauaugaugcgacggccaccggcugcugcauacucccagggugaccgugaguagggcauuagaagcugaaaagucucacaguuacagucccagggcacaaaagacacaacaguguagaccaugggcaggaacaccacagcucaguaauagcucuuucccaagcuuucacccacccuuuaggacucaauuucuucuaaagcagaaacaaacgaacaaacaaaaaacuugaaucacaucacagcuaaggcacuuuccucugauucuauaaaaucuuuaaagcaaagacaagcuuccucuccucccucagcccagugccuccuggugcucucugccccuagguguaugcccauccaaggacagcuuucuucuuaaggaagguaaacuaacccuggacauucuaacauucuaacaucagaaugugggguuugaaguucaaacgcuggcuguuucagaagccuucucuugauacggguggaggcuguguuugaaggagacugaagaaggguagucacgccuuuguuuuuaaguucgagaacaucucuucccugaguccccauuugaaggagacugaagaaggauagucacgccuuuguuuuuaaguucgagaacaucucuucccuaaguccccagcgugucuuaggcacuauguugccaguauuugccaagcucacagccacacagcagcaaggcagggagcagccuggcagugaaggcauuaccugugaugucuuuaaggcuuuccuuguccccagcccuuucuggauucacagaggaguguauacaggacacuaaguucccuacuaggccaugcagugagguaacguucucuagguugaaaacaugcauacugagugguucgcuugcuacuucuccuagggcucuuucaucugcacccucaacuccgacugcaaacacauuaacguccgcagacuuaaguuccgcugagggcagagcgaagccauccuccgauuguccaucaguuaauacuaugauaaccugagggacuccgucagcagcccggcuuccggaagccucagugagguggcugugaauuacguauucuaauccuuuuccaguuugguugcuucccccaauguaagacauguucacaauaugagaaaggacuucuuguuuagagugguauguauuuaacaggaacucgguauguggguuuccguugagccggaccagagcaaagugaaaaucauugucucccacagcuaaagacucuacaacaucagacagaaacucuugaacaagcaggaaacgguccuucccagcacuccaagaggaauccacuagaaacacuaugucagccgccgcaccguuuuugacaucuuuaaaaaaagacauugguucagguuuuucuaccgauucaguggccuccuguccauuuaccucuuucuaaauaaccuaaagcaaaucugcugcuauuaccaaauacgucacacaucucaguuaaaugagggcaaguagggggacuuaccugcagagcagugccaagaaagaggacacagcugcugcuauacccagcaaucgcccauguuccauacugagucgccccaagucaggggucagcagaauauuccagaagaggagaaacaagccugggugccuuugaguugaggcaugacuguaacaauuugacccucuuauguccaucugaccagaccaaagggaucucuugucuuugguaaaugacuaccaugagcagccuguuccucaaugugagguagagaguggccccaacagaggcagaaggagcccacugaugcauugugaacucacccccaacccucggggcuucaggaaacuugcaagaaauguaaugagacaagcaacucuguaaguggggaaaccagggauauuuagaggaagaaguccuguuucucuuggauauuuuaacaugaagaugaucccucugagcaguuagcacauuucuccaucccagaggagccugccuacacccugagcaguacugugcuugcuccaggaugauugguuucccccacaaguauagacagacacccugggaccaggccaucggaagugcuuggaagauccuucagaagcugcagccaggccucuucugaaauucuacuuaccccagguuuuucugagaggccccuaagccuugauagucucccacuaagauaggcuacuuucccuuccaucuaaggaacccagccuuauagacaggcugcugaaggaccaguaccccuggccaaugauaaggagacagggcuuccaguuccaacauagaaggcuuaucuugcugcccuaaaauucugaaagcaaauucuuaauuggaguauuggggucucugcuauauaaaguuguuuaaggaaacaacuuuguuaaagaaccaacagucccauguauaacuaucauucugugccuacgguuagagaccaggaaguuggguuuugugucuucuuauuuucuuguuuuaaggaaagaauuuuuaucacaauaauugucuucuuccugcagaccaaagauguggggaauucccucagauggcaggcuucaugggauggagacucuaaucagacccaaugugaauaauaauucugcuaccaagcaacuuaauauuugauguugaagaagaagaugacgacaaaaggaaggaaggaaggaagaaaggaaggaaggaaggaaggaaggaaggaaggaaagaaggaaggaaagaagggagggagggagggagggagggagggagggagagagagagagggagagagagagagagaaagagaaagagagaaagaaagaaaaagaaagaaaaugaaaagaagacaaagauaaggaaaaagaaaaaagaaaaacagaaaagccaccuccccuggccaccgcaucugaaaggccuguaaagcccgcccacaugcugcugacucucaacguccccaggccccgugugaagcucugggugauuugcucuagacucaaacacugcuaauacacagcuaguaacuucuauuuugaacaaaauuaaaccuuaccuccaugcuguugggcaugagucguggcaaugccugagaggagaaggcuaaagacagccacuaggggcagaugccgguguuuccucauuuugaaugucuaagcaccaagugugaaccuaaaagaaaggacaaggagaagagaaugauuaguuuuuagcucuccgaaauccauuuugguuuuugugugcuuuuugaugucugaacaggcuuugugugugauuaguguuugaaccagcaacaaaugaguagacaauaaauacacaagcaaguggguagacaacaguagucccucaagguuuauuaccgagucauguuacaguucucucacaacgcacucugaugcccccucaagggcaaagccacccaaugcaguuuucagaaugggcccccacuucuaagugauauaugacuauacaccacacacacacacuugccuauggugcaggcccauagucuuagcuacuguagacugauguagaaagaucacaaauuuacaaauacaaggacaguuugaucuacaaaaugaguccaaggccauccugaacaacucacugagacccugugucaaaauaaaacaugaaaggugagcuggagauauagcuuggagauaaagcguuugccuaacgaguauggggcccuuggucuggucuucuguucuacauacaaguugggugucaagggcagagacaagguggguauacagagcucuucccaaggggccacagacuuuauuauuuguuuuaucauauauguguguauaugugccugaauauguguguguguguaugugugugugcucaaguguguguguguguaccauguacaugcaggagcuccuggaggucagaagaaagugucagauccuccugggacuggauuuacagguaguuguaagccccauguggguucuggucacaggagaugaguccucugaguccuuucucucuucacucucauuacuagggaaugagcuaagugggcacccucuucugagagucuuauuaacugauccucgaagggagaaucucuaacucuaaucacuacauacaucagccauggucaggaacuauauaacgaacucuuuuuccaaauugaggcaggcagcaacuggaagacggcaugcuccugagaaaauggagaguaaagggcuugcuucgcauacacagagggugugggguugcagggggauacuggcccucuugauggaaauaggcucugccuagccagaggcagugagaucuguguccagcuccuccgccucuuccucccuugcuaaccagcacuuucccugucauuugccaaccucaaaucucaucaccacagaacaaaccaaggaagguucaguuugggagacaaagaagccagagcugagggcagagugcucaucaccugcuuucccaucaugcaccaucuagcagcuacaaacaugacuuccagacaaguucaaguucugaauguuuaguaggcucugucaucagucugucaagaucaucucuucccccucaggcuucucaucagccuccccauccucuccuguccagucaugaaucagcuuggggcuggaguaucccucaagguuccgcacugaugcuuggagauuccauccaggcugaggucuccuuccuucucccccucuucccugugccccgaagcacugauuccugccauuagagacccauggccuuggguggugggacucagcaucucccggugaguaaaugaaaaggcuaaaagaugcuggcgaccaaggguacuucaaagaggcccagggagggaccagagccaauaauaucaucgguacuaguucagaaucucaccuuuuuucuuuuguacugaguuugaaaacauacuguuugauagugggaaucaccuagaauagucuaugguuaaaggggaaugucugucugguuuaagaaacugaaaaucauuuaaucuagggauauuuggcuuacuucauaauuuauguuucacuacuaggauauuaaacaguauaagaggcucuucuagugaauuaaaacucuaucuugaaucaauguggacuauaauccagggccucuguucccuucucuuuucucuucucuucucuucucuucucuucucuucucuuccucucucucucucucuccccccucucucuuucugucucucucccucccucucucucuuucucucucucucucccucccucucccucucucucucauuauauuaaaaauccaaauacuuguaaacugcuucuauaucccuugucucgggaaagguuugagucuguguauggggaaacaaggaaggagaacaaaguggucauguaccaugguaugcacaagagccuccgucauuaugcaguuagaacaagacuccaugaaaccaggaaaguguaauagcaggagaagacauucaagaaccaaacuuugugcugaagacagaagcaacguacgugucuguguccugguauucaaauaacaccacuguuguuucugcuuguaacuaacacgugggaaagaaggcaagcauguaguagcgagauaaugacguuugagggaaaggugugaguuuuaugaaaaauaagaauuuagugugagcauaaacaccugcuaccagggucacaucucccccaucugguaucuuagcaugcuacagacucuggcuaaggccaaaguuugugcaucugagccugaccuuccucccacagguucagcucuggucuugugauccucccuggcuacuuuuuguccaacaaacacaagugcacacuuucccagaugagauggucucauggccccaaaauugucacugggagacuggugggagaggauacuguggccaacuauuugguggcagagcuuugcugugagugaggagaaggcaggacacuuggcaaaaugggaggggcagggguuaggagagaagaauauuucugaggcugccaccugaugauagagaaaagugcauagaaacuugcagcucauccacagauuugccauuaagucuccuuccugaggccaagcccagccucaaagaaugggacacagcacugacugagguauggcaugcccaaagaugagaccguaaucaagagacucaauuuucagacccaccauggguuggaucccagggaaguuaaccaugagcaucaccugugacucagaaccugcuuguagcucagauuccaagccuucggggacugaaccaccugucaauacaacuaccccggccaacgugucggcagcggaaaggaggcacggccccagaacaucaggcaagcucucagcacauuuguuuccucaguguagucagauuguggcaacaguacaaacacccggucccauuuuccuggcuuggcauguucauugccucuuagacucagaaacgcacagcucugaaaagcagucugugguguucagcgcucugacuccacagugugcccaugucuugauguaaccuaagugguggugcuaggacucugcccacagccaguaugcaagccacugcugaugggcuggucacccucucacccugucacuaccccagcuccaccccauucacucuauagaacacugcccaccccauguuccacccuagacaccuuucuaagguggcgcacgccuuuaauaccagcacuugggaggcagaggcaggcggauuucugaguucgaggccagccuggucuacagggugaguuccaagacagccagggcuauacagagaaacucugucuugaaaaaccaaaaaaaaaaaaaaaaaaaaaaaaaaaaaaaaaaaaaaaaaaaaagaugucugccucuuccucucucccucucccccucucccccucucuccccuccccucucucucucugugggggaggggguguuuguguguguuaaauuaacugaugaugugaacucaggacauucuacuuugguuggguuuucagauauuugauggagaaccugcaucuuucuggguccucuccagacacacagucuguuccuccagagucccuaauggcuuuguaauuagucuagagcuguauuuuaaugacaggucaacauaugugaaaacucugaauguuuaccaccauugugcaccaaacuacaucucugaaagagcuaugccccagggacagagugcauucuuuugugacucuaaacccagcuaugccacagccugccacaauauuccauuagucuuauguaucacaacuucaaucaaaagaugugcaugcaggucuucuagcauucuaguucaaugauuucaaauauuuaauucauucaggaaaugugaggcuuuaaguaacauuguguauguaugugugagugggugcguaugugugcaugugugugcaugugcauaugugugaauaugugugcauguguggagaggacagaggucaguguuauguguuuuccucaacugguuuccaccucaugauuagagacaaaaucucuuccagugaacccagcauucaccgguuggacuaggcugaccuacaagccuccaggaauccugccucugccucccagagacaggacaacaggugugcacggccacaccuggcuuuuuaugugggucuuggauacaacucuguccccaagcuugcaaggcaaggacuucacuagcugagccacugucucaucuuucgaggagcaucuugugggagaauuaggauacaagaauauucuagcaccucgcuaugaggcaauagucgugggaucuaugaaaggggauagguggggccugagguaagggcugucugaccacuguugagucuacauuaaggacaggaaauacucugcaagccacauggacagaaagcucacugugggugagucauauggagucguuuugcuaacgaucccugccccucacacaggggacuccuuugaauacacuaauccuaccauguguuagucacauagugagucacgcuggagcaaccccuaaagcuccuuccuagccuuccauggucccuaagcggugaugccauggcucugugaagauguuugaagccaccagcuaauugaguuucucuaaggaaauggcacucguguuauaugaguggccugagcauucaucucggaagagcagcucccuagguaccugauggcuccaagagacaaaagagacacagcccaaauagaagcuuuuuuuuccccagacuccauccagauguugagggagaggggaggaugggagaagccccuucaccucugagaagcagggcaggagcugaugcccuggguugagguguccuugagauccaacaaagcugcuggauccccaggugugaaacugaaaagaaauugucuccacgguuugcugucaggaaaucuaagcucuaggauguaaugagccacacaguagaguuaaggguaaauggagucauuaauacauauucacccaaggaguaggagccccuuacaucauuggacugcauccucucggugaugagcgcaagaagcacuugcaggaaggggagcuuuuaucgagauugcacuaaucuaaaggugucaagcaucagcucccagacagugcccuggauagcucuuuuuaaugaggggggacaaagguagccacacccucucuucucccacugccagucucauuacucucagggaagagagagaaguaaccaccaggcagaagaaaucagccacuggguuucuaucuuagaggcaggauuucccaccuccuucccugcauccaguggcugugcaccgcucccaccacuuuaaagcaggaaaacuaaaacaggaugagggaaggugguuugcagaagccacauagauaaaacaagauagggucagcauccaaacucaaguccacagcuccaaggaaggaaugaagcccaggaaacaguacaagcuaggcaggacacucccagagucauggugcaaggaagaacaaauguccuugguguuggugaaugucugguucuuuucuuccccauaugaaaacauaaaagucagacuuggcugccugggacccuugugcuggguggggugggcuguccuuugucagagacucugugcccucaaggcgacagacucaaaaaacccaaguacaauauuaacuguauccuccccuuucugguuagcaugucuaagugcgccacuucucugucucuuuuucacaaaguugaagugucuuuucccaugugguugcuacccacuugaggucccaagagacuccuucucaucaagguugcccuacacagucuucagcuugcaaucauaaguguaucgcacagacuuucccaggccauuuugcaauucugugaaauuaguuuucauuaagccuccucaaaagcauuuccauuuuccauguuaggaaaucuuuuuuucuaagacacacacacacacacacaugaggaaauaauuuugaaacaaagacuuaagugcauccagagcucccauuuugaagucuuucauuucauuugucuccaggcaacgcuuuaagaagccaggcagcucuccuauagaguucugaagccuccauuaacaccucacugucccacuuaaacuggggccgcggccagagccucccuuggccuccccccuccccauuguggaaugaaaucucaaauugcaguagaguucagggugcuaccuuacccuggccuuuacuacucucauuucuggacuuuuaagaaucaaaauagggacugcgggcggcggaggcugcgggggcucagcaauuaagaggaugcacuguccuugcagaggccccaaguucuauucuuggcaccuguaucaggcaacucaugacaaccugaaacucuaguuucaagagucucugugggccauggucacacacacaauuaauuaguuaauuaauuuuuuaaaacaauuuuuggcauuucgagacaagauuucuuuguggugccauggcuauccugggacuuacucuauagaccaggugggccucaaacucuaagacccaccuugucuccaccuccugaguccugggacuguaggcacgcagcgccaugguguauuugguacuagcuagagacucagagcagguacaacuuggguuucgaguaugcuaagcaaucauccugccaagugaggggcaucccuggcuucagggccuguuuuauguagguuuguuuguuuguuuguuuguuuggguuuuuuggauuuuuguuguugguuuguuuguuugggagguaauuuuguuuuuccagacaggguuucucuauguagcccuggcuguccuggaauuuucucuguagaccaggcuggccuuaaacucagagacgcaccugccucugccucccacaggcugggaagccaccacuuagcgauaaaaagaaaucuuucccucauugccucucacagacuccuuaguugcagagauccuauggugaggccuaagagaagagggugggguuuacuauggcacuggauggcacaacuuugcagaaaccuucaaaagcaaaugauuugagacacaccuuuuaaagaaacgcaucugaaauugagauuguucuguuugauugacagccauugccuugcauuuuuguucugugacagugcucgacaacaacaauuugaaucuacaucuuuccugugaccacaaauucuuucaacauuucugaucuuauaugauccuacaugagcaaccccccuccuugucaccuaccagcacgggagggugcuggcuccuccuggugggaccucacagagcaaugcccagaugcuuagcagccaucaugggaugcuacugagacguuggagagaggguguggccaccucucacagugagaccuccgcagagaagacagggagccccucagacgcaugcuaagccccucggggguuagcuucuuuccuucucuagaagcagcacucggaaagcagaggcaagaauuuccggaauucaaggugagaaagcuacauggugaguuagaggggccauccugggcuacauaagccccuguccucuaaagagggagcaggagccaacuccagacuaaucgucgagauauuuagaaacgggcuugaaaauauacuccuaagauacacaaaaauaaccaugaagcagaaagcucugaaucugucguaccagaggccaccauggaacauaaaaggcauucuaugaacuguguggaaaccagaugaggagacgcugugcccguuuccccagcuaauuauaaccauuaggcagagacugccuggguuuuaacagucagggagagagccugcuacaaacugcuucacaagcaauuaugcaagcagccacuccuucccagcccacgacacaggccacaguuggcucuagcucucggcacgucucacauuuaucccauuucuuccuuucuuggcaagggacucgaguuccaccagccucugaaaaccaugugugccgccacagaaucgugaaagcgagcggccacggcaucucacagcccaaggaaaaguuaccgucuuugcuggcuuucaggugugagagaaaaacucauccuaaguagacagaucuuguaucaguuugucuaccuccuuacugucucucccaguaaccucuccuagaguuacuacuuagaaguaaaacaaaacugugugcccuggcagggauccccggacuccugugcuauaucugcagccacugcgucugacugagcaggucucugacauuccacauucccuguaaggccauagguggguuuaaguggagcugacuccagaugccagugcugguugcugacucaacuagagaagguuccagaagugaaaagccaguuuccuggaauaguucccccugagaccugagucaucuccagcugcuggucaauucugaaauuaaaguggcccaugagcucuuccuuccagcggacaauucccaaagcacugggacuguggaaaucggggauacagagcacaugguggggggaggcuccacaaagauggcucccagugaggcuuucccuggucacuuccagcucacaaacagcuccccauauuuccugauugcuaaaguuagugaggagagaggauggcacugggcaccacacagccagacgcugcaaggugaaugguggauggugacuuggcaaagcauucucuauuuguuucauuucucccauuuuucgaacauccaaauauuuuuuuuuucuugagacaguuucacauaugucacccugccuggccugaaacucacacuguagccaagacuagcccugaauuucugaucccccuaucuccaucuucaaaacgcugggauucuagacaugcguuaccacuucuagauuccauggcacagggaaccacucccccccccccacaccaaggagcuauagaucccagauccuccagaguuuuucaaacaacagugacuccgcugccacaucuacuccaaagaaaacgugggaaacauaagauaccuuucuuccacgguauuucuuaaggccuauucaucccacccugcccccaugccuggguccugcgugcaugcuugguggaauccaucaggcaggcgcagaacauuggguggggcuggcuuuauuacugcuccuaacacuguagccacacaccagcaugucaccucucugaguaacacaucccaugaccccagaaagacaccaagacaauguucucugcgcuaucucaauagccaaacagaagucaugaauuuugccaaccugaucuugaaacuuagcauccuggagccugauugauaagcaauccugagaccauguugugggacaacuaagagaagguagcgguacucugagaugaaauucagugccucagggccucucugauaaaugaugaaaagucagagagucgacaauguauuuuaaucaucaaauacuuaaaaugagauguuuaugugaaaugagaugguuaugugaaauucuuucaaauauguuucucugcugggaagagcagcaaagggcagacugugcacccuucaagagcuaucagauuaggggacguuaauaccuucuccgggguucaaauaagagacuauacagugugugugcgagcaugcuuuaguccccauguuuuccaugggagcgcuuauaacuuagauucaggcaauguuuccuuuaaaauuugccaguugcccgaugcucuugaccuggaauuacuuaagagcagagaauguguuguaugaaggcauaauuucauuucugaaugcucauacacaagcaaggaagaaaaauggaauuuuaaauguaugcccggcacagagacugggcuggaacagccaauccuagcugccacccacaagcugggguguaaauuguugacucccuaugagcccugaaaccccacccuggaaaccgccaggaacuuggauuuuccaggcacgccaagggauacacugcccucuagagaaaagaguccagaaugcauucccagaagcagccaugugcccacucaaacuuccuuucccaaaacagacccgggauauugggaugcauuaagaguuucaguuuuaaaaccuaacauaaaauucauugcuacagaggaucucucuuuuuaagaaccaggaccuggcuggcacuccccaacaagauacucacugccaugaucgggauggcaguggguuuuauggggaauuaucacuugggguuuggaccaugagcagcaccaagaagcuuuauaagaggauaagcagaauagagagaaauguccucauguacuuuaacaauguguguuagaaccuggagcaggccuggagagagggcucagcgggugagagcacucauugcucucgcaccggaccugaguuuaguuccgaugugagguugcucacaaccacccgcaacuccagcuccagagggauccaacaccucuggccacugcagacaccuacacugguguucacacccacacaugugcgcguacaugauuagaaauauuuuuuuuuuaaaucuuaaaauuugaagcacuuucuggguuuggcugagcuaccgacgggauuuuaaaaugucacuucccaagucaccaacuauuuguguguguuuuuacugccugucugccacagccaggacaccaugugcaguuccugccugugggucagucaguggagaaaagcuuccucaguacacagugccuccuucagcccuggacaucaccugcugcccauccccaagagacaccagauucgcagcuucuuccacagaguuucauuguuugcauccugcaagagcaucuuacacaacacaguuggcaacucacuagugaauuuucaauccugaauguggaauuucgcauaaaagcagguggugucacagcacauacagcagcgcucuauuuuagccacucuuucuccaagucaccaaacguccggaaagagcgggaaagcaaaccaagcccuggauaguaguacaugucuccacccacuccaaagaaggaaggugguuucaggaggagaccguggccuugagcacuggggucuguagguuuuacuccaaaacuaaggucagaguucacagcuccagaagcugggugaauagaggaacuuucuguacucuguggucauugauacauuguagauuguacugucugaagucacagaauugcaguuaucauaggauacagcacagugcagagacacagacaguucucgaucugaaccaugcuuaucuugucucagauacaucauuagguucccaagcuugacggucuccaccagaacggggugugguacacaccuccaagguaagauacgcucuuaggccaaaggauaccucagucacccucaaggaaggcacuggggccacacccucuaguucccagacugaaaaaauccaggagaaccauucucugucacccauccugaccaucuuccccacccagugucagcugaaugccuuuccucugcugagagagagagagagagagagagagagagagagagagagagagagaauauucccuuugugacaauguaaaguuuugcuugaugaaagaugcccagacauuggaccacuguccccaaucauaaaucucucucaaagaaguucuacaccccauuccuucagccucagcagaaacccacagcacaaaauucaggcuauuacuguaagcccucugugccaucaagcuggccuccugaguggaaucccgcgugggccucccuucauuccccaugaguuguguaccuuugugaaaacugagucaaguguccuauggcuuugaacagauuguaacagaugaacagucuccucagaggggaucagucugucagcccaucccacauggagaucuaaaggguccccuacugcuggcucaucaacuccauggcuccaucaaugggaaaggaugcuacugaaagucagacacucaggugggcccggccaguaguccagcaucucagagcuucucucucuucacccauaagccaaggaugacagcacuggaaucuucuagcccagaaucacccaggaaagaagucaaaaagucccaguaguggaagcuacagcaaucaguuggucccauauuguuuuuguuaaaagcaauaugauuuuuauuuuaaagucuuuuccacauuucagcuugcucugggaagcugggaacuguccucaggucccaugaauccccuugaagcucugagacucugggguuuucaucuggagucagcucgggguagggagagaaaugacuucucuaggguguagugugcccacuggugcucauacaacuuguucuugaaguccacaccagucccuaaguuugccugggcuuuugugaaauucauuuuucuuagccuuucuccaguacuccaaugaacccuucccauuggccccacccuugcauugaucccaugguagcuugaaauagauccccaaaugggcuggcaaccauccaggaacucucuuccauccucagugagagagggccugaaccccacccagcauccucauggccagggaauagcccuugggccucccaacuuggcacaggccucucaucuggacaacccacggcagcccagucccgagcuuugccuuauccacuggggaaguugcucuaguaucacauugcgcaugcuuuaggccugcaguucccuuaagcauccucaaaggacaaauccuacaacagugacuucagauaccuaaaaugaugaagcagcagccuugauggccauggcuaagcagcuccggcccagcccugcaacuggcaccaguaucucuccaaacucggaagacagcaguuugccugaccagccucucugcacuuaagaguauaccccuacccaugacccuuggagaacccaaagagaugagcucucucugggguccacucugcagguugcccuaugcucccaucagaugccucugcaaacaaagcagcuggucuggggaaggagaagcgacuuuuaacaagccagcuggaggagagcaccagucagaagugcauagcaugcaggcagggacacacaggacacuccccgcagcagcaaaccuagacacaaucggacaauccgugaccuucagcagguuaaagaaacccuugugccacaaaggaaagaaagagcagcagacuccuaaaguauguccagaaaacugagugacggggugaucguaagagccacuaacucacuucugauugaaguguuucccucaugccacagaggaaacgaauaagcaaaaacucacacuuacccugagcggaccugaagacgcgugucccugggcuucuaaacucaaucacgcuucaccaggaugcauaguguucucucuugcuaagucuccuuuucuuccugcaacccuucuccaccaaggaacagaggauccaggaucagaagacacagucuccucuugcaauccucgcuggaagcuggagccuagagaacugagcagccuuuggggaaaggcugaacuccaaacug

SEQ ID NO: 291 - RNA, 77116 nt, Mus musculus
caguuuggaguucagccuuuccccaaaggcugcucaguucucuaggcuccagcuuccagcgaggauugcaagaggagacugugucuucugauccuggauccucuguuccuugguggagaaggguugcaggaagaaaaggagacuuagcaagagagaacacuaugcauccuggugaagcgugauugaguuuagaagcccagggacacgcgucuucagguccgcucaggguaagugugaguuuuugcuuauucguuuccucuguggcaugagggaaacacuucaaucagaagugaguuaguggcucuuacgaucaccccgucacucaguuuucuggacauacuuuaggagucugcugcucuuucuuuccuuuguggcacaaggguuucuuuaaccugcugaaggucacggauuguccgauugugucuagguuugcugcugcggggaguguccugugugucccugccugcaugcuaugcacuucugacuggugcucuccuccagcuggcuuguuaaaagucgcuucuccuuccccagaccagcugcuuuguuugcagaggcaucugaugggagcauagggcaaccugcagaguggaccccagagagagcucaucucuuuggguucuccaagggucauggguagggguauacucuuaagugcagagaggcuggucaggcaaacugcugucuuccgaguuuggagagauacuggugccaguugcagggcugggccggagcugcuuagccauggccaucaaggcugcugcuucaucauuuuagguaucugaagucacuguuguaggauuuguccuuugaggaugcuuaagggaacugcaggccuaaagcaugcgcaaugugauacuagagcaacuuccccaguggauaaggcaaagcucgggacugggcugccguggguuguccagaugagaggccugugccaaguugggaggcccaagggcuauucccuggccaugaggaugcugggugggguucaggcccucucucacugaggauggaagagaguuccuggaugguugccagcccauuuggggaucuauuucaagcuaccaugggaucaaugcaaggguggggccaaugggaaggguucauuggaguacuggagaaaggcuaagaaaaaugaauuucacaaaagcccaggcaaacuuagggacugguguggacuucaagaacaaguuguaugagcaccagugggcacacuacacccuagagaagucauuucucucccuaccccgagcugacuccagaugaaaaccccagagucucagagcuucaaggggauucaugggaccugaggacaguucccagcuucccagagcaagcugaaauguggaaaagacuuuaaaauaaaaaucauauugcuuuuaacaaaaacaauaugggaccaacugauugcuguagcuuccacuacugggacuuuuugacuucuuuccugggugauucugggcuagaagauuccagugcugucauccuuggcuuaugggugaagagagagaagcucugagaugcuggacuacuggccgggcccaccugagugucugacuuucaguagcauccuuucccauugauggagccauggaguugaugagccagcaguaggggacccuuuagaucuccaugugggaugggcugacagacugauccccucugaggagacuguucaucuguuacaaucuguucaaagccauaggacacuugacucaguuuucacaaagguacacaacucauggggaaugaagggaggcccacgcgggauuccacucaggaggccagcuugauggcacagagggcuuacaguaauagccugaauuuugugcuguggguuucugcugaggcugaaggaaugggguguagaacuucuuugagagagauuuaugauuggggacagugguccaaugucugggcaucuuucaucaagcaaaacuuuacauugucacaaagggaauauucucucucucucucucucucucucucucucucucucucucucucucagcagaggaaaggcauucagcugacacuggguggggaagauggucaggaugggugacagagaaugguucuccuggauuuuuucagucugggaacuagaggguguggccccagugccuuccuugagggugacugagguauccuuuggccuaagagcguaucuuaccuuggagguguguaccacaccccguucugguggagaccgucaagcuugggaaccuaaugauguaucugagacaagauaagcaugguucagaucgagaacugucugugucucugcacugugcuguauccuaugauaacugcaauucugugacuucagacaguacaaucuacaauguaucaaugaccacagaguacagaaaguuccucuauucacccagcuucuggagcugugaacucugaccuuaguuuuggaguaaaaccuacagaccccagugcucaaggccacggucuccuccugaaaccaccuuccuucuuuggaguggguggagacauguacuacuauccagggcuugguuugcuuucccgcucuuuccggacguuuggugacuuggagaaagaguggcuaaaauagagcgcugcuguaugugcugugacaccaccugcuuuuaugcgaaauuccacauucaggauugaaaauucacuagugaguugccaacuguguuguguaagaugcucuugcaggaugcaaacaaugaaacucuguggaagaagcugcgaaucuggugucucuuggggaugggcagcaggugauguccagggcugaaggaggcacuguguacugaggaagcuuuucuccacugacugacccacaggcaggaacugcacaugguguccuggcuguggcagacaggcaguaaaaacacacacaaauaguuggugacuugggaagugacauuuuaaaaucccgucgguagcucagccaaacccagaaagugcuucaaauuuuaagauuuaaaaaaaaaauauuucuaaucauguacgcgcacaugugugggugugaacaccaguguaggugucugcaguggccagagguguuggaucccucuggagcuggaguugcgggugguugugagcaaccucacaucggaacuaaacucagguccggugcgagagcaaugagugcucucacccgcugagcccucucuccaggccugcuccagguucuaacacacauuguuaaaguacaugaggacauuucucucuauucugcuuauccucuuauaaagcuucuuggugcugcucaugguccaaaccccaagugauaauuccccauaaaacccacugccaucccgaucauggcagugaguaucuuguuggggagugccagccagguccugguucuuaaaaagagagauccucuguagcaaugaauuuuauguuagguuuuaaaacugaaacucuuaaugcaucccaauaucccgggucuguuuugggaaaggaaguuugagugggcacauggcugcuucugggaaugcauucuggacucuuuucucuagagggcaguguaucccuuggcgugccuggaaaauccaaguuccuggcgguuuccagggugggguuucagggcucauagggagucaacaauuuacaccccagcuuguggguggcagcuaggauuggcuguuccagcccagucucugugccgggcauacauuuaaaauuccauuuuucuuccuugcuuguguaugagcauucagaaaugaaauuaugccuucauacaacacauucucugcucuuaaguaauuccaggucaagagcaucgggcaacuggcaaauuuuaaaggaaacauugccugaaucuaaguuauaagcgcucccauggaaaacauggggacuaaagcaugcucgcacacacacuguauagucucuuauuugaaccccggagaagguauuaacguccccuaaucugauagcucuugaagggugcacagucugcccuuugcugcucuucccagcagagaaacauauuugaaagaauuucacauaaccaucucauuucacauaaacaucucauuuuaaguauuugaugauuaaaauacauugucgacucucugacuuuucaucauuuaucagagaggcccugaggcacugaauuucaucucagaguaccgcuaccuucucuuaguugucccacaacauggucucaggauugcuuaucaaucaggcuccaggaugcuaaguuucaagaucagguuggcaaaauucaugacuucuguuuggcuauugagauagcgcagagaacauugucuuggugucuuucuggggucaugggauguguuacucagagaggugacaugcugguguguggcuacaguguuaggagcaguaauaaagccagccccacccaauguucugcgccugccugauggauuccaccaagcaugcacgcaggacccaggcaugggggcagggugggaugaauaggccuuaagaaauaccguggaagaaagguaucuuauguuucccacguuuucuuuggaguagauguggcagcggagucacuguuguuugaaaaacucuggaggaucugggaucuauagcuccuuggugugggggggggggagugguucccugugccauggaaucuagaagugguaacgcaugucuagaaucccagcguuuugaagauggagauagggggaucagaaauucagggcuagucuuggcuacagugugaguuucaggccaggcagggugacauaugugaaacugucucaagaaaaaaaaaauauuuggauguucgaaaaaugggagaaaugaaacaaauagagaaugcuuugccaagucaccauccaccauucaccuugcagcgucuggcuguguggugcccagugccauccucucuccucacuaacuuuagcaaucaggaaauauggggagcuguuugugagcuggaagugaccagggaaagccucacugggagccaucuuuguggagccuccccccaccaugugcucuguauccccgauuuccacagucccagugcuuugggaauuguccgcuggaaggaagagcucaugggccacuuuaauuucagaauugaccagcagcuggagaugacucaggucucagggggaacuauuccaggaaacuggcuuuucacuucuggaaccuucucuaguugagucagcaaccagcacuggcaucuggagucagcuccacuuaaacccaccuauggccuuacagggaauguggaaugucagagaccugcucagucagacgcaguggcugcagauauagcacaggaguccggggaucccugccagggcacacaguuuuguuuuacuucuaaguaguaacucuaggagagguuacugggagagacaguaaggagguagacaaacugauacaagaucugucuacuuaggaugaguuuuucucucacaccugaaagccagcaaagacgguaacuuuuccuugggcugugagaugccguggccgcucgcuuucacgauucuguggcggcacacaugguuuucagaggcugguggaacucgagucccuugccaagaaaggaagaaaugggauaaaugugagacgugccgagagcuagagccaacuguggccugugucgugggcugggaaggaguggcugcuugcauaauugcuugugaagcaguuuguagcaggcucucucccugacuguuaaaacccaggcagucucugccuaaugguuauaauuagcuggggaaacgggcacagcgucuccucaucugguuuccacacaguucauagaaugccuuuuauguuccaugguggccucugguacgacagauucagagcuuucugcuucaugguuauuuuuguguaucuuaggaguauauuuucaagcccguuucuaaauaucucgacgauuagucuggaguuggcuccugcucccucuuuagaggacaggggcuuauguagcccaggauggccccucuaacucaccauguagcuuucucaccuugaauuccggaaauucuugccucugcuuuccgagugcugcuucuagagaaggaaagaagcuaacccccgaggggcuuagcaugcgucugaggggcucccugucuucucugcggaggucucacugugagagguggccacacccucucuccaacgucucaguagcaucccaugauggcugcuaagcaucugggcauugcucugugaggucccaccaggaggagccagcacccucccgugcugguaggugacaaggagggggguugcucauguaggaucauauaagaucagaaauguugaaagaauuuguggucacaggaaagauguagauucaaauuguuguugucgagcacugucacagaacaaaaaugcaaggcaauggcugucaaucaaacagaacaaucucaauuucagaugcguuucuuuaaaaggugugucucaaaucauuugcuuuugaagguuucugcaaaguugugccauccagugccauaguaaaccccacccucuucucuuaggccucaccauaggaucucugcaacuaaggagucugugagaggcaaugagggaaagauuucuuuuuaucgcuaagugguggcuucccagccugugggaggcagaggcaggugcgucucugaguuuaaggccagccuggucuacagagaaaauuccaggacagccagggcuacauagagaaacccugucuggaaaaacaaaauuaccucccaaacaaacaaaccaacaacaaaaauccaaaaaacccaaacaaacaaacaaacaaacaaaccuacauaaaacaggcccugaagccagggaugccccucacuuggcaggaugauugcuuagcauacucgaaacccaaguuguaccugcucugagucucuagcuaguaccaaauacaccauggcgcugcgugccuacagucccaggacucaggagguggagacaaggugggucuuagaguuugaggcccaccuggucuauagaguaagucccaggauagccauggcaccacaaagaaaucuugucucgaaaugccaaaaauuguuuuaaaaaauuaauuaacuaauuaauugugugugugaccauggcccacagagacucuugaaacuagaguuucagguugucaugaguugccugauacaggugccaagaauagaacuuggggccucugcaaggacagugcauccucuuaauugcugagcccccgcagccuccgccgcccgcagucccuauuuugauucuuaaaaguccagaaaugagaguaguaaaggccaggguaagguagcacccugaacucuacugcaauuugagauuucauuccacaauggggaggggggaggccaagggaggcucuggccgcggccccaguuuaagugggacagugagguguuaauggaggcuucagaacucuauaggagagcugccuggcuucuuaaagcguugccuggagacaaaugaaaugaaagacuucaaaaugggagcucuggaugcacuuaagucuuuguuucaaaauuauuuccucaugugugugugugugugugucuuagaaaaaaagauuuccuaacauggaaaauggaaaugcuuuugaggaggcuuaaugaaaacuaauuucacagaauugcaaaauggccugggaaagucugugcgauacacuuaugauugcaagcugaagacuguguagggcaaccuugaugagaaggagucucuugggaccucaaguggguagcaaccacaugggaaaagacacuucaacuuugugaaaaagagacagagaaguggcgcacuuagacaugcuaaccagaaaggggaggauacaguuaauauuguacuuggguuuuuugagucugucgccuugagggcacagagucucugacaaaggacagcccaccccacccagcacaagggucccaggcagccaagucugacuuuuauguuuucauauggggaagaaaagaaccagacauucaccaacaccaaggacauuuguucuuccuugcaccaugacucugggaguguccugccuagcuuguacuguuuccugggcuucauuccuuccuuggagcuguggacuugaguuuggaugcugacccuaucuuguuuuaucuauguggcuucugcaaaccaccuucccucauccuguuuuaguuuuccugcuuuaaaguggugggagcggugcacagccacuggaugcagggaaggaggugggaaauccugccucuaagauagaaacccaguggcugauuucuucugccuggugguuacuucucucucuucccugagaguaaugagacuggcagugggagaagagaggguguggcuaccuuuguccccccucauuaaaaagagcuauccagggcacugucugggagcugaugcuugacaccuuuagauuagugcaaucucgauaaaagcuccccuuccugcaagugcuucuugcgcucaucaccgagaggaugcaguccaaugauguaaggggcuccuacuccuugggugaauauguauuaaugacuccauuuacccuuaacucuacuguguggcucauuacauccuagagcuuagauuuccugacagcaaaccguggagacaauuucuuuucaguuucacaccuggggauccagcagcuuuguuggaucucaaggacaccucaacccagggcaucagcuccugcccugcuucucagaggugaaggggcuucucccauccuccccucucccucaacaucuggauggagucuggggaaaaaaaagcuucuauuugggcugugucucuuuugucucuuggagccaucagguaccuagggagcugcucuuccgagaugaaugcucaggccacucauauaacacgagugccauuuccuuagagaaacucaauuagcugguggcuucaaacaucuucacagagccauggcaucaccgcuuagggaccauggaaggcuaggaaggagcuuuagggguugcuccagcgugacucacuaugugacuaacacaugguaggauuaguguauucaaaggaguccccugugugaggggcagggaucguuagcaaaacgacuccauaugacucacccacagugagcuuucuguccauguggcuugcagaguauuuccuguccuuaauguagacucaacaguggucagacagcccuuaccucaggccccaccuauccccuuucauagaucccacgacuauugccucauagcgaggugcuagaauauucuuguauccuaauucucccacaagaugcuccucgaaagaugagacaguggcucagcuagugaaguccuugccuugcaagcuuggggacagaguuguauccaagacccacauaaaaagccagguguggccgugcacaccuguuguccugucucugggaggcagaggcaggauuccuggaggcuuguaggucagccuaguccaaccggugaaugcuggguucacuggaagagauuuugucucuaaucaugagguggaaaccaguugaggaaaacacauaacacugaccucuguccucuccacacaugcacacauauucacacauaugcacaugcacacacaugcacacauacgcacccacucacacauacauacacaauguuacuuaaagccucacauuuccugaaugaauuaaauauuugaaaucauugaacuagaaugcuagaagaccugcaugcacaucuuuugauugaaguugugauacauaagacuaauggaauauuguggcaggcuguggcauagcuggguuuagagucacaaaagaaugcacucugucccuggggcauagcucuuucagagauguaguuuggugcacaauggugguaaacauucagaguuuucacauauguugaccugucauuaaaauacagcucuagacuaauuacaaagccauuagggacucuggaggaacagacugugugucuggagaggacccagaaagaugcagguucuccaucaaauaucugaaaacccaaccaaaguagaauguccugaguucacaucaucaguuaauuuaacacacacaaacacccccucccccacagagagagagaggggaggggagagagggggagagggggagagggagagaggaagaggcagacaucuuuuuuuuuuuuuuuuuuuuuuuuuuuuuuuuuuuuuuuuuuuuugguuuuucaagacagaguuucucuguauagcccuggcugucuuggaacucacccuguagaccaggcuggccucgaacucagaaauccgccugccucugccucccaagugcugguauuaaaggcgugcgccaccuuagaaaggugucuaggguggaacauggggugggcaguguucuauagagugaaugggguggagcugggguagugacagggugagagggugaccagcccaucagcaguggcuugcauacuggcugugggcagaguccuagcaccaccacuuagguuacaucaagacaugggcacacuguggagucagagcgcugaacaccacagacugcuuuucagagcugugcguuucugagucuaagaggcaaugaacaugccaagccaggaaaaugggaccggguguuuguacuguugccacaaucugacuacacugaggaaacaaaugugcugagagcuugccugauguucuggggccgugccuccuuuccgcugccgacacguuggccgggguaguuguauugacaggugguucaguccccgaaggcuuggaaucugagcuacaagcagguucugagucacaggugaugcucaugguuaacuucccugggauccaacccauggugggucugaaaauugagucucuugauuacggucucaucuuugggcaugccauaccucagucagugcugugucccauucuuugaggcugggcuuggccucaggaaggagacuuaauggcaaaucuguggaugagcugcaaguuucuaugcacuuuucucuaucaucagguggcagccucagaaauauucuucucuccuaaccccugccccucccauuuugccaaguguccugccuucuccucacucacagcaaagcucugccaccaaauaguuggccacaguauccucucccaccagucucccagugacaauuuuggggccaugagaccaucucaucugggaaagugugcacuuguguuuguuggacaaaaaguagccagggaggaucacaagaccagagcugaaccugugggaggaaggucaggcucagaugcacaaacuuuggccuuagccagagucuguagcaugcuaagauaccagaugggggagaugugacccugguagcagguguuuaugcucacacuaaauucuuauuuuucauaaaacucacaccuuucccucaaacgucauuaucucgcuacuacaugcuugccuucuuucccacguguuaguuacaagcagaaacaacagugguguuauuugaauaccaggacacagacacguacguugcuucugucuucagcacaaaguuugguucuugaaugucuucuccugcuauuacacuuuccugguuucauggagucuuguucuaacugcauaaugacggaggcucuugugcauaccaugguacaugaccacuuuguucuccuuccuuguuuccccauacacagacucaaaccuuucccgagacaagggauauagaagcaguuuacaaguauuuggauuuuuaauauaaugagagagagagggagagggagggagagagagagagaaagagagagagggagggagagagacagaaagagagaggggggagagagagagagagaggaagagaagagaagagaagagaagagaagagaagagaaaagagaagggaacagaggcccuggauuauaguccacauugauucaagauagaguuuuaauucacuagaagagccucuuauacuguuuaauauccuaguagugaaacauaaauuaugaaguaagccaaauaucccuagauuaaaugauuuucaguuucuuaaaccagacagacauuccccuuuaaccauagacuauucuaggugauucccacuaucaaacaguauguuuucaaacucaguacaaaagaaaaaaggugagauucugaacuaguaccgaugauauuauuggcucuggucccucccugggccucuuugaaguacccuuggucgccagcaucuuuuagccuuuucauuuacucaccgggagaugcugagucccaccacccaaggccaugggucucuaauggcaggaaucagugcuucggggcacagggaagagggggagaaggaaggagaccucagccuggauggaaucuccaagcaucagugcggaaccuugagggauacuccagccccaagcugauucaugacuggacaggagaggauggggaggcugaugagaagccugagggggaagagaugaucuugacagacugaugacagagccuacuaaacauucagaacuugaacuugucuggaagucauguuuguagcugcuagauggugcaugaugggaaagcaggugaugagcacucugcccucagcucuggcuucuuugucucccaaacugaaccuuccuugguuuguucuguggugaugagauuugagguuggcaaaugacagggaaagugcugguuagcaagggaggaagaggcggaggagcuggacacagaucucacugccucuggcuaggcagagccuauuuccaucaagagggccaguaucccccugcaaccccacacccucuguguaugcgaagcaagcccuuuacucuccauuuucucaggagcaugccgucuuccaguugcugccugccucaauuuggaaaaagaguucguuauauaguuccugaccauggcugauguauguagugauuagaguuagagauucucccuucgaggaucaguuaauaagacucucagaagagggugcccacuuagcucauucccuaguaaugagagugaagagagaaaggacucagaggacucaucuccugugaccagaacccacauggggcuuacaacuaccuguaaauccagucccaggaggaucugacacuuucuucugaccuccaggagcuccugcauguacaugguacacacacacacacuugagcacacacacauacacacacacacauauucaggcacauauacacacauauaugauaaaacaaauaauaaagucuguggccccuugggaagagcucuguauacccaccuugucucugcccuugacacccaacuuguauguagaacagaagaccagaccaagggccccauacucguuaggcaaacgcuuuaucuccaagcuauaucuccagcucaccuuucauguuuuauuuugacacagggucucagugaguuguucaggauggccuuggacucauuuuguagaucaaacuguccuuguauuuguaaauuugugaucuuucuacaucagucuacaguagcuaagacuaugggccugcaccauaggcaagugugugugugugguguauagucauauaucacuuagaagugggggcccauucugaaaacugcauuggguggcuuugcccuugagggggcaucagagugcguugugagagaacuguaacaugacucgguaauaaaccuugagggacuacuguugucuacccacuugcuuguguauuuauugucuacucauuuguugcugguucaaacacuaaucacacacaaagccuguucagacaucaaaaagcacacaaaaaccaaaauggauuucggagagcuaaaaacuaaucauucucuucuccuuguccuuucuuuuagguucacacuuggugcuuagacauucaaaaugaggaaacaccggcaucugccccuaguggcugucuuuagccuucuccucucaggcauugccacgacucaugcccaacagcauggagguaagguuuaauuuuguucaaaauagaaguuacuagcuguguauuagcaguguuugagucuagagcaaaucacccagagcuucacacggggccuggggacguugagagucagcagcaugugggcgggcuuuacaggccuuucagaugcgguggccaggggagguggcuuuucuguuuuucuuuuuucuuuuuccuuaucuuugucuucuuuucauuuucuuucuuuuucuuucuuucucucuuucucuuucucucucucucucucccucucucucucucccucccucccucccucccucccucccucccuucuuuccuuccuucuuuccuuccuuccuuccuuccuuccuuccuuccuuucuuccuuccuuccuuccuuuugucgucaucuucuucuucaacaucaaauauuaaguugcuugguagcagaauuauuauucacauugggucugauuagagucuccaucccaugaagccugccaucugagggaauuccccacaucuuuggucugcaggaagaagacaauuauugugauaaaaauucuuuccuuaaaacaagaaaauaagaagacacaaaacccaacuuccuggucucuaaccguaggcacagaaugauaguuauacaugggacuguugguucuuuaacaaaguuguuuccuuaaacaacuuuauauagcagagaccccaauacuccaauuaagaauuugcuuucagaauuuuagggcagcaagauaagccuucuauguuggaacuggaagcccugucuccuuaucauuggccagggguacugguccuucagcagccugucuauaaggcuggguuccuuagauggaagggaaaguagccuaucuuagugggagacuaucaaggcuuaggggccucucagaaaaaccugggguaaguagaauuucagaagaggccuggcugcagcuucugaaggaucuuccaagcacuuccgauggccuggucccagggugucugucuauacuugugggggaaaccaaucauccuggagcaagcacaguacugcucaggguguaggcaggcuccucugggauggagaaaugugcuaacugcucagagggaucaucuucauguuaaaauauccaagagaaacaggacuucuuccucuaaauaucccugguuuccccacuuacagaguugcuugucucauuacauuucuugcaaguuuccugaagccccgaggguugggggugaguucacaaugcaucagugggcuccuucugccucuguuggggccacucucuaccucacauugaggaacaggcugcucaugguagucauuuaccaaagacaagagaucccuuuggucuggucagauggacauaagagggucaaauuguuacagucaugccucaacucaaaggcacccaggcuuguuucuccucuucuggaauauucugcugaccccugacuuggggcgacucaguauggaacaugggcgauugcuggguauagcagcagcuguguccucuuucuuggcacugcucugcagguaagucccccuacuugcccucauuuaacugagaugugugacguauuugguaauagcagcagauuugcuuuagguuauuuagaaagagguaaauggacaggaggccacugaaucgguagaaaaaccugaaccaaugucuuuuuuuaaagaugucaaaaacggugcggcggcugacauaguguuucuaguggauuccucuuggagugcugggaaggaccguuuccugcuuguucaagaguuucugucugauguuguagagucuuuagcugugggagacaaugauuuucacuuugcucugguccggcucaacggaaacccacauaccgaguuccuguuaaauacauaccacucuaaacaagaaguccuuucucauauugugaacaugucuuacauugggggaagcaaccaaacuggaaaaggauuagaauacguaauucacagccaccucacugaggcuuccggaagccgggcugcugacggagucccucagguuaucauaguauuaacugauggacaaucggaggauggcuucgcucugcccucagcggaacuuaagucugcggacguuaauguguuugcagucggaguugagggugcagaugaaagagcccuaggagaaguagcaagcgaaccacucaguaugcauguuuucaaccuagagaacguuaccucacugcauggccuaguagggaacuuaguguccuguauacacuccucugugaauccagaaagggcuggggacaaggaaagccuuaaagacaucacagguaaugccuucacugccaggcugcucccugccuugcugcuguguggcugugagcuuggcaaauacuggcaacauagugccuaagacacgcuggggacuuagggaagagauguucucgaacuuaaaaacaaaggcgugacuauccuucuucagucuccuucaaauggggacucagggaagagauguucucgaacuuaaaaacaaaggcgugacuacccuucuucagucuccuucaaacacagccuccacccguaucaagagaaggcuucugaaacagccagcguuugaacuucaaaccccacauucugauguuagaauguuagaauguccaggguuaguuuaccuuccuuaagaagaaagcuguccuuggaugggcauacaccuaggggcagagagcaccaggaggcacugggcugagggaggagaggaagcuugucuuugcuuuaaagauuuuauagaaucagaggaaagugccuuagcugugaugugauucaaguuuuuuguuuguucguuuguuucugcuuuagaagaaauugaguccuaaagggugggugaaagcuugggaaagagcuauuacugagcugugguguuccugcccauggucuacacuguugugucuuuugugcccugggacuguaacugugagacuuuucagcuucuaaugcccuacucacggucacccugggaguaugcagcagccgguggccgucgcaucauauguuaacauuacacggugcgacaggcugaccaggugacugagagucuuuaaaucaaucacgacuacugauuuuccuuccauggauaaauguccaaaagaaugagagggaagaaaagugacaagaaugucaauucuacugcuuaacagcaguuuugccuaguggccaggaauagcuuucucaucagcuaggggugggggacagggcacccugugccagagcacagguccuugaaggacacaaguaggaaagaaugguggggaguagagaggcaugcugggagagacucaccucuccuccagaagaggaagggucugcaucccuaggauucugggauggggaagcugagcuccuagguagaaugggcaggaguggaggagagugucaggucugggagccugggguuggagcuauuuggaacaaagaucacagagauaugaugaaggcucccacuugggaaaugacuguggacuugcaggaacacucacuaaaagccagagcuugccagccagggggcaucucaucagugugucccuccccuagcuugcuucaaacuccucagguacauucagaagcaaaagaauucccagacugggcguuuggaacgagagaacugcucagguaaugcagaguaggagcuacuagaaccuuagccacaccuucccggggacucccagcaggguggagaaggaggugaaaugcuggggcauaugaggagaauucucagagucacaggaugagacaccggacuguccuuaagacaguugagcguguauggaagguacagccagaauuguauuuaagagggcguuuggaaucaugaaguuggagaauuggagggguugcccaugaggcuggaagggcaaccuaugcccucuagagaggucuccuaugggaggggcugaagagcacaauggguucuugacuagggaaagagugaucuugcagccaggacucaggaggcauggcauauacagcccagaggaggugguagagggagucaaguucacagguagcuuuucccuucugccaagagaaugacugaggcagggggcuggagguaaagcauccggugaagccagucuccuucaaggaagaugcuaaggagugagaugaagaugcaguagagagguagagacaugagucaagcacucuaaggagcaugugggacacuuaggggagacagauggaacagguggcaagccuuugggauuauaaucagaucaauaggcagcucuaagaaaacaaugucagaccaguuucaucacagggauuuagaaaaagacaggcgaagagagaggugguaugugucagcagaaagaaaccuguugccauggacaugcaaggcuucgguauauagggcugugggaaugacacauccuaaggagcuguuucugaaggcugcucuuccuuuggcuuccccaugguuccccaugaucucagccuugguaggauuggggucaccaaggucuaccaaaugacagagaggagacuaccuggcccacuuaucuguacuacuaggguucccugcuucggggguugagggcgugucucuccucuggcacugcuuuacaauugccagguuauaggaaacaaauauguauucuagggaucacccuggaugguauuccaguuucagagggaaugccaagggggcacuuggggcagccguguguguccaccaagagucucugacccacuccuuucacaauauggguauaauggcauacucauuugaaaaacgugguuaguagagaauggcccguuuuuaaaguuaauguguuggcaaacuugcaaacacaaauagaugauguagucauuauauaaaugauagaaacugaaauggccacagcaagagcaaagagucuacccacugcauauuucuacacagcuaaaaaccuuuguuuuuaugccaagagagcaucucugucuucucugucuaagucacuggcagcaccgggguggagcauuaucagucuguugucuuuucugauuaacugcacucugcaauuccuccguaucacgucucacuggguguucguuccauagcaagacugaaguaagauaaaaggagcagccaggaucauaaucgugagcccugcauaaaacucuggaaaaggcacaugggugguccgacugagguugcugcagggaccuuagauguucccuguggacuguucuugauucuaacgugagagcacacacgaaaaggcucagggaucaccauucugcauggacucugcccugcuaguuagucuugguuguuuuuuguuuuuuuuuuuaaaucccuuugucacccuuuggaaaugggugccacugagaugggagaccuuuauucuaaaagagaagcugaaggcaauucugaggcucccugcaugcauuuucuuuauaaauuguguuucucacaggaaauaggaacuugauguuucuugggugcccgggcaacuagggcuuaggcuuagugaucuuccauggacaucuugaacucuuuccauagaaagcaccacagaggguaugacccccgagacacgauguagaccaccagccagcuuccacacuuuacacuuucaggcugaucuuggaauugguguuggccguuggugcgccuugcugcacacaagaauccgggacccccgccugggucucuguguggcuucggcucucacggcuaacaaagcaugcucuguguguuccauuauuguguguguaagagaaucaugguucugacucagugaugacaaauuauccaucauuuuaugaccuaccacuggugauguucagcccauucucccacccagagagcucuugagugguauauacaccauuagaaauuguaccaaagaaugguagagguggauauaaggaaggcagaaucaugccaugcaaugaccaaagaucuguuuauugcccaucuugaauguaaauaaacuucuuuuaaaaugucuagauaggauguguaauaaacagguccuucuauguccuuugaggucacuggcuuagaccuggggacauggggacauuuuauggugcucuccaugcaauggugaaagccauuuuuaugaucugugcaguucacauccccugguucugcauccucuugagaucccuucagaagucuggcugaagacggguggauacuuuggaauuugaacccaggguccggucuuauguggauuuugucagacaguuacuaacacauaagaucuaagccacuggaacaaagcaauuguccucuuggaucuuguuaggacaguggcaacaacauuccaagucacuaccucucuccaugcaaaggguuaagcccugaagggguugucaaugcaguaaggagggagggagggaagaucguaagaucgugccuaagccaggcacuccccgcuucuccucucaggagaagaacacugcccaagagaaaaaauuccaacgugcgagcugagcuuucccccagugagaauauaaacagauuuucuggcacaaggaaaaauuaaauuuaaauauaaaacacucgcuggcacucaaaacucugaaugaaugguccuuucuuacauuccgguguaauaacuaugcuucaaagcccuagaguaugaauagucauccucaugcagcggucccucuugucccccgugcacccuuaauucauuaaaacauuugcuagguugauucuucccuucuccuaguaugauuuuagugcacaaguucagcuuuuggaguccccuguucugguuuguagguucacucacugcucccauuuauccaagccucaauggaaccccaguuccagcaauggaaaguucaaguuucccucacugggaaaaagaggucuuuggcagccauuucuauguccuucgaugaugacaacacugauuggcuuagggucucccugccaaucuugguucugcuaggcaauccacuaggaugucauaaaaugagguuggauaauuaugucaugacuggcuucacaucacugcuuaacauuguucuccauuauuugacugaauacagaggcaaugccaaaccauuucugauccuagucccaccuuuggauaucaugcagccaagcuccugagagaugauuggaggauccgacacaugucaagggaucugaaaauuaagacuuuaacugugucugaguuuuggaucccagacuugcaugggucauccauuuugauuuuccagaaacaaaacaacaauaguuacccagagaauuaaguaaucuggaacuaucagucacugggccaugaaccugggcuuuuguuugcuaaacugugcacuugcaucaaaaucuucauaaucccguaaggagucgggagaaaugaacacaaauuauaaacaaccuuugaauuuaugccaaccuaaucaucucuccugcaacauaguauccuauaaucagauacaauuauacuucccucuaaauuuagaagaaaaauccauccagaauguugauuucucuugggguaugaugcuuugaaguuuaacugugaagguaucgcagacaaaaauuugcuauaaaggcuccuacuucaaccacgaucccugagacauugccucuuauccacucagaauggagaacugaaagagacuucacauuccuucauugacauuguguuuuguuugucuguguuucguguuucuuguugguuuccaaggaaacacgucugauagccgggaugaugcauguuggucacuuguucuaaugcuuucacuuuuuuuuuuuuuuuuuugcaucucuuucuuuuaaagcacaagacucagcugacauuauuuuccuuauugauggaucacagaacaccggaaaugccaauuucgaugucauucgagacuuccuuguaaauguccuugagagacucucaguuggaaaccagcagguccaagugggggugguacaguauagcgaggagcccauaaccauguucuccuugaauagcuaccccuccaaggcugcaguucuggaugccgugaaagggcucagcuugguugggggggagucggccaauauaggccaggcucuugacuuuguaguggagaaucacuucacucgggcagguggcagccgcguggaggaaggggucccccaggugcugguccucauaagugcugggccuucuagugaugagauucgagauucggugguagcucugaagcaggcuaguguguucucguuuggccucggagcccaggcagccuccagggcagagcuucagcacauagcuaccgaugacagcuugguguuuacugucccggaauuccguagcuuuggggaucuccaggagcaaauacugccguaccuuguugguguggcccaaaggcacauugucuugcaaccaccagcuauugucacacaagguauguaugccccuuuuuuuuugccaucuauacaggaauggggguguguuauaugguauuugucaugaaaggaaaguggacacuggagugauucaccuugggagaaccuguaaguacucacagccagucagucaucauucugugauguacuggcuucuguauggcuugugugugaccauugcauuguccagaguggagcacucucauggguuguaaggaaaguguggucuuuaggcuaacaauguaacaaauauaaaauguaacaaacacacugcuuugagcuauuacauggauacauuaucuguucaucauacagucaucuugaaagaggcuuaagggauucaucacaauucugagaaagccacuccaggguaaaaucaguacacucauaaauagugucuucccaaagucagugaaggggugugguuuuugcuccugucucgguguaguggacaugagguacaucucugaagguaagacucagccaagucccugcugaaugggguaguuacagaacauccugguccuguuuggaacaaauugguuugcaugacaugcuucagcagcagagucaacuagagucacuuaaggaaugcaagccaaccaacaucauaugagagauacacacuuaaacacaggagguguggggacaccagaaggcugucagucugggauuccaucacagauggugucauuuucaugacgcuagucaggcagugcaaacuguccaguaagugggggacacagcugcuaccaaaggcuucaguauccauagguacccaauucaccucuuccgggucuucgaguagggaugcacucagaucagucuugaacacaagacccuguuucccaucguuguucagcagaguacaggcuuagugaaaaugaguacaugaaagagacuuaugggagacucugguuagugucugcagccuagaauucgaauuuuucuguacagaacuacuugugugucuagcuacguuugcuaacucuauaaagagccuggaccuaugaaaugacucuugucauaagcaguuuuuaccuguuuuaagcccaggguuccaggcuggguuuucuuagccaaaggggugacuguggucuuaaaaucaaauguuuuggugaacaugucacuauaugaaaugaacaguaaaacucuuuaaagucugaaugaaacacuuuaagacucuccacuggcucguguauggagcugcccucugcugcccggcacuugguuaacuggcaguucuaaucauagcauggugcuaacagagaccuggccacaccuccucagugugaaauccauccagaaucaggauagcuuccuucagauaaguuuaaaacagcucuggugauaauggcgguugugacaggaagcucagggcuccaggacauuuucaccuaacuucggcaccagaacuguuagugagaaccacuuuccugggaaggccuuugguaaaucuggguucagauucucugaggggaaacauggaagaaaggguacucuaggucuguguccugcccagcuguagccugaguccugcccagcugugguuugagcugcagcuauccauccagcugccuugcccuggcucugauggucaaggaaacagugauggggaaauacacagcucacugaugcuucucugagccugcaugcacuggaagcaaaccguuguucuaugguuuaggaacaggaucaacgccauggcuaccuuugggaggacuguuuuuuguuuuuuguuuuuguuuuaaaugacccuggauagaucauacaacaucucugggcucugauuucuuaaauucucauccaagaauuuacuggaugaagauaucuuugccuuaagagacgcuucaaaaaaaaaaaaaaaaaaaagagacgcuucaacaucuguauuuaaaugggugguaugcugccccuuguauuggauuucuuguaguuaacuagcauuuuagccccuuccucacagacaucacggugagucucagugaugaacucauaacucauaacucuuuagcacauaucugauaugugcuaaucacucuggcaagcacuggagacaccgggaggagaaagagagauauagucauugggucugucacaugugagcuaaugaugaaacuaagccaugucucaagugugacaagcuacaaggccaccaaagaggggcugggauagagaggaugggggcaggggacuuaguagaacgguuugcauaguuauaggacagaaaugaucagggaaagaagaguugagagaagggcauucuagacaaagggaugagcagacaggguggccuugaaucaaaaagugagguccccacccugaccugauagacagaugacagcucagcuggagugaagggggcacagggaagggcuugagaagcaaugggccugcgggaggaagaguuggcagauauugcaguuuuaagugggagaucagacccuucuauggcagcagcagcggaggacugagcagaaagcagaguccugagguacuccuuuuggagaacggggagcccagcuuccugggggucucccacuguggcacguuggugucaucacccaugugugcucugaggucccagcuguagagcacaggcuuccugauugugcaucuguuugcuggaugccgaaaggagagaagggaagagcgccacgguuuuucugccaggagagucugguggggagauggggacagggcaagugagggcuggugaaucagagagcacaugaggauagacccagggcggggguugugaggcugagaguaguugccugagggaagaggaaggguugaagaucagauuugagaacucaguagaugaagaaguggggauuucaguugacugaaagagaagaggcuaggaagguagcaggaugugggagauuucagggguguauaugaucuguggugaccauggguaauaggcacuaccccagaaacagcgaugggggaucggaggacauacucacggcaaguccugggggcuucagaugaccauucccaaguccuuuagcagauauagagagaagagaauggauagauaggguuccaaggacagggcauaauaguaccacagaaggaaaggcaguuccuaggguggggacagaguggcuaauugacaggauuuguuuggugauauuaaugggaagaaugaggauacccuuuuccaacucacaagcuuugggggggggaauaggggucuugggguguccuguuguccaucccaggaguaagggcugaagagguucauucauggcugagauuagcuggaccuucaaggacacuuccuaagagacaaugacuccuccagucucuggggaagagauugggggcaggguguggauggugguggugaggaaguguuggucauccuugagagaaucaugagguaugauagcuaggugugagaugguccauuaagcagcuccuccaucccacagaaagaggauuccagagaaaggaccgguccugagaaggcucaucagcuagugucagaagcaugaggcgaacauaggaacucagucacucuuugagugguuugggacuuuuuuucaguccuuauuacaguugccuaagcaucauuccaggugucucccuguuagcagcuuccagaacuuuaaacacaaaccaaaccaagugaucucucccauaauccaagaggacaugucuuauggaaccugggagccccaaggcauacuguagaauccucaaagcugagucugugguagauaguuuccaugucucccacauguggacauuuguccuucucauggaccacugguaaaauguauggcgaaguguuaaaacuugugagguaguaagugugacuauuaucagguuauaaccuggagauguucaugaaggagcaugcugccucaccaugggguggccaucccauggauauuugccuaucagucugcugugugagagaggugugauaaauaugugugcuacagauauggagcauuauaugugcaacauauauguguguacacuugugugcauauuguucccagugacacaagaaacaagaaguccacuauucaaacacaugugcacuagguuuaucugcaaagacauuuuauauuacaaucaauguugccaccccacgagacugcauauuccaaacugaaggagaaaagagaucccugaauaggucgucauauccguguuuguggccuagggagcaagggcagguaaugucgcauacacguuggcgccagcagguaacugggcuucugggauccaagucuuaugcagaaagaccucccuccuggcagaacucagcuuugucuccuuugggugcaaagaguguuagaggaggcucugucacacuaaugccauucguuauggcaguccgagugacccuggcccauauuccuggccucuggucccugagacuaggaaugagcuguguuuuagaacacgccaugagagguggcucugguucuuagaacacucuuccuugccuuuauuucuaacguucuuucuucugcuggguguaaaacacuaaguuguuugacacaaaggaccuacagaugcuucuuugugaacacacccaccccagcucagcucacuuagacuccuuacugucuaggaggagccugagacaucucaagucugguaggggcauuguucccaucccuugggcagguuguacauguucagagacaguggcugggugaacucacagccacugccagcagugaucuggccaaggugauugcuuucgugguuugucuauguaacccagaucaugacaugucauugacugccauuuccauccuggacugugaaguaagugacaagcuguggcugacuuuggugggguggacccuggcuccuuuuccaagauuuaugauaaaccaguaaaccuuuguuuuugcuugccaaaggaagccauacaauauugaaccauagaaaauggagcaguccuguuccacuucacguuuguguguggauucuaggcuagugauacaaagaguuuucugagcagacacgaguuuuauuccuuuaaacuauguugggcaacaaagagucaauuaccucuuuagugguggcgucuucugugaagcuacuucugaaacacauuacagguaggugggguuggaaaggagccggucccucauaugugacaguucucccaagggcauuggccagggcaagggagaguauccuggacauaguaggauuacagugucucugcugaaccugaucccaggggccauacuguucauccuuuauuauugcuaucuacagucauggaagucaacaagagggacauagucuuccugguggaugguuccuccagccuggggccauccaacuucaaugccauccgagacuucguuaccagagucauccagagguuggaaauuggacaggaccugguucagguaucaguggcucaguaugcagacacugucaagccugaguucuauuuaaauuccuauaccaacaaaagggaugccauaacugcuguacggaagaugagggcccugaauggcucagcccuguacacgggaucuucucuggacuuuguucgaaacaaccucuucacuagcucagccggccauagggccgcugaggggguuccuaagcuccuggugcugaucacaggcgguaagucccucgaugaagucagccagccugcccaggagcugaagagaggcagcaucauggccuuggccguuggcagcaaggccgccgaugaggaugagcugaaagagaucgcuuucgacuccucccuggucuucauucccgcugaguuccgcccugcucccuugcaaaacaugcugcccagccugauggcaccucucaggacucucacuggaaccacggaagguauggcggcuguggauuacacaggcaggagggggcugguaggcagaaacuuugagaaauacccgcuggaauacuguuuagccgacagacugcuguuuuguguugagaacaaccauuuaguucuccugcaggguugaaacaguagaguugaaaaugucccucugcacaugcaugugauuuuaaacuguagcaucacagggucaccugccuguacagcuuuuggccacagaagucacucucaguucuuugauggacaucccuucuauuuuuauuagugacucuuuccaggaaccuccccucagcccaggacuuuccuuucccaagcugacaggaucucuacucacagaugauguaguacccucagcucuuagccccuguuuucgcccuguauaagggagccucuuaaacaggaaaacaugcugauagaugggugugaagacccagcccgugguccuucagcucccucacuuaauaugauggacagugcagaguuauuucuagagacacugaagcgcucagucugugaacuggguaaaugcaaaccuucauccucagugaagagaagaugaauauccuggaauccagcuuuccccucucacagaccaucacacagaagggcuguacagugcaugaaccuacugcaugggugccugcuugcuccucagaccaucuguucuugagagcccucaaauucucucucucucucucucucucucucucucucucucucucccacucuuuuauagccaaaguuaaaugcaugaacauaggauccaguuagucugaauuacaauggggcaugggaggguaguaagucuauguauccuucaguguccauaggagauaggccaauucccuccaucugugaauacagaaauccacagaugcucaagucccuucuuuaagaugguacaagugcccaaauguaauuuguauauauccuccuauauauacuguagcaaaugcaaggcuagcauuguagccaauuauauaggaaguacugagaagggacaaauaugauuuuuuucccaaauauuuugagcaaugguugaaucccuagauaugggacccacagauaagcuuuucuucauggccaaacacaggauacaaucucuucgucacccaacuucucugcgacaagacacaugacaaaaucaaacuaguggaggaaggcugguucuggcucacagccugaggaugcugucugcaguggugggggaguccugggagcaggagcuugagguagcuggucauauuuguagucacaaagcagagagagacagaugcuggcacccagcugggacguucuccuucuuccucucgcccaggaaggaccccagcucacagaaagauggcaucuccauuuaggguggaucuucccaccucaauagcucaaucuagaaacucccuuauagaauacacggaggccugucucuuaggugauuuuagauucugucuaaguugacaucuauuuuaacuaucuauggugcuaccaaacccauggugcugccacaucuccuuggaggcuuucuccuggguacccuauuacuugguacugaaaugaccccuaaucagaaaggaggauagggggaugaagacuccaguuguaggaccacauccuuugauuggcagacauccuuugauuuaaucuuugauuagagaagcuguguuccaagguccaugugggcugauguuucuugaguuuugggguagaaagaucccucuaugugcacccaggugagucccagaggguccagccagcauaggcgagcauccugugacuggaucucuggagacaaugagcaacagaagggccagcacccuguggacuucaguuccagggaggaaacacuguuuuaggacucuucuagugauguugguuguaaacauucuaacucuagcacuuugucugucugugagccaucucgguuuuguacacuuggcuaucagugugccucacaaacuccagccacugcaaggggaaaauaugcagccgcuugccauauuuuaccagaugacccgcucugccacguugacuaccucuguguucugagugugccaugugugcccaugagggcacacaugggaagcccucucaggggcaugucucacuguguuuucugugcuucacugcaguucacguaaacaaacgggauaucaucuuccuuuuggauggcuccgacaacguugggaaaaacaauuucccuuaugugcgugacuuuguaaccaaccuaguuaacagccucgauguuggaagugacaauauccguguuggcuuggugcaguuuagugacacuccggucacggaguucucucuagacacuuaccagaccaaguccgagcugcucgcucaccugaggcgcuugcagcucaaggggggcuccggcuugaacgcaggcucugccuugagcuauauccaugccaaucacuucacggaggcaggaggcagcaggacucgugaacacgugccucagcugcugcuccugcucauggccgggcccucugaggaugccuauuugcaagcugccaaugcccuggugcgcucaggcgugcugaccuucuguguggggaccaaucgggcggauaaggcugaguuagagcauauugcuuuuaaucccagccugguauaccucauggacgauuuccgcucccugccaucuuugccucaacagcugauucagccccuaaccacauauguuaguggagguguacaggaaguuccacuaucccagccagguaaaccucccagcagugugggccccuuuccuucuccagaugccucucuggcagcaguagccaaaggcaccucagagccugugacuuguggaagaaugguggguucauuugggcugggacugguuaaagacaguguguuggcaaauguagacccuaaguguagaacauucagcuaugcccuguucaugaugaugucucacauuuacugagaagaugaacaagguggacauucuagaguucauaagggagagggggcaggggaagggaagggaaggggaaaaagaaggaaggagacagaaaaauugaugaugauuuguuacaugacuauguauuggcauccuuuaaagcucgaaaucuuccuuuauucagacucggccauguuuaaaaagcaccugaauacaacaaagagucugugucgcuacuucuguggcaggugguuacuauuaugucccuuagugguggauacacaagaccuaccagucagauggguagcaagccugagccaauggcuaucucaccgaaguaguucucagaacuguuugagauauuuacaugauggugugcccccugcccccuugcugucaccuguguuuucuacaguccaguuuugguaaauuggaaauguuuguagagguuuuaacuuuccaccucccaaagcaccggcagguauuauuuugagucuuaacucuugaccuuacagguucagagguucagucuauuaucaucaagacaggagaauggcagcgcccagacaggcauggugcaggaggagcagagaguucaacaucuuguuccaaaugcaaacagacaacuggcuucuaagcagcuaggaugagggucuuaaagcucaugcccacagugacacacuuccuccaacaaggccacaccuacaucaacaagaacacacuuccaaauagugccacucccugggcuaagcauauucuaaccaccacacacaucaacccagaugucagugggaaguuagucuguaacuggucucugucacaugagauagaagacagucuuuagggagaaguauagaaaggaaugguuuugaugauuuuauuuauaacaacaagaaaacguugucuauucucagugguuuaaccugcugcaagaacagggugggcaggcuuucuggcuacuugcuuugucaagaaugucugguggcaggcuguuagaaugaccaggccaaucccauuccuuugcaaauuugugcugcucuggaacagcagaggccauuggcagggcuuuguuccccucccuugcugguacggugaugucauaagaaucaggcgaacucucacaucguggcaguacgaggcagaauguacuugaugucagggucucuucgcuuacuguguccaucuguuuuccucguagagagcaagcgggacauucuuuuccucuuugacggcucagucaaugucuugggucaguucccugcugucagagacuuucucuacaggaucauugaggaacuugaugugaagccggaugggacccggguagcaauagcucaguucagugaugacgucaggcuggagucccgcuucagugagcaccagacgaaagcugaaauccuuaaucucgugaagaagaugaagcuaaaaacaggcaaagcccucaaccugggcuacgcccuggacuacgcgcuuaggaacaucuuugugaggucggcuggcagccgcaucgaggauaacgugcagcaguuccuggugcugcugguugcuggaaggucgucagaugcuguggccgggccugcaagcucccugaagcagagaggagugguaccuuucaucuuucaagccaagaacgccaaccccagugagcuggagcagauugugcugucgccugcauucauccuggcugcagagucacucccuaagaucggagaccuccaaucacagauugugagccuucugaaagcagaacaggguucaggcccuguaucagguaugguucaccaagcugccccccaaacccccugccccccagcccugacccccugcaucccagucucuaguuucaaaucuuuagcagaagcugcuggcucuaggcucuuagaugaaacucuucucccagagcuuacauagaauguggaaacuacaggcuauuucuaggcgaacaaaagaacagaaguauucucugauuuucuaacuugugucuuggaaggauacuggugaauaaaggcacuagaacauuucacaguaagaugccuuauagagguuuagauaccaguagcuuuugucuugaaaaaguuccugucugauaauaaagccauacaccauggcuaugcuuaucacuaaacagccuucauuuggacauagugucaagcgaugcacauuaaguggcucuuacuaauguaagucauguauuuacauucguuaaaaacuaaagaugccagagaaggcaggugaauucggggccacuaucugcugcucccagugcugugcgagucaccagauguuucccuucaauuucaggugaaaaggaugugguguuucucauugauggcucugaggguguccgcaguggcuucccccugcuaaaggacuuugugcagaggguuguggagagcuuggaugugggucccgaccgugugcguguggcacuggugcaguacagugaccggaccaggccggaguucuaccugaauucccacauggaccagcagggugucaucagcgccauccgcaggcugacacugcugggcggcccaacccccaacacaggggcggcacuggaguucguguuaaggaacauucugaccaguucuacugggagcaggauagcagaagguguuccucagcuccugauuguccucacagcagagccaucaggggaugacgugcgaggcccuucaguaguccugaagcagggcggggcugugcccauuggcauuggcauugggaaugcugacaucucugaaaugcagaccaucuccuucaucccugacuuugcuguggccauccccaccuuccgggagcuugggacgauacagcaggucaucucugagagggugauccagcuuaaucgugaggagcugagcucguugaaacccauuuugacgcccucaacaggugcaggugagggauugggaguggauucuuuuaguuagcuacuugcuugcacugugugguacaaagaaagcacuuucaggcuuguuuccucugccacauagcauguguggaaaaacuaggaacauuuuuguuuuguuuuguuuuguuuuuggcgaugucaagcaauaaaguuaagauucaugucuguggucaacuuaaagcauccaagagggcaugcacaugauguagauccaggcucuacagaggggccugaggaggaccuuugaugaguguccaaccuaaguagcaagcaguggccuccuguugccuggaggaacuuaaucacaggugcucugcccugacaagaggaauggagccucugaaauguuuuuaucuguagcacccgugugugacauuugcuugaaacuuguucauaagucugaacaaggucugagcucaggaaagagaccaagaugcucucacccacagugcaagccggcccagggcugugccuccuuccuggacacucagggcugaaggagacagacaucacucaguguuuucaugagaggggacaugagggaguagggcaaggaaggcagggaguaauauacguuagagaaagucagaggcaggauuuguacaguggauuugcacacccuugaggggucagcuucccccugguguucgggagugagcaguaugcucuuuauacuuacauggagugacuuaggauguucacacucacguacauuugcgggggaagucucugucucucugucccugucucucucugugugugucugucacucucucucucucucucucucucucucucucucucucucugacauagaggaccacagccauucccaaaccccguugcaccacaggagugucuguuaugaugcaccucacggccuagggcuccuguaugugugggugcaugugugcaugcucacagaacccccuucuugugaauccagacauaugcuuccacagugcuugcuuccauucacucucccacacaucacacgucagagcggccacucggugcacacuccccuccuccuucccaucaagcucccuccacccucaucuccccgugccuugcugcagaccugaguuccacuuccuagagaacguucagaagcuucgcugggucccuucuggugaugguuuaucuucucagagcguucucuucuucucuucucuucucuucucuucucuucucuucucuucucuucccuucccuucccuuccccuuccccuuccccuuccccuuccccuuccccuuccccuuccccuuccccuuccccuuccccuuccccuuccccuuccccuuccccuuccccuuccccuuccccuuccccuuccccuuccccuuucuuucuuucuuucuuucuuucuuucuuucuuucuuucuuucuuucuuucuuucuuucuuucuucuuuucuuuucuuucuccugggagggccugucucuacuucugcccuucccuuugaacuugcucagcacacccucuucaugucucauuugcccuguccccgucauuccuguuccauucuccccuguucuggaugauucgucucgugauaagugugcauugcucagaccgggucucucagugcccuacagaagagccugcaccacuuacaugugcucugcucagagucucuccuuccgugcaauucauugcucacccuuccucagaaagugcuuucuccagagucccguggcugucucuggacagugcugagccagugggcaguuccugccauaguugauaccugcuuccuaaaacaucaucgccagucugauguaggcacaacucuuugguuucuccaucccuugggcucaccuuucuaugccucuugcugguucuucuuuugucuggugcucagauguggaaauacacaagacuugcuucuuugcuugauguuuucccuauagcgucugauacuagaaucucucacuuaugggacacagauccgaugacagacuaggaagugguucaagggugacuggggucuggcacccuugaagcugaagcuauggucaugucugcuuuucagguguuggcagcaagaaagauguggucuuucucaucgauggaucccgaaaugcuggcccugaguuccaguacauccguacccugauugagaggauagucgaguaccuggacauaggcuuugacaccacccggguagccgucauccaguucagugaggacuccaagauggaguuuccucugaaugcccacuucagcaaggaugaaguacagaacgcugugcgcaggcugcggcccaagggugggagucaggucuacaucggaaaugcccuggaguacgugcugaagaacaucuuccagaggccacuggggagccggauagaagagggcguuccgcaguuccuaguccucauuucgucuggaaagucugaugaugagguggacgacucagccguggaacucaagcaguucgguguggccccucucaccauagccagacacacagaccaagaggagcuggugaagaucucccuaaguccugaguacguguacuccgugagcaccuucagggagcugcccagacuggagcagaagcugcugacgcccaucaccacucuaaccucacagcagauccaucagauccuggccaguacccgauaucccccuucagguaaaaaccauggagguggggcugcuugcagaggcgguggcgguggggguagggguggggguggggugggugcuugcugacuugugugcgcaugcaugcaugcccccccucucugugugcuaacguuuuagcacuaguauauauuguaggcugagcacaucuccccauauuauuauuuacccuuucuuccucuucuuugcuuuucuagauaggugguucucaaccuuccuaaugcagugacccuuuaauauaguuucccacgcugugguagucccccaacuauacaguuauuuucuuugcuauuucauaccuguaauguugcuaccauuaugaauaauaaugcaaauaucuguguuuucugauggucuugagcaacccccgugaaagggucauucaaacccucaaaggggccaugauugagcagcauuguucuagaccaguuaacuuugaucuuuugugucauauagaccucuauggcuuuauguaucuuuauaaacucuagaaaccacaaguaggagaagauaguccuucugagacuggugugacucccugaacauuaacucucaggugcauccacuucccugaaaacaaugucacuuuguucuucacggcugaaaaagaguuccauuguguguguguguguguguguguguguguguguguguguaaaccacguuuucuugagauucuuaccccagccacaaugaccauuaaaaaaaaaaaagaauagcaaaugcuggugaaguguggacaaaacggugcgcuccugugugccuggugggaguguaagcugguuuagccacaauggagaccuuuauggagguuucucaaaagacuggggagaagucuccauacaaucuggauaccccacuucugaguacuuauuugaaagacuccagaucaacacaccagagugcguacuucagcacucuguguaacagugagcaaaugggccaacccaaguguucagugacggaggaauagaaaggaagaugugugugucuccugcacuaguuuugauauaaaauaaaccaggcucaaugagcccuguaauaaugugucuuagcuugcuucauuuuugcugugcuaaacacuggaccaaaagcaccuuggaaagaaaagauuauuuuuauuuggcuuauauguccugaccucaguugaccauugagagaaaucaggguaggagcucaagcaggagcagagacaagagccaugaaggaaugcugcuugcugauuugcucgccauggcuugcuuggcuugcuuucuuauaccacccaggacaaauugccuagguguagaaccacccacagugggcuugguccucucgcauugaucauuaaauugagaaaaugcucccacaggcuugcucagaggccagccuucccucuuuucagagugguucuaguuuaugucaaaagccaaccagcacauaaaagaauuaagaguggagaguccuucuuugcuuucaugaagucuccccuaccagcccaagaauaccaggauacacuguuaauuagguggauuuuuuucugucagugaagagcagggagaugggggcuggugcugaaaggcauaaaggguuugagcuuguauuagagaauacugugaaagccucaaggcagggguuccuuggccaggaucugggguuucauagaagucugagguaauucugcauguggccauugccaucagucuugucuggaaggaggaagaccuugggaaagacuggaaauguguaacugucaauccugcucaccagaacaggggcugugggucauccuugggguuuuagacaacacuauuuguauuuagacauaguugguggguggaguguucuuaucuuuaucuaaucccaucauagugagagucugccugaugcugaagucuugggguggggugugcucagcaggagauccuaagguugugacucagcucagcuccccagcuuuccucuuccucagugauggcugcaucucguaaucagcucaacacuucacuuuggaguauugcacugugaaagccaggagucaaagcaaauaacaggucaaaauucaccaaggccaccuauuaguuuaguuuaacuccaacaggauucuccaacaggagaauguggcucgucucucccaagauauucugguuaauuuuauacaaguuaaaucucuuuaauucaaaaugcuaggagccagaauugcuucagauuuuggauucauuucuaucuuagaauauuugcauauucauaacgagcuaaugugggccuggggcaugaaauuacuucuguuucuuauagaccuaguguaacagucugcagguaauuuugugaaacaaaacaaaacaaaacaccucaggauaaaguaaaaaauucccagucuugaguuuuccaccaguuaaaaaccaugucauguggaaaaagaaaauuugauaguaaaaagaaaaaaaauuaauaauugcuauggauucucuaaaauacaauuuaacaagaaccaaguuauguaagaaagccaauaucugggggcaguuaacaugacucuuggcauacagcauugcauugugggaacccuuucccccauggaugaagggaggacagcaacaaacgcuggagagccacaugggguucaucuuagagcugggcauggcagccaagcgagggcagucgucuuucucuuuuccuaugaugaagaggguggccccagcgaucccagucucucuggugauucauaaccccguggcuaugguaauauuggauuaguuucucaacacucuccacaaguuuuaaauuaguaguaauccaggccucaaggccaaaaccaaaggaaaaaaaaaguuaucuuagagaaaguuuuggauuacuuaaaauauuugaaguaguuauuagcugcauuucaaauaccaauuuuuuguuuaauguguguguguguguguguguguguguguguguguguguguguuuauaccagagaacaacucuuaagagugauuucucuucuuuucugggaucugaguauugaacucagaccaucagguauguugcuaaguaccaccaaccuggaaaacccaacuuuuaacaacuaacugacaaaagcccaacacauguguuggaauaucacuucaguguugggucaccacgggugccacaaacacaagucccagaagccgauguaaugggagucagagcagggcugcucaggaacuaaacuccauucucucuuuuguccacagugguugaaagcgaugcggcugacaucgucuuucugauugacagcucugaugccgucaagcccgauggcaucgcucauauccgagacuuugucagcaggaucguucgcagacucaacauuggucccaguaaagugaggauuggggucgugcaguuuagcaaugaugucuucccugaguucuaccugaagacccacaagucccagagcagugugcuugaagccauacggcgucugagguucaaaggagggucuccccuaaacacuggcagagcccuggaguuuguggcaagaaaccucuucgugaagucugcugggagccggauagaagauggggucccucaacaccuggucuuauuccugggugggaagucucaggacgauguggccaggcaugcccaagucauaagcucaucggggauugugagcuuaggaauaggagaucggaacauugauaggacggacuugcaaaccaucaccaaugaccccaggcuggucuucacaguucgggaauucagagagcugcccaacauagaagagagggucaugcuuuccuuuggacccucuggggcuacuccucagccuccugggguagauuuaccuucuccuucccggccagguaggagccauuugacgcacaguucucgaauguggugucaacuguuuggaaugaaacaguaaucccuuucuuugcaauaauucucuucucucgagguugugucugcagauauuagaaaccaaauacugggggauauaguucauuugaaauuguagagggaagcaugucccccaacguguaaggucaucaagccuucaauuuuccugagguuaacuguugggucacugaaaggcuugagguagcugucucgggguaucacauucauuggcuagagccagucagucugugcaccacuggacaugccuuggagucaggugacucacccuuguggugaguuacauauuguggucaaggcacacuuuauucuuuggacugguauggccaccaggauugucccaguuacaacagccucuccauguuuccaauuuucaccuaugagacucuaaucccaggcccuccaacucccccugcccccuuuccuugcuccucugggugacgcucauucagacacucaugcauucaaacagcgcuggcuuuucugaaggauccacagucccucuuuguucuuuaacugccacuucagaguuaggcggcacaucuugcaucccucacacuguccccaaucucccacaguggucuagucuugauuaacugacuagaacuggaaaguggcuggcuuccucuugcuacaauccggggugucucccaugcuauaguaguucuccuccagcccuuccuugcucugcccuuaauucgucuuuccucauuccugcuagaggauaucuuuuacuuuuugaccaaaaagguaagguucagugacauuuuucugaaacaccugagaucacagguucguaguggagacauuaguuacuuggauuugcauuguauguauucauauuuuuuuggaggccuggacucuccucauuuuccuugugauucccuuguagagaagaagaaggccgacauuguguuccugcuggaugguuccaucaauuuuaggagggacaguuuccaggaagugcuccguuuugcaucugaaaucguggacacggucuaugaagacggagauuccaucagagugggacugguccaguacaacucagaccccacggaugaauucuuccugagggacuuuucuaccaaaaggcagauuaucgaugccaucaacaaagucgucuauaaaggagggaggcaugccaacaccagggugggcaucgagcaccugcugcggaaucacuuugugccggaggcugguagccgccuggaugagcggguuccucagaucgccuucgugaucaccggagggaagucaguggaggaugcucaggaugugagccuggcucucacccagaaaggugucaagguguuugccguuggcgugaggaacaucgacucugaggaggugggcaagauagccuccaacagugccacagccuuccgggugggcagcgugcaggaacuguccgaacugagugagacagugcucgagacucugcaugaugcaaugcaugagacccucugcccuggugugaccgaugucuccaaagguaauugucgcacgcacagcuucccucuuccugcugaugcugagagccgccuuagugccgcucugaggguuccucagccuugugguugcuuugaacauuuauuuguguccuuaguauucauaagagucaaagucuuauaagcuuuacuuuuuucucccacuauuugauuccccagauaguuuagacucuuaucuuuaaaagcauauuuuugagacauagucuauuuuggagccuagacugaccuggaauucaugaaauuccugaauaggcuggugcugggaguauagauaagccucucaauauguuuauugggucgguugcuuggauugggguauuuguguucugaaaguacuuucaguuuuaaacaccaacuugaguaaauaccagauguacacuauuugcccaaauaacuaacccccuccaaaaggagcaaacauguugaaauagcccacagcuuuggauccuggcagagucagaucuugcuucucugggcucccacgugggagaucucauuuugcucucuaccugccccucucuucacuagccugcaaucuggaagucauucugggguuugauggaucucgagaucagaauguguuugugagucagaagggccuugaguccaagguggacaucaucuugaacagaaucagccagauacaaaggaucagcugcaguggcaaccagcugcccacugugaggguauccgugauggcgaacacgcccucugggccaguggaggccuuugacuuugccgaguaucagccggagcuguuugagaaguuucgcaacaugcgcagucagcgcccauacguccucacagcugacacgcugaaguuguaccagaacaaguucaggcagucgucgccugauacugugaagguaagcaggccagggccaggagucccgugcagugcucugagcuucucugccuucuuagagucuguccugagugauuaguguucaucacagugggugggccaggguuguuagcaccugacuucaaggagaguuacuuugcuaaggacuggccauaauuuuauauaucuucuucuucuuauuauuagcuucuccuuagccuuccccaccccaacaaaacacaaaccacacuacacauaucuccauacugccccccacgaaacauauacacucaucauauagcacaaauacauaacagacacacacauauacacacaucacgcuacacuauacauacauaagacauacacacucaccacaaugcacauauacauaacauacacauauaugcacacaccauacugcacauauauaaaacagacacauuuaucacagugcacacacacacacacacacacacacacacacacacauucuguuauauuaugugcacucuguauuuuuuuauacuuacgcugccaaacaaaacaccacaggcacggugccuuaaaccacaaggguuucuuucucccagugcuggaagcugggagaccaaccucgaguaaggccugggcagggcagcuuagcucugaagccuggcugccugacuuguaaaugucagccuucuccuuggguccucacauggucaucccuuuggcugcuaguggcucagucaucuucucccaggaggucaccuguuggacuaguuuaggggccacucagaucucacacagcuuggcugcuuaagguccugccugcaagugcagccaucuaaggcacuggaagucaguuuuugagggaacacaggccauccuaggacacacaugcauacauacacauguacacacucacacacgcagacacaauuucuagaaacuguaucucauaaggaugagaauacaauaaacuacuuuucuugucauuguugcuuguaguuuugaaauaucaaacaaacacagauguacauuccuuuauguuccacacugcccuggccuuggucuccauucuccucagcuguagaggagggauuugaaccuuccaacugucuaucaugcucccuagcaauauggaugggauuugacuccucuguugcuuacagguagucauucacuucacggauggagcagauggagacauggcugacuuauacagagcaucugaggaacuccggcaagcagguaggucccaggcucccuccgugugagaagccccuccugaccgcccgaggcggacuggccacuguacugagagagauccaucaaugcaauccugagggguggaccaucagaagcucuuguccugcuaucuuggcccuucuuucccugcuuggguugugacauaaggguacugaagcuacuucugagccaggaacagcuuucgugccaggccagcuucagacacucugaucagggggaacacccaaaaugcacgaggcuuuugcaaaagaguucaaguguuaguucauucaaggccgucacagacacuagggaugagcugagcagaaagucaucacaccaucaguuagcaaugaucacagcuuaguauacaggccacuaaauuaauauaaugcaaccaguguugaucacuuaacaugcacauaauuaauauaaaauaaaucaugcaagcacuuuucaagcagacuugccaauggcuacaugagcagccuuacguguguacaugagcuuuggaacaucccagugccgauuaccaaacaguugccaaugccaaaggcucuagagccaagguucucaaccugugggucacgaucccucugagggcacuaagaaccccuuucauagggguagcacauaucagauucuuggcauaucagauuuuuacauuaugauucauaacagcaagauuacaguuaugagguggcaacaaaauuaauuugaugacugagggucacagcaacaugaagaaccauauuaaaggguugcagcauuaggaagguugagagccacugcuaagaaguuaaggaagcagaacuauccaagcacauuaucuuuaaauaagacuuauuuaucuaucuguucaucugucugucugucugucugucugucuaucugucugucuauuguguguguguguguguguguguguguguguguauguauguguguguguguguauaccaaguguguucagguguccucagaggcugaggagagcauuggaucucuugggacuagagauacagacagucgugagcuacccauugugggugcuuggaacggaaccuggggcauuuuccagaguagagcacagacuuaggcacuggagccaucucuccagacccaucuaagcgcauucuauuuauuagcucauccuuccccaaacagcggugaggacacugcuguggccugacuuuagauguguuaaugcuucaguucuucccauggcacacuuccagucugcagggucagaggugacguggugucacagaugucacuucagcuacucagaggacuuuagaaucccaacucuuccacaaagcaaauugcuuucauuaaacacauguaaauuauagcaaauaguuaacugugaaauuuucucuaaaaagaaugguauaaagggcuggggauauaccucggauguggaaagugugcauagcaugcauacuucauguucccacuuuggugguuugaucccuggaccaccaaaaagugagcaacauggaccagagagacggucaguggggaaagucaaccacugccuagccuguuaacaugaguucacuuuccaaggguagauggagaaacuaauuccugaagguuguccucugacugcccugugugcacaagacacuugcauuccccuaccacaaugaaaaaauauagcugaacaacaacauucccccccccccaaucccugcucccccaaaucaccuaacagaguaaaaccagagucaggaaaaaaugaaacccagcucuccagugccuaggugagguacauuaaaugguuccuuucucacaggugcccaagcccugauccuggugggucuugaacguguggcuaaccuggagcggcugaugcaucuggaguucgggcggggcuucauguaugacaggccccugaggcucaaccugcuugacuuagacuaugaacuggcagagcagcuugugagucuuuguaucuuuuaaagaguuuuacacacacacacacacacacacacacacacacacacacagagagagagagagagagagagaguuugaaauuuuuggcaucucaagacagcaaagccagauaucuuacuggccuggugacugggggaagggcauauggauuuaucacggacuccgucaaggcuugcuuuauugcuguaugaguccugaauaugccaucugccuuucuccaugauggaauagagaauaugcagggaaagagauggagccaacuucuaggugaaguccucucccuggcucccuuucugggcucuucucuuagugagagccguugccuccugggauggggaguugggugggaguguagccagggauucucagauagugugacuaaggcuguaggagugggagggagugcugcccucucuuccucuuucuguauuaaaaauugggguguuuuuauuggguagaagcagcuucaggcuagaacaggggagaacgcacacagucagcacuaauucagugaauggcacuguguuugggauguguaaggucaggggcuuggcaagggagggauacagagguggcuggugacccagauuguggagguccuggcucagagcccagggccccacgugcugccuaccccuggcuucuccagggacucucucaggccagucccgauuuccaccaucccaacuguggcucagagaaccucaagguguagauuucuaauuuagaaugcucuuugaccucagguugcuucaauguguugguuggauuuuauauuugagguuuggacaugaggagguugucuuaguuaggguuucauugcugugaagagacccaugaccaaggcaacucuuauaaaugacagcacuucaugggggcugguuuacaguucaagaaauucaguccauuaucagcaaggcagggaaaauggcagugugcaggcaggcaggcauggugcuggagaaggagcugacaguccuacacguugguccacaggcagcaaggaggagacuguuacugagcagagccugagcauaggagaccucaaagcccacccccacagagacacacuuccuccaacaaggccacacccacuccaagaagaccacaccuccuaauagugccauuuuucaugggccaagcauuuaaacaugugauucuauggggaccaugccuauucaaaccaccauagagguuauacugaaaauccaagcccugaaugucuguauuagaaacgucuggaaaaugagccuagucuaggauaagaaugaccauaguugauuuuucuuuucucuuccaccaaugacuucccacccuaugggaagagcugaguccucagcuguaccuggccuuugagggaguggcaugagguagcucacugcggcagauuaggacuaaucccagacccuuggugguucccuguuuucucuuuuugauauuuauuuacuuuuuccuuggcaggacaauauugcugagaaagcuugcugugggguuccaugcaagugcucuggagagaggggagacagagggcccauuggcagcauugggccaaagguauggcaaugguacucuucacaccacagguuagacaugcagcucugacacuauuuggcugggugacuagacggauaugagagagucagaaggacccuggcaauauugccaauucugggcuccaagguacuucucgcugaccaauaucccuagugucuuacuggugauagagaugaccugcuauguuucccucuuccacuggaugggaugguuugcucuuuaacaugugggucugucauuccacaaaacaaugugaaaacccgagcauaccuaggcagccucacgaugugggucagugggacccuuagugguuaccuuaaaagugagccacagcucucugggaaaagaaagagccugagcuaucccaaugggaagaucaucacuggauagagagugagugagugagugagugccaugcucagcucagggcaacgcccacugucgagcaaggcacugcugugaugcuuuaugcgaaacgccaugacauggggacccacauguuuuauuucaggguaucuccggggaagauggcuaccgaggcuacccgggagacgaaggcggaccugugaguaaaagcuucccugccccucaaguuuuuacuaccuccuguucuucccauauggggacuggauaguggaguuuguagccugucugguggccagggcguucucaucaggagaaagauuuuucucuuaacuuauguaacuauuuuccuuucuuucccacacuaaggacagagagguucuuugaaugugacaaguauguguguguggaguguguggggagacuugcucuguuucagaguggaggaaggugagguauggugugccccgugcccacugcaugucugagcagaagucagugguuuaugcacugcuagucccagcuuuugagaggcuggggcaggaggauggugagcugcugaacuauuauguagcgagacucugcuaauucugcgaggcucugggaccauaggauaaggcccaucucugggcuaugggauggaggggcuccugggagaauaagcaaggucuucagguguccagaccagauaaggaugucagugcugacucuguugccaugggacagcuggaaaccaugacaauacagcgcaguggucaaaggaaagaaaaguacccccuggacacugcaaccaucccagagucuacucuccagacugugaaguugugaauucuugcuuagacaggagcuggggguggggguggggguggugaggauguugguacauguagccuguuuacagugaagcccucuaugugcugcaugcuauucuuugagagagagagagagagagagagagagagagagagagagagagagaagagacaccagacaguggauuccaaccugcaaaaugccuguguuuucuuuacagggugagcgagguccaccuggugugaauggcacacaagguuuccagggcuguccaggccagaggggagugaagguaugguauggauucauguguaggggagucagcacagagcaugcugggaggauaugaguucuccaagugccuuggggagggaggguagcaagcugggggaugcuugaugcuugaugcucugggggaugaagauccccagagcccaguagccagggucucucgacgaagguagcucugcacugggugguucaggaguccagagcacagacuaucacuggaaaggagucuggguggagacauaguuuccuguggaaacauuuagcagccaggagucagucgugaagugcaagguucuggccaggcccugggaggaguuggggaaagaacugcgcgggauuccaggguccgcuccuugcugacucggagaacagggcugagaagggaagggccagcccacugcaaguuaugaaacuggccuucugucuuuggaguugccucucccucccagggagaaagaccacccaaguguucaccucuaggcaaauucacuuaauaacacaccagcuggcagugagagaggaggcaagccagaguguauguuuaauguauagauccucagaacuggggauccucagacacaggugaaggggcaucccuuggccucugucccgaggaacaggcucuauaucacucauguuucugcuguccucuuaccuuccaggguucucgaggauucccaggagagaagguacuaaaauguuuguuuguuuuaaugaaaacuccccugaggcuucuucuucucccuugcugggauaacuuguuccacucacugucugccuuuuucuacucagggugaauugggagaaaucggcuuggauggucuggauggugaagagguggguguuuuuaccucccacaucccaacugcaucuauucccgagguccuggucaccagcaguccauggagcugucaccacguuguacaauccacucucauugucuuuacagggagacaaggggcugccugguucuucuggagaaaaggggaguccuggaagaaggguaggugugcucuuuucucccugucccggaggggguggggagcauaacaccuuuuccagcgaccaguuagcacucuucccaugguuuccugguagauguaugagugauguccccucucaacugugacacccuauaugucauuuccuuguuggaaagcaugcccuacaggguggcgacugauuuuguucaguugaaaacacauuucuuaaugccuggggccgagaggcucuccaggaaacauuuguggacuagccaaacacaucggaaauauuuugacaugauuugggaacuagagagauggcucagaaaaaccaaaaaccaaaaaccaaaaaaaaaaaaaaaauacccacauauauuggucauacggaggacccuaauucaguuccuagcucucagacugaauguuucacaacugccuguaacucucacucugggagauaugaugcccccuucuggccucugcagauacugcacuaaggucuacacauacauagacacauauacauacuuguaaagaaaauaaaucuuagaaaauaagcgaucuuuucaagcuucaugccaacugggaaaaugguaacagguguuuugaugagacuuacaaaauaaggaacgugauuuugaugaacaauguagaggucuaaggugcagcuugaagguuauaguuagcaaacauuacuguauuagaaauucugguuggaauaguaggcaucaacuaauugaucacagaaauaacauagugggacaauagauacaaucauuuucuucaccauagcaaccacucauauauauacaguguauauauauauguauguauauguguauguauguauguauguaugcaucauggcaucauguuauagauugcaaauacucaauaaaauacuuguuaccagaaauaucuaguuuuaaacuuccacugugugauugauuuagggugacaaaggacccaaaggagacaaaggcgagagaggagaugucgggauucgaggugacccgguaaggaagauaucuuuauuuuggauuuaacgggaggaggcuuaugaggaaagagaaaauggaucguuuacauuuugaaauugccgauaaaauacaagauuuauccugucguuucaauuuggggaucauugggaugauuuguuuccaauacaacaagcguuuucaagucacucaguaggugcaucuuuaagggucuuccugagaugccuucuggacauguuugccuuaggauguguccuaugcagauuucuggcucacacauuuguaaacccuuuaagcaaaggaccacugcugagaugaccuguucugcaggucacccuccucugugggagaggauggaaugugaggcugaguguccccaggagggaaggauuugugcuacuccauuggggccaccauuaggcucuggguauuagcuggauaggagaugucuggaaggacugucuuugaaagccuucucuucaaucugauacuaagaauucuaauggcugcagcuuuccuuauauggggcucauuggacaaauccuguuguuuucagggugacucaggacgggacagccagcagagaggacccaaaggagagacgggagacaucggccccaugguacagugaucuauacccagagacccuaugugccagggcggcaaacugacucucacaucauuccugccucaccagcugcagcccccaugaacugcagagucugugagaccagcagcaaugucccccaagacuggcaccugugugccuggaaaggcagccccugugggacugggcaucagggcugcucccaggcagcuguugugcccugcagcuguguguagagagcucuggugaagccaaagucuuaaaggggugacagugacccuaccaagccugaugcuucccaggagugucuggaguucuguccuccuguagacagacccucuccuggggauagacccuuccacgccgugucuccagaaacacacucugggguuuaaugugcuccucugcaggugagaauuucauguuaacuuuuuacccccacuucagggucucccaggcagagauggcaucccuggcagcccaggagacccugggaaggacguaaguaccuugggauguuggguucugcucacuggcaagugauuggugcacagugccuggcacucugcuaugguccagcucccuaccagggguuggggcaggggaaagccauuccugaaaccaucugucuacuuuaugcuguacggacaguacuaaaaacaaggccauuugugucaauauaaaauaaguaggcuuuugccuuugacuuaauguugcuguccuagauuguuugccggcucacagcuccgaaggguucagggagcauggguagugagcacggcggucaugcuugucuucccauggagggaggcaagcugugggucuuuauaccagaucuguugcugauaggacauuuucauucuuagcuuccucuggcacccaucgcucaccuucccucagucuuuucucucuccuucaguccuuuguccuuucccucuguagagaacauugaacacuuaaaaaaaaaaaaaagaaagaaaaaaaaaaggucucugcuguuuucaaguauuuggucaacucuugcccacuaaguagcuaaaacaucagaauggaaacauuaauucugucuggcuggugggggagacauggagaagaaggaugaagaaacagauuucuggagcccauauaauugcuucuguauuugugccacucacagaagggaacuuagcaauguggcuuagcuuuuguguuuccaauacauuuuggagugugugucacugaaaagcuuguuccauacucacugaaggaauguggaagccaaggugaaguccgugauccuguaugaagcugcuugaaagcuaccagggcccaaguaagcaaagagcaggguccuaguagcaucgaagaagaggacgaagaggccaggagguuauaauccuuaggggaguccaggaaguuagugggugccuagggugggucucugcucagaaaugaacagagcagaaagcaugaggggggcagggcugguccgcucaggacaggguccucagcauugcugggcucaguagcugaccaucacagagaguuccugaggucugaggcuucccagaggagugacucccuugugcucaaguggcuucuaacuuuuuaaaaacaaaaauuaaauuauugccuucaaaaguuugaacauuagacuggaaagcuagcccagucagccaaaugcuuagcaaauaggcuugaguuguuccucagcacggguguaaaagucugggguguggcgguagguuaauaugguuaagccacacagggacaagaacacgcuuuucuacacgcuuuuguaacauggcucucaaaauggucugaggacaugacugaaaguccagcugaggguacggucauguucgcuaccauggggugaggcagaaacuccuguuggaaucaauuuagaggcucacuaaguggcaggagguggaacacaguaaauuugccucagggugaggaccaacagagaggccuuuugucacuuccuucucugcuaugccagacauagaccaagaugugcuccaggguguuagagucuucucaguggccucuucuggccccugcaggcugccagugagcagugaggcaggagccugauggaagagcauguuccuuagggaggggcagggcuugguugcugcucugugcaggacccugagcagcucucaguauucacaccgaccccaggaaggaggccagcaccaugguggcugcagaguggccaacugcugggcugaucccccuggggguagagaaugugacuccuagguugaccaagucucugaccuugcagagacaguuuagcaugcccacagauucccucccccaacucuccucuggaacauucaugagguggggaaucccuggguccuccugcggcaggcucacauuuucaaacuaaggcucaccucuggaacauccacaagaagcugccaagacaugagcccaacuuucagguucacgugugugcgcugggguugcucuuguuguguuuggcggggaggguugagagcccaggacucccuucaccgcagugaagcaucucaacucugcuaaguuagagcaacgggcagguucucauuccuguuucucauucuucucugggaacuggcuaggauucugcagccagaagccauuauuuuccuuggcagaucagaagucauucccaacuguucacuggaguaacucacaggcacagcauagaaguagaaacugcuggggaguggggaggagggaugagcgcaccagccuccuaggugucgggacuagucucuggcauagaguuugcacuacagugggugcauacaugugucaggauucagcauccgcaucucccccucaagacaugugccuucuuccacaggguggcucuggccgaaggggcccugcaggagcuaagguaggccgcuggacuggcuuuucaugucucuugucucuuaucuagacuuccaggagucuccuagacacagucagcccagggaugaaguuagugucccuggccaacagcuuauauaacccucccuuuucccuaucauucucucaaacucagccucuucuacgguaaaagguguuucaugugguuucuggagugaggggagggaagggaaaagguugaccagccucagaugucuggggagcucucugccaggaauguccaugugucuggccaucuugccugugccagagacacaguccaaaacauccuuguuuaucaaagcugucccgugaaacaggcaagugacaauuugugcaggcucagagagacaggcugcugaccugugugaggguccccuuuccccaguccagagcagagagcugguuugguuuaccugcuugucuuguuuccaagggcaacagaggugguccuggccagccaggcuucgaaggcgagcaggguaccagaggcucacaggucaguauccuggcaugacacaggccuuguaguaucuccuagauccuugguggcuuugucuuaaauuaaggugauggucacgagacacagauucugccucuagcgaugauuccacagcacucagagcacucacuguauuguguaauaauuuaaaaauguuuuauuaaccccaaaggaagcaauguauagucgcugucuauugcucucuaccuuuggggcccccaucaacuucaaauuguccuccaccucugccauuuccacaucuucccucacccuuauagaccccacaccugucgcccuaacgucugucacauuuaaccccuagugcccuccaucccuauugcccuccauuccuauugccccaccccagcugccacuaaucccuacugccccuccucuuuacugccccuccccaccccgguaacccucaacccugaugcucccuaccucuggcccacacuggucucccugucuuugugaauuugccuguucuggacauuucauauaaaugguaucacuugauagguggauuuuauguuuggcuucuuucacauaguauaguucccugaauucaggacauguucuggcagcugacauagugguguuccucucacuggcugaguaauaguccauacauggauaaagagcagccuuuuucacucacugguuacuuggcauuuggguuguuaccacucugguuacugagacucagaucaacugcacucacccgugacaugaccuuuuccuccccagggcccaccuggucccauuggucccccaggccugauuggggaacaaggaauucccggaccucgaguaagcaucugaguguagcaacuggacuguguuggcugguggggcuggugaggggguggcugaugguguagagucugcaggagucgcucugugacucugugggcuuaagugggcaguguugggcaccauuaagugcuugggacguguggguggccugugacaggggauagucagggucuuuagucuggacaguuguugcuucauguacaucccuuuccuuaccuuacagggaggcggagguacggcuggggcuccuggagaacguggcagaacugguccucuggggaggaagguuugucuggggaacaguggggcuuugcugaacuaagugcugccaccuccccgcugccugcccucuccucugccucuuuaccuucaaccuaagcccugugcaucaauggucacagacacaaccccaauuucccccacuguucacauacgcauguuacaacuaguggugguccaugccuuuaaucccagcacuuggaaggcagaggcaggugugucucagugaauuucagaccaaccugcuauacauagugaguuccaggaucagcuaagacuauauagaggucccaaaacaccccuccccaaaugaaacaaacagaaagggcagauacagagccacuugcgguggcucaggccuguaaucucagcacuuggucagaacuuggggcaggaggauuacuuuaaguuugaggccagccugguccacaugguaagaucacacacacaucaguauuuuguuuuauuauuggauuuuugcuaaguuuuuaaucugucugucugucugucugucugccugccugccugccugccugccugccuaucugucugucuaucuauuaugugugugguuguauacauaccauaccggauauguauaagucauuagacaguuuggugggauuugguucucuuguuccaccaugugaaauuuggggcuugaacucagguugucaggcuuggcagcaaaaucccuuuuacuuccugagccauuucaccagccccugcauuuagcauuuuaaaaauauguguauagcagugcccauuuauagggcacaaugugugugauaauuucauaauacauauaaugguaaggucauagaaauggguauuucuuugcauugggggcacuugaaacucccucuucugaauauguaauaaauuguuguaaacuugagucauccacagugcccacuagaucauuccuccugccuaaacugcacgcuggaaccuguuacacaguuaugcucugucccuaccaaucaugaguauccacucucucaugaugucagccuuugccgcuucaugugugagacagcauguggcacuugucuugcugugcuuggcuuaucaugauuaaaauuugauuucacggaaaccuaaaagaugacauaugaggcaccuaccccuggacaucacuacccccgacaucaguacagcaagugcggagcuuggguccccaugagcuggccuccacucagcgaggcauccuuguucuccccauguagggugagccaggagagccagggccgaagggaagcaucgggaaccguggaccccgaggagagacgguaaggccacucggugacccauggggcucacugacugggaugaacgacgcagaaagcaccuuagacuuggaaagguuugcagcucuguuuggaugauugaggauauggcugaccguggugaaagcuucucauuucaaaaugaguuuuauuucccuggcaacuuugugagugaaaaggaaaucuauaggcuauugggaguuuuccuaaaaugagucgcucuuccugaagauuccauaaaagaaccagacaccagaucauuauaaucucaagcuuuaaaauacugauaugucuucccaacacgcuccucucauugugggacaguuaacaguguucacugugaaugccucacacaauggugggcacagagcugaggauacagaguccagggguuuggaggaaggcugugucagucuaggacaagaagggauuggggaccggagaguaagaccugcgcacaaaagacucagcauaucuaagagguuaaguucagauaauccucacauagaucugaguaucucuacaaacacgacuuuguuuacaccuguggaagagggcacagagauggaggcuucuuucucuugcccuuugguccccaaacacucaugcacucccccucuguugaggggagaaugugacauggugggugugaagugucugaugcaauggcuugcuguaacacccucucuguuccucuuagggagaugacgggagagaugggguuggcagugaaggacgcagaggcaaaaaaguauguaucuguugaagcuucuagagacgcccucauuguugagagucaccaaggauggcuucugacaucuuguauuagaauugauggcuuuaaguugggaccugauacugagguguuuguugucuuuuacagggagaaagaggcuucccuggguauccgggaccaaaggugagugguuggaguaauggggugucugcauggcuucuggauaagccugagcugucccaugagcugaagucagaguaccucagcuuuagucuuaggucugccacucaugacagagccaugcugggaaagucugagcauucuaagaugcucccuccuguguggacagaguuggcagugcuugcuguccccggcacuuguuaguuauguggacagaggaagaaucugagaccuguaaaugccacaacccauuuggcagucaugccagugaugacauaaaaccaggcugucuguaaauggcaccaaaacacugcagccauuuguagaugugaaccuguuaacuauuuagaaacuaugguccagacacucuguugggguccuacccagggacacccaccccuaucaggaccuucuguugaagaccuugaugugucacuucuuggcucucuucccagggcaccccuggugagccaggggcagauggaccaccaggacccaaaggcaucagaggucgaaggguaaguucgcccacgccuugcugugugugagugggaaugagcaggcucguggccgugugaugggauccugagacuuuuaaaaaacauccucuuccuucucagccugaucagugacagaccgguggcagaagggaauuccaaguuucaaaccaauguccucacagccuaugagaguuguguucuguauauguccuccuucagccaugaccucuuguggggagggcuugauagcucuuucuauggcaugucuuaaaagucauuagcccacagauuaucucaucauggugcuuggggaggcuuaggucuugggcuggauggugucaugacuauucagaugugaggaaguagggcuuaaugaguccuucuuaggaagccuguagcaucucuagccaugccuggaccacagucuccucauuccuuggcugauaagaucucucuuacuuuaaccgugguugaaucuagauuucucucauuaaugaucauucacuuccccuccaacauuaauuaaacagaaucucaauucauaguccagauauaaauaaugccucucacagcuguuuucagccagaaauauaguuaauaacaauaauuauacgguaaauuugaucaguaaagauaguccaucuagaucauuuugaauaggugagugauggccaugaacacuuaucuaacugauuggcaguuacuuauucccuuggguacucagagggauuuuaguggugguuugggacaaccguguaucuuucgcaagccugccagacuguacagaauagggacucaaagaagcucuuugggguccuuacccuuacaccugaauuuuggagacuucucauuggugauggguaguuuggaauagauucuuucuaucaccauucucccuacaggagcuaagaauguuccaucuuuuaccuccucuagggaaauucaggaccuccaggggcaacuggacaaaagggagacccugguuacccaggaccaucuguaaguauccauccaauugcuaaugagucacuaggugggagaaagccugacuggcuccuuacaucuaaucucugaaaaugcccaaccaucuucuuuccucaaaaaaaaaaaaauccccuacauauguguuaucuguuuacuaaacuuauuaccuucugacacugcaauggguaaaaagcagacgaguuuugaaauaauaagcuuuggaaaauguuuuauggggaccagguagcuagcucaguggcagagcauguaccugucauggacaagauccugaauuuucuuccuagaaccauaaacaagaaaauaaguagcauuuuugugguaauaggaauugaccuaaggccccauuccuaccaggcaaacagucucccauugagcuauaacuaugguuuauaugcuauucugugauccagggaauauuauaauauuugccuuuauaauuucucacuguagguuuguucagagagagcaagcugcaguacaguuguuugcaccauguagaagcugcacaacgagaccaaaucuggguuuggggagcacuuucuuuguuuauaaaauucccaaggaagccacugacucaguguuuaaaauccaucagucauguguuccccagagcccaggaggaaucuuugucacggauacuacauggaaacugauacaucaguuuccauauuugguuugccccucuacugaaaugcaugagguucgaggaagaacagacaagacaaaccaggagugggccaaccacuuugagggacuggguugcucaaaggcaaggguagaaggcugagcuuuugcgugugauggaggcaggcugaggggugaugcaguuaauaaggugugcugagccagucauuucagguuacuagccgagagaaacugcuucagggaaacccagccaaguaucuccaaagcuugaccaucagguugacaaaacauggggacaaaccacagaagucggucaugagucugugccuagugccuaggggaugaggugcuuuugacauggaggggacaaugugauaaucucuuaccuaugcuuccucaggggcaggcuaugcagagugagcaucggaaaggaagcuguguccgcaggggaagcuguuuugauugcccagaguaguugaaaggguugugguuagagccaugggugaacaacaagcuaccaggugggaggaguagugcuuauucaaagcgagcucaccuccuaggguuucuucugccccagugguggaauccaauguagacagagggcgcgugggagcucaaggcuaugcagugucugcugcuuuucuauuacuucccacucuguuccuguggcuaaagaguggccuuuugguuucuuuauuuuucuccuuauuauaauucuuuuguuuguuuuuuuuuuaaagauuuacuuauuuauguuauguauacgaguauacuguagcuaucuucaaacacaccagaagaggacaucagaucccauuacagccgguugugaaccaccaugugguugcugggaauugaacucaggaccucuggaagagcagucagugcucuuaaccacugagucaucucuccagccccuuauuauaauucugaacacacacucauuguacaggccguugaguuccacacaugcugugauuugaguaugccaacccucacuucucccgucuucuuucccuucuuaaaccacaccacauccauuugcuuccucucugagacuuuuguugcuugguuuuacagggucacaagggcaaccgaggcgacuccguugauguaaguaguguguguccagagcgaacuguuguuuuacacgccugucaucugcucuucuuaacacucugauuuccuccccagcaaugcgcccucauccagagcaucagagacaaaugccguaagugcucccucuucuguugccugggggacaugaugccuuccuucaccuuuaaccaugcucacccugcagaccuggcucucacccucucuucucuuuguuuccuuuauagcuugcugcuacggugaguauuggugacuucacauucuucugaggagagacagauccucugcggugaguagagcuuaucucugaaccuucauuucccacagggccccuggagugcccuguauucccaacagaacucgccuuugcccuggauaccucugagggggugacucaggacaccuucagccggaugcgagaggugcuucugggcauugugggcgaucugaccauugcagagagcaacuguccgcggggugcccgcguggcuguggucaccuauaacaaugaggugacuacagagauccgguuugcugacuccaagaagaagucugcccucuuagacaguauucagaaccuccaaguggccuugaccucuaagcagcagagccuggagaccgcaaugucauucguggccaggaauacauucaaacgugugaggaguggcuuccugaugaggaaaguggcuguuuucuucagcaacaagcccaccagggcauccccccagcuccgagaggccguacucaagcuuuccgaugcggggaucacacccuuguuccuuacaagccaggaggaccgacagcucaucaacgcuuugcaggucugugcucuaugcuuuggcucccccucccucucaucuuugagaaagcucuaaggaaugccauguucucuguauagaguuuguguccauuggcuucugaaaggucugagagggcugggacaguugagaucucuugugaggugucuagggcagccuguggcuucagcaucagcaccaaccucuggaggacuguaacuuacucccuccagauccugccauacauggugguagcgcuggauagguagcaaggcucuguguucuugcuagccaaguaggggcuguugguguggguggauucugucucucaguagaggguaaguucuggcuccuuaccaaguggcucaguuugaguuuuauaugacccuguucugacuuccuagaacauguugcuaaagcuuuuacuuauuuuuaccuuauggguuagaagaucuuggaguuagugagggucucaaauauggagaagcagcugggccacuagauccugagguucauguccuggguauagcccgccccgcucuguucuggaggagacucuccugagcuagccaguagaaccuauaggcucucagugaggaccucaaaguaugaguggccucaggcuccuuccuaccccccccacucccccacccccacccccucacugugcagaccuuuccuuagcuagcucucccagccagucuauacagaggacacauccccuucucccuuguauaucuuuaauuguaacugaccagaacuauauucagggccacuacuagugacacuagucaagaaacauggacaauagauacaaaggacaggagccccuggccagaauuagguguucuuagucccuauugccaccugccuuacaccgugguauguaaccccuuucugugucuuggguuucucucuugugaggugaggcugugugauuugggcucugugccuugccaguugggagcaccacuuucugugucagcaagcuauggcuugcucagugccacugucccucauuguuuauucugccaaacugcagccugguuuggggccagacacuggguuuggaguucaguauuaaacuugggcuccuggccaugaguccuugugagggaacaguuuugcucauuuuauuuugugugggcugagggacccagaagcacaugugaccacagaucagaaaggaauccccuugcucauucauaucaguuacuuguuacauggaugccacgcccaccacugugaugggagagauguuuucaucuccaaagagggauauucuugguugccuugucacugucuaaccuggagaggauagggaaagggcagaucaguguuugcugccacuguuaaaaccaccaccauaauauuuuagcccccacuguucaucagaggcauaccagauacuuuguuuagugucuaauuaaucaucugagcaaccggaguccaaacaguaagacgcugugccaugggcaaguuuaucucauuuuauuuuguucugcuguuacucuguuuucauaacggcuccuucuguguguaugccuccugacaucucccuuugucuaaaccagaucaauaacacagcagugggacaugcccugguucugccugcaaggagggaucucacagacuuccugaagaauguccuuaccugccauguuugcuuggguaagcugcucaucuaucugggcauggggaucugucuaaccauagccaccaaaguugucacuacagagggacuuuugaaugaagagugauaauguuaaguuaagacucaaggcucauugcauugacuaauguaaagaccacucaagggaguucugaucuuggaaucuagagcccacauguuugcccuaaaguacuuuuauuuaagguauagcaaguggcaggaauguuuuagucucacagagcacuaugaagacuuuaagucauugacaaguuucauuuagugaaacgagggaacaaaaacugaaaucugggcacaauuaaggcagagaggcauagucuaaguauauauccuagguuguuucaagcuagugauucuccugccucugcccuuucaagugcauggauuuugggcgugcauccuuuuccgcagugaaguuucuaucuccugugaugauuguagucacuugagucccagaaaauugggacacugcugggaccacaugguaauugaccacugugauuuuuuuuucuagacauuugcaauaucgacccauccuguggcuucggcagcuggaggccuuccuucagggaccggagggcagcaggcagugauguggacauagaccuggcuuucaucuuggacagcucagaggcuaccacacuguuccaguucaaugagaugaagaaauacauaggcuaugugaucagacagcuggaccugagcccagacccgaaggcuucccaacacuuugccaggguggcuguugugcagcagucaaccuacgagucuguggacaaugccagugugccgccugugaagguggaauucucacugacagacuauggugccaaggaaaagcuguuggauuuccuuagccggaggaugacccaacuucagggaaccaugggccugggcaaugccauugaauacacuauagagaacaucuuugaaagugcuccaaacccacgggaccucaaaauuauggugcugauguugacuggugacaugcagaggcagcagcuggaggaggcccagagagccauccuccaggccaagugcaaggguuacuucuuugugguucugggcauuggcaggaaggugaauaucaaggaggucuacagcuuugccagugagcccaaugaugucuucuucaaauuuguggacaaaucaacugagcucaacgaggagccucugaugcgcuuugggaggcugcucccauccuuugucagcaguaaguccugugccacacauaguguguucugccuauggcuuuauucuggcucauacucucaggucacaagucugggugaacagucauagaaaaauacaucuucgugcugaugugacuuguucauucauccaacacacacacacacacacacacacacacacacacacacacacaauuauacaugugccuaaccugugccuugaguuaggagcuagagagucaacaagguacacacagacacaucccuugucuuccuuugcucacuuauuaugcccguuugucugaugcuuucuauccauaaggcacugauacucuuccaaagaguccacgacuagguuugcaaguggaccaaacacacaaugacuaugcaugaccuaguaugcugguugugccauaaggaagccuauccugucagguggcuugagggaagcuuuuagaagggguugcauugauuuaggauuugcugccaaacccaugcuugccucugggcagaacucauccuaccuucauuucuucuucccuuaugaagggaagcugcugcagcugcucugcaguuacccaaggaacuaauuuucaguaguccccaccuuuggacuguaggcuuagagcaucuguuaaucagcuuaugggucuuuugucccuguaccugugaucucuugagacuguauccucccuggagauaguuuagaccugacauaguucauggcgaaugagcucaggucacauauuaaacaaauaagggagaucuauaaaaccuaagacagcaugucuaugcugagucgucauuguaagacagcaugcccaugcugaguagucaucgcucagcagaaagcugaggaccacgaacaacacacuauucacaucaugaaagucuguccugcaaaagauuuaggagaagaugugaaggaaaggggagccucagcuuuacccagggauccaugcuucugccuuaggaggauuaagcuagaguguaucccagaaagcauucggagaaccuugaacauaacuggauuguaauucgauguucagcgagugucuggaaacuguccuacuaucuacauaaaguuucauccuagccuggucugcucuuccacauugaggacauguuaccuuuaaaugaaucauccaaguaguuaugcaacuaacuaaucaaacugauuuuaauuuccauaugauucacaugaaguuugauuuuuuuuuuccccucucuaggugaaaaugcauuuuaccugccuccagaucucaggaaacagugugauugguuccaaggggaccaaccagugaagaauggcgugaaguuuggucacaaacagauguaaguaguuaugauugucaaaccaaauaucauagcacgagaguagcuguagaggcucuccagccaaucccuagcuucauggauugagauauugaaauauagaaauaugaauucccuaaaauagugugaguucuuaaacauucuuuuguauugguuagcuuuguuacauaaugaaguacccagaauuuaguaacuuaaaacaagaauaauuugcaauccuguggguuagaaauuucugacuggguuuagcuggguggucugucugucugucugucugucugucugucugucucccagccuccuuuauguugaugaugauaaauuucucagcuacagacaggcuggucuaaccuggucuuagugggaagauucaucucugcucuacaugauuucuuaucuuccaguggcauagccugggcuuguuugcaaguugaucaggaggguuuucauuagaaaaggacuaaauauaaguucucuugagacauaagccaggccuagcacauugucauuuuaaaccacauuuuaugggucaaauaugcccagagccuagauugaaguguggcaagcaugaacagaguuggggacuauauuacauuauacauccuuuccccugucucuauccuuucuuuuugucuuuuugagaucuuacugacuaguucauguuggccuagaccuuacucaguagcccaggcuggucucaaacucguggcaauucuccugccucaucuuuccaauguguuaggauuacaagugugagccacccaccucaccuaauaaguagauacuugauagugcaagcaaauaauacugauuuuguugcauacaacucaguugauuguuuaaauuaaaacauuguuaaauauuuauucuuuucccuuuuacuuagcaccuuuucuuuuccauugaaaaugggguaacagauuuaugaauaauuaauguaauuauuucaaauaauucuauuuuaauauucugugcaauauuuucuuagaggcagacucugaaaguaagagcuauaguauauguaacauuauagaagguuuauagaaaccagcaccuucaugcuguuaaacagcaaguucccuguagaucauaggguuaugacucuauagcaugcaaaaguauggcuauagguaauguuugauuuguuuuuaacagaaacccuccacauacugcuaauucaagucuuacauccaaaguugugaccacaaugaagccagugacaacgaccaaaccaacagcaauuguaaaccugccaccugcuaagccagccccagcgaggccagccccugcucagccaguucuugcuaagccagaccccgcaaaaccagcccaagcaaggccagccccugcuaagccagcuucugcuaaguuggugccuccucagccaguccauguucagccagccccugcccagacagcuucuguaagaccagcccccgcuaagccagccccuccucagccagcugcugcuaagccagucccugcuaagccagcagucccugcucagccagccccuccucagccagcugcugcuaagccagucccugcuaagccagcagucccugcucagccagccccuccucagccagcugcugcuaagccagucccugcuaagccagcagucccugcucagccagccgcugcucaaccaaugccugcucagccaguccuuacuaaaucagccgcgugugaaaaccagccucugccaacaagccuguggcagccaaaccuguggccacgaacacagccacagccacagccagaccugcauuagcagcgaagccugcugcagcgaagccugcagcaacgagaccccuugcugcugccauaaggccaguugcuaccaagccagaggcccccaggcaacaggccaaaccagcugccaccaagccagccacuacuaagcccuuggguaagaaagccugcuuagagacaccaucuuuuaugccugcauuuaauacuccaaggacauggcccuggaagcuggucuacaggguaggcugaugacccaaggugggcauaguuacauaauagaccuuagaagaugcuagccagacauaggguuguccacauauugcuuuucucugcaucgugaagcaguuuucccuuguacaaccucucaaggaugcugggguccugaggaagacugaugcuuccuguacguucagcccugcuucccuggcuguagcuucucugcuguagagccccauccugguucucuggcucuucaauauuucugucccuaucuuccaugguauucccugagccuuaggaacagaggcuguguuuuagauguuaucaacuagagcaggacacuccauggucaguuguucucccaauuuucucacugugaugaauuguuucugcugcaaaaagaagcaucuuugaugaggggugaaagcuaugcuuaucuguggguauaaagauagguguuuagaaaucacauggcagcauaguaggcucuucucugggucccauggccucaccauccaugggcagcugacgagguccuaugaugcucucaucuauaaaguucaaccucaagaacccuguaauagagccauacaagaaauguuuugaaauauuuuaaguaagcuuaugauuuuauguugggccauacccacagguauccuugguugcauuguagaaugugggcuaugcguugagugcuccugacuccgagugagagagaaaggagaagcuugccauuuuguucugguuaggcagcagaguggagucuuuuucucucucccucccucccuccuucccuuauuuccucccucccuccuucccucccucccucucuucuuuucuuuuuucuuugccugccugccugccuuccuuccuuucuuucuuccuuccuuccuuccuuccuuccuuccuuccuuccuuccuuccuuccuuccauacuuccuuuuuugcuggaacuaaacuugcuccccuucuaaugugacucagaaagaucaaagcugguccugugcuaaucuauuccuucuuuccaaaagggauguggucacagaaaggggccucacacugaguauuguggcaguaucagggguugguucaauaaagugagaaaugacaccucagaaacucaguucucccucagaggcugaccagcauguucauucugacccaagaaaagcacuuuccugauuuuauguguguguguggagggggggggggauggggaugaguuaaugagacucagggggguauaauuguuagcuuuucugagaagauguaagaagauucuacagaaugucauaaucuauaaaugaagaugaaucuagaauauaugugcucaugaaaaaguaggaauuaucuuuaccuaugagcagacagagagcugagacaguauguucuugucauagccuacaacaccaugauuuuucauguuugcaauccuagagcuggucuuguacugcacauguaacuuccuacuagcaugcuggagcuuacauuucaaaguaucuucuucacaagggauuuuugauagaaaaaaugaagguagucacuuauguaccuuguugaugaauaaagaugcguuugagucacuaugcucuuacaugccaggcaggcugguggaggauguuacuggugaaggggacacuagcucccuuucuuggcgagcuucaggccagccguccaccaacaucucccagaucucuucugaagcucccacaugugcuccuguugugaggaguuuuacuuuuauaaacucugcacucugaucuuucagcgagagugucccgagaaguccaggucucugaagucacggagaacagugccagacuccacugggagcggcccgagccuuccagcuccuuuuuuuaugaccucacuguaaccucggcccacgaccaguccuugguucugagacaaaaccucacugucacugaccgugucaucggaggccuacuggcuggacagcuguaccaugucguaguggucuccuaccugcagucucaggucagggccaucuaccaaggaaguuucaauacgaguaaguacugacaacuugagagcacuugggucuugauuucuacaugguauaccaaacaggauauaaaacaaugaugccuugaguccauucugaagcacagacacaauuaaguacaauccaucaaucuuggguacuuaggcuacacccugaaaaucaaaaucacagcaacagcauaggagacaggguucccugugccauaugcucucauucuugguuccugggacccuuuaagggggagaccagauuugcucugccuuagccuaucaugucuagguggcaugugggaaauggggaccuggauccuggcgaggaagauaguaggaucucuguugccacuuuuaguuuccgagucaacuacuaguugguuguauuuucuuuucuuauagagaaaacccagccuccaccucuucaggcagcacaccgagcauccaguucaaccaucaaccucauggugaacacagaaccauuguuucucacuaaaacagguaagucguggcaguacuagguccccuaauggacuucagaaagcauucugagaccagggagaaguacugcuuaauggcuugcaaacccuuugaaauugaggccaccugccugagacuaaaucacaugacuuccaugggaucaguuccaaagggguccucagcugcuggguuucaucucacucuacauggucuugguuucaaaagcagaggaaccaagcuugucaccauaguguuagaagaagcuggcuggagcugcuucugagcccauggcuauuaugcacggcuccaccagucacuuccucuguguuauguugaaacuggcuaggguugacuuguggucuguagugcugcaaagaauaaaguuucauucacuuaccgagucaucuauaagacacugcuuaggagacccaagguaaccagacuggauccugcagaacauguggauucagauauauuuucaguucucaaaaugccacaucuaggcuuggucuuguauuccacuuuccuggauaccugagcacagagugugucuguuagugacaggaaagauugcuguuuuugggauacaagucugagaaccuguaacccucccucccucuauauaaguugcuuuucuauugcuaugacauguucuugucauguggucacuuggucaugaccaaggcaacuuauagaagaaagaguuuauuuugggggucacaguuccagaggaauaagggucugugaugauggaacagagguaggaggcugcaggcagcuggaguagcagagagauccuaucaugauccacaaacaaggggcuuagaacucauuggggcugauggaaggcuuuuaaagcuugaaagcuuacccgugacacaccuucuccagcaagaccauaccuccuaaucucuccugagcaaccggggacugucuuaggcuggguuacuguugcugugaugaaacaccaugaccaaagcaacuuggagaggaaaggcuuuauugggcucacgcuuccauaucacuguucaucaccaaaggaagucgggacaggaacucaaacagggcaggaaccuggagucaagagcugaugcagagaccagggagaaguacugcuuaauggcuugcucccuaugcauggcuugcucagccugcuuucuuauagaacccagaaccaccagcccagggauggcaccaccuauaaugggauugcccuccaccaucaaucacuaauuaagaaaaugcccuacaggccugccuacaacccaaucuuauagcggcauuuucuuacuugcaguucccuccucucagaugacuucagcuugugucaaguugucccaaaacuagccagaccagggaccaaacacauguucaaauauuugagccaaugggagccauucacauucacauaacacuuucauuuagcagaauggaggcuuggcuaacuagcuuugaggaagugacuacacagugaucaauuuguuugacuuaggcaccaaaggcgccauuaacugacaugagaacucaaaauccugugagacuuuaguuaugguacuguuucauaguccucagagugcaagccccugcuuagcauggagauugucugaugccuucuggccagucaggaggaacaggaugccucucaauacgugcuuucuuucugagucaucauucauaagcagccuuuguaacugccuuuguaacuguacuagacggaagagcuacuaccauugucauuuaacagcaagcgacugcaugguguccaaugucucuagccuuuccugugaaaggcuagcagaagaauagggaguuuuuccaauagaaauuuuugggacugagggagguggggcuccauacagguggugguaauuaacuacaacugcugagagauucuauaaaaagccuugaagaaauuuaaugcuaugguguaaaugcaaacuggaaaagugaaguaggugggugaagugagaguugguugggggagggggaggagggagaggaggagggggaagaggaaggaggagaagaggaaggaggaagaagagggaggagggaggaaggggaggagguagaggaggcgggggaggagacgccacugcucaucaguuucugcuguccacaccaaagacuacagacagacuuuugucuccugccugguucuacccugcagcucacagucuauucuggucuauucuuaagccaccaugguaaggaugccccaacaugaaugcugaccucaaaagaaagccacaucucuguggcugggguuuucuuggauuuuccuucaagauacugucacagggucagggagauugcucaguggguaaagcaccaaggguguaagcuugagaacccaaguuugaaccccagagccccuguaaaugcggaaagagagaaucaacuucacaacauuugccuuugacugccaaacucaugccacggcccaccccucuccugucauguucccaugcacaauaacaaguaaaauuaggggaaaaaaacccccaaaaccaaacaccagccaaagaagacccagaauacauucacuucaaagacacagaaagcuguguguuuaaucugauucccucuuccuagcuuucgucucugaguauggaaaauguaaaauuuccagcaaacucuuguuucauugagagacuuggaggaacuccuagacagcaagauucagggauaaguugguuucuuuaugugugccgcugaaggcugagacuguauaaacaguguuuaguuagcguaaacaacauaaucuuuaaacacuaaucugggucaggcuguucuguuuuuaaauguggaguugcugcuuccagaaucagggaaggauuuucuccacagacauguaacacugucugacaaagaggggagauuuggguuuuguuuguaacggggacccacguuccugucaaggccgcagagcauuuguuugcgggugaaucuaaaaucugucuccuucccacugaugguggugagguagucugaggaugcaggugaaugucugugucuucuugacaaagcccgacaagggcagaggagucugacuccaugucucccagcucaagcguguccuuuugcuagagaacugugcuuccagaagacccugccucgaggugaagguugauucugcugguagaccuccaacagcauccacaccuugccuuucaaggcucuagacuuugcagcauuacguuugaaaugguuagaauuuguauuuugaaaaccaagcaaagcaaaccuuccuuaaaaucuccacuuuacccuuugcuucccuuagcucucaaauauuacaaugcagccacuuuuaaguaguaagguuacugucuauuaaagccacuuagcaacgacugaacaaguccuucaguauugucuuacucgaggaaagcaaggagggcgcuuugugagggagagccuugagucagguugguagccacucccacaaacgugcagauuaucugauccugagccuuuguugaaagaaggcuuagacuuucagacuucuagauuaaaacauuuuacaugcacacgucuuucccagcaaacuccagcguuugccagaaaguucuguaaacagaagucuugcuguucucaaacugucaauuuaccucuguaggcaucuaggggacccagccuuauuuugcaacugggcuccagcaggcgugugcauucaaacccugaacuuccuuaacuggagacaaaccaagcuucuggcccccacaaagucuugcccuggggcauuucugcggccugaggagcuucuucuccaucuuaguuuuaugugagagggaagaaaaguagucggcuauacuguaucugcacacacacuuaacacgaugaacaucuguugaaggccuggcgagaaggccuggugguuaagagugguugcugaucuugcaggggucagaggucagugcuagcacccauguuaggcugcucacaacugccucugacucuagcucuaggggaacugacauagaacacaagcauaaacaauaaaguguauauauuuacuuuuauuuuuauuuacuuuuuuucaaaaaagaauacucaauuacaauuuacauacauuuucaaucuacuuaucuucuugaaauguauagucuaacagaauuuaaugcuauuuaccaaggaguaugaaaguccauggucuggacaguguagacagaaagaacuggagagcagaugaccucaaaauugaaauggggagaaguuagucauuuuauuuuuguuauucagugacagcuaauaguugagauucuugcuguacuuuuuguuuauucuuugcaaaccugugacugacugcuaugucaguuuaauaaugaagaaacagaggcucggguagguuaaaaccuucccaccaggaaauucuucucuacaguagcauugagauccaaccacagacuccaauauggagucuggaggcugaggcguuggcacaaaccuacugaugcuccuuucuccucuugcuccuguagauauauguaagcuguccagagaugcugggacuuguguggacuucaaguuacuauggcacuaugaccuagagagcaaaaguugcaagagauucugguauggagguuguggaggcaacgagaacagauuccacucccaggaagaaugugaaaagauguguaguccugguaaguggccccucccucucuuggguuuuauuuuucuauuaugcauaaagaggagagaucaggguuaauggccucacugcugagaaaugccugaauuacaaugguuauggaaaaccugaaaacaguuaaaucaaauccucagauaagauggaccagugaaccauuaaaaagauaaaauuuuuaauuuuacacacacaugaaaaaaaaaaagccacaggaaguuagugauuggaaugacugauuuguuucuugaaagcauauguguaucuuuggugguugggaaacccagagccaaccaagcacaucaggaacauuagcacauccuugucacuuuagaagugucacaguacacaugauuguugaauagaauaaugaucaacaacagaagaccaaugauaaacacuuauauauauucauuuuaaaauagcuuugcuuccuauaaacaguaaugcugacaccaaggcuauccaagucucucuaucauagugagcaauucaauuaguaauggcucagaguucagauuccacacggcccaaaccugaagccacaaggaccacaggaaccagugaggaaaggguacagacuggaggcugugggaucaugcuaugauaaauauaguauauuuuauguuuacugaccucucuucuuuucuucuuccucugucuucucccuccacucuucucuccuucucuccacacucaaugcucuccauacccagaguuaacaguuugacaagagccuaagcauggccuucaggcaacacguaccucugggagaaggaggaggcagccauuucuaacucguuucuauagaagcccuggguagaugccucagcacggugccuuuucaugcuuugauugacacucaaccucgggaggaaacccucugcacgugaccugucaauauggugcuaaaugugucuauggacccugcucuccgucuccaggcaguucuaccguauacuuggacccuuggguuauagcuagccacugcugguguuuaugugaacauuccuauaaauucaauuucccucuggaguuccacgcuacgccugugccaggcaaacccugugccuagaacauagccuggacgucacagcuacucuguacauuucugcuugguucauuccucuguaguugcacggcuuagauggagaaacaagagucuaaccuucucauggucccaguuuucuggauuagacuucgaucaauauucuucuaaauccucugacaaaugaucuaauuagaagaaaucagaccucuuuccugugugcauugcugggacaaaugccuccauuagaaaauucaaagaaagucauaaucgagaaucucuuuggugguccucuaaggcggguuguuuuucaauguuguugucuuggagcuuggaggugaaauucaauguuuaaaauuuuuaggaaauuuauacaaagaaacuuuuaaauaaaguauauugaaugugccaugag

SEQ ID NO: 292 - RNA, 907 nt, Mus musculus
cauggcaccgaggaccuggcuucugugcuugcugcugcuaggcuuaguccucccaggagcuuccagccgagcccaccagcacuccauggagacccgcagugagugccuggcauauggaggacagccacugucaccucccauccauaugcuucccaaaugccuugaguacccagccccugaaugggagguuagccaucuccuaagccagugguuuccaaccuuccuaauacagaacuuuuaauacagauccuuauguuguggugacccccagccagaaaauuauugugaugcuguuuucauaguuguaaguuuugcuacuguuauggaucauaauguuaauaucugaaaugcaggaugucugauaugcgcccuuccccccaaacaaaagggacacaacccacagguugagagccucugggaucuaagcaaaagcuaccuuaccaugcagucaguugggagauugguccuguuaagaucuccccagaaugguccuguuuccuguccucaucauuccccuaacccaucuuuguggggucccuuaagacuuuggaggaugacagucagacaggaagagaauacugauccuggcauaugucuaaauaaauucccuaaagccacaccacugcccagauaugcccagccaguguaaucagggugggugccaacauggccuggugcccagguuuccaucagcuuaggggcucccgugucccauacgcugcucugacucuuuccuuuccagccccugacaucaauccugccugguacacgggucgugggaucaggccugugggccgcuucgggaggaggagggcagcccugagggaugucaccggaccuggccugcggugccggcuaagcugcuucccacuggauggaagugccaaguucucucacagcucaugaa

SEQ ID NO: 293 - RNA, 1568 nt, Mus musculus
uuucaaguauaaugcuaacuuuauuguaaaaugagauucucugggugaagcaucagcaacacuaguccugccugccauuauguggaugaaaacagcuagacuucugucugucagugagacaguaacaagcacuggauagacauuguaagaaaacggugaacauggcaaccgcuaaugcagagugaacauuacccagcaugaagucagugaaaaacugaacaugacucucauuguauggauugaaauaagaaaaagaauaugguaauuuuacccauuacacuuuguaaaaucagagacaugaauuuauaagcagugccuuuaauaaagacgguaauuuaauuucaaauaaauauauuugcuuucuauuccuuuaucguguauuuuauuauguuucuagcuggcaaaacccacccgauuauugaacucaguaauaacccaauccaugaugcuccaucugucauacaucuaacucacuuuacauacacugcaaguucacauagcaucccuauaaacugcuagaaccucccgagcccagugugacuggccuuuuggacaaggcaagggaggguccgucugagcauccucagauucagccugcucuucccacaagugccaacaaggggcagcuccuagcucuccugcuccucguagugagcguagccacuggcauagguccuuccuaaauucaaguuacugaacagaucugaugacucagcauuugaguccuucccaucuucuuccucuucauccucugcuucauccuccuccuccucaucaugguauccaguaucuccauacuuguccgacgcaucauacccuucuucuccuccagucugccugccaaauuucaaggagcguguugacauguuaagauccuuugucuccuguguuucaugcccacauuuagggcaaggagguuguuuuccuuuuucuugcuuaaacacuuugcuccuuguauguucaucacagaaacaagccuuacagcggagacaugaaugcuggccaaguugacugcaggaaacacauuuaaauguuucugcuucuaaaacuuggcagcuggcuugaugcucaaacuggucaucuucacagagaaaauuauggcaaaacgaacagcugaauauucuuccuccauggucccauaccccuugcucacauucaggcacaggcaugggugcuaagacacuuccucccauggcaaacccaagcuucgcagaagucacauauugcacccaccauaacaaggccaguacuguacacaccagcaugcuugauaacacagucugaagacuucaucauacacuuuguuuucccacacugugcacaaauugguaacuucugaacagaauuacaacaauagcaaaaugcucuauucuucugccgccucugacauuugucgcauuccauugaagcauugcauggguguuuggcuaggucgacaguacuucuugaugcucgcaguuguuucucgaguucucggcgguucucugccuucuuccucacaccggucuuuuucuuuggcauguucccuucuuucgcaguggccgaggacgcagaggagagggcgagcc

SEQ ID NO: 294 - RNA, 7206 nt, Mus musculus
uagaaagcaaauauauuuauuugaaauuaaauuaccgucuuuauuaaaggcacugcuuauaaauucaugucucugauuuuacaaaguguaauggguaaaauuaccauauucuuuuucuuauuucaauccauacaaugagagucauguucaguuuuucacugacuucaugcuggguaauguucacucugcauuagcgguugccauguucaccguuuucuuacaaugucuauccagugcuuguuacugucucacugacagacagaagucuagcuguuuucauccacauaauggcaggcaggacuaguguugcugaugcuucacccagagaaucucauuuuacaauaaaguuagcauuauacuugaaaaauaaaaaauaaaacacacguucagaacucacuuuguagaccaggcuggccucgaacucacagagauuggccagcuuaugccucuggagggcugggaugaaaggccaguacuacuacuguccugcuucacgccuuucaauuguuuaaaaaaagauuuuuauguguaugagucuguuuaugcgucugucugcacuuacauacgagcaccaugugcaugccuagugacuauaaccuuccauaauuuuaacagcccugcuuagcucaccucugaucuagaucgccucaaaaguaucaacacauaacuuccuaauuucaggcaauuaaaucauucgcgaaggcggaugugggguauccuauguccagcgagcacuagccgccaacccuuccaggcgcucagucuuggcugcugcggugccucucauugcaccgcgcauccuaacacuuuuacuuccaugaacuuugcggcgaccggugaagucacugguccuucugucacuagugacagcccagggaggugggcucccagagcacggugccaguagcuggagcacccagaugacucgccaugagcggcgcgcgcuuugccgaugaccgguuagauaggaccggcagcgcgguggcccuacuaagguagucuccagcuccgucccacugccaccugaccccacaugaccaaucaaccagucaggggcggaggcagggcccgugcggcucacagauuggccaaagcgcgaagcgcagccaaugcggauacuccgggacccgaggcuccgcccauucagagacuucggggcgcucaggcuuggggugaccugccggcgaucagggggauggacgcggcgcgaaauggcgcgcugggcaguguggagagccuacccgacaggugcgcucccuucaaggagcccgcagggccuagggacaccugggggaccucagugaguguauggugaggcgggaggaagggacacgcagaagcguccggccacaggaaccgggagagaacaggcuaccgcccaagcugagggcagaagggggcccacgggugacaacugugccgaguguggccacaucauccucccgcguuucgggcuucuucccagggaaugggcucuuccuggagguuggaacuggcagccgaaucgcgauuaucugcguuuuacaagaaucgccgcugcuuagagucuaggauggcguggcugugggacgggggggaacgggggggggggacgggacuuuggggcccauuugaccacccgaagguuuaaagugggcuuuggggcgggaacccuaggagcaccaggacagugggggagaccugccuucucuugcuguccacugggcugugggaccuccuccccuggcgcgcaaggaaccggagguccuggcucagccuucucccacccaggaauguguuauaccagaagcccccucuccauccccaucucauuuuuuucuucuuucucuuuucucuuuuacccccggucccuccuccaccucagccccauaaggccucgauauguaguccaggcuacuccugccuucuccgauaugguggaacuugccuauaaucccaacacugaggacaggaggauugugauuuggaggccagcuuggaucacacagugagaaccugucucauaaaggccuaagccugguggcuugagccuauaccagacguuuauuaagcaguuucacuuucucuaggaagcccgcuaauaacagagucaaucgcugauaaaaugcaaaccauaaaccaguucggccaagcuauagaugggaaaaccagucacuuggcaggccuaugggugugcagcacuuugggggcucuuuauuucuaggaaggaacagacuugggacacaggcaaagccugcggcaaugggaauuccagccccaggguggucagguagguccacauuacaaagcccagccuugcaagaucaggugacugcguggcacuuaaagcaaagauaggagaugaaagcuucuuccugccuguucugccgugcuccccuggacauaguugggcagugugugcuggcucaccacugcaucggcuugaacacugguuugauguaaaaccaagugaaauaaugacuguuuucaggcccgauugccuaccauagagauuuccgaaggucugggacccuggugagaacacaagcagauaacucuccuuagggagggucucuggggcuuugaacucuguguccuguggaugaaguuccuacauaggaagacaaagccugcuuguuccuggagcugcucaucacuugcucccuagagaggacacuaagcaugugacucuugggucagaugaugaauggguccacagcggaagacagggagggagggagggaaggaagagggccaggcugcgugcggccuacaguuuccaaucgaacccuggagccucauccaaacagaucugcugaagcacagacuuuaaaaaguuuagguagaguggggguggggcaagaaaaacugaaaaugcaaguugccccagggagagaccugcccaguaaaagccagggaggggacagccauagcccugggaagccuccagcaaagaugaguacaaagcuccuuccuagaggcaguuccuggaggacuggaaggggcagauggcuccaaguuguugggaaauuacccaggggaaugugggacuccccagccauuggcagauccuuccucccucccuuccuggaguugggccgcaucucuggccuccagccaucagucagccucaugcuaggggagauuauggccaucuuguauggggcagcuacugggugacuggaaaccauggugucucccaucaggagggagaacauggagagcugaggucuaauagccuaccugggccuucacucuagaugcagaagacccucacuguggucccccaaaagaguauugcugcuauacucugccuccccaaacuuuacaggcuauucucucuuccaggaaggucuauauggacuauaaugccaccacaccucuagagcccgaagucauccaggcugugacagaggccaugaaggaagccuggggaaaccccagcagcuccuaugugucagguaaucuagaagaauccaugacaauaaagggaaccagaagccucuuagagaaaguguauacuaaccugacuugguggcaugugccuuuaaucccagcacucagaggcagacugcucucagaguucaaagccagccuggucuacaaagugaguuccuggacagccagggcuaccuaaacugagaauccgugucucaaauaaaaaacaaacaaaaauggguggggguauauaaaguguaugcuuacaugagaugguuuuguuugggaaugggguggacuuucauuuuucuuucaacuuuaaaguuaguacaaugccuauauugcuuaacagaauucccaagaguuuuuuuuuaagcacacuuuagaaaaauggaaacaaaauaauuacguucuaaucuuuaagcauugugucacuaaagucuacauagugucuucuauguaaauuagcaucauguuacaauuauauaccugacuugauucuuaaagucuucugucccuguaugauauccuagcuaggaacuacacaucccacaggcugggauuaaaggcaugugccaccacugccaggcuuauaauuauauucuuacuucuuucuaguuugccuuugugguguagaguuuuaaauuuuugcauuuuuggaugauaauuugcuucaagucaguagucaaaaagacagcauuccacauuuucuccacagacuuggaggcuaaucaugcuuugccuuccuaguuaauguuuaucagcagaaggcaagggccccgcacccagcccugcacuguguaauuaggguaacuaagacaagccacauuaaugaugguuuauugggaaaugagugccagccaggggacuaaagaugacccaagcuaacugaucugccaccaggucuuacugguaccucugucccuccguaagggguuuggugggucauagcaguugcuuauugaaagcuccccagcaacucagugacacagacuuuccagaucagaugcuagucacccauuaacuugucuguugccuuauuucuggacauugccaucugccuaauguccccuguaguauagucaaacuucuguuaggguacacuagagaaggccaagaagauuaagggucaacaggaaguggggcacacagugggagaccguugcuggccugggugacaucccagcugcuuucuguugauauuugaguagaaaugccaagaaaagugaaaaucaugaaucacaaauguuugccugucuuguuuucaaggcagaugggaucucacuguguagcucuggcuuccgggaauuuacucuguagcccaagccugccucaaauucacagagauccaccugugucugccuccagagugcuaggauuaaaggcauguaccaccaccccagcucaucacagauguuuuagugugucacaguauuagguuuuaaaaucuacagcaaugugugcugagguucugugggaagaguuugagugcuccagauguggccuugcuuguaacagccaacagcauuuggaagugagcggagaaggggagagguucuggccuacugggcagcaugggaaagcuggucuggacccagcaucaaauguagggaccacugguauguuggcugagagccgcauagagccaccuuccucugacacaguguucagugcaacugggcagcagccaggacaccuaauugaaggcaaaugcuuccaaccuuccuccugugucucccaaggcugaccugagguugagagaaggcacuggcugaccggguguguaaagccucauguucuguuugguuacuucugugguuccuuguccuaucaugaauggugggaaggugggcggcuagccauagcacccccuccucuagcauccaguaagaaagaaaagcugugcugggggagccuagauuccccccaaccaagcugccccuggcucucacugaguuccgguggugggcacugacuuccuaagucucucaauguggccccuuugcugaugccccaccaagugguaggaaagugugcuccuuuuagugggugugucuccuuuuagaaucaccccaguccuuggcuucccuuaucuaguugcucuguuagauguggaauugcuaguaaugaccauguuuuuuguccuucaagguaggaaggccaaggacauuauaaaugcagcucgagcgagccuggccaagaugauagguggaaagccccaggacaucaucuucacuucugggggcaccgagguaaagcugcugccuuuaccaaaaggcaaugaugggguagggguggggucacaucaggaacaguuguuagcuguggaucacagguuacuucagccacagcaguuuuuagauuaaaagucaauugguuuggggguuuuuuguuugguugguugguuuuaguuuguugguugauugguugguugguugguuuuugcuucuuguuuuuuguuuuguuuugugucuguaauaggcauugaccaggacauaaaaaugucacuuaggaaauagauccaguagaaaagaacuggugagaccucccagggaggugacagacauuuccuggggccuccuaagaaguucugacccugcuuugcagauuggaggauguggguucuuuuaaaaccaaucagcugacucaguacagccucuguuaaaauucugacaaugaacucucacaaaugaacucauguagaagcuaagagucaaggcuucuggaagauuagcugcccaaugagaaggguggacacuccccaaaccaagacuguaagagcucccauagcuacgcagacagcuuuagcaaggauagacauuuggucagagacagugugucagugcgaacacuugcugcgagacuagguggccacacaucuugccugcucaggacaggccuggacagccauuguccauacaguaguagggcauaagacugucaugugagugagugggcagaucguagggaacccugccuaacugugcugccacuggacccaggagucaacuucugcuguucagcagagaugggaccaagaagugacauuagaaaguccuuagcugggggcuggagagauggauuggcgguuaagagcacuggcugcucuuccgaagguccuguguucaauucccagcaaccacaugguggcuuucggccauccauaauggaauacccucuucuggugugucugaagacagcuacaguguacucauauaaauaaaauaaaucuuuaaaaaaaaaaaagaaaaagaaaguccuuagcugcugccucaguaccucuguagugucugacaacgaaagguuucucaaagcaaguguggauagggucuacuuuaaaggagagcauugggcugggcagccgaggcaggaagaucacauguaugagccaaaaccaaccagggagacacugaauuguguuccagcaaacaguaacagauaaacuuugcauuaucggagaauacuucaaggaaagucaaagagcauuugaaaaaggcuuucaucucacggagcugaccaacagcuagcacccaggacagcugggggacucgcacaacucacagggggauaacagccagcaaacgagucagagacuuuguauuagucagcggucucuagagucacagaacuuaugggucaucucuauauaguaagggaauuuguugaugacuuacagucuguaguccaacucccaacaauggucagcagcagcugugugaauggaagucaaaggaucuagcaguugcucagucccacaaggcaagcaggcagaaggagagaaagagugua

SEQ ID NO: 295 - RNA, 24970 nt, Mus musculus
uaccuuccaacaacuguguuacacagcaacuuaaaaguauuuauugugucauauugcuaggcagaauauauuuauguaauggaucacacaaagcccuaacaaugaagggcagacccgagaagcaugaccucuuuccagcucacuucaccaaagaccaugagggguaagcucuggaaagcaagggagaaaugccuuuagucuugagacuccuacugaaguagcaggagaggcucuuacuaaccaggaaggccacagugccaagaguuacccagacagaagcacuuggggacaugggucacagccuauggggcacugaaugauuccugggcugcuaugaaauugcuaaauuaaacuguuuagcuuucugaugaguuggcauucucugucuguaugccaggcugcccagguccuagucuccaagcaggauugcugucucucagucccuguagacaggguagcgcuaauguucuugaaguuacuuaaaauuuauuugaauugcauuuauuugggagguacggauauggagaucagaugacagccacagcaguugguucucuuacuuuguggguccuggagacugaaucuggguacuuaggcuuggcaggaagugucuuuagcagcugaacaagcucacugggcccacaguguuauuuugaaagguuuuuauuccucuguguggaguacaugcagaggucaacuuaggguguuccucaggagccaagcacuuuguuuuguggggacuggaucucacuaggucccagauucaaggucugaggaucugccuguucccaccauucccagaacaggauuauaagccgugugcuaccacacuugguuucuuauguggaugauggaaauuaaacucaggcccucacgaauggcaagcacauucaccaaaugagcugacuccagcuugacacccucccuaguauguugggguuuguguuuugaacagugucucaggcaucccaggcuagccucaaacuggcuauaguggaggguggccuuccaauucugaucuuccugccucuaaucagguguuggggcuaucuauaggcauguacugccaugucugguuuauggugaaggaacccaggaucccaagcaugcuaggaaagcccuccaccaagauaugucuucagcucugaguggguuucugaggcagagucuuaguauguaacccagacuggacuuuugaauguuuaaauuuagggacauuuguaugcauucaauuucuauuuauggcuuuuccaugacagacccuaagaagucaucuaugguuuguacaggauauuuugagguccuuguagcaucugcagcacauuuucuaacuggccaacagugauacggcuguggaggaggaggacagugacugucauaaaacaggucuggaaaggcagcuauguaguauuacagccccuggccagcguucauacaaaaaucuacaagagcucuucacuaaauagccccagccugauguuccuacacagaagguaaauuuggagacagguuagaaaguucuucgggggccaaucaugcccagagguucccugccaugggcuagaccauccacucaggcagcgaaccaagcacuccugagauugacagcuggguguaagccaggacgacagucauccucucagggcucacuucagggaaacaggaacgagaugaaugaaguugucuaggaaccuggugagacggcaugguaugugguaaauucaccuauggaccccauuucagccacaccugggcuccugccagaaaugugcucuguauagaaaacugaacagagcccuauuauccugucaucuuacugcaaggccccacuuccccaaagggucacaaugacagcaagagccugugaacuacuaacaggucaucaugagcuuguccaagaggcccauggugguucugacaaggacagauccagagcacauucuagagcaaacacaguuaacucaggaccagucacucaaauaacuaggaaaaaaagaaaccuuuauuuacaaccauggaagucccacaggaguacacacagcgugcacaaacaaaaugaaccugcaagucaagagcacacgccagugugcuggccucaguguccuauccucaccaccaucaccgucacguugucugcugagccccgcugcacugccuuguuggccagccuguugcaugcagcuucauagcgggcaucaacagcaggcuucccuucccgggucuggaucuugucauccuaccaaagggaugggaucugagugaacagggcaccagccucugucauucuuuuaagacacuacaccagggcagggccugcucugucccuaacaaagacuggcaggacagugccuggugagcuccauaacagggcuuauguugacggaguucacagauuacuccugacacagggguugcggggcaauggaaacaaagcagcugagacaaguggcacacccucuaagaugucucaccucaaggcaggacaagaugaaguucacagcuucuucugggguaaagaccuugaaaagcccgucgcaagccagcaaaaugaaccuaagauacagggaaaaaacaagggucucagccacaagcuccugaacaaaggugaccugagagcucagugaggaguggcuggcugccuaacguuaaggaaagcccugguuccacucacuacccuaaaaauaaaaagaauaauggcacacauauguguaaucucaguccucuggagguagagaggggucauucuggcuacacagcaaguuugacuccaguagggcaaguugucucaacagacccaaaccaaccaggcuuggucgucacaccuuuagucccagagcucagcuagcagaggcaggugcaucucuaggcuagcugguauauauagugagacccugucuacaaaaauaaaacaaggggcuggagagauggcucagcaguugggaguacugacugcucuugcaagaacccagguucaacacccaguuggcaacucacaacuguaacuccaggaccuuacacccucacacagacauauugcaggcaaaauaccaacacacauaaaaaaauaaaaugaaaauaaaucaaaaaaccaaauuaaacaaaaauccucaaaaccaauccaguagcacugugccuguccaacaacucaauggccacgaaaauuuuaaagcaauagaauuuguguaaggaagcugaaacucuuuaaaaugaguugugguuuaaggaaggaugcuguauaccacaagagggacauuuucccacccguaaguagaaucucagagaccucagaaggagaugcugcauucugguuccuuagggacaaucauggcagcagguauguagugaacauaccugugagccaccacaggcccaaggauggagaacaagcauccuaagggaagcauccuuggguggugcuucacugcugagggucugagauccuagaguggauauccccacuuucuggucugaacacagcucacuguucccgagaugcccagaggaagccucugagcauuuauguucuguuguggaagccacuguucucuuggccuggcuuuaaaauagcuaccugcuuuuguuucuuagccuguccagagucucuauuuucugacagggcacauaccuagccauauuuugugagcacacaaccugagguugagacaugguggggacaagucuagacaggcuacucuuuccaguauuuuucagacucagaauagucaaucacagacaugggcuuagcacagcacugucacuacauacugcuacugucauaguugucccuaaggugccaugcuaggagagcacagaagaccccaggcagauggccuguccuaaucuagggcagagaaugccauaaccguacaaggggccuccagaaacacacuccaauaucccaggauaacugacaacguagccuaggcagguaggugucagaacauggcucuuccuagcaggucuggaggcugccguguggccucuaugcucugccaccagccccugcuccagcucaguccuguuucucugagcuccuuccauuccuucugcucaguuuggcucaggcuuaccccacccuguuggggucaagagggcuguuaccuugcccucagccagucuugcuagguuuccugugcuacucucaaucuaccugcaacaggaaguuuuucucagucacucaggccuugauuuauaagcuaaaacccaaaugccuuggccaccccacagauccugcucagucuguccccagaacuucuucccacuuuccucuccauccaccaagccccuggccaccacaguccuggcuguuucacgcuauacaugaaugaguggacauggucuggauagucucucuggaauggaugccucuaaagccucuuagcacaaccccuacauuccugugauaaagcaagcauccaucucaauugauuccugaccaccguggaccccgugaaaccagaacccacaggugucugucucuguaccacaggaccaggcauacugcauaccccuccccaacuucccccagcaaaggcugaacgcagauuggaggaaagucagcaagagaaacaagccccuguauguguauacccacacuuuuggugaccguuugcuuuuaccugucauugggggucagcuggcagcgucugauaucaggcacagaugugaccccacagcgcuuguacugcccaucuccaauggaacgcgauaccuccagcacgcccaagacacgcccaucucuaaaaugaagggaauaacgucagacugucagacuuaacuccucacaggucccugaaagcagaaacugagagucuacaauagcugagucugacauuucuuuuuguuuaguuugagacaugguuucuuuguguaguccuggcuauccuaaaacucacaggcuggccucucaaauccacaugccucugccccgagugcuggaucaaaggcacucaccaccaccaccaacauuucuuuaucuccagugagacacagacauaaaccgaggucauucaggucuugcuccccucggggaugaggacuacacagcuauacacuagcagcaacaaugggcaccauccaaccuaacuguugauggacucaacagugaaucucacagcaaugccuauaccccuuccccaaccucccaugcccaguuauucuaacaagaugguaugagucuaugccccuuaaaugacuacgcacacagccuguguguggguggcaggaaagagggugguaagcacucuaacugucgaagcuaggcucagaggauaucugaagcuauaguuccuagcugcugaagcacuuucacaccaguagggcuacaaucucacucaugauaaucucucucacacuuuucugugaaggaaaaaacagaugaccuauaaauagaagagguaccuuaggcagacacuaugaucacagagaaccaguguacaguuacacugccccaagaacuaugcuagcccaggcucucauauugacucccugggcucugaggacaucauuuuuaagacuuacuaaauaccaaagcaguguggugguuuaguauccuugaggcuccuaagucacuaacgagaugcuguacagauauaggugggacaggaaguuccuccugggcuggugcuacaguucuggaggcagccuuaauuccagucacccccagugacucaguucagucacccugaaugaauguuuuuuaaucccuagagacuuuuuuuuuuccauuuuuuauuagguauuuagcucauuuacauuuccaaugcuauaccaaaagucccccauacccacccacccccacuccccuacccacccacucccccuuuuuggcccuggaguucuccuguacuggggcauauaaaguuugcguguccaaagggccucucuuuccagugauggccgacuaggccaucuuuugauacauaugcagcuagagucaagagcuccgggguacugguuaguucauaauguuguuccaccuauaggguugcagaucccuuuagcuccuugggugcuuucucuagcuccuccauugggagcccugugauacauccauuagcugacugugagcauccacuucuguguuugcuaggcccuggcauagucucacaagagacagcuacaucuggguccuuucgauaaaaucuugcuaggguaugcaauggugucagcguuuggaugcugauuaugggguggaucucccuagagacuucugcuguuuccuggggaaaacagagcauucuagaauacaaauuauuaaacagaacuggaguaauggaagugccuaggagcagugcugaacaggagcagugagagugcucggcuugggagcacccauauaggaagcagccccaaacuuaagagccaugagagaaccucuucugcagcucagaucuuagcuaugagcagagccuuccuacuccaaguucucaaaagcuaagccuccugcucuuccugggucuggggcucaccugacuccugaaggaaguaggagaccacugacuccuuuagcugugggaaagggggaagaauguuccacccuggagaccagcagaagcccaaagccagugugugaacaccaguauagacagcuauaagcucugguccccaaggaccaugacacuaguacuuagcccagucccagguacacgaugccgauguacugcaaugucacugucuucagaaagccugccaggcuagcccauuccuuguaaaagaaaagcaaacaucucuucauacgcccaaaggaagcccugcuacacacugccuucauuguaaggaacucuacuaacaggcuagucuuacgucauuugucaauggacaccacacugcugcccccuuguggcuaccgucuaggugcuguagaaaugguucucacccuuccuaaugacccuuuaguacaguuccucaggcuguggugacccccaaccaugcaauuauuuuguugguacuucauaacuguaauuuugauacuguuaugaaccauuauguaaaucugauaugcgaccccucugaucaugacccaaagguuaccugcugguguacagacuguggugccacguccugugugaccccauguaaccuggcugccucccucuaugcccagcagccaugcacaaagccucccagcucucauacauuagagaagagaaagccuucagacuucaaguucaaacaccccagcagcuuagcuaaaaggacauuuuugaacauuuuaucuccaacagaacaaaaaaaacuugaggacaaauuauagaaagaaccagaaaacagggucacauuuagaaggcaauguccaugaaguggaagaaugaaguucucauuucaccucugggcacacaagugaucgacucuggucacaugaccuuugaagacagcggugagugaacugaggagguacagcagcaaucucugugucagcaacagcacacucugaaggcgucccuuuauuaacuaauuuuugagagagugccucaccacauugcacagguggaccuugaacuccugaacucaaauacucuccugucucaaccucccaaguaccugaaagugcaaguguucccauaccuagcuuugaaccuggucuacuaaccacuagagacuuucagugccacagcgcaauauauaaacuggguaugcuaaggcaggccaauaauuccagaagugaggagcuggaggcaggaaaauuacaaguuuaaggccagcuuugguuauagacugaggugaggccagccugggcuagaugagacccuguacaaaaaccaagcaaggacaguaugagagaagcuccccagacacacugaaaauagcugagugguaaguacucacuugagacagguuuugucuuucuguucagccagggagacacuuucuaccuuuacugugacacagaugaacuaaguuauucauaugcacugccagaccugagaguggaccuuacuaugcacauuaauccucaaugguguggaggcugaguuccugggaccccauaaaugcccuggauaccugacauucccuccagcuuucuguauccucaugcgcucuucauacugaguuggguugugcucuuugcugaggcuuaaggcugcgugcuucugacuuuccucauuauaucgacacaggauugccugggaagacagagaucgcaaaccauggaauucagugagcagcaucuaggacucagucaaagggagacuuacaaugauuucacauucaguugcuugcugacauacagaagcucagagaauccagcaucaaagaaauagcaaauaggaaaguuguucucacucuaagggugagaaauccccaguuuuggugucaauucugucauaagccuugcuggcugacuguagccaaucucucaaauggccauuguugguggcauuagugacaaagaugggaggcauuuaacaaauaccauggccaaagucagaaggcugugagcuuuucugagaauugaggauacaggcaagcacagcacacacucccuguuugcucccacggccaugguuacugugucccuuucacagaggacacugaaacccagaggaguaauuugcuuaaagucacauaaagaaccaggguucauaggguucauacugggucuggguaugaagaauuugggggggacgggggagaagguggagugacacauuuucccuccuguucugguuugaguaacuuguucuaaacaaguucuacuuguauacuuguuuacuuauauacuagaacuugucuaucaaggcucccaggaaccuaagcucccugaggacaggcugucaccuccguuuacagcugcauuccuagugaugaguccuagcccuaagcaccagaggaggagugguagaggcugcuuagugaguggucacuggcaacugaaggacacaggacuggguggaaagcagcaugcuugaacauaaggccacucccuauagcaccugaccugucccugggcucccgugcugcagaugugcuuggccuuggccuucccuuucacggcucucuagcuacucugcagucaaagcccuuggaaagguggaguuaauacuuucauucaauaccaacuaugucauaaaaaugaggaucuaaguuaccugcacacagauuucauucuaaaccccagugucauuuaauagcauggcaaacaaaccaaaacaaaaaacaagcaaacaaaccaauaaaacaaaaaaacaaaaaaacaaaaccaaaccaaaacaaaaaacccccgaaauccuauuggcaggggagacagcaucucggugugaaccagccagcucuugcccuggggagaacagacggcccugcucagcugccgagucugucccagguguacacuggaacacuccuugcagaaaccccacuagaagggaaggcccaaccagccaccaacacuuuaacuugcuuaaggucucuccuuaagacaugcugucaccuaagcagguggcucagagccacauacccgacuaucuccaagguuggcgauauacaggauguuguccacagccaggacacacguggcaguggacccgucuuuccaggcaggcuuccuggggaaacacaucagaaacgcagucaccacuacuggcgagugcccagagacuaauuuauagagcuaaacagcaagucugccaggcuaaaacagauuguauccucuguauuacuccauaguuuggauauggguaguguccccagaugcuccuaugucaaagguugggaucccauggugacacuauuagaaaauacuguggcccucuaggaaauggggccuuaugagagauuuaggucacugugaaaguuuccucauaaggagcugugggaucuuacugcaaaguccuucaaagggauuguggggcuugggcucauuuucccugucucuugcugucuggcucaugaacacacaugcugagacucacugcuaccauaguaugccacucgaaucaaaggucugaacuaacugggcugcccuauagcugugccucaaguccagaacaguaagcagaaacaaagcucuuuauuuugggcacagaggggccacauaccuuugguucacuccagaggcaggcaaaacuuuuaaguuugaggccagccaaggauacacagugaaacccucucucaaaacuaaaaacaaacaccaaacaauucuuccuaacauagcccaugugaugcagaaauacacacaucuuuuuuuuccccuucuuaaaauguacgagugucuugucugcauguauucaagugcauaccugcugcuccuggagaccaggaggccauuagaauccuuggaacuggaguuacaggaaacugugagccauuaugggagugcugguccucuagaagaggcagccugugcucuuaaccacugaaccauccaucucuacaacuccaacauacauuuuucuaaaaagcauuuuuuucugcuuuuuaaauuuuauuuaccuaaaaaaauauuauuguaugugugugcacaguguguaagcaugcaugugugugaagggaauaucucauuuuacccuuuggaacugaacucagggaauaaaaauuaguggcaaucauccugacuggcuucccgcuggccccacauccuccuuaauuaaugguuguaagagcucacacauggugcuggguacuccugagacagaaagcauugugcuaaacagcaucacaagaccugagguugcucaggaaaacaccacgcacugagcauucugcaugcagauacucacuggcuugaagccuguuucaggaacucuucaucggugugcuuaaaaguaucuagcagacaccucuuuacagucuucuccacacugauuauaucuccugguagagaagggucaaacagagucaucuuucaagaggagaaggcugcugcccacucagguucuguuggucguuuucacauauaaacuauuuucuaagcauguccuugucaacaaucuacuuccucaccuguaggagcgccaugcaauuccgauguacugguuuccacagcguggaggcagacaagacacuuaaccacaucccagacacuuaacaagcuaagaaauggugcuuuauuuacacagccucuucugaacccuaagcucagacuuucugaaccuaagccuaagacuuucuuuuuuggugacagagacuuauguaggccaggcuucaaacuuacugugcagcugaaaaugauuuuugaacugcucaucugccucaugaaccaucauacccaguauacguaguccugaggacugaaucuagggccucaggcaugcuagucagguaaacuaucaacugugcaacauccccaaacccaucaacgacguucugccaaagcaaaacacccaguccgacagacucggccaugcaaacagcacagcaagucaaacguccacagguucaguucucagucucaccuuuaggaaauuuccugauuaaguucuggugcaaauucugugcagcaaauuucgaggcucguauuccuccauguccaucaaacacagcaaaguaugaaacccgaguacuagaagaacgaauuaaagguuaauuauaucccuaaaacaaugaacacaccucuucacugaagcuugcuuuacugaguuuugaggugggggcuccauauuuagcccagucuggccuccaauuacagagccuugugccccugcccaggugugcugagauuacacguagguaauuucaccacacucagcuucauuaaagcuuugaaguuucaucucaagcaaugaacaugaaauucacauuguugagauaccagucacacugacaugugggaaaagguauuuaagagauuuaaguaaguuucauccauuuuaauuguugaguccaguauaguagcucacaccuguuaucccagaacacaggaggcuggagcgugagaaaugcuaacauugugagcuccaagaucugccuggccuacagagugagaccuaucuuaagacacaaaacaaacaaaacaacauuuguuucaaaaacuaagcuguggcuggagagauggcucagugguuaagagcacuuauugcuccugcaggggacccaggaucaguucccagcauccauuacuccaguuccagggaauucaaagccuucuucugaucucucuggguaccaagcaugcauguggugcauauacauacaugaagguaaaaacuuauacacauauaauaaauaaaauuuauaaacuaagcuauauaauuucucagugaaauuagaauucagaacuuuuaucccauuuaaaucagacuuuuguuaaacaaaugaaaaaaguuacucauccaagacucuuguccaaaauguucauaugaacaagggagaaguuacaggauugucgcuuaaguguugauuaauaucuaacuucaaagcuuaugcugaucuucuuauuccuauuuccuaccaacuuuugucagaaaacccagcuagaugguuaacuggguaguuuggcuugacaaccugacacccugcauucaauuccugguacccguguaaugguggacggagaaaaccaaccccacaaaguuauccacugacaaaacuacacagcacaguuccaccugcaucauaaaugcacacaauaauuuuaacuuaaaacuacaucagaaagaaaacuauuaaugagaaaugacauuuaggguuaagaugaacuuuucuuucaaacuucuuugcauuccuuugaucaguaagagcacuuaucaaaggcuucaguuccaugugugcaccgcuuucuuucuuccaggccauuuugacuacuuuggucuuucugggcccugauuaucuagcuguacagccucucccaaugccauaagacuccgcuggguuuaauuuggaggcaaagccuuuuugguaguucuaagacuuuccaggaacucaacauccacugagugcugggaacucaggacaggacgacaaucauguaccaccacacccacacuuccugcagaguuuacucggugacuuucaauucauccacucucuaggacacagaguaauagcacucagcccgaagcugaucaguccccgugagaguacaacugccugaaguccauagcaggggagacaguucucacucagcggcacucagaugcaacacugaggaaaucuagguugggcagaucuuugcugaggggcagucccuuguuuagcaauguaauauucuuuucucuacccaccaaauaccaauagccacggccuacuccaaaaauauccucagaugguaacaacuaucuuaaaaauauucucccaucuaagauccacugaugcaaaaggcagguuacucauggcgucagucuuucuuggagaaacaucuucacacaguccaaaacuuagaacagaggagaaaugagcaccagccaggcuugcuggacuguaaacacucacaugagagaugauggaggauuacacuccugagugauaucguucaggaugacaugggcauccugcaucuccucccucucacccuuccgcucugccacauagccuuucagaccaaagaucaccgaagaggcuggggaaagaaaacaaaaagccaauacaaaacugugccuuacccucuagaagcccuagucccagagcaaauaagagguacuacggcagccuagcucagcaacaucacagugguacaaauaagcaauauucccucaaggcauuuccuuguggccacaauucaggguucugccacaaagccuggagcugugacagacaugugagcugcaccuaaggagaucagagucaaagaagcgcugccucacacuaauggggaugugggacuaagggucaggagaaagugauccccaaggagaaauuuaaucuggugacaauuuaaugaggacccaaaaacucccauuucuaaaaacucccaaucaguagaguugccaacuaugcugcuggagacccugagaguaugcaucugcgugcucuaggcugccaaccgugguaacaggcacuucccuccaacugagcaguuaaagggcaggagucugcuguagcacagaauggugucgcacucagaggcugccuaguuaaguucucuacagagcuggaacacuucuagaagcgaaagcaaugccuuuggccaugucuagcagcauugccacauuagugccacugcucucacugaggcgauuauucguagacgugaaaguuuucagucauuucucuccaucaguacaaaaagggaagucuauagcuauuucuccuagucaaagcuaaucaagaguuuuuaaacaaagacuaguagucagaaagaauggauggucauaagucagccauuucugaagaggacaaaggaaaaaaauccguccuuuucuaugcugaagaacaacaugguuuccugucaggucaggcaagcacgugaaaaguaaaggcagucuuacauaucauuugcagaagggggccacgcccaccucuuacacucagagaagugcuacaguuagaagcugacucuggcuuugcucugggauguuuaagguauaagaucugauacauuuguuuucaaacugucugaaaaccuuuacaaacuuucuuuuccacaagcucuucaccgccauucuucuccuccucaggggcuuuccucuuugcuccuuucccuucagucuucaccaccugggaaccugauguggcaagagaaccuagaaaugaaguaaaggccagacagaaacagcucuagacgcagaguugccagcagacccagcuccauccacucuagccuacagacauaacugcacuucaggcaaggaccaacacauacugugcccaggcuagaacuucugguuagaaagcuagaagauagggcagcauccacacugaguaaggaccuaagagucucugcccuggagauuucucaguagcauagcacacuuaaacuucuagccuguagcauauucaugauguaggacauccacagacccuuagugacuaacagggacauuuccagaagcugcagcaaacuuguauguccugaaccaguccagacaaaacacuacacuccuaaaaggcuuacaaugagcuaaaagcacagagugcugcuggggccgcccuaccucucuaucaagcaaaccuagcugcuccagcagcacucaugugugcgggaccauaaggucuagcuucaguuucuaaucuuccagccacaguuucuucauaacauggugagagaaugcccuccagacugugugaacaucgauagggacaagaaauaaaccagccacuguggugccaguuacaccaaaugucccuaaaugcucucuguagccauucauucaaccuacuucuuaggaaaaagaagaaaaagcucugugcuaagauucaucuccuugcaaaagagcauauccacaaugguauuacaaaaugcaugacacacugcauaaaaaagagcaacuuaaugagaaaaugucauggacauuuuaagucuccucagugucuuuccaucagcaucacgcugcuuacuguuugggcuccaguuuuccuuucugaauccuuucuaauugcaaaauagagaaguacacugcuauuaacagccucuaggugaguuccacugcaccacaggacacggucuauauguuaaagacucuccacuaggccuugucuuacagacuagcacauggucaacucccacagacuaucugcccucuugagaagaaucaguuuuccaagaaauccaaaauacugaguaccagauuauacacgcuguguuaagucuucuaaugaguaccaauacagacugaauuauuuuaaaguuaacucuacaaaaacacuugauuugcauauuacccucauauaauuaagagcacugacucuauuaggaaaguuuucaaggcugacugguagaagcaugcugcaguuuuucauacgagucccuaguccugaaaacuuugggauucucauaaaagacaauuaaauguucuuuuuaaaagcaauccuacugauuucacagggauuaaaaaaaaacuauuuagaaaaguaguaaauauucuauuuggcaacaaaucgaacuuuuaaccucaaaaaaauagaaccaccugcagccucuccccaguccccacacagcaaagaggcugucaguuagacggaauaaacagucugcagcuauaacaguacacccaucacucuucccuucugacacaaaacagaacacugucaugugggggacauaaggcaaaucagaguaacaaacugaaaaauuuuuaauaugaaaguucagagugaauuuuugaccuuuuaaaugaugguuauuauuuugagacauggucucauuacauagcccaggcuagucuggaacucaaguuccuucugcuugaaccuucugaauagagauuacaggcaggagccacaugccuggaucuuaauucuuauuguauuuguauuuauauuuaugaguacacuguagcuguccucagacacaccagaagagggcaccaaauccaauuauggaugguugugagccaccaugugguugcugggaauugaacucaggaccuuuggaagaacagucaguccucuuaacugcugagccaucucuccagcccccuggaucugaauucuuaaaaaaaucagccuagcaggugaaggcaaaguuaaggacaagaaacaaaauggcugauacaguacugaagucucuaaucucagcuucuaucugagcaugucuguucaauuuuaauagaccucaucuauacuauacuuuaacgucauucaaaauccugcuaaaacccgugcacacaguuuacauaguggcacaauaaggguuauccagccacaccucaaaacuguuugccuaccugaauugccacuggcagcaggcggaagaucaucaaagaguaaaggucccccagagccugaaacacagaagaacccagagugaguccacgaugacaaaccaggccucgguucagaauccaucccaccaggacaccuaugcagcagcuuauugagacaaauucagaacuugugucaauccagugcaacucagucugcagggaauaauauauccggaaccuauuuuaaaguccuaugauuucaaaggaaauagaaauucugucuuaaaugagcugaauuucacugcaaauaguaacauacugaacugaaccagagacaaggcucguccuguuuaugcagcacuucucagagcugccuacugcaggucuuucugccuuaccugaggccaugaguucaaaacuuaaaagacagccaacaccuaaaacaucuguguguuaaaaaugggggaaagggagaaagauugagacaacuacaaucccaggaugaguagacguugacacacaccugggaaagccugaagacuguaccugagucaguacugcuggccgggggcagguccucaaagagcacgggucgucccugugcuuccuucccugaaacagaaaaccugcuuuuagagagcagguggccacccaggauaaacuucuacagggaacacaccugugcccacuccugauaugagguauguugcuaugaguuacaauauucucuuuucuguuaagcagacauacuuuuuaaaaaaucucgucaggacagcuauuuucuauaaaaggccuguuuccaacagucacaguccauauaaaaacaacgaaaugacaccccagcaggugccaaauuuaaaagauauuuggcuuuuuucuuuugggagagaggggucagggguuuuacaauauagcccuggccugaaacucacaaugaagaccaagcugaccucacacucacagagaugcuccugccucugccuccugaguguuggguaaaaggucuaugugugcugccacagcucuuccuccccuuucuuuucuagcccuaauacuaaguguaaaaugcaugcuaaguguguccuaccacugaacuacacacaauauacccugguuccuaaaaucuucccucaaaagagaaucacugagcgagaaaagagaaaagaugacucuguagcucaaggcagagcugagaagcagaggcaccuucagaggccccugggaacuacugaaugcuaucuggugacuugugcaacaggagagaaucuagugugacuuggugucaccagcaauugagucuauggagaacuuaucucacagcugaagaggacaggccucagaagaaagccaaggaauguuucuuuuuaaucuaaaaagcugaagauugccaggcgugguggcauacgccuuuaaucccagcacucaggcggauuucugaguuugaggccagccuggucuacaaagugaguuccaggacagccaggucuauacagagaaacccugucucaaaaaacaaacaaacaaacaaaaaacaaaacaaaacaaaaagcagaagauuaaauucuagaugucuuaugucccauuaucauuuuucacauaaaauguaaucauuauuccuuacuccccagcuucuaaaagucuuccaaaauucuacuuaaacuauuaaacauaugagcugacacacaagaaucuagagaaaaauauccugauggugagggguaagcagacuccuuaccuacacuucccagacucaguuaugcaguaucacuggcagcccaauuguauuaagugggaaacuaucaaaagcauucguuuucaacugcacaccauucuaaguuagcgcagagacuugugcuaucccuagccccuacccacuguguaucucaucagccaggccaucuuugcucuccccaugcugccugucacugaaucccucagaaaccauuagugcuuaguagccauuuuuggguguuugucagagugacugccauagaauuacacaaucuauauucaagcaacuuuuauuauacuuaagaaaugaccccaaaacacacauuauuuuuaaauuauuuauuuaauuuuauguguacaaguguuuugccuguauguaugucugccuguacaccaugugcaugccugauacccaaagaucaaaagaaggccuuugaagccucuggaacuggagcugcagaugguugcaagcuaccauguaggugcugggaauggaaccugugucuucuauaagagcaagaagugcucuuagucacugggccaaucucucaagcccccaaaacacacucuuauuauggcauauuaugauuauuuuauuauucguuucugucaagcucucacacaagcacagggaagaacauaguguuuuacagaauuuuuuagcaucuauagguucucaaaauguagagcuggguauaaaugacuacuauacagcaugcuuaccuccuauggugcucuugcagaggcucuggguucaauuccuagcacccacagacccaagacagaccucguucuacugucuguuucuuagacauguaaaauaacccucauuuuuaucaguucacuuaaauaaauguauauucuucaagagguuuauuuaugauuaugauuuguccuccauauaaagaugagauggguaucaauucuccuuacacgggugucaacaugugaguaugcuuacgugcuguguguguguguguguguguguguguguguguguguguguguguguguguguauggaggacagagguagacucuggcugucuuauuugaucucuuuccacauuauauauugaggcaggaucuuuugaaguuagagcuugcucauuuggcucagcuaguagccaguuugcuucagaaauccaucucugccccugagucuugggauuacauguagaccucaucaugcucacccugcauuuacauaggcaguaggaucugaacucaucuucauacuguguggcaagcacuuacccaucccuguagccuaauucuucucuuuaaaacaaaaaguagaaucuaucauuccaaagaaagaaaugucuuggggauauuuagaagugccuaaauagggcuggugagauggcucagcgguuaagagcacugacugcucuuccggagguugugaguucaaaucccagcaaccacaugguggcucacaaccaucuguaaugagaaacaaacaaacaaacaaacaaaaauaauaauaauaauaaucguaugggccggagcacacuggcuggagcaagagggagaagggaaggggagggaaaaaaaaaaaaaaaaaaagaagugccuaaacacacgcacaucuccuaaagcuaacaaaaucucuuuuauuucauuaucuuacaacaacccuuaggauucuaauccucaggauucccccaacaagcugaggaaucacaaauguuuucauuuuucucaugagacacaaauguauggaaacaguaggcaaaacugcccuucacuguccccagcuacccuuggggucaaugaggcacugcuucuagaaccacucuaauauccaaaaccagagaugauugcucucuuauacaaacguuacuuuacccaaacaacccaccaacauuauccucuauaugucacaccaucucuagaauauuugugcccagcacacaguaaauacuacaaaaauggccccuagacugugucaucuaagcaaggauaacuagaaaccagucuauacaugcuuacuacagcuucuaaaaaucuguuucaauuugugguacauugacuccacaaguauagaacccacagauacaagagagcuaacuccacucuaagaagcagaacacuaaagaguauuuauucuaaguauuaauucuucuacaaaccccuaauauucucucagcucacuuccaaaggucuaaaaaucaaaacacccuucccccggacacucaaaacuguaucugguuggggaugaugagauagcucaguaauuuuccucuugcagaagaccuauguucaauuccuagcgcccacauggugguucacaacaauccauaacucuaguuccaggggaucccacacuguccucugaucucugggggcaccagacacacaugugguauacauacacacaggcaaaacacccauauaacauaagucuuuuaaaaauuagauaauuaggacauucagugggccaugacagcagcgggcccagccucuuagggauagggacauguaaauuacagcauggaggccaaccugagcagcagcccuccucaucuaagcaugguuuuuccacuaccguuguucaacaggaaaagucuuugcauagcuaacagguguaucuucaguucucacaggcacuccucacagcagaugucuugcuucaugccagucuagucccucuucagccauaacacugaguguucaaacagcacugucacuaauggacaguauguugcucucucucacccuagaaugccaccagagguacuuaauuaaacaaagagagacuaccuucccaucuuacuggccacaacugagaaugagcuguaagaugaaauucucacugcuuguaaagcacuauacuaagggcucuaaaugcuuuaacucaacugauuacuauaaggauccuauaagguacuguuacuacuccaagagaaggaagcugagacaccaaggccaaacgccugcccaagaugagugggcuauggggaguggagacucaaacccagcuggcagauucccagggugggcucuaguugagcagcugucuuggacuucaaccaagaccacacuuacccuuacaguucuacagcacaaccccaagcuggcucaugaggaccucuuuagucauccugcagaucaucaguauggucaaacauguuugugucuggauccuuuaaaauguccuauagguuauaaauacuacauuugaucuuagacaauggaugugggucauuuauuauacuauggaacuuuucauuagccaaaauuuugcacuguuuugaauaaacagaaauccaaacuaugugaacuacagcugucagcuaccaccagacaauaugcaacuuugauccauaacaccaacgggaaugaagugugcaccuuuccaaucacagcuuguauuaccauccccuccuccccaucauuuauccaggcacuccaucuucuggauauuauauauuaugauaagaguugucauuugucuucuggagacaguguuucauuauguagccugacuguccuggaacuucuuuguagagcuagaccagccuggccuugaauuuagagauucaccugccucugccuaguaagugcugggauuaaagauauguacuaagggguugucuuuuuauugaucuugugaaucuuucaaucauuaugcauaacuauauuaacccuucaaaacauauauugucauucuuuccucaauucacuuaacuaugacuuacuuuuuuucuugcauauacacuaaguccuagaaguaauguuuucuucugauauuuuaaccuuuauguuuguauuuccauuucucaaauaaauacucaugugacuguguggguguauauacgaguguguguaaaggcuaaaagccuauguccgcauacuuuaauugcugagauuauagacaugugucuucaccccggcuccuaaauuucauacguuuaaguuacucuggugagcaaauagcccuugacaauuaaacaucaguuuuauuugaggugcuaaggacuagacucaagauuuuucaugcuaaguaugugcucuugcgcugaguaauagcgccaggcugaccaucaggugcuuugucuugguaccagcucuggacccagggccuuacacaugcuaggcagguguucuaccaugugcucucgcucuagccugaccagcagcuuugaacaaaauguucuaacaagcaaacaagugaaccacucuauguaaccaaacaaucuaugccagcauuuuauguaucuauaaguuccacuacugauagaaaauagguauaauuccuuucugcaaaagauugauuguuauuuuaaauugauauacucaacuaucaaaaucucuuaaguccuggagugaagcuggaauucaguacaauaucuguagacauaaaacacauacuuucuacauacuuauuccagguuauaaaaauuugucuuguggguaugaagauaagaugugauacuuaaaaaaaaacaaaaacaaaaaaaacacacaaccaaaagaaugaaacaaaacauggcugcugugcugagugguggcgccauaugccacacaccucauacuuucuacagaaucaguacaacugucccuuuauguugugguuacagugcagauccuagggaugucaccagccaucaucuacaaaucccugaccauagaaucgaaccugggccaugcauucuaccaaacgcacagguucucuuuauuccacauaguaucugcaggaggcaucacuuauuacacacauuugccagcgguuccugaaggucaaaggcagugcaaagcuugaucugaagacacagcaguuuccauuguccacacaucuuccuauaguaugugaaaaugacuagacuuauuucuuaauugcucccaguacuauuuuggaaaauuuguuauacuuacccaugcaugagcagggucaguaugcaauuuagucuuauucuuaugacuacauaacaaccaacaccauuuacuaaagcaaaguauggugucggaacauggucugagaauggaguccugugaggagaauucuaagugccugugagaaaacaagacaagagucuugugaccucaguuucuucaaaacacauaauuauucuuggaauguguuuuugugucucccccacccccuguaguggauaggagugaguuuauuucagauuacucaauauguuugggggggagagggggagagagggagggagggaaggggcauggggaacgcauguaucugcuaagucccaaguugaguuuaagguuuuaggucaugucaagagagccuugaccacggagaagacccaaaauaacuuuggauaaaaagcaauagggacuacuaaugaugacagauuucuaggcacaucuggcaauccaaacucugguccgagcacauucagacacagguuauacuccagugacagaugcaaggcugccuguaugaggccagcuuuacucacaacuguaacggugguuaucuucaaaaagcauggcugaaucaaacucagucucaaggccuaguuacuuagaagcuucuguaccaucagagugguugguggggguacguaacggugccacuaccaggaacaacugcaaaaagaggacacuacaaagcaucucaggagucuggaggugcgcagguuaaaaaccaaagcacaggugugaagaggacaggucaauaccuucucauaaccccaagcuccagcauucuuccaugcuagcccgucccgcucugccaagcuggagaucugagcccucccacuuuugaacauuguuuccuugccuagaaucucuggaaaccaucagccgaagcccucgcuaaaggccgccuccuucccaggucuuucucacuagucuucggguaccguuacuccggacgcuuggcguuucccacgguuuuuaaccuaugccucugcgaucagaacugaacucucugaaggcaaaggcuggguccucuucaccuuccuauuccgugccaaagaccuucccaaaacgugggcugcagacgccaccccccauccccggccucgguuaucuagccguagcgcccugcauuggcugugcaggcgccccgcaccaaggggcuggaagucggaaacuuguuaaguucucgggguuuccaggacgcaaacaggcccgggaccaggacauuccgcugggagucuugcuguagccaaauuaaagccagagugccccgacccuucggcgcgggacuucgugcgugugccacgcgaggccuggacagggaccgcgcggucgcugcggccucgggagccacaggccgagacugaggcggcgguggcgcgaagauggcggaggcagcgcaucccggcgccgcccuuuucccccgcgccgcuuaccggcagauggccgcggcgcgcgcucgggcuccggcagguccccgaagagguccauggcggcggggcaguggagcggaggcuccgcgcuacccugggcggcggcggcggcggcggcgccgucacucaccgcgggagacccugccaaucgcgcgccgcccagccgccg

SEQ ID NO: 296 - RNA, 4412 nt, Mus musculus
cuccaggucauauuuuuuuauuuaauaaauugaaguccugugaaacaaaguacacauuuuuacauauacgaaaagaagcguugacaugauuuuuccacaucgauaaugaauaaauauaccaagaacugcaugugugcccauggacccuuauugcaugauauuucacacacacgucugagugagccuggguggucugguggauacccacacacaaacacauuuuguuccuguguuauuaauacuucgguuuuauuagccuuauuaaugacuugguuuuuaaaagaaaaaaaaaucaggugauaucaauaagcagaguauuauuucccaaacuggcucauuuuucaucagugcuucauuucaaaacugaauagagaaggcugcucaccaccuucccgccaucccgguccuaacauaggggaggcucuggugugugucugugccuucuuuuuaaguuucaacuaaggcaagagagagguuuccaaauuccaccagcaagaguuuuuuccucaggcucuuuacacuucugauuuguuaaaaguguuuaaaauagaaaagaucaacauagaagaagagcaaaaaccuaagugaguugcuggcugggaauuuacaacuggccccaggggaaaucuuuaaugcuugcucccaggucggugguucucaacuugugggucuugaccccuuuggggagcccacauaucaguuauccugaauauggauauuuaugcaugucugauauaaauaucagauauuuauaauacuauccauaacaguagcaaaacuacaguugcuaaguaacaaugaaauaguuguaugguugguucggggagucaccacccaugagaaucuguauuaaagggucgaagcauuaggaaggcugagaacuacuguccuauguaaaggggagcccccauucugaguggcagcucuauguuccaugcaauguccccacccccauccucuggcugaacugagcccgggcaggcagcuugagaccuaccaggcuucuuggcugggcuguuuuccuuucccucucaacuaugaccucugccugguggaggaagggaggaggggagaggagaagacagugagaaagagaaacacagacacaggggaggggguggcugcugggcugggcaccagaaggcuucuguugggaaaacacccuuugguuacagagggaggacaguaucaccugauuuauuuauuuaagccggacuuuaaaggggauccaggucaggagaugccucacccguuugagugauacacccaaacgugacccagcaugccugcacccuaugccuuccacccggaagucccaggaaaggccgucucaugcaggcaggaagcugggaucuggaugcgguuuuuugguccuuaaaggaacuuugaauuuuuaaaagaugaaggaaagggacauuggauaaaauguggccuucccagaaggcaagucagccuggcaaugggcacuguggcugaaggagaccuuuaacuacccuucugaagccugagaauguuuaaggagccacagagcugugacaguccucugugagugggccugcucuccacagagcauuguuccaguggugcguguugcauguccccaaagguggagagcccaggccuuuggugagggggcaagaaguggcauacacagcucuuccagcuccuuagacaguggucucaacccgagggccccacaucgggggcccuccccacugcccccaggaguggcugaggcuguagcagucucuggccucagguucaacuucaauaagaccuaguuagcccuugaucacagggcuucucugacagccaugcucaagccuggccuaguugagcccgggucaccugggaauagguucaaaggcaaggaagcuguaaaccaccuccaggccccagcuagagcggccuggcgaacaaagagaccccaagcacuucaaacgcgcuggcuggcgcucggcgcucagaguccagauggcaaagggccgggauccgugaugucuguucaccaaggccuggcccaauguucugcaauccugagcccuccugcccugcccaucagugcccagggcaggggacuucagacagguucagccucucccuagucucaguguucugggcccaccacccgccugcaagugaagcacaguacagaggcugaggcugaaccccaaaccgggauccaacacucagggcaaggucagguaggcaggcauggcgggcacaugggcgcucccgcagaggcucgcugugaugccuaagcuauaaagcauuuagggggcagguucugaaaacguguccaggcugaaguagcccagaaaaucgggauugaaaaaggaucuccaacuugcauacuggcccgagccgggcggcgucucuauagauccuagaggcgagaucguggggguggacaucucugccaacaggcgaguaucugcccugccccgggucguggcacucugccugcacagcuccacucacugcgggcaggaucgcguugcagacgccggaggucucagugcgcgccccaagaggcucccagcugcguccuugguccacggagcacaucugggcuuggacuugccuccuccaccccucgcagagacccugaacccuggcagggccaaaucugcuccaggagacucagacaaaggcaggcaccguugaacuuagaggucagcaccgcugauuagcggcccgcgccugggguaggagcgcaggcugagcgcgcggaucuggccuccgagaugcgggccacagucagggccgaaaaaagcggagacaaaacugaaagugccgcccgggggggggggggggggcgggggcggccggcgaaggccccagaauuuguccugccccuggccacgguggccaaucagcgcgccgcccucgcuccugacagcuauuuagcaacccagccgggauagaguuuccaaaaaaguuagaauaacuuccucucccggagaccucgguuuugcacaagccggccucgaaaucagagccuuugagagcgacccgggagccugugcucggcggccgcgggcuuggccaguggcgugcgcucggcgccccccagccccacgcgcgccgggcgggcgccauggaggagggcuccagcucgccggugucccccguggacagucugggcaccagugaggaagagcuggagaggcagcccaagcgcuucggccggaagcggcgcuacagcaagaaaucgagcgaagauggcagcccgaccccggguaagcgcggcaagaagggcagcccgagcgcgcagucuuucgaggagcugcagagccagcgcauccuggccaacgugcgcgagcgccagcgcacccagucgcucaacgaggccuucgccgcgcugcgcaagaucauccccacgcuccccucugacaagcucagcaagauccagacgcucaagcuggccgccagguacauagacuuccucuaccagguucuccagagcgacgagauggacaauaagaugaccagcugcagcuacguggcucacgagcgucucagcuacgccuucuccguguggcgcauggagggcgcgugguccauguccgccucccacuagcgccgcgccgugccauccaccuccggagccgcaagccaggguaggugcugcguguggugggcauccacgacgcacgggugggugggcggacgggccaguguaucucuccucgugaagguaccucaggcaaccgcacagggauggggugagcuuccucacccugcaaggguuggcgcgaccugagaaaacucuccuaccccgggggcacgcccaaggucuuuugccaaggguauccguucggaauccacccgccugugguuccccaucaggguccaaauacacuuauuggacaaauggucacuuuucauuuuugguggauggguaucugugggugacucuguggggagcgguugucaaaacgucuuccuuaggccagcggaggccaggagaugcgaugcccgcuggguuguggccgaccuguugccucgcgcucauucuauggagcugaggagcccacgcgugguacagacaauccgcucuuucugauccgcaguuccggcccgcgccuuggaugcuagggcguucaagcccuagccggcucaguacguaagaugaugcuggccccuggcgcggcagagagguuucuguucagcgcuggggcuccagguucacagaggagcaaaucucugggcgccaagaaugcaguagacccuugucgccccaaaaguauggaacccucaagcgcccaggccuggguggauguagcggcuuggagucucuggcugccugcaagcagguggaucguauuuagaguugugugcuuaaguaccaccauccuugaacuuggaaagacacagaggcaagggauucaggcuggguaacaggucug

SEQ ID NO: 297 - RNA, 5580 nt, Mus musculus
ucagauugucagagucucucagccccaucuacaggaaaaguuaguacugugcugcuggcgagcagggacagagaguuuaguguguccccuucagguuuguaagucagauaccuuccauaucagcucagugacaguucugcaaacagcccaacagcuuuucuccaagagaaauggaaaugucucacagaaaccuguccacaauccucuucuguacugcucauagcagccaaacuguggauggagcaucuccaggguuuauccuguggugacaggugacagaacacaccuaccguugucuuggggucaugcagcauauagaggcuccaaaaccuggcugucagggaaguaagccuaucacaaucgccuccugcuauguuucacucacaggaagugaccagcuuaggccucggagcagggcuucucaaccuuccugaugcugugacccucuaauacagcuccuuguguuacagugacacccaaccauaaaguuaguucauagcuauuucauaacugucacguugcuacucuuacaaguuuaauguaaauauaugauacacgggauauguaauauucaagcccugugaugaaaggaucauucgauccucaaaaggaugcggcucacagguugagaaccacugccuuagagacaugaauuaaguuagugaugucaagugcugcaacuuguagggaaauggaaacagcugucuguggguguaacauuuauguuuaggagcaaugaaaauguucccaaguuagguuauagugaugguuauacaggucuguaaacuacugaacuguucaguuuaaagaugugaauuuuagggcuuauggguuuaauuuauucucccuaccugggaugggauacaguccaggacacucagucgguuccugaaacuggcagggaagcacccugugaacaacagucaagcagagaaugaagguggcuccucaccggcuuaggagagcagcccauccagcaugugcacgaggaugggugccuguccuaggcgggagggaguggcuucaugaugcugagcagaacagugugcagcugaaaacucaggauuuaucuauuucuagaacuuucuauuuaauauuuuuagauguugauugaccacaggacacuaaaaaugagaaaagacugagaugaaggcaugccaucacugguccuuugcuuucuguggcuucccuauggagguggaucagggaugagagacugucauggaaguugaaugcaugcucagaguggcaccuguuuccaauccauaggggccugcugagccccacagugagucggugucucccauccacacccaucccacuguaaucucugcugcaagcugagagggccaggaucaaguugguuucccaagaaaguugcugcagaccacauaccuagcgcaggcucagccaggccucuccugccugucaugcacagugauaucagucccucagcccacagcccucaugcccaacauucugagcaucuuagaaguugggggcuccagacaucccaucauuuacacagaaaggcauuugcugggagcgagacagguuccugccaagugucuguacucccaggugucaaagcacuuucauauccaucccucuaaugccagccuaggcuuauuaauuucacugugucacuaccugaguggugugguaggagguuugaagacaggaaacacccauucucauguggcacauucuugaagaugacuuuagaagcuggguaaucucacugggguuuguuacgugauugauuugugauagcaaaugacaguugauugaaacguuuauacaauguuuuccugggacgcccaggaagacagugauguucucugugcugccuggcaccaguguuccugcccugcucugugagaggcucacaccugagggccaucuacuuccugcuugacccaguggggaccacggcugggcucccuacccacugugcauucagccuccaucuuaaagugccagugcuccaaagaugugacagaaguuaauuacucauccuagcauuguguuuucagcagucauuugugacuguugccauuuuuccaagggacaaaacagggcuucugaacuggcucuccucuggauuucuugggauuggaaugguagccaguguacccaccugggugucagcuccugacaugagugcuguguccacauuaauguacuucauaaaagcaugcuaggggagaaauugcccagggaaagaaggcuguugagggcagcaguguagugcccauccugacagggaagcacccuuuuguauugcugccuccuuauccaccucaccacagccuuguuuugaaaagucagaaauuauaccuagaacaucuuccccauagcugaaagcaguucuugcagcaauggugggucuacaagaucacuugcucuuugugaaggccaagcguuggccucacugagccucacucucuuuuauauaugagaacuuggacugcuaugggugguuuacuaugagcauccaauaguuuuaaaugccugugcuugccagugggguccuggcacugaacucuagucugauguuuuacucccgcuguucuggauaugguaguguguguguguucaucccuugauaaaacacgguccuggugucaagaggccucuggacaacaggaacugacauguuggcaagcuacugcuugccucccuacuggccucucuuguuauguugccugaggccagguuugcuucccuaagccagcucugcuugaagaucccaucucuguggccacaaagaagcaaagauacguucaaaggggacagagacuccugugugacuauagcucaugaagucuaguugcaccagcaccugcaucaguacuaagcagaguggcccagccccugcaggccauggccuguucugcaucauuggcagggcucucaguggcccuuguugccauggcagcaucccugauagacauccucuagagggaggccuagccaagcuguggccccuugagagccucccuguucccugcucccuguucuggaguuucugucugccuauaucgugccaaagcugcagcccugccuguguaguagcaucagugagcucucauacugucagcaauccguacccaacuuggagugaaaacagggaagucugggccuccccagcaucaggcacagcuaggagaagccacaaccauguacuaauuugagcacucccucccaccccccaaacuuccccagagguacccuccucagccauggacagucgacauugaggugacaggccagcuaacaggagcccaggguucuaaggggacauugcuuucccuuacgugucacuuucaggauuccugccuagauuaacuaggcagacuccagccuuuaggaauguugaauguuguccagagggauacuuugaacuguaaccuuaagaaaaauagaagguacucagaaucauaggugguacaaggacacugaagagacaugacaccaaacagaaaacaggacguguucaagccagaaaggaucacagaaguuguuaguggauaucuguggggccauaagacagagacuguuguugugagcaucaugaggcucagcuguucacauaaagguauugggaggaaaggcuccucugucuguuucuccuuuagccaagcuguagaugagaggugaauggcaugcaugcucuucugauaucuuucuccaguguugaguaauaaacauguuaggaauggagcuugucugcccacagcacacuuacacugccuccuccucucagaagacacccugcacccuuccuaugacagcuucuaccugucauggccuacuuugaacaguugcuuuguuuucugagugccacccuagcuagaguagggagggaccugaguucagguccaucaugggccacuaucccugggcacuuauaaccucuuagagcugagucaccuugggcaggucagccauacagcggugauaccuuucugccuuucuugacccgcuccugugugugugugugugugugugugugugugugugagagagagagagagagagagagagagagagacagacagacagacagacagacagacagacagagagacagauagacagacagagacagggaaagacagagagagacagacagacagacagagacugagacagacagagacagggaaagacagagacagacagacagacagaggaagggaggaagagagggccucugucgugcucugacugcuugagcaccuauccuucuaggcccgccuuucuaccucugccucuacuuaugccuccugaagguagccaucccugguccugaccugcugucugcaucccagugcuuauacuucaacuuuucuagcccgacugcagcuuacacuucccugccauucucuacccagggccuaaaggaaguucuuugagcccucugccauguucugagccccguggucugucucugcauccauagcccuguugccaccucuuuuacaccuaugagcuccugggcaaugauagccuguuccagaggcccuagguuguucccagccccaucuuuccucuuggguccuggcugucccucugcuauaacucccuagcaggugaaaccagcuuccccagggaauuuccuuuaugucaucuaaagauacucugucacuuccaucccugccauagcccugacccugaccugucucagcaaaccugacaucagacacccaguucaccucauucuguuaccaguuacacugccccuggugcuugccagacuggugucaguugcccuuccccuuccccuucccaaaaucagaguuaggaguuugggauacccaggaguaaggugccauuagcacaucacaaacuaugaaggggagcaaauacuuaacagugcauuuuuuaugaagccugccuaccuagucuuuugccaucagcuggggagaggcuugacagcucacuaagguguuaugggcucaauucgccuagcuuuauugaggcugucuacagugugcagugugcugaucuacauauguacaauaugacaaccucagccaugccaguucacaugucuaggacuucacucagccaccucauuguauguauguucguacucagcaugcuuaagauacaggacaagugccaccaucagcaucccgugucccacagagcucaucaaucugguaagaagcagugcccuguggucagugucucccuggcuuccuccucucugcuucgagucuugagguuuuaggaaugagauucccugagcagguuaggcuuucagaacauaacuggggaagucuugauuucacagccaugugguagcuucauaaaaauuagcuggggagcuuggcaccaccaguacugucccccacagacugaugguaugucccaaagauccuuucuauuugagacuucccuaagcuuccagagaggcagcuucugagaacuucuucuggacccucccaagucuguacuggguucuugccacaggguaccucacaucugcuucuguugcucuucuccagccacaguauguccugcuagguggcaucuaaggaggauguuacucacaacaucuguggccuc

SEQ ID NO: 298 - RNA, 5252 nt, Mus musculus
gagaugaggguggagggcuguugagcgcccuggaguggugcugacucaggaugcaggauccgagggagaacuugacacuuagucaaaccuacucggcucuggcagagaugcacacagagacguggguagagccugcguccugaagaacccagcuuuuauuaaaacacccuagagugaaccacugguuagcucugggcucucaccugcagcuucugagaucagcauggcaugguaugguugucaccaaagugcuucuucaaccggaacaucuauacaacaaaaggaagcaguguucaucacucccagacuaacucagaugggcaugguggcgcacgccuuuaaucccagcacucgggaggcagaggcagguggaucucugaguucgaggccagccuggucuacaaagugaguuccaggacagccagggcuauacagauacagagaaacccucucucaaaaaaccaaaaaaaaaaaaaaaaacuaacucagauaucugaacucacaggaaugcucaaguggagaaauaauuuuuggggaaggcgguacucuaacucacaacagagaaagggcugauaaugagaagacacagccaggcaguggugguacacgccuuuaaucccugcacucgagaggcagaaggaucucugaguuugaggccaaccuagucuacagagugaguuccagaacauccagagcuacacagagaaacccugucuacaaaacauaauaaaaauucuugcaaaguucacacaaaugcucgaacaaagggcauggcaucuggaauuuacucccaaacagauuagagguaaauacauguauaauggauacuaaaguagauguaagguauaugcuauauacauuaauugacuauaaauuuuaucaguaagguacauguuauauacauuaaucgacuauaaacuuuaucaguagcaccuaccuguuuuguuuuguuuuuguuuuguuuuguuuuguuuuguuuuguuuuuuugagacaggguuucucuguguagcccuggcuguccuggaacucacucuguagaccaggcuggccucgaacucagaaauucgccugccucugucucccaagugcugggauuaaaggcaugugccaccaagcccggcaccuaccuguuucuuaucuaucaauguuaucuacaauuuauagcacaucugucuaucacuuauuauuuauuuaucaucuaucaucuaucuaccuaucaucuaucuaucuaucuaucuaucuaucuaucuaucuaucuaucugucauuuaucugucuacuuauuuaucaucuauuaucaaucuauuuaucauuuaucaucuaucuaucugucuacuuauuuaucuaucacuuauuaucaaucuaucaucuagcuaucuagcuauaaaauuuucuaucuauaaucuuucuaucuaccuacuuauuuauuaucucuucuaucuaucuaccuaucuaucuaucuaucuaucuaucuaucuaucuaucuaucuaucuaauaaucccccuaucauuuaucauggaaaauccaauaguggaagaugucugccaguauuugguagugguccucgggaggaagccgauccuagagagguagagcuuaagaggaggccauuguggcgguguccuaugaaaggacuaaggacuccagucaguuccuauaagagaaggcuguuagaaauaacaagauggcuccucccugcucucuggcucccugucuugccaugugaccucucucacaaagguucccacuugugaugaugucuaacauguuugacccagacaaggggccuuaucaauggcaaauaaaaaauaaaaauaagacaaugaggucccaaacuaagauuuucaacuuucaaaacuguuagcuaguuaaaaccucucuucuuuauaaguaacuggccccacauauuuuguuauagcuauggagcauugacuucuauaagcuggagaguagcauuguucuggucagugauagugaauucagaaaguuacugcuaugacaauuccacacugaggacaguccuuaaacccagaacuuuauauccagcuaaacugacauuuacaggcaagggagaaaggaaggcaucuucagauguuugaccucagaaacuuggucacauaaaagauuccuucauagaaaaagccauugauuaaauaauccauuaaagcaaaacucugugcccaauaauuuugcgucaaauucugagugauuuuuacaugcugugggaaagagguuuggauuggaaagaaagggccagaagacuugugggagauaaggcaaguaacuccacucgagcagcagaccaggagggaugaagcucuguggccacucaugccuggggaaagacuggggugaguacaccagagacagacgaggcccaacauguugcuggaucccaguggcauaguugggaaauacuagaagcuaaaauaugggcaagggaaaaugguacuaccacccugggagaaggcgugugugaagauggggacucaaggugaaucccguuagagggaugggagagagaugaaacagguccugcaucccaggagaaccagccccacugucuccacagacgccucgaucugaagacaucugugcacaaaaauuccuggaugcugaauauauccuuacguaugcucggagccuuuuguacaguuccggcuuuccacuaacgggcgaacucugcaauaaguucauuuaucaccagcaugagaauccuuugguaaacuaucaguucuguugugccugaaauaguugcauuuuaaaaguuggcucugauuugacuuguauacacccgauaaauaaaacuaauuccauucugugugacaaacugaguuaauuuguuagguaaauaauugaacaaguauuucaugugaaaucacccacuacucccauucugaggcagcccuggaaaagggagugggaucgaagcugcauaguuauuagguguucaucaagggucuccagaaugaaucaguucagaaggaagcaaauggaccuucaucagaaagacacggagggaaugugcagccaguacaaagccaggcagcagccucuggaaugucucccacgggaccaguaagaaccauucguucuuuagaccagaaguucccaccugaggagccaacacgucuccacagcaacaggagcuugcaacaagcugggcacagaacacugaauccagcaugccuggugaaauggaggauucuugcccauagggccacagaaccuugaacacucagacuucaaugucuaugccuacucacaaccuggagggucaaggagcugagaaccaggaagaugguggccaaggccauggaagaagagagaggaaccacacacaggaaagccaagagcagagagguagcaggcaucccggagauccuuccucaugauaggaaaagacuuaagggggccccagggcagccugucucaaguguucccuuccuacaaggauggaggacuugaccagccucuucuuccagaugccuuuccugucugcuuuggguaagaagggcagaacacccuugauaauaagcguggacuccugccccaaagcaccaagcagaacucugcucuaggcuucucuuccuguugcugucaguacguagugagaacuaccccauacugaguccacuccucaacaccuugcugguuuguaaaggaaaagugaaaguuggauccuucugccucugguuacucugugucccauuagauauggggucuauccagccuaggugcaggugggacucauuaaacuaaaggguugucagggacaaagcagacaggcuaccaccaaugucaggaguacaugcucucccaugaauuucugggaacugguucuagaaagaagccuacagcccuagaggcagcagugggaagcucucuacucugccugccaugggaggcuucagcaaaaugugaaggccuuccugggcuucuugauaggagaaguaugugcagugguacuaguguggucauugguauacauguguucaucacacgcacauacugagauuaugguagcaugcauguguauugaacaugugugcagcccugggugugccuguguguguuggcgggggagcuguguucacgugagucuggcugaggguuggaagacagcagcauugucccaucuugccuacaccuacaggcagugaggaaacccccaaguucacggccuccauaccccaucugcccucuagcagguacagcagacaaggcgugcuaggaaacuuccagcuccauuccccagggugugucuuccuuggguggguugacugcaaagcaauuuaaacugacugugcaccugagugcuauaaaacgcccaggcauucaaagcccucaagcccucugcucaggguggcucagagccauggauggcagaggccaugcagggagcagccaaggaguugauacccacgucagccacaucaggucaucuaccauuggugcccaugaguucuuccuacgcacugggggcacgccacccacagaggcucccuguguucaugauggucagggaaaaaggauggaggcugcgaggagggaagaucaugacuggcccugggagcacucccaucugccacuugggaaaaacuuccuccagagugcaugaaagacagacacuggggcucuggaggagcagaggaagcaagccacugucuacauauaggcucaguggugaccuaguacuagggugagcgaggaggaaagucuuugguucuuaacaaccccaaccaagaaauucuguuuauuugucuguuuuucuauagaacaaaaggccuugugcagacaucucagaacuguagagcuauuauuuaacuauauucaaaugaaaauagaaauucucuuuugaacaguuagugcucaguuuucagguaccuuuugacaauagagacguguccuuggaagaggaggaauaggaaggcccacggugguagggaguguugggcucacaguuggagggcuggguugaccucugcaucccuacagcagcaacucaguagaagacauugacaggcaccugcugagaccagaacuggcuugaggucuugagcgccaaggguggagcaagcgucugcuugucugacauugaaugauagagacccuugcaaaaaccgaagaguggauguauuucaaaaaguuagcaaacgagaugcucucgacauccaggcugccuuccacccccagguuuccuucagaucuuucuuuggcuccugcuacagcucaucagagugaaauggug

SEQ ID NO: 299 - RNA, 4843 nt, Mus musculus
uagaaggggcuggccggaagugagcgcaacgccgccuugucgagaugaaacccgcaguggaugagauguuccccgagggcgcggggcccuauguggaccuggaugagguggggugguggcggcgcggagcgaugcgugggggugggagcacgccugcaaaccugcgcgggagcccaggccuuuggggauucagaggcuggggaagcgggagcugccggggacagucgcagggcccgcgacuguuaacgugaacugcagcgaggaaguaggguuugcucgcugucaguugauuguggcuccugauaaaucuuccagagagggaaggcccgagcgaggcuuacgcacugacaggccucaagaccccaagcucugagagaaggguaagggauggugugugguaacugcgugcuuggugcugggacucgguuauuucguguagacacauacagaguuuucgagcgauccugugcuuuugauuuccaccauggucacagaucucucccugauaugggugguuaugaucaggagugucagccagcucuuguaugucugcuuccuguuccuccucaaagcucagcgaguagggcgaugcgggaacguauccccggaccugagagaugucaguuguggcccgaagaggccgguugcauauccuaagcaaggguaggguggggugagggugcccuacagacguauccgugggguuuuagucggcucaguugaggcuuaagagaggagcuugcccugauccaaauauugaaggaugugcccuguugaccuugggauauagaugacgagagccauaguagcggagcagagcgaugcucccuuguccacuaaaggaaggggaugccuuguuguuugucuuaugguuucuauugcugugacaaacaccauaaccaaaaaagcaaguuggggaggaaaggauuuauuugaccuacauuuccaggucaucacuggaggaaggcaggacaggaaccuggaggcaggagcugaugcagagaccauggaggggugcugcuugcuggcgggcuuguucacugaggcuugcucagccuguuuuauuauagaacccaggaccacuagcccagggauggcaccaccuacuaugggcugggcucucccuaauugagaaaacgucuuacagcuggaucuuguggagacauuuccucaacugagcuccuuccucucugaugacacucuagcuugugucaggcugacacacaaaaccagccagggcauaauugaacaccgaggggcaugaacaagcagguccgcauaaggacgucugcagaaugaagugggcucugugauuccccugaugaggcaauugcucucagccuuagccccucaguccugcagcaggugaucugagggcaucucagugaggaagccugacuuccuguggggguugugccuuuggaggguuuggggcuucgguuuauacagagauaguagagaaauggaaacaagaagaaggaagccuuaaggaaguugugauugaggcagugaaggcaggagggcucagccaggacuucagaggcagucuguauggcuuccugcgguggcgggggugugugcagaggcagagacagaggcagaggcagaaggaagauucaaaagagaguacaggacaugcucauguaccugacacuccagggaaacuugaaccagcagccuucgagugauggggcccaggaaggaggaggccaaagccagcuguacugugagacacacccacaggucccugcuaccacuguucugggugacuaacuggcacaaagccuuugagagauuggguauggcggcugcccuggaggauccuccccagagcagcagcaccccagaccucaguucaggaaugagcagcuucccaagggcuguggucucagaaagaaggggggcucuagagcagacauccagcuugcugauguacuucuguggccucuggcauugucuaggagguugaagacuccggcaagagaguaccacacaaggccaugccaaggaaaacucaagggacacaggaccuugagagagcuugaaaaucauuuguuuggcuuccccauucacacuauuuuuucuauuuggaaaauucugccucccaacuugaacauucuugucccucaguguccuguuccagggaggugggauggguuucguaacaaagccaccacuuacuuuugggaaacaaauacacuggaugacccugccucucauucuccaggcuggagguagcaccgggcuuuugauggaccuggcagccaaugagaaggccguucaugcagacuuuuuuaaugguaagugggugccaggcuuagucaggacuuuccucugccguggacagcuuugugcuguggguaauuuggaucauggaacaguguggcccggaccuuguuccuggcaguuagcucugccugucagcccugucugaggggagagcaggaaguaagcuucuccccaguuuacuacccaggguugcauuugagcagugguaugaagagcacgugcaaauggacauugauuauggccugccucccagacacaggccggcggggcucugucuuuggucucuccugauaaugugcgucccuuucuucccugggucacaccuguuugucuaccuggacucauggccacugcugccuuugcaggguaacagcugcgcucagcuuccgcucauuccgagcgagcgaggccagggcuaagagcauucuugauuagauuguuguaccaguugagcagugaaagccggcaguaaaaucaccaggcaugugacagggccuguuugacccucuuguccuucugauucugaacgccucguuccuacugaucaacccuuacauuggguucaaguggcgauugggaaucuaggcuaaguucccuacuuggaggggagaggugguuuucucuuuucgucccaacaaagcucuagugcaugacuuuccaaagagccaugacuaaccaugccauauugauuucuaacuuacuagagcuccccucaaguuccaaguccagauggguuugggggcucauuggcauguagcugaugcuugacuggggaggccaucugucagauggguggguguuuccuuccugggaacuuugcauuucuggugucagagcuggggguuagaggaaggggcaauguaaccuucaaagucauuucucuaaauucuguucagggaguagauggugcagggcuacugacugcuucccagcacggccuauggcaccgugggguagaguaggucacggcuccugacugcuucccagcacggccuauggcaccgugggguaggguaggacagggcuccugacugcggggugcauagggcuuauaggguugaacuaggacucccucagaaucccauucgucggugucagcuccugguccuugagagagcagcuguguacuguguucagugcaugugguucuauagggagcaaguggccuggcuugcaccaucagagagcacugguaacacggcaggagacaccugucuccuaaugagccacacugggcagggaagggacaugcaggcucccugucuccuacucacugccugagcucagcaagagugggcgcugucugcagucugugccaaacccagugcuuaugaaaccauucauugugagaagcccuugagacuuuuggcuuccaccaaggccuugucgguucccuagacagauggguucugcagcuguugccuggugagcacuggguccuacuguggaccugacucucucucuuccccuaugugcaguuuauaaguagugagagaucuagacaagacugcaggcaggccgcugagagccuggauaagcugggugguauuguaucccgaggacucuccuagggaggcuucucugggucacaggaauggagucagggcaggaaucacaggcgucaggaggcggggaggguggagcagucuccugcguggccaaagcuguacuagagacacugccuuuacccagaaaggucuagugcaggaacacuggaggcuggcuuuccaagcagaugagcucugcacacaugggugagcuugacgccguuccuagccucaaaguggcccugcccaguagauggaaacguggaagaugugugaccagaagagcggguggccauggcugugggcaccaguggcauguuugcaugcugacuguaaauacacucugacuggagcaggcuguagcuguguaucuggagccuggcuugcccaggcucgcuaagguagucaucuugggcucaguccggccacuguuccccacacuuccacccuccuggugcaggcguggcacugcuggcuguccucacacucaguauggccgccaggcugcaaggugcuuguccguguguccacagcacccccaugcuuuauaaagaucgccucugaacuagacuacacuggggcagugcuguccaucccccagaguucuguccgcucccuccagcuggcuaaagcuaaaccuccuggggagcccuuugccaggcuacaccguuuaccacucugccuuuccagcuuucucacuugcuuguccuguacccaacagcgcuucauugugauuuguuuccauagauuuugaagaccuuuuugaugaugaugauguccagugaggccgcccgguccuaugugcuccaugucugugaugugucuggagucucucgggacacgaccagcugauuguagacaccguguugauaucacuagaaaugaagaccuugucaaccaauagaggaacugucugaaccaacuggguacugaugucucugggaaugccagcccguguccuuguuuaaguuaauaaagaacacuguaacacgcagggugauuuuaau

SEQ ID NO: 300 - RNA, 1270 nt, Mus musculus
cacucuaagucaaagucucccuggcucaaugacggcccuuucucucaagcccucuucauccacugagacccucugcgggagaguagugcugaaucucagguguagguucgauaauaucuaggacaaggaucaagauuauuuaggagagguuugaugguggugcaaaugugugugugucuguguguauguguuuguacauauguauguauguauauguguauuuguaugugugcauguguauauuuguauauguguguauguauauguguguauauauaugugugugugguauguguguguauguauauguguuuguacguauguauguguguauauguguauauguauauuuguauguguguauguguauauuuguauaaguguguauguauguauauauguguggugugugugugugugugugugugugugugugugugugugugugaucuguucucuggaaaguuuuagacucucuuuuuguuuggggcucugccuagcauaugccaccugucccuuccuguuuucaugacuuuucuaggaucauagacccaaggaggaauccugcuucgugccuaggcucaagagaauaaguccuuaauuuccaauauugucaauauucauguguguccuugagcuggcuuucauguuaaaccucuguggccuggccugucauuagcaugcuaggucucauguaacccugguuggcagcacugcugguucuguagugucagucuguuugacaguguggccaugucaaccuuggagggacacagaauaaaucagcaagaguggugcagcugguucugcuaugacguuccagcccccagcccuuccccaccuucuauggccaguggcuaucccaguccuucccagcaagccacagcaguccccaucuguguuaccccuuucacacuuuuuccucaaccccucuggauaccuaggauauagauugagucuucuaggguccccaggagugaaccuggaguguguguguguguguguguguguguguguguguguguguggugucacaaagcagucaggcugaacaauccuuguguuccagucuuguuuccagguugcuauacagcaucucacaaugugcuccauccuucuucuugguuugagcuguaggugaacagaggaggauggugaagagggugcagaacugaagaacaucaaagucccagcauucaagauaggcaucucucaccuugaagucuuuuaaaaacuccaaaggggcaaaaauaaaagcccaaagaaaaaa

SEQ ID NO: 301 - RNA, 29137 nt, Mus musculus
guggggccgggcgggcggcgggggaggcgccgagccggggcugcgcguucgcccgccgcgcucuaggcggcccgacugagcggccggaccucgcgccucgcgccuagcuccccgcgccgcagccgcagccggcuuuuguugucuccgccuccucgacugccaccgccucuggaccacgagcgucgcgcgcugggaccuuggcucugcccuucgcgcacacugggcugagcgggccggccgggaccgagggaggcgcgcaccggcggccagggagccucgggccccgccauggaacuccggacccgaggcugguggcugcugugcgcggccgccgcgcuggucgucugcgcccgcggggaccccgccagcaagagccggagcugcagcgaaguccgccagaucuacggggcuaagggcuuuagccugagcgaugugccucaggcagagaucucgggugaguaagggcgcugcguccgggggcaccggacccuagcacucgggaggucugaucugggccccuacccgcgccgcagcuagccccgggcgccagaacccgccgccuggacuuggaguggccuccugcuccucaacuggucuauaccccacggcccucgcccccgagcuccgauccgcucuguugcugcccaguucccagccacuacgcucuagagucccuuccccauagcaaucugcgcucccuuuggguuaggguuguugcugggcgucuuugguccccggcuuggcccacugugcuggcggggcagcaaucccagcuccgggacagcgugccugccgcccuugcggcgaagcaagcgguagcucugggacggucuauugggucgcauaucccgguugcagugggcuaggaacuucucuaugcggaucucucccagaggcgucaaggguucugcuuaggaauuuacgcggauccacagcaggagccgccuaggugggauuuaugggggagauccuacacuucaagccuggguucuaaggaaaugugagcccgcugcgcgauucaggggaccccagggcucgaggggauuccuaccuaggaacuugugcccgccagcgccccuauccuagcacacucguggucugaccgggcgcuccgggccgccuggagcugcgagcccagcugcagguggucggcgucuuggaucccgcccaggggccuugucaucucuuuguaagaagagcggcccuccuggcggcggccucggcccugcagcugcugagagcagcccuuccccucccuucccuucccugcugccucaggagcucugggaaccgaaucuuuaugagcuuggagugccuaugcaaugucccaaggaccucccaagccccaggcuuugcucuuaaauguguggggagcuuuccuggauaaguguaacaccagggccuuggugagcagggaauuccugcugugggauucuucugaaacugagggggcuugcagacuagagaccaaacucaacuggugucguaggcacucugaaugaggaaaguaagaguauugcccagagggguggccuguggccccaacuugcuugggaauggcaguagauagccagccauggagaacccuguuucuggggagagacagaacccacaagacacauuguguggccugagucucuugacuaucucccucucaaaugcccucagaacaggccuuucuaugccucucucuacauacagcccugccauugccaaagccaccuccuacaguucucugggcacugucacccggugccuggcagcagcagguauaguuugguugguacccugcucacucuacccaccuccaaacacacagaaauaggaacauauacccugacauccuuguguaucucuuaucccugccagacguacccugcuccgcacacauaccagccugaggccuuccagccuacaucuuaccuuggcauggauaugccacccaucuuaaugccuucuuggagaccuucuugagcuuguacccacccacagcuacugugcccgaguaggcagggacuggcaauguaggcagugacaagggcagugagagggcaaaauaaagaagcagaggugugguccuuccagagagccugguucuuacuacccugcaguuggggaaugugggggauuaggaacaagacaagcaaaaggcuuugaugucugugaggacagccguagaugcccauccagcugggguguguaggcacccugcagaauuacagcagucauacugguuggggcccaguguuuguucagagacacccuauuuauugacaugcaaggcuggggccuauguuuucccaucaucccuauuggugcaccucagaacuggugccacacuuuucuggaaccccaugggcugcaccucacagcccucagagugggagaauaccuccaagccccagggcacuaaagagaguauuagcauguggagugagaaacagggugaccuccuaagauagcaguagcccaaagggcagccaagcucaggguccugucugguucugugccaccagaccuggacucugaggaccaggcgcccucugguggccccuaauggcgcaguccucccuggagcuccuauguaaucccuuaguuccaaagagcuccuacuuauaagaaauaugggaauaccccaggagauaggugccugcugagguucaacuggagucauugggugauuaggagagaggaagaguggcucaugggcaaauggauguccuuuccugccccugagucuuagggaccagaaauagcgggagacuucccuuuuaucaaacaguacuauauguaagaggcuggcuccucaccgaaggcacugcuuaguuuucuggauggccuuuccaggcagcagugaugacagcugucccauucuguagaggagaacuagccaggggcggccgccacuacagugguauccuccuucugugccagggcccugccggggagcaaggucuaggugagguugcuaggagcccacugcugaaucacagccaugggcaagcaagucucucuuagcuggcaggacuguucugggcuauguuccuaaguauacccucuguaguuagcucuauaccaggguuuuccauuuggauucuagggucagagacuaccccugccuggucucuguugucaacacaaaguccauccaggccacuggccacaaccaaguagguucucuauaaacaacugcagaugaacacguguuucuuggcagcuguaccgcagccuggagguggaagguggagauggccuuagcagagcgcacacagcccuccuuaggguccccagccugggcagaguaggggcugggcaucagaagaacuuaaaacuaucaagcuucuauguccuaaaaucacaguguuccugucugccugccagcuaaggugggcaccucauaccaaaaccccacaaugacuauucacuaagcucccagcaggacucuaagucucuaugugagcuuuggccuucuguacaguaguucggaauccaagguccucuuguuccuguaugcccuuuccaccucuuaggaguugucugacuuucuguagaagccaacuaaggucuguggcucucagaagucacuggcacauucgccacccuggacugaaaguaucugcgugcccuauucugcccaggaagagacaccccuguguggcucagccugaagccuggggugguccucauacccuagugugcugcuuagagcuugacuuucaucauccccagcacaacggucgucgggcuuacguguacccaagggagccauguuccagcacggccgucugcgugaugcaaugaccuggguccuugcuguagcacugcggcucucgugcuggacaggccauccuguuucuccauggaaacuuccucucuugggcuccagaggcuuucugcagagucagcacauacugcacaggugauaguguccaucagcugagaggguuccugaugaacuggcuccaaagaggcauuuucacaacuaccccgggagcacugggugagagggacugugugagccacuggagagaagaggacaucaaggccagagaggccacauaccguucuuagggcauugucugacaaaugccaaagccugugcuggcagcuauuccucaguaaagccggagcagaccuccuuucuaaggcucuguguucuggaagcgucacacugucucagcuuggagaccugaaguaggauuuugcagugcagguuuugugggccuucccuagcucuagacauauaacaggggugacccaaagugugcaaagagguaucgugacugccuccugugggccgaggacagaaccucagauugucaauaacaacagagaggcaaacugaucuugaugagacuaggucccaaaagaauaguaggcagacgcccuguacacagggcuagccaaggaauaugguaggggcucugacaaugauagugacacuagaauacuagugcaagucucuacugacaggccuacucucaccucacccgccaaaguacuggggcuuuacugucauguaugccagccaagcaacgggaugcacuuuagagccagguagguucagccaguguacgaacacaccuccauuuauaccauggguccuguaguccagcugucacuugcagggacagguggacucuuucuuaaacaagacuguccucuucaggcugggucaagagggauuucagggucuuugcuaugucagaacauaggcagagccuccacccccaccccgccccugaaguucaagccucuguccagcccugaccuacccugacugugggcacagucaugugguguuggaugcuacccauguccuuuaguggcuauaggcuguugccucucaccuggaacccaagcaccuugcugaugcccuacuggcagcguuucuugguggugauuaagagcaggccugggucggcaccuguauugcucgaauucucccguauguuuugaggcaugguucccuagguugauaugguccucucuuccuugaacucagcuccaacaccaccacccacaccauaaagauuccauuguucuggguucuuaccagaacacgggggaaaccaggggugccuagacgucuaacuuguugcccaucagcaccccaugccagggaagcucuugagugugaggggaacucccugccacccauugagugacaagcauccuuggugacucccuuaggagccaccuacccucagcuccuccucugccuaugcccacaguauuaucucccacuggauucucauugcccuggcauauaacuccaucccccuagaccagucccuccugugcucacucagggccaccucugccacuguuguccccaacauucccugacaggcauauacacuccugcucugaaucucaccugagcaggucuuggguccauuuguauggugaacacucccaaguucucccugugugccaagcaggggaccagcccuggaaauccuaguguuuucauuuccagaaccacaguaccaaagcaaaugggaagaugugacugcagacauugcuucaugguugggguacugggagccugaggccaggcaccagacaggguuauucccuuucugcagcggagggagagcccagugucucccagcauccuugagaugugcuggugucccugacuuaaaaacccacacuuuaaucuuugcauagcuucucccauacaucuauuucuuauaaaaacacaguuuuaaaaagaacaguugucuuggauuagggcccgcucauauacucuuaauaguuaaugucugcagaaaccucacaaauauucuugaguuugaaugggggaaucauacucgcauguacgggguuuuggggacucagcaaggaaggaccccaugaugucuacgucucauucucgguacugauucagcauguucuguccggcugcugaaaucucggcucucuguuucauucagagucacaccuuuccccaccugcuccuuaccuugcccaccugaaguccucucaucagagcuucuccccguggcugaccccugccuccccagaagaccuuccuuccacgucagguggcaggccaggguuuucuugcugauaugcuaggucuaacgaugcucucucaguggccggacccauaacugcuaaccagugaaacaucucugugguaugucacagagccaggaucguagucugaagaccccuggcuggcagucaguggcaccagagguccucagacagaccaccugugaacagaagagucaagccagaugggaggcucaacccuaggacagauuuucaaggaaagcggagagcaaggggcggagacaagacuggguuugguggaaagccccaaagcaugccaaacaggccgucucccccggggccagggccagccaaacaggcugcugcucacuuguacaaaacgcucccuagauccugaggacuuggccaggugacagggcagccccugagggcuccgucaaucuugcucccuggccaucugcccgaucucccccaacccugggaagccagggccaggacagagaggaaaacagaccaagagcaagcccucuguggaccgaacccagaggccagugccaggaggucagcaugcugugucuuugugugggcgccacagguggaugaggcgagcucaguuggccucuagccagugcuagggccugugucuggguggcucagaaaggaagcccuguaaucuaccuaggggaugagugcuccagagccgcuggugggcagagcacugcuuagcaugcacaugggaaacugagucccagagauuaagccaagguggagccucucuagagguccaauacccugacuaguuccuauuuauagucugaguaagucaguggcccagcccagaguuggcaagugccugugugggucccagcuugugguacuaaccugaguacucacacugccuuauuuaaacugaggagaccuuuaaguaagccugucucauagguacugaaauaguguccacgcugcaagagugagaccauagggcggagaucuaguucucaagccacagacucccucaggugcaaaaagggacagaggacuaaggcaucagaagccagcacuggaaagaucagguuaggggagcguguccuaaagggccuuggcuagcugacugaagggacagagguacaaacucagcacauccucagcuguccacacccagguagaucuuuuaaggucagagcuggccuuuuaucggucccagaugccuaagccaagcuggccaggcuguaaggccuuuuuccuuuagccccugacucaacauguuuaagaucuagugagaaauugagucagggcuuccagacacccccaccccccaaaacccaguaguccccagacuacaguggucauaagcccaccagcaucuagugaggaugguguguucaaguagcaauacuaccagaugugggacaggagggcgcugaugagaccuugaacagguggcccaccuccccauaggccguucuggcuuacuguagccucagaaacaccuccagaaggauucccagacucuaaagauagcuguugaccauaucccagacggugaucuguggguggccaucccuccuguugugaccggggcaucuucauugucuguggcuaccugugguccucagaauccaaucugaaggugaccuguggugacgucugaguguguccucaaacaucguggccgcaagugcccaucagaggcucugggggcuacagggaauacaucccacccaccugugaccaucugucagucucuggggagaaagcugaugccaccugcugcugggguuggcucagacguuuacacaucuacaguugucauggagcucgggacacacuggaccacacaguuaucuagaaggaggagguucuuacuaauucacuguaauucuuaguaaguuaccaaaaucccuaguaauucaccauuuuuaacuucugucccuccuacacucuuguuguaacaguacccagaaaucucuguacauccugauauccuaggacucccaguuggcacaccuuacccagcacguguucauauggggcucugggcuuauggccauaggucagauacccugggcauacccucuaugagugaugugauaauccugaccagaauccaccguguggaccuuuggcaaugcauuguuccuagcaguucgugggugccguauuuagcuuucuucucugugagcucuuaggaucuuccacaaacaccaguggcaccaggagaaggacuuaaguggaagguguaggcucaccaaagucagggggaccuuggguagggagaggaaguggaguuggauccaaaggcuuacaguugagcauuaaaguguuagugcaagucagggguccuuauaggaacacaaaugaaacucagcauucaggaauguggguaaggugacugauucccauccaggcugggaauaacagaaccuggggcuugaccaguguaaaaaccacugauauuuuucaugugccuuuacuuuuguaggagauagcuuagaauauagcacacuugccauaaguuugaaacuucagugaacaguaaaccagcuaccaggucucacaacaugguguguucauagggaagggcacaccacuguguucugcaguguuccaacaaacgcucauugaguuuugugggagauggaggcuagcuccuugggucaaagagaaggcccaaguggccuccguagccuucucaucucaugcuuccaaacuaaacccaguucugaaaaauugacagccuccaccagauggcacuggggcucagaacggagcccaaguccagcugagugacuaagagagccugccauuccaagggcugggcuaagaaaucagugugaucaccaguguggacaguagugauguauagcaggguuacaggguacucuaaagccucuaggggugcugcaagagcaccuacugugugcugggugcuauucuuggugcugauaccuagcggcagacagagcgcucuucaggcugugcagcuaaugggguccuugaaggcuggcaugugucaaguuugccucugagcauggccuugcuugacucacaaccagauguugcacagaucacuuaaaagugcagggagaccacugugauggugcaacagauaaaagugcucgcugcacaagccucaaaaccuguuugauccccagaacccggguaaaagcaggagagaacggacagcagaguuaugcucugaccuccacaugagcacagcacccacacauacacauauacucacaacaacaauaaguauagggaggguuacaaguggggcuccaugguggaucuuuggcuuauuagcacaugcaagacccuggguuuuggccccagcaccacgaggagcuaagaaacgagggccuuggagccacacaccugcugaagugauccaacccuaggcugcacaggacagguccagggcucccagacuacuguccugcugugcagucuuggcuuucucuugacauaucaucaagaugguuuaagaagcucuagccaugucgggcguggugguguacaccuuuaaucccagcacuccggaggcagaggcaggcggauuucugaguucaaggucagccuggucuacaaagugaguuccaggacagccgggcuauacagagaaacccugucugggggguggggggaaagcucuagccaccugcggagucacaguaugauggccccagccuucuguguuauucaucuggugggacucuugccuugggcugggcccuuagagcuuuuugucgaccucagaaaccagccucuguuuccuacaaaacucagcaggauuuaucgccaaacccaagaacauagaguagcagagucuagccugcuauugagagagcagagagaagucaugaaaaaggaacuagaagauaggcgagcaggccuucaacagggugggagguggggaugaggauccauccacuguuacacuguggcugaaccucuggcaaaagccugcagcuggugacaaaacccaggagguggagccagagaagagucuagucacaggguuaaggcuagauguggguaagaaggagagggcauaauagcaacuuuguugcugcugcaagaaacugacaaggcaauugaaggaaguuauuuuguaaauauauuuacagcucaagggggaggucgguugggauugggaagaugcagugggaggagcuugaagcagcugguuacauuguauccacagucaagcgucccuaaaugcugggguucagcuugccuucuugguuuguuuucuuacagcacugaagaucugucuuagguuauugcugagauaaacacggugaaacaauuugggaaggaguuuguuuuggcuuauaccccucaggucacacucuugcaaagaagucaggagcucaaacagggcaggaacugaugcagaagccauaaaggagugcugccuagggcuugcuccuuaagacuuucugauaguccuggggcgacaccauccauaauacauuaaucacuaguuuuauuuuauuuuuuaaaauauuuuauuuaugauauauaaguacacuguagcugucuuaaccucugagccaucucuccaguccaaagauuuauuuauuuuauguauaugaguacuauagcugucuucagacacaccagaagagggcgucagaucccauuacagaugguugugagccacuaugugguugcugggaauugaacucagaaccucugaaaaagcagucagugcucuuaaccgcugagccaucucuccagcccccaaucacuaauuauaaaaaugcacuauaggccauuccuauggaagcauucucucaacugagguucccuuuuccccaaaugacuucucuugugucagguugucauaauacuagccaggacaggaucaaacccacagccuguauaugcuaggcaaguguucuaccacugaaccacaucuccagccccuuauuucuuuuuauucagccugcgacugaaccccaagagauacuacuacacaugucagaugggucuucccacuucaaugcaaucuagaaacuuccucacaggccugcccagaaguuuaucuucuagaugauucuaaacccugccaaaugaauauauuaaccaacacaggggugauaguuacaccaaagguggccaaugucuucagaguagggcagggcuagaagacagcucugugaauucaguguugggugccuuagcgccuccuuggaguagagauccccaagcugcccuggaagacacagugcauucugggugucaggaugcagccaaguucuguucccaggcuuccagagcuucugucuggcagaguggcagucuggggucagucaguauggugacaucagagccaugcagaguggagaccggaaggcauauggaugggugcgcuugggcuguuggugcugugugcaguggcacagugacacuggacucagaaggaagguugggcuaggcuguuggagaaagucacaccauugguugagaaccaucucaggagagugaccugcucagugcccaguagcuagcagugaacacugagaaacauccucaccgaauccaagccugaucuguuggacuuagcuaauccaccuaguucaagagcgagcuuugcccucacuuggcugugugacugugagcuggcugcugggcucuguauugugccuucagaggagcuccugggaaacagggaggcuggguccuccauggugcuguuuucuccaggcaggcugugagcgacagaacucaguuagagaaggucagcauccaggcauccagggaggcugaggagccacagggcagggaggaccuagccagugucccacagugcuccuuccugaagucaugucagccacucaacuacuacucacuggucccaucauggaaagccaugaauugccaggacaguguccccaggauacaucagcaguagagacagggcuguguggguagcaggccagcaaucacucucagggcugcuguugaaaagugggaguugacuuuuagaaaggaagccaaugggaggugagggaugggaacaccucaggucuuaggaaaggcaggagggaacaggagcgugucacaggaccagcuucuugccaggccugggcagguagcagcuaagcggugaggccuucccuguccuggaucccaggucuugacacaguccugaagcucccauagggaagcauggauccuuccuucaacugucuaccuccagggauccaagaugccugcccugagcccuaugagcacacagccgugucacccaccggaucccuaugccagcccugugccugccagcagucacuggcaagagccugagccugaguguagacaagguggggccaagacaccucagcagauagcugugugagcaucccugaggagggaugagaacugaggaggcagagaguggccccaugaugccaccugcuccuagaguacaaagggugagucugagcuuuggggaguagggccugugcaaauaacagugacaaaacccugcuggguaggagucccaggaguacuuggugggguuaggaggggccuuucugggcuggguugugagacugucaucaguaacaggagggauggccuccuagcaggaccuugcagacccuugcccagcagccugagaucucauuuucagaaagcuuggccaggaccagacaggaacuuugcugaccagugcaguggccacaucugacuccagcaagaacccuggagcccugcuuuuacgggcgagcauucgucugugucccuaggaauccuggcugacugccugagagcuccagaggucucacacaccagccaagccugggccgggggaaggagcucagccgccccagggucugaugugggugggucacaucacugcugggaaccucagucaucccggcugaacugugugcuugugggugaaugcccaccggugacagugacuucaguuagaucacaucccaugucuuaggguuucuauggcuucgacgaaacaccaugagcaaaaagcaaguuggagaggaaaagguuuauucugcuuauaccucuguauggcucuucaucauggaaagaagucaggacaggaacucaaaccggacaguaaccugcaggcaggagcugaugcagacacauggggugcugcuuaccggugugcucccucguggcuugcucaaccugcuuuuuuauagaacccgggaccagcagcucaagggaggccccauccacaaugcacccucccccauugaucacuaauuaagaaaaugcuuuacagcuggcucuuacggagucauuuucucaauuaagguucccuccucucugaugacucucgccugugucuaguagacauaaaacuagccagugcacccccacaaagaacugcaagacacagccaugaaaaagcaggccaccccaguggguagacaaugacuggcuucucagaaugguguguugucaccaacugaaccucuguccccauuaaacacugaucccuguucuaguuuuauuuuuguugcuguuguaaaagacccugacucaaagcaacuuagggaaggaucagguuuguuugacuuacauguccaucguuacagggaagucagaagcaggaaguugagacaucuggacacaucacacccauaguaaagagcagagagaggcagauacuccuaugcugacagccuuguuugcugucagcuagcuuucuucacucuuccacaggucaggcucaagccuagcggauggugucaccuacagugacacagacaugaucccacagacaggaucccacagacauggccacaggagaccaugaucuagauaagaacucacuagggcucucuuuccagaugagucuagauuaugucaacuugaaagucaaaacuaauacacauacacacauacacacacuccauuucucuccucagcuucugacaugcacaguuucacucucugucucuuuugguucugucaguccuaaggaccucacuuggcuucuuucauugagcaugacagccaucucacagcaugucagaauucccuuuuugaagcagaacaauauuccauuuuauaguuaagaguuuguuuauucauucaaacauccauuuguaccuucaggcucuauuugauacacacacacacacacacacacacacacacacgcacacacacguaaaaaaucaaauauaacuggcauccaaguucccugcuacccuccucuaauugugcuugcagggagugcugggaccacagcuagaagccacaugcaugcccuugcugggcagaggugcugucaggacagcccagccuagggaagcugucgagacuacugccucucagcagagcauguugacucuugcuguagucuuagccuuccacccaggaauuccccugggacgagaaucuagggaggccagcacuguucacguggccauucccagccagugugaccuuggguaugucgauuugucugucuguaugccaccaaggucagugauagacagaugaagugauucuaaccccaaacccuuguuugcauggcacugaccaugucgugcuaggaguaggagcccucguggaugggaacuccucucccggguuucccuuauaccacaagaugcuggcuggucugccucuuggaccugcuuggaggaaggucugaguugguuauagcagcagcuuuguuccagaaauguccacaccggucuaaggugccccugccuguuauauuuuauacauauuuuaacaugagagcuagcaugguugcuggguggagcugaaagaaaggaaguggagcuuucuggggaaggggggugaacaagccuugcagggaggugagggauaugcccaggaggauggcugccaugccaguaggaacagcuggucaggcagccaguagccuggugcuucugcuuugggcuccauccugguuggguuauggccucucuuuaccaccucugccaguuugguauuuacggagcugagucucuuuaguccauguagacacaucugaggaaguagacccggucugucauacagguuuccucagcugcccuguggcccagacagggcccagaaguggaccguugagccagcuagaugagaaaacgguguagagccagggggcaguuggcacgaacccucccuuuuauauacuuccugccugaaucgccacccugacccacaugggugugagugagagagccagguucaguuucacugaguuggugaugaaacacuacaaacucugagugggcucugcccugcugccaauucaaaaaguuguggucuugguagacaugaacacaggguccucuacaucucuaauguguaccaagaaaccauggacacuggggcaagaccuuuagcuccagugggaccuuucaucaugcugaggcaccuccuaccuggcauucacuggugagguggccugagcaggcaguuuagagagcauccauuugggagucugcuggauccaaagcccccuuggcugagcagcuguuugcccagaagauuccuguguccccaguagugugacugacuaggaaggcugagggcauccauccauuuccaggaagaaaugugaguaaguggcuuuccccaucuggaaucagagauuggaaaggggaugaugaucaacagguuuggggagcuguccuugucccaggagggccaggagcauagaugaagaggcagccuggguaguguuuggagcuagguuggcuggcacgacuaagagaaguguaucagggaacuggaagcaggggcuugugaggauggguucucagggaagggaguaauaggaaggacugggccacuguggugaccuuugugugcccagcaguggagaucugauguucuaccagagagggaccuccucaaugcaguuagcagucucucuccgggucuggccauccaugguccucucuagcuaguuccugaugaguaugugcccugcugaggccaaugagccagagcaccagauacacccccccccccaccucugggcuggggcuagcccagaggcagagauuugauccacaaguccuuugaaaugccagcacgguggggggggggggggguccgcagcugccuacuguuuccagggacacggggggugggggggggcggugcugaaugugccagugaagguugcgggaggaggugcgucccaggaagcugccuucagccuugugcaucagugagacugccacugcccugcugcccuagguugugggauccaccacaccacgccgagaccccuagccucaucuuggccuuuccugcugaguucugcugcucugcaauugccagaccacuucacuggcgcuggaaucgcccuugcuauccggagugcauccacagcuggggacacuauuggagcggccauggagaaggggguucuaaggccaggaggguguccgcuaagcuaccaggcuacgucugcuaggcaccaucucuaucaccauuccugucugcauccccccuccuccaugcauucaccucucaucuucaguuccauucucucgcagcuguacccccacuacagccuaucucugucucauccccuucccaucaagagcuuggucaucagcccugauguccacucaugucucucagcucccaccuccaucccauccccaucucccuaaaguugugcugcaccauccuagauauuccucucuaccccaucccucccccugcaccccucaggcugccgcagcccccuuuccgcaguaagucccccuuccucuacugaacccauccccccuuucaccccgcccccgccgccacagccauggcgcucgcuuuucucccuccuuuuucugccgccgcgcccacugcggcaagccccuuccccgccaaucacaucgcccucucuccucucccuccaucucccgcuuuccgcagccccccuccaaaugccccccucugccugccgcagcacucagcucuccgcaccagccgcgcccacugcaccagcgcccccuccucacugcggcgccagagcaggcgccugcaucugcagcuccggcuuaucuuaccggcuccagcuguacagaaccauccccguugcagaggaggcagcggucggucggagcugcaggugucgcccaggcuuuguucgcccagggccuggccugaugcuggagaggcagcuggcaggagcccuugccugcccggagaugaccccucccaucgaguccauagaagugccagcagccgaugccccccaguuagggggucccuguucgugauggagguucuucuuggugauguugccauuugggugaaccggaggcaggggcucgggaaucaugaaggcauccaggaggguggaaaaguauugggagugaggugggggcggggaggggauugugcuugaugcuuuuccaauuucagagauggaguugaaaugucuuccuucgggugugacccccggggacuagacagguuuguuggggaacaggagcaagcaaugggaaaaugccccuggagccugggcagugaguagucccccagaaagcugggccauuugcuccaggcugucacguccuggagacucucagccucuggggcuggaaaacccaggagcacagagggcugguuuacuucuaaccuaccagucaacagaaaggccugcucuaggagccagcagcuggggaggggaguguagccugugccucucccuuaucugcggugcugagagauuauacuccgaaugccccuacacucccccaagccgugccagcuggaguguuuuaggggccgugagggaagugggcuuuccacucugcaucucccccgugagcacaggaagcuucuagaagaauggaccagaggcgggguagcaugacucugcauuaucuucagaagguggaggguuucaaggcauugggucccugaagugucaggggaggucaggucagagaugucuguggguagcaucaggaugcuggacucugcuaaaguccuggggugacuguggaugaugaccaagagggaugcugccucugugagggaggagcaggagcuggagcugucagcagguggcaggagggugugacccugaaagguaggaagccacaagcugcugucugcucuggagaauaguggggggccggggguggggugcaagcagccagauuugggaggagguaaaugagcaguugcugcccauggguuugcugcaauggggugccaugcuaagugucacaagaagcaggggucuuggaauuugagaggcuuugggguuggggacaaggcuuagaaaagggacuaaaguggggaaaaccugccauuaacaaacaacccccuuccccaaauaaaaccugugagugccaggggaggguagugccccccaaaaacccaggagggaaagaucuggaaaaaugaaaccaacucugagagagaugggcggggucaguggggaacaauacugccgcuccacucccacccaccuucagggcuggcaaggaggaagcugcugguaggguagaacggagagacguuccuacgauggguauguacuccagugcuuuccuggaaguguagagagcuuugcagagccugccuuagcuguucugauguugagcaccuaugguuccaguugggcugggucucagcuccucuaucuuugacccucagcaagcaggucugccaaugcaugggcuucugggcagccugacccagccugcccggggcccucaggccagugcccaggcucuggcuccgugucuucacucccguguuuguccgaggagggagggagggacgggggcggugcuggggcaacuggaacagcgcaggucaccgggcuggcugggugagguggccaggcagagccagggggcugcaggggaggccauuggaugggguaugcucauaguagcuggccaaaagucucaugggucccauuuauccagaaccugccguggaguggggcgaguuucuguuucugaguguguguccuuaauuaacuucuuccuguuucagcuucguucuucugucuauguggugagggguggcaauugggaccacuaagauggagaaggaugucagaggagcagaaaccaugggaggggccaguaaggcugugcccaccucucucuugccagugcucuguugugcagccugguccucaauauuuccaccuaaaaccuuuggccuacacacacagagugccucugucccagcugagcccaggauggccccauccugauaccugcagccuccauccccauagcuguuuccccacucacugcugaagucagagaugggucauccucuacagugccccccaugauuccuccucuaacagaaaaacccuuaaaccccaccacucaaagagagagauguggcauaucaccucagcccagcagaccauggcccggagcagagcaaauagaaggcccugcugggcccuguaccuuguugugccuguagccugcuugcggguggauaaucucugcuuagcccucccuacucuagaaggaagggaaucaaucaauggaugcagaucaaguggcaggaccuaggcuugcagcucccagcugucugggcaccaacccagcccuuucuugagguugggugcuuaauaacauguugcuucccaggaccugcagucccugugaaaggcaggugcccugggcaggaggaagcagugugguaggagcagaggguaccagguaggggaguggugggaggggcauuccgugugcaccucccaucucugacucccuuuucucuugacucccccaagcacccuugaaucagaauacaauuccuucuguucuucuaccagcugucagccacugcccugcucuguggaccuuuggggacccugaaaccaggugggacucagccugugaggccaaaaguccccaggguucugggaugaagcacagcucccaugccuuaguaagcaggagaagggcuaggccaggcccucaaccugagaccuggaagagcagaucugaagguugcccuaccuagggauggagggguggcaucuggggauauauaccuuccaugucaggucaaaaucacagaggcuguacacaguuccacucugcaauaugcacacacacacacacacacacacacacacacacacacacaccauccagcacacauaaaugcuugugcuuacuaagugcuaaagacaaggaugugaucauguaacaagcucuuaagggugaaugcaaccucagaaucucuccuuagucagagaucuccacucccaguuggcuucaggggagggggguucauagaaauggggccuaacacauaauggccucauccugaggucacagguuccugcccccacaugcuucuugacaagauguccacuccccucuggcucagucccccaccucugauggcagccugcaguaucacauccuggaguucuucacaucccaccuuucccaucaacccgucagcaaggauaaagcccagguaccagcccuggcaccuacucugggcucuggaaacucugcauuucacuggcuccccauaacaucaaaaucagcauuccugcacgagggaagcuucuagaaucccugcugaccgcucccucuucucagaccuuucaccuaaggcugggccacugccucugccuuuuugauccacccagucccuuguagggacuguagggcucugucuuuaggcucagagacagcagugugacccuaugagaagggaguagaacagaguggggucaggcauaggcccaguccugaguagcucagcccccaacugggacaaaagccagucuccaagccucagauucccuguaaauuggugucacuauagccuuagcagaagguuuccucucccauugagguuuucuucugaugccaggagacucucaggugugugcuguaagggcuccaugguagacacuuugaggccaauuguaggcccaaagcaacccucugucagcaaguggcaguugauauuguccugaaugguacugcugcagugccaccaagggcugacaggucagcucaccagcccaggauagauggcgggggagggaguuucagccagaacacuauggggacugggaauguguccagcuagugggaaccucaggccaggguugaguggccucuguuugggacccagugccugcgcagagcaugcuuuucuucaccccagaaugguacccagggcccuugcagaaugcugacacaggcccugcagaacauucauggggcacuccacucugcugucagucagguggccucugagacuggccugagcuaagaagaggcuggauuucuucuuccucccccgggcagaggcaccugccaggcucgaaagccucuaucagguccccaaccuaagucgggcagccucucccucuaugugagggcugagcuggcucucagggagcccugcuaggacucucauugcauuccugagaugcuggacuaugucacacaguacucguagucugaggcucagcccucugauaacuaugauaaccugugguaccccaucccugaaucuuaaucagaggcccugggaggucagagacacuggagcccagcuuugcccuacaaugugcccccucuccccaucucugccuucacaaagggcuccuaaccugagcugagccccaucuugggcagagcauccuggaccacuguucccccucacgacacccuuugccgucccacaggugagcaccugcggaucugcccccagggcuacacuugcuguacuagugagauggaggagaauuuggccaaccacagccgaauggagcuggagagcgcacuccaugacagcagccgcgcccugcaggccacacuggccacccagcugcauggcaucgaugguaagugggcacuugugagugugggggaggagccagaggcuaggauuuggauggcuaacuccauaggagggucucccucuuccugccaggcuugaauagaacaaugaacccaaguuauugucagggcccuagggagaaugggccugcuccucagaggggaacagcugggcuugaggugcuucugugucccaagcagaguuccccuccagaccuacagagggcugaccuguaucaccugcaucuucugggguccccgugguaggcccacuaucccagcuaccgucccccccgucaggaagcucagacugaaggcugaaagugcagggcuuguccugagguaaccaccucuuggccagggcaagaaagacuccugugcacuucaagagaccagguuagcgacuuuuacaaucauguggccacuguauaugggcagcagcuccaacagugauggaauguuucacagggacucuguggggcccuagggucauaagauuccccuagaaaguccccuccuuaaacagagguucacuaacuccggaagagauacaggcagggcccaggcaaagauguagccccugcagugggguggaacugggaaaauacaaacuguaaaggcaaagaggggaagcacgcacagcuugucuagccacagcugggccauagcuucaaggguuuagaaaucacagcagaucagacagcccuaaccauuugcagacucugacacuuguugcuaagccuuccuuuauuacucggugugggagagaggagcugagcagccucagaccuugaggaugccacaaucagggcuccaucccagagauguguaguacagugacauuuccccaaccucaaaaucugcggcacauauucacauguuuacacccucaccgaaaaguaucuaucuggggugcugguuugcagcagggcggguuugcuggagaacaggaggaggaggagggcugcuuggagcaaccaagagcauugggguggaagacagagcaguuggcagcuaggcaaggcucacucugguuucuuucccaccacucccacuacagucccucccagaaucagugaaucucagcaucuguugguuccuaagguccaacucagaaauggccucuggagcuagagaccuaaguacacaugcgccuaugacccuagagaggccacuccugacuucugcaccucuggugaggagagccugaggaagccucugcaauaugguguccagcuuuuauugacugcauaagcaggcucugagaagcgggggauauucugucaagcccaugaguagauuggcagagaagcagagccucccccucagggggucauugccucuccucugugcacagaccacuuccagcgccugcugaaugacucggagcgcacacugcaggaggcuuucccuggggccuuuggggaccuguauacgcagaacacucgugccuuccgggaccuauaugcugagcugcgccucuacuaccguggggccaaccugcaccuugaggagacgcuggccgaguucugggcacggcugcuggagcgccucuucaagcagcugcacccccagcugcugccugaugacuaccuggacugccugggcaagcaggcggaggcacugcggccguuuggagaugccccucgagaacugcgccugcgggccacccgugccuuuguggcugcacguuccuuugugcagggccuggguguggccagugauguaguccggaagguggcccagguacaaacacugccuggggcucugaguagaccccugggaguuccucaugcuaugcccugggugcuugguaucccccacacucagcccuguucucugagccuccuggcucuuaggcucauagcugcagccuguuaucaguugcuuacaguggguccuuagaugugaguccacuuaaagccugucugucugcugcccaguccuggguccuuauccagaugcggcugugggcagggugaagagggccauuggucugcugggcucaggaaacaggaaacgagaaaaugauauaguuggcccuugagcaaacaggccucacagggaagcacgguagcucagugaaugggagagcacaaugcagauccaccuggggaaggguaugcagagaguaucagcuuuaaacugcacugccuccaucucuagcuaggugcgguaagucaccucccaacccaugggccucgguuaucugcagcaaagccucguggcagcaguaguccugggacugugacaccgaaauguguaccugagaugaccuggccuagagcagagccuagauguucuggcuuguaucccaagcccuucacauugggguucccucggggcuagcuggugaccgggugcacaaggacugcagugggggcucaggcugccuuuguucuccagguaccucuggccccagaauguucucgggccaucaugaaguuggucuacugugcucauugccggggagucccgggcgcccggcccugccccgacuauugccgaaaugugcucaaaggcugccuugccaaccaggccgaccuggaugccgaguggaggaaccuccugggugagccccaccucccaggccgucuggcuuguccuugggagcaccaugcagacagagguccugggaggcaguagucccuggugugggccacaugaagguuugaaggccugauaugaguggggcuuuggggaucaagggaaagauuuuauuguuccaaggcauaugguagaauagcugcuucagcaugcauauacaccaacacagaggugauaugugacaaacccauacauguaugaacauauacuuaaacauacacaaucuggcauuguguauguuuaaguaugauacacacaaugggccagucuguggugugcacagagacucccugcccaucacagguguacuuacaugugcauguacuggcauaaggggaguugacauacacauaugccaacacauaugaaucacgguaucccucuguugauacggggcaaauuagcaugcauacaugucggcacugguacgaagcuggcaugagcugguuaguaugcugaucugacagguguguuggcacuaugagccagugugugcgugcuauuauaucugugugguaugcaagcaugcacaugcacacacacacacaguuuauguguucagggucuggugugauuacaugcauacguaugugggcacaugguaggccaacagcuauucaugcauguucagcaccugcaugagcuaacauggacauauauggaaaugaacuaggcaagcuugccagauguccuguguguucguggaaaccuaugcucugccuguggguauccacuagugacucaaaguguaagcugguucagucggaaugugagcucacgugaccuucugcugaccuauaccugugacugcuguugagacuguaugucauuaaugugcacauguaauguaaugugcacacauguuaacaccucugccagacuccauggugcucaucacugacaaguucuggggcccgucgggugcggagagugucauuggcggugugcacguguggcuggcggaggccaucaacgcccuccaggacaacaaggacacacucacagcuaaggugugugggggcugggggcgggggcugggggugggagggggugugccacugcgagcacuggagggucuguccccaguaugggucugagaaacccugcugucccuccagaaccccuuuggugucucccuaggucauccaggccuguggaaaccccaaggucaauccccacggcucugggcccgaggagaagcgucgccguggcaaauuggcacugcaggagaagcccuccacagguacucuggaaaaacugguaaguguacccaucucaguggccaugacauauccauaugggagggacaggacauaggcagucugucccccaggcuucucacugcucugacugccauccaacaggucucugaggccaaggcccagcuccgagacauucaggacuucuggaucagccucccagggacacugugcagugagaagauggccaugaguccugccagugacgaccgcugcuggaauggaauuuccaagggccgguaggugcccgccacuggccacauccucacagaugcccagagcgagggaaaguggccuggaggaucccacacauucaccagcucccagcagucaccacauacccagcaccccaccauggagcccgcauggguuaccaaugcguuaguuugcuggcucuagggugucauggggugcaaugugccuugguuagacuccuuugcaaaagcuaauggaaugagucguggcuccagcuggcugcccuguuccagguaccuaccagaggugaugggugacgggcuggccaaccagaucaacaacccugagguggaaguggacaucaccaagccagacaugaccauccgccagcagauuaugcagcucaagaucaugaccaaccguuuacguggcgccuauggcggcaacgacguggacuuccaggaugcuagugaggcccgcccagggcugggguggguuggggagggaucgccccugcucagaaguggaaggguacaaggccucuccagaguccucugccaggggccuucuaagggcccuguguccuuguagcacaguugaggcccagccaggauguccaucuggcuaucaugugacaggugggcacagcaggaggcagaccuaggaacugugucuucaggcgggcacaaugggccucagacucccagugucaccuaagcacucaggagcccagguaggaagagccugcuggagccuccugucuuccccaggugaugacggcaguggcuccggcagcgguggcggaugcccagaugacaccuguggccggagggucagcaagaagaguuccagcucccggacccccuugacccaugcccuccccggccugucagaacaggagggacagaagaccucagcugccaccugcccagagccccacagcuucuuccugcucuuccucgucaccuugguccuugcggcagccaggcccagguggcgguaacugcccccuauccccaaggacugucuuggccaaaacaugcaacagaccauauuuaauucccuuggccuuuugagguccagggcaggauaaggagacaguagcucugagugcuggggcagggugcauggggggguccuggccuccugggucuggccacgccugucacccuagcuuuuaauuuuguaucaggucagcugcgagccaguguccccaaaagccauguauuucagggaccucaggggcaccucuggcugcacacuccuccccuacccuccugcaccacccccagaagcucaugaggccaaccagaagggcggcuguuagcuacaacccaacggagaccucaagugagccugugccuuccucuccugccucuucccgcuggggacucccuaccagaccccaugggccacagaugucagaaauugaggcccauccugcagcuccccaggaagccugcaagggaugccaguauguugcuguccaggcucuggcagggccuucaaguuuaugcaugauaccuucuacucagaagaagcucugcagccaggauccccacacacagcagaccaggacccuguaccacuguggagcucagugaaucugguucucaaaaaaagacccacugugggauucucuaguaugacguaggugaggugggagguggcagcuggcacagccauacuacgcucaacucugccacacuguuugaggguauguuccguccccucagaugggcucacaaagacuggccuuggugguccacaugaggagccucacuucaggggaacagccagcuacaucuagccccuaccccacuuagaaaggucaccuggccauggggaugcuggguggcuggugaaacuuuagcucagggucaaugagaccuggcacugcaggucaagaggaugccugggccccuuccugacccaggcagcucugcaggagcuggggcagcauugacagucaagggcuuuuacagacaugcacauucagacccucaguguccuuguccacugagcgcuacaucuccaucuuccuugacagcacuggagaggcucagggcaccacuuggaaucugguuuccuccuauggccucgagaccugggggcaccuggcuuaccaaggcugucaaggcuccaucuucccuuccagggccuaggggaugcugaguugcuauauccaggaaggcagugguccugacaugcagaaggccuggaaaaaaggcugcuuaccgcuuuuuuuuuuuuuuaauuuuaauuuuuuuuuuuuaacuuucuuuuagucacuggguuagagaggcuauugccagcacagcaccaaggccugcccaguagucagguccccugguccaggauggguauucuccauaauuggucuguggguuuguugggcccaugcccugagcacacucaacccagccacagcccugcuagugccacucaagcaggggcacugggagcuagaccugggcucugagaugagugccuaggugucaggacagcagcacccaugcuguacagggcagccgggacaguggccaggguacuggguccuuucucugucacucggugucaguggauaauguguguucuuugaguccuuguaugaauuaaaggcuggggaccuacaguggacaugaccucauuuaaacugguaagacucgguguguacaugugagccugacaugccuagcccauggcagagcacagacuggagcuuguuagaaggagguugaagagggguugugccuguaggaaaguccugggguuuccaugugguggcaaccauugaacaucuaucuccaaguccugccugggaagauaccugucugugccaacugaacaucccaaaguuuaugggaggagggagccaggauaccagagccagccagccuacguggguuccaccagccuuccaccucuuuaacacaccucaaucuacaugccauugucuuagccauagaaaaguucucauuccugccagggugccccagagguacccaagagagcaguguagggacaaggaauagccugacacaccagucuaucccaaguuauccuacaucugcagaaauguucuaaguaacuuaagauacucagagcuaguucacccucaccuccaggagcugaccugucccuauguaaaauagugccuaccuccauugcuacgaagcucacucaauagcccagauucaaagaaucccugcucagcca

SEQ ID NO: 302 - RNA, 13608 nt, Mus musculus
ggacauucagauuaaaaacuauauugacacauguagcuguuaaaucaaucaaagaaacaacacccuacauugagauucuaucauucagaacgcuaauauaaugaauuaaacaaaaauuacuggaguaauauagacuagugcagcuaccauggaaagcaauguggaaguucucccaaagauuaacaauacaacuaccguaugaucaagcuaaagcacuuccggguuuguaucagagugacucuaagacaacagagaucccugugcaucugcuuauuaucacacugcucacuacaaccaggauaugguauuagcuuaaugcccaucaguagaugacuggagaaagaaaacaugguaaauaaauauagucaaguauucagucacagcaaauuaugaaacuagguccuuggcagggaauuugauagaacuagagauuaucaugucaacagaaauaagauggggggggggguugcaggagagauggcucagugguuaagaagacuggucgcucuuacagaugaucuacauacauguagacaaacauacauagaauaaaaagaagccaggaucagacaaaacccuuucucuaauaugcagacuaaagaaggaagggaagaggggagcgaagaagggagagagugggaggaaauucauuggugggcacgcgacuaaagaagggggcaugcaaagguaacacgugagugcaauauguagaauaugaaaacgcaaucgugaaucccagugugcugaauaugaaacauucauuggaaaugucccaagugucugguguuuacaccacugcauuacuguuugauucacggggcuuguuccuauugauguagucuauuuacacccucucccguuuaugucugagcugucugcucugacacucucugccaguguucccuagcugugucuugagugcaagcuuggauuguuucauguuguccuuuauguuguuggcauuaaccaguaggugaucucaguugugccaugucuuuaugccggaaguucuacagaacacuuuccaagucucugugaaggagagagcuaauggccauuccagacugcacaagacacggccuuuagaaagggucccagaaaacauuagcugggcuccaaggagccagguaaaggcucuugguaacacagggacuaccuaaagacccacugucuucucacaccucugccucaggaccuucagguuccuguggauuccagucucuuccaucaggacccuggccucugaaaauguuuuaaaaauuaguuuaugugugugaguguuuggucuguguaaauaucucugcacuacacgugccagguacccacagagguuagaagaaaguauccaaucuacugagacagcaguuacagaaaguugcaaguagcuauguugacuugggaauggaaccuggguccucaggaagaccagccagugcucuuaaccacugagccaccucuccagguccccuguccgguuuguuuguuuuaucuuuacccacagcuucauagauaccaugugccuacuuaauucaucccuacuuucuugaaauguagauauccccuaacuguucuaccucagccucucugaugguaacugggacuauuugcuaaauacuccuauguacaggccacaguaguuuaugggaguagaaaugggacaugacccucaagagugugcacuagagguaacauccccuccacgucuuuuaauccuuagcacacugccuggaaacacuuaaaauccccuccauugguacagauuccuggguuuccccaggcagagggaggacaacauacccccaccaucccuuugugguucugacaauugugguugggguguaaguuagccucuaugcagaggucccccaggaggagggaugcugcccaagaggacacugggcaugugguauugacggagguaggcuguggguagcagcaaacguugggguuugaaauguugguuugccaugggaugagaacaaagcacccgcuuaggcucacaaggcagacaguggaaggguaggguagguauaguggaggaaacuagaaacacuggcuguacauggcugcuacagacugaccuagcaagacuuuacaggcaguccagcuuugccagcuggagaaagggcucagguggagaucaggaacaaggauguggcugaaagugugccccucuggaccucuaauggcaugcagagccagagccgggcaacagcaaggagggcauucuaggcagacaccuaaccuagaaccuucuuuccugccaccauggucuaaaccgagguaguaauuucugggagucacuucuaauguuauacagaucuuagcggugguuggagggcauuguggguacaguuggucuagaagcaacacccugggagaccacgaaggugucaacuuguaucaucaaaggaugaguuggugaugacaugacauacuugaaagcaacaauugaaagagauucugcuguugaagagggcuguacggaugucuucaggugugggcucccuggaggguggcccuggggccagagagagagcaaagcugaaugaaauacauaggauucuuggccaugcacccuccagcuaucuguuauauuuuaaguuggaaaauaccucucacucccagugcaggcuccgauguguaacacuuggccgucaaguuuauggugcuauuuugaaggcuaugaagccuuuaggagauagagccuggcugguaaaaauaggucccuaggggcuggccuuccagucauauuugccuguaguucugaacugcucucuacugucuuguaccgaaagaucucagcaagccccugaggccacugaccgagccuuuccugacaccauggccuaagacaacaaacuauuccuuguuucuuucuaucagauacuguuacaguagagaauaguaaccuuucucuucugcaggugucucugugguuguccucucugcccugugcugguuuggagggaugguuugaguagucuagagccucgggcagugccgugugggcacuaugcauguacacugucuaaggagaggugacccuaaguccuggacucauuugggguguauuaggggaugcucgacugucugugcugaggggagguuccuuggaaagaaggugaaugggacacucagugacaggagcuggcuaguggguagaggcuucaaguuauucaucuucccauucccuguaaccauguaugaagcugacugugacugagucugacgguggcuugugacaaaaagacauaccacagcacacugccaaaguuggaggccgcagaguaccagauagucccaaugauggcucugucaccagcuugucuuugagcaaccacaaggaauggcuccacgugacacagagaacuucccuuuuguuagccgagacaucugaccucacagcuugcugugcuggaguccaggcucagcauuucccaugaaucccuguaaugcacaccucuauugaacucuaguguuagaggccugggugccccagugauaagagacagagguguggucagagucacagagacuaaaguccaggugagggugacaaacauccuuuuuuaggguccugaaggucugauugaggagcugagaagaacaaggauccaccuucucccugccucccccugcugacccguccccaucugagccuucaggguucgguucccaccucuauuuaggucugucuauugggacaggcuaugaccaugauucugugacccguucucaucucuuccagcccuaccccuggcagcuggguaggugcaaaagacaggguagugacagacaggaagggaggucagaucugcagaguggagauuuaaugggacagucaccaugguuccuguugcaguuccaggcugaagucacagccuggggucucuccuagcagacaggcacagagagcaccaaugguacacaggucgccacaaggauaggccauucuucccuguaccucugggggcuuggacuaguacagagacaggccugcuugagaggucuagucucuuccucugucuccugcccccacacugauggaaugccuguguccuugccccucugucuucugucccuaaagcaaggcuuuccauccagcccaggggccagacacagggcucugcaggaaagcacauuuccaggaccgugcauucugggucucuggcacacguuaaggcacauugugguuguugcugugggaccgcuggggucacuguccccagggcagugucagcagaugcuggcuuccagggugaggcauggcugucaguguugaaacaggaggcauaguguguauaggccaucccuggggccugcagugcaagagagcagggacagggugggcccugguccacgagcaucaaugaauacaguuccuuuucccuaugccccuggccuggagccaaugggagggguuauggucccgggcagagcucguggccagagccaaggcgcagucauggcggcccggaccacaaaaggcacaaucguggugucugggaggucgagggucaguuaccaucaaggcuaggcagacacauugacgucccugagagagauggugcugcugggggccucguccccgagcagcagggcuggcgagucuggguucgugucugccucagcaccgcccagguccgugcugggcucuguacucggcuccgcacuggggccuagccccugggacaggaucugcuggaugguucugcgcaaguugggaugcagccggcccuggguuugguagaagaccucuagagcgaaggacuugagggcaccagugcagagguccucguacagugggaugguguacaugcgcgacaucuguggaaggcacugcgucacgguagcaggcucccugcguacccuccaccacccagaucucagaugugccccagaugcucaggauggcuuugccuggacucacaugcuacagugcccccaucagucuuacccuccccucuccaucuaggcugucucagaauuugggcuauaagggcugggcaaggaguggggaugcugucccacccuccagucaugcccgggcauguaguugcaccuggcuuuccaggaaacggcggacccugugaagaucaggauaguagucauugcggacaacgaucugcagccagcggaugcggaucucagcguucauggaguccagcagggaugaguagcacuuggacaggcucaucaccaccucugugggguggugggcaggucagggcugggcuggagccacaucccuuucccaggcuacccuguugaccgcggggacccacccugaggcaacggggauccaucuagcagccgguccaggaagagugcugucuggaagguccuccauuuggagaugucaauggcacuggcugaagcugccgccugcuccaggggcucugcaguccacagcuggaaaagggcuuccacaggccggguuaggcuggaccccugugacaggucuggcucagccaguggugggccuguggcauugagccagcgcucgaacuccagcccugcaggaagaccaggccuggggucccugccuagguuuggggagggcccaccugagcagccugccagggagacuccaagcccaaaggguaucccugggcaggugaucucuucuaggacccaggguccucaaagacuaugagcaguucccuagaaguuugugcuuuccccuuggagccacuggaaagggcuccucugaagggcacagggaggccagaaagcuuggguuggugaccaauggaucuccaccugcuacaugccuguccuguauauaucacugggcuggagaaggcucugcacuguccuguuccgugagguacacaggcccugaggacccccaccagccccacagagcacuuauacaccuucuaaaacuuagggucaccauuccuagacuuugaagcccucuagcaaacucuguuuuuccaaggcuagcuccuuuagugcuuccuuuagucuccaggcccucagauccccaggagaccucuacuaugcacaagcagggucagccaguucuagggcgaacugcuugcucauccuccucuaggaauuuugcauggcucuuuuagaaacccuucccuucuggcugcuuagcuuggccugcuuagcccaggggccaccuccuccaggaagccccugccccucucgcccugcuaugauccuuuagacuggagguacagauuccucuuuacucucgcagcauccugacccagaccccacacggugcagcggugcuuggcagccucaccugcccggcaguccacgcucugcuccuucaguucagggaagaagcucaggaaggaauccagcagguccugggccaccacacuggugaacuuguauuucuccacauaggccugugagaugaggggcaagaccuuagcauggaaggcuggggaggucuagcucuggcagagcaggguuggcaccauggggcaucuucuaaagacgugcaucccaguccaggugacccauaggcccugcugaaaggguaaggagaaggaggggacaguaccuccacaggccaugucccaaaucuggcucccagguccccuucuccuccgggaaggauaacucugccaguuggaagaaguuuuggacacgagguggugggcccgagauacuuacucggagaaagucgucaaagcgcuggggaccgccacagagcugggacagguaguacacgaagcaguagcccuucucauaggugaacagguucaucaggugacuaggauucacgccugaaggggaacaccuugucugggaugccgcuggacacgcaaguccugcauggcggggcuggggcgguagucuagaacugaggagcuugcaacaacgggcagggccacagucccugacaugaguaucgacauccuggguacacagauggaguuugcucuacuccauggaaaccaguucucagacccugugggacugugguaggaggaggcacccgagagguuuuccccgggcacuauggacagccaggcuggccuuggaaggaauucuggcauggugagguagagaagcccuggcaaggcagugaacagcaggaaaggagggccuggggaugccaugcauggguucccagggagauucuggaguggagaguaccugguucuagcuugaccugcaacuugcuaaccggacuaucuuccccaagaagccgcaucugccuaugcagggcauccaagcggaaggcugucucuaggcaggugaaggcagccccugaguggagucagaguaaaggcagaggucagggaggcuggaggcccuacagugggguugccacucucuacccaccacccaaccccugacacggcuaggugcugucaagcuggaggcuaggcagggcucugugccccuugcaauuggugccuaagagggcucaaggccucuaccccugccauagcugccccagacaauaccauaggucuccguggugaugcggcgcugugcauagguggccaggcccucacucagccacaucuccucccaaguagcguuggugacagcauugccgaaccagcugugggcuaccucauggaugacaucaaucaccaggaacucgucacucucaaggauggaggagaugaugaaggugaggcagggguucuccauggccacgauggggaaggagggcggcaggaagacgaugucauaucugugcccauaggugcaggguaaggaauggaagggcucugaccauggcucaccaaacccacacauguaugcuucaccugggauggcagcccagcccugcaguccccuuccucuccaggagacagaggacagggaacucaaagaagucccaaucuagcccuaugucuuucuuugggggaaagaauauagucagccaggaaaaagaguggacagacauaccugccccacagacagacauaccugccccacauguaugguccauauaaucgcucugcugcacucagccacuguuccacugcaccugauagcuugcugguggcugugggcaggaggcauggcucagcccacacacggcuccugucacaaggcagagaagguggacugaggcugaaaagccccgaccuuacuuaucccgugaaucucccucugccuugccuggcccugcucccuggauggucuccuucacacaacagguaggggaacuacuuaaggaacccaaggugaauucugauccuuuuguuaaugaaaugaaggaacugggaaggauaggagggcacagcugguugugugguagccccgggagugcugaccgacugcuaggcagggcacuggaugggucaguuaguuuaugucugaggacagugggugcagaggcacaguaggcaugugcauggucuguagccuucugggcccuuccugaggcucaggggcccagaacaguguagcaggaugcagaggggccuuaccugggcccaaugucugcuggcuugaggucuccggccacaagggcuacgagguaggcggguacugggugcuccauguggaagugguagaggccuuccucuuccacguacacgcucuggguugcacucaucagcaccuguaccccuaagggggccugcaaugggcuaggcuaaggauuggcacucuaccacacaaccaccucccaggaaagggagccacacuuuuagucagggacuccacaacucaggucagaggacccccuugucuguaacaggggaccuuauggucccaucagggagcccuccaucccccaggagugaccaccgcaaccaggucagcgaacuccauccauauccaggaggaaguccucagauucuuaucagauagucucacagguuggguuaaggaacccuguccccucgagaggaccacacacuagagccuuaaaucugcuccaguugaaggcugccaugcuuuggcuauaacucaagaacaucccccaaguuccugaaggucuagaggucuuggaaaccaaauaucaggcagcaucucuugcucagugcuguaccuuggucccuucaccuggccuccauaaagccugucuuugauucucugcaugacugucccacuaagcagcugggaucccagucuagacaggcaagaggaguacagaaguagguggccagagcccaucugcaggccugcuauaagcuccagccccggacaauggccaaaggaggcagaaacaaccccagccgugguccugaccuugacaacggcugaguaggugcacuugaccgccggcguaucgaagcacgggaagaaggagcgguugcacacagagugucccugggugaagacgaauggcuuggcauugccauaggucagcuccggguccagccaccagaucuguaggcaagaugaaacacaggcagauacugucaccuaauccagggcuuuagaugcagaaccuggggacaagguguuaggaagggcccuugcuguuuuguuacaggcccacaucuguuccugcaaccaucaccugcccaccuggcacacucacuccccuccccuugcaggaacugucaauccaguuugugugugucugaugccagccuuguuccagacaggaggucacauguuuggagcuggcccacccauaauaucgugcugccuggggaaauaggaaaaugcccaccaugguaugaacugaacuuccaaagggacacggagggauggucagaacaccugggguugaauacagggaacuaugggagcccggagcuuccuuacaucgguguagagggagucagcccuggugcuggccaaucugugggggcagaacagagacuagauaugcucugaugugacaggagugucaaggggagggucucugaggccagagccuagaaggaagggcugcagcaaagagcaauucccagugauuucucccugccaccacucccacccuccuucagccugcccucucagggccaaggucgcuggccuagccaaccucuuucccagccguagcuguugagacauucugaaucuucagaugaccaggucaggucccgcccucacagaggcgcuucugccacaaagcaaugucugcccccacacugcucucuacuagcacuauaggauugcugaaacaaagugacuuuuuuacuuugguuaucaagggcccauggauccuuuuaggugccauagauagaaaacaccugaauacuucucugaguggacaaaugugugucuccaagacugacugucaucaugcugauaccuccagaccccagaggaggggugguaguguguggugggguugcuugccccccagaccccagaccuugugugugugggagcuauucauccaauagaucccagacaggaugccugcuuucagaccccaaagcugugugggaaugccuguccccacagaccccagaccuggggcaggaguggggaggacuaugacacagaaccuaggaucuggggagcugucugcauaggcccuagacaugccuucucccaagacucaagacuggggaauaauagcugcacgugguggcgcacgccuuuaaucccagcacucaggaggcaaaggcaggcagauuucugaguucgaggccagccuggucuacagagugaguuccaggacagccagggcuacacagagaaacccugucuugaaaaaaaaaaaaaagaaagacuggggaguaaugccuugccucacagaccugggggugugccuacuccacagagcccagaucugggggagauucccaccccaacagauccagagucugauaccuuccccacagacuccacacccaggaggcugccugucacugggucacaaacuugggugggcugcucgccauggagagcuggucaggugucugcuagcauuccuggagcucuucccagcacugucugcaccaacagcaaaccugcugaugugucuuuucucuucuuuucuuuucucuucuuuucuuuucuuuucuuuucuuuucuuuucuuuucuuuucuuuucuuuucuuuucuuuucuuuuuuuuggagagcuaguuaaaugcagccuccagaggucugggacccagggaccugaauggaggaguguuccugcaguagauccuguugccaguggguuccugguccacucagggaggacaggcuuccaaaugcccuucagucucucccuucucauaccaccuauacuucagcgaugguguuuccaucuccccuuccacugaacccucaggcgccaccuacuuuuuacccuauaccuccaccaccaugccuuggcuccagcaggcaaggugccuuuccagacaccaauaauacuacccuaaaggugagagucgccugccccagagcauggcagcugaugggcugguggauaagcaauggguuaacugacuucagauucuguagagcaagaaaaaaaaacuguucuuguuggggugggaaugaaggccuggggugcagaggagcccuagacucugaagcaccuccaaacugcggccccuagagucggauccacugucaggggccugggaaaccuagauggcucccucugcauccucacuaggcacagggcagacggggaucugagugcugagcuucucaaugcucaugugcaacaguaggugccugagguuagaggccaaucugcuuccaugggucagcauuguuauguuacccuggagccacccagacucugaggacccugcagcuuucccuguccagagcaaccacagcccccauacaucagcccacgcccccccaccccccccaucuagugcaacaaugaaagguccauucccaucccucugcuguuaauggcagaacaaacacacacagcacacauccacaaguggcagccaggaagugccucccucaucagucuucaccuggcaugcuaagcaguaggccuaacaucugcagaggcuucacacuaccacagccuaccacagccagcagagggcugagcccuggugacuaguuacaggcgcaggggcagggacucugggaagagguggcaggccccagucaagacuccugagaagagugcaggaagcccacagaugugaaucccaucuggucuuuuucugcccagaugucaacuugucccuuuguggcuccuggccuguuccuuugggcuccccaggugggggcagaugaaccuuccaagggcccugcagagcugcugccugugcucuguguauccaugguagaugucacaugagcacucucuccuaccuggggagcuggagggaggaaccgugcuucaggagucaaagguccuguuccauucugcaaccccauuggcccugugcuaccccaacacuagcuuuacauccuuugcuuuuuccaucgggaccugugggauggugggugcucugugcggaaagccugagcagagcccugugugucuauuaggagguggagcacaccugccccagcaugucacaauacaguguagggagcccaaagccacgccucacagcucacaaggccuugucugucacccacugucccucguuccaccuccagagaacagacccggguguccucaagcccugugaaggugcaggucacaggguggcccuucuguaucaggcgcucucagaacaccccucaaugcugggcucuuacagcugacuuagcagagccccaccagaagcugcucuuguacccagauacugguacaagacgggaaguugucguucuccccuuccccugagaaacacacuguugaguaucuccacuguccaccgggccuggaccuggggcucuacucgaagaacuuguaggcaauaugccaccuagggcagacagacucuugguccaggcugccccucgcccucugcaggugucccaggggcagggugcagcuggcccagcagugaaaugaacgaggggugccuucaaaaccccgcugaccgcccacaauccagaagcccacccgggcgggacucacggccggggcgucggucgagguguagcguaggaugaccuggaagggcuggugcgccugcaccucgggaggcagugugacggucagagaggagccauagucggugaacggguccagccugaaggccagcgggcagcuggcagacuccgcuccaggcgcaucggcgaagccgggcagcgggggccccgaccccggggcagggaaggcgaaggugcacggcgacucggagacggcggaggcgcggcgaaacgagaccgaguguaggcgcaaggccgggugcgcgucgagcacgagcgcgcggggcgcgggccgcagcgcgcacaguuccagcaccaggcagccggccagcucacgcgccucgggccgcagcuccaggcccagcugcagguggcggaggcggaagagcugcgcgcuggaggccgaggccacguccagggcgggcggcggcuccggcggcgggcgggcgggcgcggcuucggcgccgggcgccuugcggcagcagcacugcgccgccaugaccaccggcgcuaggugaaauccaugggcggcggccacuguaggccgcggucagugggcgaggggcccgggcggcgguggcgguggcgguggcgguggugguggcggcggcggcggcggcgguggcggccgggcgcgggcacaacaggaagucgcgccgggagccgcccggcccguccccgcgccg

SEQ ID NO: 303 - RNA, 10184 nt, Mus musculus
cagggacucaucaaccaggccuggccucugaguucaacgcagagcuagcugggaaauguuccggauguuggccaaggccagugugacgcugggcuccagagcggcagguuggguccggaccaugggcucguaucagcugcuggugccaccgccagaggcccugagcaagccccugucaguuccuacgaggcuccuguuggguccggggcccuccaaccuggcuccccgugugcuggcggcgggaagucugagaaugauuggccacaugcaaaaagagaugcuucagguaggccuugguggcaggagccuccaucuagggguggugaucacucgguagcaggcagaucugaccugugugcccacugucuagaucauggaggagaucaagcaaggcauccaguauguguuccagaccaggaacccccucacacugguugucagcgguucagggcacugcgccauggagacugcccuguucaaccuccuagagccuggggacuccuuucuaaccggaaccaauggcaucuggggaaugcgggcugcagagauugcugaucgcauugguaagggagaguggucugugaccuccuguuaucccuccagaggccuccugggggaauccugaagguaucucaaccagaucagugccuguuccaucugacuaggcacuccuuccugugacccuaaugccuccaccaccccugaauaggaugcugccucuuccagggaggcauccaggcauucucccagcccuagcagaccggccuuguccaguuaggacaagauuguuucugaaauguauggaagagguguuacggggaacccccuggucugagccccagcagcucuuaagaucuucaggaagacuggaauuucggaggcugauucucuccccaaaucucagagccuugguugucuguaaaaugcagaccuagcaacaguuuucccuccagagccugagauggaagaggguaggcguacaccuagacuucugccagacucuggcauuugcaaauggcccccaugguucacaggugcauggucacaugguuggugggcaucagucauccaggcccaaagccacucuuugcccuucacugagaccugggugguucagguuuguccccugcuaggacucuaguggugagcagguucaugugacaugggacucagagacaagaaucaggacaggugcuugggucccgguguuccuagauccacaggucaaagccugcuucuuccucucacccuucauccagcuguccaucaggugacaugggauaccugugaauggcaccagggguagguaggaaaccauaccgccugcagugcucaaaguuaccucacauagauaauauuugugugauaaggcugccaagagccuccucagccugaggagguacacacacacacacacacacacacacacacacacacacacauacaccacccccaccacugaaaagcucugggcucaaagcccuggaggccaggacagugcuugcaucugugggaaaagcaagccucacagagcaugcuccacuucaccugugguaaagccaugugagagccagaaugagugcggucccccacacuauuucuuguguauguguguguguguguguguguguguguguguguuaaauuuuuuuauuuguuauuuuauucauuuacauuucaaauguuguugcccuuccugguucccccuccacaaccccccauuccaucccuccuccccuuugccucuaugagggugcuccgccucccacuacccacuccugccuugccaauuacacuggggcaucaagccuacacaggaccaagggccucuccucccauugaugccagauaaggccaucuucggcuacauauauggcuggagccauggguccucccuguguacucuuuaguuggugguuuagucccugggagcucugguugauucgguuaguugauauuguucuuccuaugggguugcaguccccuucagcuccuucgguccuuccccucccccacacuaugucuaacucaccacccauucugucccugucaucaggagcccgugugcaccagaugaucaagaagccuggagaacauuauacacugcaggagguggaggagguacugagacaccggaaucaucguuggugggguuggcuggaauucugaggccuauggcuugacuucucagugucuaagacuggccaaaggaggggcuccuauacccaggaucaguuuggaagucuuccuccgucugaaaacaaaacggagucugggaugcaguccugugggcagggccagccaggcuguguggagucagggaggcaugaccuguuacugaacuccaggguggcagccccucaauaugggucaggccagucccaaccuacagacugcaaggcaggcaagaugcuggucacucuuuucuucuuagccaugcuuuccccucuguucccuccaucaucgugcuuugacagaaaaggggugaggcacaucacgugccuauuucuaaguuggccuauccaauuauggagggagcuagauauauguggaugaucuuggcccugcccccaacaaaccgaugucccacuguaaggagcuggcugauccagacagaggucuccaucaguccugcucagagcugucaccucugucccucagggccuggcccaacacaaaccgguauugcuguuccugguccacggggagucauccacuggcguggugcagccccuggaugguuuuggggagcucugccauagguaaggcuggccugguauggcaguaccagggcagagcaaagcccaaagccuggcuggacgaugcugccagggagcugcagggcuaucaaugacaaggugucccaacugccacugucacaugguauggguggguuugcucauaccagaaugaauaugugucuuaucaucauuuuaucugcugaggacccagaggcugggauaggaccaaguacccuguagccagauaccacuacaaugguacugacccacugggacaucccguggcuggcaaaggcuggugcugcccagccugugcaucucaaagccugcucccaccucaaccagaguucccuagcccugcagcugccccuugccuauacuucuuccccaaucccauacagggguuuacaggagaacuguuccaggacacgguagccccucuguaagacagcagugcugucuaucaagcugaccacgggccagaagaggaucuugucagggccauagaggguuagcauggcaggaccaccauggcccucagggauguggagcccauaugggcaggacccccacugaaagagccccacauagaguccugcucauguguggagcuuaauuagauagggucaagccuugccugugacugugcuuacaugguucuaugaggaaagcugggcggaaggagaugaacauacucgauguugcuggagcuggacucuggccucuaaaggcugugugucucuggcagguggccaaguguguagcuauugguagaggcaaaaagaaagcccagaccuuugcgcugccagguugcugggacccacgcuagcucuugucacucagaaccucagaacucuggcuaccuaggcugaccuucauuuaucucugagagguccagcaacagagccaucugggccaugacccgcccccucaggcggccaugacccuccccacccccaacccccuguauagauaccugcccagugcuacagcugcuucuggccucaaggagcugcuuucagagacagaagcccacaugagaagugaaagggacccuucccugcuucccugcuuucaugcuucccugcuuccaugcuucccugauucccugauucccugauucccugauucccugauccccugauccccugauccccugauucccugauuccccauugcccuuccaaagacuuucaagcccuuccccccacccccaccagacgcccaguuuaggcugaaaucugaacucccacaaucccuccugcuucacugugcugccuccaugcucaugacucccccagguaccagugccuacuccugguggacucaguggcaucccugggcgggguuccuaucuacauggaccaacaagguaagagcaugccucagaccccccccccccccccgacccccguauuccagaucacacacacuggcaaacccugaggucacagaagacucaguaugacaguucuuguagaaaccaccgacggaccauagcuggguuugugcccugucucuccaggucaaggagguuauguaguuugcaguuugcuagccagaaaguccaaacagcauggcagggucucuggcacagguccuggaugcauccccuguggaggauagcaacacuguaggaguaaagcaagaggaagaaaucacagggugaggagccagagaccaggaagggaaaggcauggucuuuccuaacagcccuuuucugagaacuaggcagggucaauuccuggggauagucagugacccaauaacaucccgauaggcccugccucuuagaggucccaacccucccauuccacacuaaggaccaacuuuucaguacaucaucccuuggggacacaucacucacauaccguauuucugggacagcagacucugaagugagucacccgccugaguuucugccaggccaugagagagggugggagggggguucaccaggaggcagcugcuacucucgggugggugugcggauaggaggcucuucagcuguaguaggagcagacaggaugaggaagggcugggcuugaguaucagaugcaucguguccaguccugcauggugucagggacaucccgcagacaccaugcuguacugccuaugcuuggcuguccacagaaauuagaaaggcuaagaggcuccagccugaggcuguaaguaaaacaaacuggggcugauauucgaggccaggucucuccggcacccacaucucagcgaaaucuuggcccaccaauagcagagcaugguacagacuggacaaacacaccuauuuguugaacucuuccgugggaucucagacaaccccuucuccaucccuacccuaggcauugacaucauguacucuagcucucagaagguccugaaugccccaccagggaucucccucaucuccuucaacgacaaggccaagugagugguccacgccuugcuuugggauguggauucugauaggggaaaccacuggcucuuagagggagggagggagggagggagggaaaggcuccauguucagaccucucccuguucacccugcugggauguccuaaaagccaagauaugcuccgaagauguuucacagggcaaaggggaggacacauggcagggccugggcugugggcaggaccagaggcuagcauucuggagguucuggaggucacgcuaaggggugauccaaugugucuggaugcucagagcccaguacccacccuucaaccucugcucagcuucugggaguuggcauaggaccugccagagaagcacaagccaccccugacucuguaguccuaccaucaucucaggauccugguaucuagauccugggccuagauaauggggguuggaggaagacacaaagucaugagagagagaccuuaucaggcaaugaccgucagccgcaaccaaccucugagucccgacccaagugagucgguuuugguggucaggaguucauccuggcugccaugucagacacuagcagugucacagggaaagucggggcugagagcuguauaagaagagaggaagguuaccaggggucgggggaaggguucgggagccccaccugggaaagcgguuucccugauaaaagagacaggacagaccugugguuggaaguggaagaaacagacagagugguggaguacugguucuagguacccaugggacagucacagucaugcagaccucagaggguugggcacucugaggaacucaugucccuccugggcucacaagaucccauguaccccgcaucugugacacagcagagccccaagccaaagacagauagguacucacacuggcuucucuuguccagauacaaggucuacucccggaagacaaagccagucuccuucuacacagacaucacauacuuggccaaauuguggggaugugagggcgagaccagagugugaguauccgguaggcccaggggaugcccaccccacacccagccucaaagcagccacacaggucaaguucugcacuccaggucuuugugccuuugagccccuauguucuaauugaggguucuuaugcuagccguuaaauugaggccccacuugcuaccuggcccagagacucagggcuaauaaacaggccccacuaccauuuccauaauccuauccucccucgguuuuuuugcaccugacccuaucuuuccauuccaggccucaguuuaccucucuuggaagguaaacuagagguuccauaggccaccucagucaugauccugagaggucuuguacaacacccaagacaggguaucagagugauguccuggacugcugggaagaaagcgcccagugcuggcuucacaaggacauggaguccuggugggaagauggcaaucaagcacgugcuucuccucuuuccuuccccuacauggugccaagcccugggccggcuuucccucccuggcauucuugacucugugacucugaagcaggaagugucccugggaaaugguuggcuccugccacagagcuggagccgucagggugggacagucagcuccuggcccagucccuaccaugacguugaaccaggcucuuuuugucguuccccagaauucaucauaccacaccugucaccagcuuauacugccugagggagagccuggcacucauugcagagcagguaauaguagggacuucacccuaaugggaagaagaaaaagaaguggagagggaagggaaggaagccccucgggccggagugcaccuccgacugggcaccugugggaugcuuccuuucccgugacucccucagauugcuccagagaaaggagacaagaggauuccuaagauagaggugcaucuguucgccaguagacccaggcuuuggaguaggagaagcuaugguguagccgggaauauggagguccucccaaggggugggggucagggaaggacuggcuucuucaaagaggaaucugggaagacagagcccagggcagacagaggcacacucuggucugacccuucggugacucagcaggucacaguggagggucgaaagggagagguuccucaggauuagguggggguucugagagagguagguauggugagaggggucucagagauggggcacauacagccaagcaguuggcagaucaagggcugucuuagucuguuugugccacaggcagaguaccuuauaguuacacuuauguggcugacaguuucuagaaacugggaaaucuaaauuuaaggucagggucuauacuuacuccauuauaacaagucugaagauuucacaagggccagauggagcaaggagaaaaaaauaauaaaaaagaaaagaaagaaaaagcuaauccucauguggcucaagcuaaccucaaacuuaguuccaggcuagcauugaauuccuaauuauccugcauccaccucccauguucuggcuuuauaagcaugcaccaccaugcucagcuaccuuggguuucauuauaaaugucaccaacagacacaugccaacaccaccuguagcuccuguauugcuagccaagauaguuuccacacaagcccuugggacacuccuggccacugcaguucucaucagagaagggguuggcccucugcaggcaugugcagguuccuagccaacugggucagugguuguguccagugcaaaaaccacucucaggaaauggaggugauguguggcuacgggcucaguugguuacauaggucacaggacagaaaaaaaaaauaaccaaagccuggccaccuucuucugaguccugaugucccucaaagaccauugccagccacaggggucaggaagaguccuggacucugacuaacauguucaaaaucuuagaaccacucaugaagucacugcaugagaacuggguuaaaaacgaagugacucaugaucuagacggucaccuacacccuggcuaggacucugaucuggggauacaucccuuggagcaaaaacuaggggaugagcuggauaggaaaaaauaagaagucauggguagccaaagaugaugguaccuguaguccuagcccucaggauguugaugcagaaucucagcuacagacugagacccuaaaauggaagaagggagaguauugggaaagagguaagcucagucuacuaagaagauggugagaucuaguggccagugggaagcagucaauggugggcaaaauaugaccuaggagugauugugggggccagaguaggaaggacuguucuuagagaucauauaucacaccuccuuagguccagggucaaaaugaaugggaccugacucugaucacaccaaacccacauggccaguaaucccagcuuccuugaguggcaggaauguguccuuugaaauguguccugccugucuccccagggccuacuggguacccaucagaggcuacgucccacuucucucccucccagacccagaagauauccucuuuccucaagcuagcccagcauagacucuugucuccucagagccugggguuccagaagaagucacccaguaucacuaagcaauagaggggcuggcacaugccugcugucauggccacauuucccccacagggccuggagaauugcuggcggcgucacagggaggcuacagcacaucugcacaaacaccugcaggagaugggcuuaaaguucuuugugaaggauccggugaggagcucgugggaggcaggcgucaguugcuugaccuaggcacugauccaauggggagggggaggcuguaaucuauuggugagagcaagcaccauguuucagagggaugugagccucccgaagcugggggcaaccucuucaggcacuugacaaucuccagaugccuccuauucucugccaagggaguccuguggcagucaaaagcuggcuggcaagcuguuucccucuggcccuuucucuagacucuaaaaagccagcacaggucaagcagccugaguaccaccauagaggacacgagugucucuggaggguacgcacggccccaguccauauggcuaagccuggcgcuucuugcaggaaauccggcuacccacaaucaccaccgugacugugccugccggcuacaacuggagggacaucgucagcuaugugcuggaccacuucagcauugaaaucucugggggucuugggcccacugaggagagggugaggacgcuucugggaagccagggcuuuauaaccagaggcacuaggcaccccucccccuuaucaaguccugcugcacagcccaucuguguugggucacugcagggcccaaagggcaugagcaccucaaauagaauauccucagcccucuccaccacagcugggaggucacacaucagcuuuaccagguccacucugagcucugagugacccucccuggucguaccccugaacucuauguuuuagguauaguggggagggcuggcucugaccccuguguggcauccaugaggcaacuucucuucugcauaccagauggaugcugaucccaugugauaaaauuacccuacccuaaccagcuccuaucagacaaagaggcugccaacagcggcugacaucugcauguuccaugccuaccaggugcuacggauuggccuccugggcuacaacgccaccacugagaauguggaccguguggccgaggcccugagggaggcccugcagcauuguccuaagaacaaguugugagcauccucucaccagacuaugcccuccuggaggggcugggaauauagcaagaacgaaaagacugugcaaggccuagagccagcaaagaugcugauguagccaggccaugccggaaggagcagggugaagcuuccccucucccuacaaauggaaccuuguggaaacaggaugcuaaacaccuucugauggagcuguugccugcaggccacuggucuuugggaauuuucaauaaagugcuugcgaggaaucuccuau

SEQ ID NO: 304 - RNA, 6701 nt, Mus musculus
aaggagggucagucacaucaaaaacucacuacuguaucuuagauacccacuagagaucuggagaccgaguaagcuacaguguuaacagugaacagcaagaucaagcagcaccucugggaacguagaugggaucuucguacuauaccucaggacucucacccccaagccgaugcugccacauucccaucuccaguuggagccagccugcuguguggcgcugucgggcaaucauuccaacuggaguggagaaagacuugccugugcugaggaauuaguauacaucauuccaaacaugcugucucugcuuucuuacacagaauaauuaaaucccucaaaacagucagcguccacuugggaaaugucauaguggaaucagcaaacagacaagguggagauuuauuuuuguguccaacugaaguaauuaugaguuguugggcucaccauuugcuaaucaaaacugaagaugaguagauuaccuaauugagcucacaguuaggauucuauuccguucugaugaguccaaggccaaacacccuacauucagggaggagagugucgaucacaaaaagaccacaaaaugggaagaguaagcagcaaagaauggaucauuguucucaaacagcuuuguccacagccaagaacaggcagaaggcauucguuccccucuacugccuaugggaugugggguagagaagauggcuugcuacguccugcuuucuguggagaguccaacaggcaaggacacgcccuugccaggaaugagcuugccucacauaccugccauagugagaacuguguguguggaggguagggguggggggaggaaucuuggaaugauugcuuuucuuuguaaacacccuccucuuugcagucagguuccagguaagucaagagccgccucaccuuggugcugauuccucacaaaaugcaccucagauccagcaguaucucugcuuuagacagaaaugauacaucagguccauuuacaacacacauuagcuguagucacaguacuuuugugggccaggucuuugagcaguuucucagcuuuggcauugcuuugugggccuaauuauuccuuaugcggugcaauguacaauauuuuacagcaucccuggcucugaccacaagauccugaggccaugacacacacacacacacacacacacacacacacacacaaauccccaaagauugucagaugucuggaggauuaaggucauccucacguaagcacuggauucagucuaaacacaaggcccacauuggguuucgugugacuguuaaaugucaccaaaugggggaaaaauacuaccaagcacuccugacuuugauccuauaaccaaaaagcuuucugcaucacccugugcaguuuccugaggaagaggcacagacaacuuuccaagaggccucaguucucugacccucuaagccugagcuccaccaaaucaggccucuccuccagcucaccucauccuagucccaguacaucacauggcuccacugcacacacuccacacugcccagugcuccccagugcuggucucugagcagcucacucuuagcacagucuacagagccagaaagauaggaggccuugaaguggcaaccagccaggaaccaacaugaaggccaacuugcccaagcaggaagggucagcaacugacagagaagcauuuugcuagucugacaaccgugugacuaaaggacauguuacuaacguaaccaacugccucucacucugcuguacacucaacacgucagaaggcugggaaauggugucagauuuagaagcugccuauugugugggaaaccugcuacuuguuuucauuaaauaaagugcuaugacauacuaacccucauguuucaauuucaugacuucaucuuuacuacuaccuggacauacaaaguacuccugagccgaaaggcaccucucucuccacaugguuuuggaacuagcacaacuuauuuuaacagagaaaaagacuccaaccuggaaggguugcacccccuggauuuugacagccgaguccuuuauuuaggauggaguagggccucccaaagaacccacaacaaagcaccccucauuugguuugguuuaucuaccuguaucuccaguggaucauuacagguugguuuuuucccccaucaaaauaccaguguugggaucaaaagugcuugagaagauccaggugaagguccccagcacuucgagaauaugagaaugaccucugacaccccagugcugugucacaguagcuccuccucuuccuccucuuccucuuccuccucagaugcauggcucucagacuccuccuccuccucuugauccaagaguuuuuuaaaaacuugaaacuccucgacagaggaacaggcuguccuggccaaaaacucagcuucagaaacucugagaauguuccucagugagggauuagggaucugugucugccccuucuuaucaggggucugguaccguccaaggcgcuccagguaaaugugucucugcuugaucuugguuauugaauacuguaagaaauucguccugacuaugucuagaugugugagucccauccugaaauaugcauacugaaagauacaaacauguucaggaauccauguagagaaaccugaagccugucauuccaacucaaaacaaacuuuaguccaaagucauuaguugccuaauuagaaaugguagaauagccacuguaguauaauaccaacacuuuuaugaaaucucaaguuuucaaagcauuuccaaauucaagcugagaaaaaugcaucagaaaacaaaggggcauacagggauauacuuuucuuuaaauagggcaacaaaaaucaugaguguaggaaaaaucagacccaaagaaauccuaagauaccuaggaaccuuuaaacacaugugugagcaugcagcuuguuuuaucugaguaugucccagcagugcuucagagcucagaggccaggcuagcuggcccacaagccuccaaggacgcccugacucuaccucccaucuccccacaggggugcuggggcacugggcauccagcuuagguggguucuggggaucuggacucagguccucauaccagcuuuguuugcuuguuugguugguuuuuagagacauggucucuacauagccuuugcuguccuggaacucacuguguagaccaugcuggccucaaacucagagauccgccugccucugccucuggagugcuaagauuaaaggagugcccgcacugccaucacagcuaugcacaagugcuuaugaccuaucugucacuaaacuuuuagggcaacugucacaauuucuaaaucuccuauacaaaaagaugccccaaggguuguaaaguuuaccuacuuggaccuggaauggggcagagcuaaacaacagguuugcuuuggagaggagaaaacugagguguuuuacucagaggcuucagacccuauucagcuuuaaaaaccugaacacucugccaucaucggccuagucacuuacucucaccuggaauuuguauucuagcucguugggguccuccugcaaaacaguggggcaucugugcagaacgucugugaugugcugugccgugaacaagcacuucucccugaggaccuucacaacucggucaaugucccgcugaugcauggugaaaaccucagggcaaacggacagcacccgcuucaguuucccuguagaguguuaagcaaagcauguaacuuuggcauguucccgaacgccaagggcuaaacaacauuuaggggcugguagaugagucaguggguaaaggcaccugccagcaaaccugaaacuugaguucaauccccaagacccacauuguggcagcagacaaucaacucuagaaguugucuuguggcacccacaugggggcacagcaggauccucucccuccacaggacugcccauucagagaucuacuuuccaugaagcaccacgcaaaggacucuucacagacccaacaacccucccuaugucccugccuuuuucuagucuucuaucugaaggcggcaacuucauacucuaggucuccucuugcuugccuagcauagaaagcuucccggggauucacuggggaauguuagaggagagugguuuccugcacaguggggcucaggcugcugcuucucucuguauaaucuagacauuguauagagacuaacaaucucuagacuugagagucugagcucaaugaagaggccuuuaggaacaaugguaggaacaagaauauccagaacacacaauuauaaguagucugagcgugaccauguguuauauccaacuguauuauuguuuguuuuguagggucuccuuggaaggccuggaaccugcagagcuccauccuccugacuauagaguucaauuaaaagaaugcacuaccacacccagccuccccguguuuuacugaguuacauuaguaacuguauucagacaaaugauauaagcagggcuucauaagugaagcaaauggucuucugaugaauaguugugccgauuuaaaaacuggaaacuuaaaagccacuuaagacugucaaguaacuuuccuaacagccuagcuucccugugaagaggcguuuccaaagaguaagcuuuauuuucuccucucaggcugugcuucacacacugacugagcuugggcuuagaucauguuacaagagacaacgugucaaggggaacacaguuaucuuuuugcuuaucuucuagaggaggcaugccgagacaccaaacacagugggcucuaagccuccccacuuugggggugaaaucuuaccaggaacagucaguaaugaaauaaaagcagucaaauggguagaguucacuggagagccccaccucccuucuccagaagggugacagcuguuggaagguggagggcacucuaacagccuuccaggaaccgggcaccaucagcucugaaagcugugugugggauguuuuugcggaggucacacauuugcauacacauacaucacuaccauagagcaacacuaacccaccaaaaccagacuccauguccccauugaucuggagcuagagaucucaaugaacacacaggaggcucacuuuggccuugguucucucuucuugggcuccucuaucccacaucccccuuacaacggcaucugcagagagcccacugcacaucuucuugaagacacugaccucuccucagcaaacuuuccuaccucacuuccucugaguaagguguguuuagcccacagcacacaugcaucccaggguauugaugaaugcagccuagcucauuuguaggugacaauuccaugccuuacuaucaaaaggcuggacaucccugcuaggguaagcuauuuucucccuaacugacuccucucccucuauaaagucugcugcaucuuauaccuucuccaaggccaagcuuccgaagguaacuggaacgccucuucaucugcaugcuagacaguuucagcaacuggggauuuuucuucaaggcauuaaauacaggcucuggguucaaccccaagaguaggaguucugaaacuauacccagcaacuguugaggauggacacuuggcuguauacuaaacaagcugugaaugugggcuucagcaaaacccauguccuggagggaacggaugaccuuuucaggcuccaaggacucaggauccacacaaggcuucuguuccucaugaagacacugaacaagucguguccuguuuucugguuccugcauguacuuuugggguguaaugcuggaaaacucuugaaagcuuccucuaccgggcacuguagucaguuugcaagacaaagaagggcucaucuguuucuguucucugagaugaggggucugccuaaccaaacaggcccaggagagggccaguagacgaugccacucaggaaccuguaaggcagagcaaaaacagaaucagucccaccucagaauaaugaccaccacaagauuacugagccaguaaccuugaaccucagcuugacccuuggcccacaaaagcuaacaguuuuuguaaacaaucuguaaaaucuucucugggucuaaaaagucuccaaagaauaaaaguagcaugcaaacgaccgcacuuacugaagauauugaagcauaagcaauaucuacauacugaagauacagggcacgagcaauaguauuugguugaaaauucugaaccucagacuagccaccagacagguacacuaccuaauuucauuccaacaaaggauaguuuuguuuuguuuuucaaggaucccuuccauuaaaagaagaauauuugggggaaggaaucugucgauuuguacacaguagccccagguguugggacuagcacauaacaaauuaagcacagagcauccggugcccgccagaauggucucaaacaccccgcucuugccgcugguggugguccaggccucccuagccauuaggcagcacacagccgaaacuccggagaagccagaagcuauucugagggccacacugucugugcacacgccacccgggagcgcuacugccacaaggugcccagaccggaacaccaagaaccagcgucagcgccuccugaacgucccgccaacagccgcugugagcccgggaccuagggcaaccucaccugccuucccagcgaagccauggagaccaagcgaagaacaacugugagaccggaagaggcgguccuuccuggcucacaacguccgg

SEQ ID NO: 305 - RNA, 6701 nt, Mus musculus
ccggacguugugagccaggaaggaccgccucuuccggucucacaguuguucuucgcuuggucuccauggcuucgcugggaaggcaggugagguugcccuaggucccgggcucacagcggcuguuggcgggacguucaggaggcgcugacgcugguucuugguguuccggucugggcaccuuguggcaguagcgcucccggguggcgugugcacagacaguguggcccucagaauagcuucuggcuucuccggaguuucggcugugugcugccuaauggcuagggaggccuggaccaccaccagcggcaagagcgggguguuugagaccauucuggcgggcaccggaugcucugugcuuaauuuguuaugugcuagucccaacaccuggggcuacuguguacaaaucgacagauuccuucccccaaauauucuucuuuuaauggaagggauccuugaaaaacaaaacaaaacuauccuuuguuggaaugaaauuagguaguguaccugucugguggcuagucugagguucagaauuuucaaccaaauacuauugcucgugcccuguaucuucaguauguagauauugcuuaugcuucaauaucuucaguaagugcggucguuugcaugcuacuuuuauucuuuggagacuuuuuagacccagagaagauuuuacagauuguuuacaaaaacuguuagcuuuugugggccaagggucaagcugagguucaagguuacuggcucaguaaucuugugguggucauuauucugaggugggacugauucuguuuuugcucugccuuacagguuccugaguggcaucgucuacuggcccucuccugggccuguuugguuaggcagaccccucaucucagagaacagaaacagaugagcccuucuuugucuugcaaacugacuacagugcccgguagaggaagcuuucaagaguuuuccagcauuacaccccaaaaguacaugcaggaaccagaaaacaggacacgacuuguucagugucuucaugaggaacagaagccuuguguggauccugaguccuuggagccugaaaaggucauccguucccuccaggacauggguuuugcugaagcccacauucacagcuuguuuaguauacagccaaguguccauccucaacaguugcuggguauaguuucagaacuccuacucuugggguugaacccagagccuguauuuaaugccuugaagaaaaauccccaguugcugaaacugucuagcaugcagaugaagaggcguuccaguuaccuucggaagcuuggccuuggagaagguauaagaugcagcagacuuuauagagggagaggagucaguuagggagaaaauagcuuacccuagcagggauguccagccuuuugauaguaaggcauggaauugucaccuacaaaugagcuaggcugcauucaucaauacccugggaugcaugugugcugugggcuaaacacaccuuacucagaggaagugagguaggaaaguuugcugaggagaggucagugucuucaagaagaugugcagugggcucucugcagaugccguuguaagggggaugugggauagaggagcccaagaagagagaaccaaggccaaagugagccuccuguguguucauugagaucucuagcuccagaucaauggggacauggagucugguuuugguggguuaguguugcucuaugguagugauguauguguaugcaaaugugugaccuccgcaaaaacaucccacacacagcuuucagagcugauggugcccgguuccuggaaggcuguuagagugcccuccaccuuccaacagcugucacccuucuggagaagggagguggggcucuccagugaacucuacccauuugacugcuuuuauuucauuacugacuguuccugguaagauuucacccccaaaguggggaggcuuagagcccacuguguuuggugucucggcaugccuccucuagaagauaagcaaaaagauaacuguguuccccuugacacguugucucuuguaacaugaucuaagcccaagcucagucagugugugaagcacagccugagaggagaaaauaaagcuuacucuuuggaaacgccucuucacagggaagcuaggcuguuaggaaaguuacuugacagucuuaaguggcuuuuaaguuuccaguuuuuaaaucggcacaacuauucaucagaagaccauuugcuucacuuaugaagcccugcuuauaucauuugucugaauacaguuacuaauguaacucaguaaaacacggggaggcugggugugguagugcauucuuuuaauugaacucuauagucaggaggauggagcucugcagguuccaggccuuccaaggagacccuacaaaacaaacaauaauacaguuggauauaacacauggucacgcucagacuacuuauaauuguguguucuggauauucuuguuccuaccauuguuccuaaaggccucuucauugagcucagacucucaagucuagagauuguuagucucuauacaaugucuagauuauacagagagaagcagcagccugagccccacugugcaggaaaccacucuccucuaacauuccccagugaauccccgggaagcuuucuaugcuaggcaagcaagaggagaccuagaguaugaaguugccgccuucagauagaagacuagaaaaaggcagggacauagggaggguuguugggucugugaagaguccuuugcguggugcuucauggaaaguagaucucugaaugggcaguccuguggagggagaggauccugcugugcccccaugugggugccacaagacaacuucuagaguugauugucugcugccacaaugugggucuuggggauugaacucaaguuucagguuugcuggcaggugccuuuacccacugacucaucuaccagccccuaaauguuguuuagcccuuggcguucgggaacaugccaaaguuacaugcuuugcuuaacacucuacagggaaacugaagcgggugcuguccguuugcccugagguuuucaccaugcaucagcgggacauugaccgaguugugaagguccucagggagaagugcuuguucacggcacagcacaucacagacguucugcacagaugccccacuguuuugcaggaggaccccaacgagcuagaauacaaauuccaggugagaguaagugacuaggccgaugauggcagaguguucagguuuuuaaagcugaauagggucugaagccucugaguaaaacaccucaguuuucuccucuccaaagcaaaccuguuguuuagcucugccccauuccagguccaaguagguaaacuuuacaacccuuggggcaucuuuuuguauaggagauuuagaaauugugacaguugcccuaaaaguuuagugacagauaggucauaagcacuugugcauagcugugauggcagugcgggcacuccuuuaaucuuagcacuccagaggcagaggcaggcggaucucugaguuugaggccagcauggucuacacagugaguuccaggacagcaaaggcuauguagagaccaugucucuaaaaaccaaccaaacaagcaaacaaagcugguaugaggaccugaguccagauccccagaacccaccuaagcuggaugcccagugccccagcaccccuguggggagaugggagguagagucagggcguccuuggaggcuugugggccagcuagccuggccucugagcucugaagcacugcugggacauacucagauaaaacaagcugcaugcucacacauguguuuaaagguuccuagguaucuuaggauuucuuugggucugauuuuuccuacacucaugauuuuuguugcccuauuuaaagaaaaguauaucccuguaugccccuuuguuuucugaugcauuuuucucagcuugaauuuggaaaugcuuugaaaacuugagauuucauaaaaguguugguauuauacuacaguggcuauucuaccauuucuaauuaggcaacuaaugacuuuggacuaaaguuuguuuugaguuggaaugacaggcuucagguuucucuacauggauuccugaacauguuuguaucuuucaguaugcauauuucaggaugggacucacacaucuagacauagucaggacgaauuucuuacaguauucaauaaccaagaucaagcagagacacauuuaccuggagcgccuuggacgguaccagaccccugauaagaaggggcagacacagaucccuaaucccucacugaggaacauucucagaguuucugaagcugaguuuuuggccaggacagccuguuccucugucgaggaguuucaaguuuuuaaaaaacucuuggaucaagaggaggaggaggagucugagagccaugcaucugaggaggaagaggaagaggaggaagaggaggagcuacugugacacagcacuggggugucagaggucauucucauauucucgaagugcuggggaccuucaccuggaucuucucaagcacuuuugaucccaacacugguauuuugaugggggaaaaaaccaaccuguaaugauccacuggagauacagguagauaaaccaaaccaaaugaggggugcuuuguuguggguucuuugggaggcccuacuccauccuaaauaaaggacucggcugucaaaauccagggggugcaacccuuccagguuggagucuuuuucucuguuaaaauaaguugugcuaguuccaaaaccauguggagagagaggugccuuucggcucaggaguacuuuguauguccagguaguaguaaagaugaagucaugaaauugaaacaugaggguuaguaugucauagcacuuuauuuaaugaaaacaaguagcagguuucccacacaauaggcagcuucuaaaucugacaccauuucccagccuucugacguguugaguguacagcagagugagaggcaguugguuacguuaguaacauguccuuuagucacacgguugucagacuagcaaaaugcuucucugucaguugcugacccuuccugcuugggcaaguuggccuucauguugguuccuggcugguugccacuucaaggccuccuaucuuucuggcucuguagacugugcuaagagugagcugcucagagaccagcacuggggagcacugggcaguguggagugugugcaguggagccaugugauguacugggacuaggaugaggugagcuggaggagaggccugauuugguggagcucaggcuuagagggucagagaacugaggccucuuggaaaguugucugugccucuuccucaggaaacugcacagggugaugcagaaagcuuuuugguuauaggaucaaagucaggagugcuugguaguauuuuucccccauuuggugacauuuaacagucacacgaaacccaaugugggccuuguguuuagacugaauccagugcuuacgugaggaugaccuuaauccuccagacaucugacaaucuuuggggauuugugugugugugugugugugugugugugugugugugucauggccucaggaucuuguggucagagccagggaugcuguaaaauauuguacauugcaccgcauaaggaauaauuaggcccacaaagcaaugccaaagcugagaaacugcucaaagaccuggcccacaaaaguacugugacuacagcuaauguguguuguaaauggaccugauguaucauuucugucuaaagcagagauacugcuggaucugaggugcauuuugugaggaaucagcaccaaggugaggcggcucuugacuuaccuggaaccugacugcaaagaggaggguguuuacaaagaaaagcaaucauuccaagauuccuccccccaccccuacccuccacacacacaguucucacuauggcagguaugugaggcaagcucauuccuggcaagggcguguccuugccuguuggacucuccacagaaagcaggacguagcaagccaucuucucuaccccacaucccauaggcaguagaggggaacgaaugccuucugccuguucuuggcuguggacaaagcuguuugagaacaaugauccauucuuugcugcuuacucuucccauuuuguggucuuuuugugaucgacacucuccucccugaauguaggguguuuggccuuggacucaucagaacggaauagaauccuaacugugagcucaauuagguaaucuacucaucuucaguuuugauuagcaaauggugagcccaacaacucauaauuacuucaguuggacacaaaaauaaaucuccaccuugucuguuugcugauuccacuaugacauuucccaaguggacgcugacuguuuugagggauuuaauuauucuguguaagaaagcagagacagcauguuuggaaugauguauacuaauuccucagcacaggcaagucuuucuccacuccaguuggaaugauugcccgacagcgccacacagcaggcuggcuccaacuggagaugggaauguggcagcaucggcuugggggugagaguccugagguauaguacgaagaucccaucuacguucccagaggugcugcuugaucuugcuguucacuguuaacacuguagcuuacucggucuccagaucucuaguggguaucuaagauacaguagugaguuuuugaugugacugacccuccuu

SEQ ID NO: 306 - RNA, 603 nt, Mus musculus
gccagaggucaucugccaagauguuucgcuacucucuugacccagaaaaaccccccaaaaucaugcaaaucaagagguucaaaccuucguguucacuuuaagaacacccgggaaucugcccaggccaucaaggguaugcauaucugcaaagccaccaaguaucugaaggacaucacuuuaaagaagcaaugugugccauuccgguguuauaaugguggagucaguaggugcgcccaggccaaacaaugcggcuggucgguggucaaaaaagagugcugaauuuuugcugcacaugcuuaaaaaugcagagaguaacgcugaacuuaagggcuuagauuuagauucucuugucauugaacacauccaggugaacaaggcaccuaagaugcgccgacgaaccuacagagcucauggccggauuaacccauacaugagcucccccugccacauugagaugauccucacugagagggaacagaucauucuaaagccagaagaggagguugcacagaagaaaaggauaucccagaagaaacaagaaacaaaaacucauggcacgugaauaaauucagcauaaaauaaaugcagauaaaguuaaaaaac

SEQ ID NO: 307 - RNA, 3180 nt, Mus musculus
auuuuuuuauuuuuuuuuucaauugcaguuuuacaaauuuuuauggcauuagggagcaaagccaggguuuaugaauguuaaucauaugcucuaaccacugugccacacacuuagucugugggguuuaaguuuauuuuuauguguaugugugucuugccugcauuuaugucugcuuaucacauggugccuagggaaaccaaaaaagaacaccagauacccuggaucuggaguuauaaacaguugugagcuuacaugugggugcuggggaucaagaugggguccuugacaagaacagcaaaggcuuuuaaccacuaagccaucucucuacccucuuuuuagaaagaggggugugucugcacugugugugugugugugugugugugugugugugugugcucuacagaaguuuauauggaugcccaguuuguuacaugggugcuaggauccaaauuccaguucuccuaauuguuaaguaaguucucuuaacugcugagccguguuuucaucccucuugcaucuuacucuuugaacuuuggacuuucagcuucuauacuguaauugaucugucaauauuuuuauccuguuaugaaauuuauuccaucuugaggauaccuacuuccugucuguuaauuuuuuuaaaggauaauggggauuuaaagaacuuguagucccauguuucuaagcacuccccagagaugcuuuugucucucagcccaggccagccagagaucuaguuguuacuauguugcugguguucucauuuuccccuuagaccuacuuucuguuuaggcuauagcccuuuuagagaaucaugauuuggggaauuggagaguguuacuauguucuaacauuucaccuuaagcagucaggauucuuuugguuguuuuuguuguuguuuuugguuuuucgagacaggguuucucuguguagcccuggcuguccuggaacucacuuuguagaccaggcuggccucgaacucagaaauacgccugccucugccuccuaagugcugggauuaaaggcaugcgcuaccacgccuggcuagcaaucaggauucuuauuccauguuccuugauguaugaaaaacaaaauauugcagaccaguguucacuuuuugaggcaucuagaguugacacuucuauguuucaguauacugaaaguaacuagucauaauuguuagcaucccaggagcaccugggauguuuuguggugcauguuuaucauuucagauaaagucuuauauagaaaggccagguuggucuugagcuccuaacccucguggcuguaccucucaggugcugagauaagcuaauguuaccacacccuccuugauuuaauaaugcuuucauuaaguccaugcuuuguuuuauuuuugagacaucauauaacuuuguagccuacugugaccuugaacucccaguacucgccucagccuucugaguacugagauuacaggguaccaccacacucauggaggccucuguacagccaggcacugggccagcuuguacuuaauguggacuuacuaacuccauuggagaucccuugacagcagacauacugacuggugggugcuugccucuccacauuaacuuuuucacagcccgagaccucaggaacaaaagaaugacaacaaaaacauuucuucuaguugcugguugguuaaucaccagggaaagacaccuugcacaguaauaauaacacagaaggaaagacaacuuggugccuacagaggcuuuaagaagcucuaucacucggugacuaugcuggcagcuuggaaaugcccucuggucuuuuaagcaguaccuucagagauuuaugucaugaagaacugugguguuccugucagccgcauuacuggcuccuggacuucucaauucugacaccucaacuuucagauaguuuccuauucagcagccccauccccauucuuuccagcacauuccauuuuccccccuuguccuucagucuaaagucuaguuagggcagcucuucccagucccucaaucaagagcccaucaccgugcugcuaccuucuaaguacauacuaagucugauugcuuauuuuguucacugcugcaaaugcuuguaagccuuagaaugacaacuacagaaggccucuucagcccuuccacauaccauugucccacaagaaaggcacauauuauccagaccugguggcucacacuuguaauccaaacacuagagaaggaagcugagacaaaucuacacagugaaaaguugucagaaguggggaaaagaaggugggggcaucugcuguugguuacuagccuauucugugcugaugcauaucacugcauaucacuguccaguauaggucagaagugugcucaugucaccucaggagagguucaaaauaaugauuguguacaaauucuucaaguaguugucaauaaacgcaacagggcagaacuaguccuuucaaaggaggaagcauucugagggcagagguucugcucugucccaacugaguaugggagagguaggaauucacugcaggcuggucuguacauaugggacacugaauaauacuguguagagggcuucgaaaguuuuggaguuuguuguguuggacauugaggaauggaguaaggauuugcaguagaggugggagcaggaggaagagaucccgaagagaaugagaauguguuccaucagggggugcucuaggggaugguaaaaugguuuuccgggcugucugcugucugagguccucagagcuuucuuuucucuuuuggugacacaguuucugguggccucaacucuggcaccucuggcucuggggccugccuguucucuguagguaauuaacuuaccaacuccucgcccccugucaggccgcagaacucuuaaagaguugguccgcucccgggcgcuguagggaccccgcagcgggcggggcgggcggccggucugacgugucucggcgggauuggagccuccgcccuauauagcagcggcggcccgggcgccgcgccucggagcgucccggcuucucccgcgcagcggcagcgacagacggacagacucucggguggucacacucacgagugaggaucgggcgagcuggugggcgggggugccaggggcggggcggcggggggucgccgcugagcacggcuggggucgguuccucagcuccccggccgcacaggcucc

SEQ ID NO: 308 - RNA, 31395 nt, Mus musculus
uuugcagaaauacuugauuugcuuuuauugaugauaguuuuagaagaaugcaugucaauauuucuaaguacuuugucauuugucuugaagguuuccccuaaaggacuccaaacgacugauccagugguuaaaagcuguucagagggauaauuggaccccgacuaaguauucauuccucuguagugagcauuuuaccaaagacagcuucuccaaaagacuggaggaccagcaucgccugcugaagcccacggcuguacccucuauuuuccaccugucagagaagaagaggggggcuggaggacauggccaugcuaggagaaagaccacagcggccaugaggggccacacaagcgcagagacagggaaaggaaccauaggaucuucacugucuucaagugauaacuugauggccaagccagagucccgaaaguugaagcgagcuucuccacaagaugaugcagcccccaaggucaccccaggugcugucagccaggagcagggucagucucuggaaaaaacuccaggagaugacccggcugccccauuggccagaggccaggaagaggcacaagcgucugcuacagaggcugaccaccagaaggccucuuccuccaccgacgcugagggggcagacaagagcggcauuucuauggacgacuucacaccuccgggaucuggagcuugcaaguucauuggcucacuucauucauauaguuucuccuccaagcacacgcgagagaggccgucugucccucgugagcccauggaccgaaagaggcugaagagagagauggagccaaggugcagugggaauaguguggcccagagucccccaaguuccucacuuacagcaaccccucaaaaggcuucccagagccccuccgccccuccaacugauguaaccccuaagccagcagcagaagccgugcagagugagcauagugaugccagucccauguccaucaacgaggucauucugucggccucgggggccugcaagcucaucgacucccugcacuccuacugcuucuccgcucggcagaacaagagccagguaugcugccugcgggagcagguugagaagaagaauggagagcuaaagagccuucggcagaaggucagccgaucugacagccaggugcgcaagcugcgggagaagcuggacgagcugaggagagcgagucuccccuaccuccccuaccuaaguggccugcugccccccagccacggucaguacuuagccaagugcucccaugccuuccuuacgcugaauaggagagguucuccugcugugugucaggucucucugggcuccacauuuccugugcuugcucucaguggucauuguucagcagcagaccuagucacagagaagggcaggaagauuuagcguugcaaguagccagguguggugaccauaccuuuaaucccagugcccagaaggcagaggcaagugcaucugugagucuaggccagccugguccacagcucaaggucagccaaggcuggauggugaggcuuaugucucuaaaagcaaaagaaugauuuuauauauuucaacuaugccuuaagaguaaggacaguguggauaguguucaguacauaugggaaacucuucuggcugcauucacucuaucugaauccgcguuugucagugcggguauggcggacagaccuggcugccagagcaaacauuucagugucuccuggaccucaguggagauagugaagccugugauuuuuucccugcauccugagaagaacagccuuagucacaagcugaccuggguguacugcuuuuguaauucuuaucccugauguugcugugacugcgaauacagaacuuugugaacagccagcaguauugauauuguuucuguuuucauuauuauuauguugcuacuuucuccuugcuuugguuuuacuucuggcuucugcagaguuucauaacaugaagccauucucccuguggcccuguucuggacuugcuguaugcuacacgcauuggucaccaauguuuugucaacucagccguuaggguuucuuaccuccuggagcuauuugaauuguggugaugggcucugaagggaauagguuaguagaggggacaaauaacuuggaguuauuuuagauucuauuauuaugagguuagugcuaggcugucuuuaagccugcuuuuugaaauguugagaugucauuguggcuggcauggugguuugaacuugggucaucagacuuguggauaagugucucaacuuuugacuuggguucagaaaugugcuguacccucacugguuacauuguucuuuuccugagcugagacugaaaucucccugguaugagucagcagauuguugccuaacuucuuguacucagucagcugauugcuauaaaggugaggcauacucuuacugcaauuccggagguaccuauuucuuccuaugugucugucaggcuauugguuuugguuaggucuuuuuacacuuuuacaggaucugaccauguagcccaggcuagccuugaacuugugguuauucuccagccucaaccucucaaguacuaguaucacacacuugcaucaccacacuugacuuuauaugucaauuuuugcuuuaggcuugaaaacuuuguucgagggggcuggagagauggcucagcaguuaagagcacugacugcucuuccagagguccugaguucaaaucccagcaaccacauggugguucacaaccaucuguaaugggaucugacacccucuucuggugugucugaagaucugaagauggcuaaaguguacucaucauauauauaaaauaaauaaauaaaaucuuggggggggaagaaaaccuuguucgauaugucuauuuuccugaucacuaacauggcaaaccuuucucgcauuuaaagaccucauuuuuugagccucauuuuugaggucucacuguguugcccaggcuucauuccagcuuucuguccugccucugccugggguucccucccugaucuagcucugugauuuuuuuuuuuuuuuuugguuuuucgagacaggguucucuguauagcccuggcuguccuggccucgaacucagaaauccgccugccucugucucccaagugcugggaucuggagucuuaacuuagucccugcuccaaguucaaggcuucccuccucccuccucccuccucccuccucccuucucccucucucccuucucucuccugccuacaguguagccaagucuggccuugaacuacuauccucccaccucacccuuccccacccaagugcuggaaagauaggcuugggccaccaaaccuaucugaauaauacuuuucugcccucuuaaucucauaugucucuuaauuuuauagauacauuuuaauugaacuuaaaaguuguuuuauaaaggacuuuaaucuauuuaucauuaucaauaaguugggaauuuuauuuuuagccuuucccuuuuuguuguuaaucugucugguuuuauagcuggucuuacacugaaacucuaucuggcuuggagaccucaaacucagcacuccucuggcugugaccuuagagccuuaguguugcaaguaugagccaccacacccaauuuguuacuuuguuuuagaaacaaacauuuaauucuggguguggugguauacaugccuucuggaagcaaaaacaagaaauucaagauuucaaggccauucagggcuacaggagacccuguuucagaaaggaaaaaaacaaaauaaacuauauguuuauaugcauucaucuuucugugaauguagauagcugaucagcuaaugccucccuaggucagauaguccagggucuugguuuguauugcuugucuuuuuacaucuucaaguaaccauuauauauuuaguuuuaaaauuauauucugcugguuacuuuauucaccacuguguaacuaacuaaguuugucauuuuuggaaauaucuaguagccuauauguuuuguuguugguuuuaauguaccacuaccuggcuaaguuuauuuuauucguggaucugugucugcuggugucagcagggaacagaaaagggcauuggauggggauuugaaccauuaucccgaagagcagcaagugcuccuaaccaaccagccauaucuccagcccuuucuguuugauuuugagaagauucucucugcuugcucuguaacuuguuauauagagguuugcuagccuccaacagagauccaccugcccugccuccugaguacugggguuaaaggcuugugccaccaugcucaguaucugguaauuuuuuuauuuuuguuuuuuaaaguucauguucuagugcagcuuugagaacaggccaguuugugauuggcagguuuuguuuuuuguuugguuuuccuugaauuuaaaagaaccuuugcagucugauuugaaggaauuauucuguaucugucucuuaugccaguuagacuuuaguuagcuuauacaugacuugccccuucuuacagagcaguaagaguccuucuggccuuggguauguagaucgccaccccuuacaucugguaauugucacacuuguccuguguguucuuugaccuaaaagcucagauuucaaauguggaauguuguuguuuguucugucuugguguguuggaaaaggauauguugauuuaugcaccagcaucacucaguuagguugaggauugcccucugcuguguaggaacagcgccaagagcuaccaggagauaaagaggaaggacuacaguagucagaggugccgggcuggaacccaagaaggaaaagagcguccagggcagaagacagagccuagagcuaggccuggaacuaggucccucuucccuacaggagacaagaccugggacacaggcugcugggggggggggcgcauaagauguacucagguaccaccauggggcuuugaaaaggacccauccuaaaacugggguaugagauccgagagugugagggacugguugaaggacacagcuggcucuuuccagaagagcuuaggagggcaaggggcucugggcugugugaggaaaagugacuguguccuguugucaucgggugggggguggaacccaguggaggguaguguaguaaaggugagcggugaugcacgaucagggacagugaucucuacaaagccaguuagccuugaugggggagucuguggacaguagccucaagggacauggcccugggggagaguccuguuuuccaguggugagaacccugcaaagcccuagggaaguaugagguugaaaucucaaccugggaaugggauggcgggcaggggucaaguagucucugccugugucccuucucugucagugaugcaaggcccggcuugugagucugaagguucugagcaggagcucuugagaggacucccaccuuggaccccuggccugucagcaugccgcuguugguguugguuucuugcucuggcuggucucuacucagguggauuccuucacugaagaaggauugccuuggucacuuuuuaguuuuaaaugaagacugaagauggcuguccauauguuuauucauuacuuuuuauuagccaguccuuuuauuuguggccaauuuacccgaaggggcagauucuccugagacaggguuccucuggccucucagacccugacuucagguugguucccagaaugugugugguuuucuguggccuguuagggugauguuuucugucauugucugcuuguccuuccugacugccaccacucauccuuugacuucucugggggggggggggguuagacuugguuuuuuauguugagagagagagagagcgagagagugcacgcacccauaugccacagcgcauguguggaaaucagaagacaacuuuuaggagucauucucugucuaccuaguaauuaaggcaggucucucuugcaccuguuguacuucguacuccaggcugaucuuaaucccagcucuccacaaguagagacaggugaaucucugaguuccaggcuagccagggcuuuauaaugagauccugucucuaaaaaccaaacaaaaagaaagaaaaaaacaggcagugguggcgcacaccuuuaaucccagcacuugggaggcagaggcaggcggauuucugaguuugaggccagccugaucuacaaagugaguuccaggacagccagggcuacauagagaaacccugucuccaaaaaccaaaagaaaaagaaagaaaugcuaagauuacagaugggcauuacuaaauccagauuucuauaugggucccagggauuguauaaggcuuguacaaauauuuuuuuuuguacaaauacuuuacucaauuaaccaucuuauuggcccccugaauuacccaugccaccccuuaaaauccaaguucuugauggaauauuugucucugaaucaagcacuuuucaaucauuucccuuaguuugaucauuuaauucuuguuucaaauaaaaacguguguuuuuguuuuacuguguauaggggagaaguauauguguggucacauggcccaaauauggagguagagggaugacucaguucucucacacucuuaguucucucacuauacucuaugucuaccuaauuauuuacucucugucuaccuaauuauugggguuuauuuauuuauuuacuuauuuuauguaugugaguacacucucacucucucagucccaccagaagaaggcaucagaucccauuauagaugguugugagccaccaugugguugcugggaauuaaacucaggaccucugaaagagcagucuuaaccacugagccaucucuccagcccuagaucucucuuguuccugccguauugcauacuccaggcuagcugacugaagagagcuuccaagugauucucuugucuccuuuaagggaacagagaaugcagguccuggagauugaacaggucuucagguuugucaucaagugcccucaccagccuuugguuuuguuugugacacagaguaaggcuguauacccuaggaccaaugccaucaacaccuccugccuccuaagugccauacuacaggccugcuuugcacucagauuuuuuuuuuaagauuuauuuauuuauuuauuuauuuauuguauguuuuaaguacacuguagaugucuucagacacuccagaagaggaugccagaucucauuauggaugguugugagccaccaugugguugcugggauuugaacucaggaccuucagaagagcagucagugcucuuaaccacugagccaucucuccagcccucagauuuuuuuuuuagguuaauuuuauuacuuaauggaaugacggguuugccugcaugaaugcaugugcaccacauguacaagugaggccagaagagggcauuggaucccuaggaacugggguuauaguuaugagcugccauaugggugcugggaauugaaccaugguccucugcaagagcuucaaguguucuuaaccacugagccaacuguccagcccagauuuucuuucuuuuuuuuuuuuuuuuuuuuuuuuuuuuugguuuuucaagacaggguuucucuguguagcccuggcugucuuggaacucacucuguagaccaggcuggucucgaacucagaaauccgccugccucugccucccaagugcugggauuaaaggcgugagccaccacugccuggccagauuuucuuuuaauauguuauuuauugcccauagagugugaaacagaaucucauugucuacuuguccaucuccccucucuuaggaaauaggaugaccacuuuacagucagcuuccuucacuuagcucuguguguguguguguguguguguguguguguuuauguggguucuggccaccaaauucugguucucaugcuuucaaugcaagcauuuuacugacugauaaagcuccagcuccuuaaagauuuauguauuuauuuuauguaugagugcucuaucuguguguacaccugcaggccagaagagggcaccagauccuguuauagaugguugugaaccaccacauaguugcugggaauugaacucaaaaccucuggaagagcagccaaugcucuuacccauugagccaucucuccagcccccucccaggcccauuuuauuaaguuguucuuuccccuuuuguugaguuuucuaaguuccucaguuaagucuuucaugaauguauguguuuuacaaagauagaccuucucccagucugaucugccuguucccuuaacagaaggcuuugacagagcaagggcuuguuguuucuuguugguugguugagaugcucgugauuaaaccaguggcuuugccuaugccacacacuugcaauguucccaggcauggaugguuucaauuuuauuuuuaaauguauuguguguguauguauauauaucgugcagguaugucugugcaugccuaaugacuaccagggccaaagagguuauuggaucaccuggaguuacaaagagaugugagccacuaugaauagcuugcuaggaagaugggguauccuucaguuugucucagaaguauguaugagauggugacuggaaaugcuaccuuuuggccuggcgagguucguugucuccagucccacuccuuugguggggguuugcuaaggacugucuccuuucuugaaggucaggguccuggcacgaacugccuguuaagugcugaguuuguaaauggucagucaaaggaaggcugcuguuggaacguagugguaggcuaugcuggugcuggagggugcugggacauuuaggccagucuauuaaaagaacagggucuaguauugcuacuuugguuuuuaugcaguuuauuuuguuuuuuuuagguuuguuuuauuuucuaucccguuccccacccccaccccagaccccggaagggaguucucucuccuuaucugagcugagugggcugccagggcccugcucauucuuucuuaucaguuccguccuaugugggucaugcuuuggggauuacuucuaaaagcucuuagcuaaaucaagguuaccucaauuuucuguguuguuucagggaguuuuauaacuuuguauuuucacauuugggucugugguccauuuugagauaauuuuauaguaagucuuggaggcugacuguuuugccuuaaguguaguggucaugacuauagauccuuuccccuuccacguagccuuugaaucauugucauugucuccagaguaucugaugagacuuugacaugcccaguguaacaacauugcuucuucauaaaaccuuuccauuuacucggacucuauguugucauuuaccucguuugguacuuucccucaacacuuacacacauuuuuuaugaaaguaaagauggcugagcaaguaaagggacuuguugccacgguugaugaccugaguuuagccccuagggaccacgagguggaaaggagaaagcagacuuacaaacaugcacuuuagcacacaaaugcacgcgcacagacacacacacacaccacguguacacuaaauaaauaaauguuaaaaaucauacauacauguuucaucuauauguauuucauuagauuuauaucuauauaguccccuuugaugcaaauaugaauuuuauagguuuaauuauaaaaauuccaguugcuuauugauagcauacaggaaagugaauuuuuuuuuuugguuuuuugagacaggguuucucuguauagcccuggcuguccuggaacucacuuuguagaccaggcuggccucgaacucagaaaucugccugccucugccucccaagugcugggauuaaaggcgugcaccaccacacccggcuuaagugaauaauuuuuaucuguuagcacuguauccuaaauucuugcuaugauugcacauuaguuccacaaguuuuuuguagauucccugaguuuccugcaguuuuauuuuauaucuuugauagacaaggacacucuuuuugcuucccagucugugucuuuauucuuccuuccuacucuguguuuuuaugaccuuuucuucuguuguccuagcugggacucccagggugauguuaaaaagcagcaucuuuauauugguccugagcauggaggaaagcuuuuggcuucucccuucccaugugugucauugugauauaauaaguaugcggugcagagcuccugaaaccuuugcuauguguguuagggaugagaacagcagcuucaguuaaugagccuguugagucauagcugaguuugugcuaauguggucucuccaugacaaguaaggcuggucaccucagaagccaacccugccauuggagggguggaacugaagccugcacugaggcucuggccucaacaacaacaaccaaugauuggucaucagagccugugcaggcaaauauacgcagguacugagaagcuggccugcuaggagagagggccucugcacccaccccuggccuugugacauuuaaguuuguuguguuuuguggcucagaaggugaucuuuuuugguuacuauuccaugugaacuugagaacaacauacaguuuguuguuggauagagcagucuuagauguugauuauggaccuguguaaaugauuaaaguuuuaaauaguuggaucugcccuuuucuggcaggggucucaacugucuuuuucucuagguguuuaucugcuucuccaacaauccugucacguucgucuuguacauuucaauguucugauauuaaggacgcucaccuuaaagacugguuccuucacuuuugaguugaaacuuuauuauauaauacccugguaggguuugcuuguuuucaagacaggguuuuuccuguguaguccugguuguccuagaacucagagaccaaguuggccucuaacucagaggugaccugccuccauccccugagugacuaaaggcucccaccaccaccacccuccuuuagcuuuucuuuuuuaaguguuaacaugacacaucuuauuuucuuuguguuuccugugcaguucagacuaaccuugaacuugauauucugccugauccucugaaguaugaacaagaccuugucuuuuuuuuuguuuuuguuuuuguuuuugagacaggguuucucuguguagcccuggcuguccuggaacucacuuuguagaccaggcuggccucgaacucagaaauccaccugccucugccucccaagugcugggauuaaaggcgugcaccaccaccgccuggcugaccuugucuuaagaaagagagagagagagagaaagacagacagacagacagacccuggguuagauccuaaucauggcagaaagagagaagagacuccacauacccacauacuucugauguucuuucuuuuuauuugggcuugaguuucugacccaaagguccauuuggaauaaauucccucagucuuuacuuucuuccuugccucugaagaguguuuuaacuggcuucggaauuacaaaugcuuuuuuuuuuuaauauuuuauuuauuuauuacauguaaguacacuguagcuguuuucagacacuccagaagagggcaucagauuucauuaccaaugguugugagccaccaugugguugcugggauuugaacucaggaccuuuggaagaguaguuggcacucuuaaccacugagccaucucaccagccccacaaaugcucuuuuuauuguuguuauuguagcuggucaaugagggugcacaccuuuaaucccagcacucaugagguagaggcagguggauuucugugagacugaggccagccuggugugcgccaccacugccuggcuuuauuuuguuuuuaauauauggggcuguuagguguuauuagaaauaaugagcccaaggaauggacauaaaaauuuuuaccagaccagaguugauuacgaauuuuaauggagaauguaaacuauggacagaaacaaaguuggugaauugucagagagagaauggcucccuaaaggguaaacggugaguucuagagcaguuaagagacgaccugucuccugggcuguauguaggucauguuugaauagcugugagaaggacagcucccuaccuugcuggguaggaaguuuuauaacaccacuugucuuuccugagacaaauucaggugcuaauuguuuguauaagauauuacaagacuuuucuuuuaaaaaguguauuauuauugcacuucuuuuuaaauguaugugugugcgaauaccuguaccacagcacacauguggcagucggucuaaggacaacuugaaggaauccauucuuuugugggucccagggauugaacccaggucaucaggcuuggcagcaagcgccuuuacucacugagccaucucacugaucccacagaauguauucuguuuaucagaaauguguuucugcgcaugcaagcuuuuaugucucucucccacacgugucucgucuguugacuuuuccuuuauaaagucccaaagaauuuaggcuuuucuuuugaagcaguaaaugccuagacauaggccacaucugaucacuuguuuuuuacaaaugagaucuugcuugaauauaguaguaaaauauacuguuacuggcuaaauauuuagaauaucuaauuuaaauuaccuggagguguuguuuuuauagugugaaauuaacaauuuuauucucacuaacguaacuaauccuuuauauaugguugucucguguguaugagugcuuugccugcauguauguucaucacccucagaggucagaagagggguuggauagccuagaacugggguuaaugguugugaaacaccaugugggugcuggaagccaaaccuguccuacacaaagcagcaagugcucuuaacuguugagucaacucuccagcccuagaguccugucugcaucuugcaaauuaaaggaguaaggacugagcaucuauguauucuguguauucacagaacagcuugaauucaguccugucaguggggauuuugucugauaaacacaucgaauccguguaucugaaggaggauaacaaauacaccaaaugauagacucaggcgaagcaaauaccugaaaauagugugagcacuaacagucaucagaaccgggcuagagguggggcucagugaaggcuuugcccagaguucauaaagcacugaauaaaugagucagguccuggugccaggaggaucagaaguucaaggucuucuaugcauuguguucaaggucagccugggcuacaagagacccuauuuccaagggaagggaguagcagaggagcagggaggagagacucaaagaacauaauaggacugcauuuugacaagaguguacccuuagcagggcagugguggggcacaccuuugaucccagcacucgggaggcagaggcaggcggauuucugaguucgaggccagccuggucuacagagugaguuccaggacagccaaggcuacacagagaaacccuuucucaaaaaaccaaaaauaaauaaauaaauaaauaauuuaaaaaaaaaaaaagaguguacccuuagcagagacaagguaggaaguuuacaucucaaggacacagguuaacugaaacauugagaggacacaugaaggcagcgaggucagagaagcuuguuauauagacuuaaagaaaugagcugcuuggugcuaguagaaaauacuucaaaaguugauccagauucccuguaugugaagugucgucauggagagauuguagagggagcucugcuacaauaaagagggagggaggaggagaaauaaggaagagagauaagcgggagacaggcuagcggagacgggagauucuccaccccgaccuugacuuucuuggugagaaccuagugggcuuccuggauuccuaagcagaguuaguaaggcagagggugacuggugguugagaagcuagugauugagggcuaaugggaaagagucuggugagccuggcaugauggccuacacuuuuacuucaagcacuggggacaaaaugaguuccaagacagccaggcuuguuacagagaaacccugucucaauaguucucuccaucugaugagacagauaugacaucccucucagaucugaggguucaauaacagcaccuugaaggcuugggaauaaagaaucugaguccuaaacuauggcagaagagaucuaauugaagaaugcuguuaccgugccaugcagcggccaacauccuuagucuaggaguggccaaauuuuauuacagaggaaaauaagguuaauuuaguuuuguuuuccuuuuugagagucugagcaucaaacuuagcuaguuuuugaaauuacacucugggaguaauuuccaacuggagggacaguguuugcccugaaagcacacuuuaguguauugaaccuucuuccauaugucaugugagacccagucuuacuacaaacuucuaaacauccccaagugaagagauggcuuuccaguccuuggagauaaaauuccagagcuaaacccaccuaguuggucaggcaagaaugaucuugaaggguuggagucucaccaacugaaacuggccacagagcagcuacaagggacaggguacucacuguccuagagggagggaaugaaggccuggcuaccuguagaucucucagaugaggaaggagagucgcagguguagagacucagccacaugauuugcuuucuccuacacuccagggauggaaaaggaauaagggaaaaaggucugaguccuuccuacuguaaacucaccccuuacaagcugucacugccccuaugucacgugaugggagugaagagagagggcucccagaaagaagaaaaguagcccuguagcuagucuuugcuacuuuguggguucuccuuuuucccacccuuuauugccuagguuuuacccccaucacuagauagaguaagaaggauggggugggguggggagagaaagagagagggauccuugacucuaauuucuuucuuguuucuuugagcacgacuacuagcaaaccacaucuaaccacccaacaccgacuuaucagcucucuaacauuuauauacccucugaaaaguucccagaauugcaaacgucacacaaucacagaaacuaucuucagcuggcaaaaccacaccucugcuagaacaugaggcaaaucauagucagcugcuuuaaagcagccccauauccccacaucugggauuaaaacaaaaacaugggggguggggaacaaaaacaaaaaacaaagcauauucuuauaauauuucuguguuuuuuaaaagaaaugaaaauuccauaauuaucgcuacacauccucucuuucuuguguuacggggcaaaaggaacuuuuuuguuuguuuguuuguuuguuuuggguuuuuuuuuuuguuucuguuguuguuguuguuguaguuugagacacgguuucucuguguagcccuggcuguccuggaacucacucuguagaccaggcuggccucgaacucagaaauucaccugccucugccucccgagugcugggaauaaaggugugugccaccaagugcugggggggggcggggggggaggaacucuuuuuaauucauaccuuuggaauggcagcaugggugacucuuuguuuguuuuuuguuuuuuguuuuuugagacaggguuucucuguguagcccuggcuguccuggaacucacucuguagaccaggcuggccucgaacucagaaauccgccugccucugccucccgagugcugggauuaaaggcaugcgccaccacgcccggcuaaagguuuuuuuuguuuuuuuuuuuuuuuguuuuuuuuuuagacaggguuucucuguguaucccugguugucuggaacucacucuguagaccaggcuggccucgaacucagaaauccgccugccucugccucccaagugcugggauuaaaggcgugcgccaccacgcccggcuauauggguaacucuugauucuugccuggucaucugggcuggugcaggacuaugaccaaagugguguccuccuggaguaccugcuuaacucuagagguaggugcacggugcagggcagaggcugaggugaggcguaagaucccaucucgugggcuaagcacuggacggcucuuaacuucugcaguugccggaggcucacugcagaugccugccuuucucuuuggcuuccucgaagccucuagcaugccacugcuccuagcacucuuccauuuguggggcuuguggcuucauagcagguggagagaggaaagccaccuguacggacagguuggugucagccuuagagugaccuguguuucucagccaugaccuucacaagugugccuuauguuuucaauaacacccccuucccccuuaagugaaauggaagggcugggagcauuccccagcugagucccuuuuugggguuuguguuuuuuuguuuuuuucaagacaggguuuuucuguagcccuggcuguccuagaacucacuuuguagaccaggcuggccucgaacucagaaauccgccugccucugccucugccucugccucugccucugccucccaagugcugggauuaaaggugugugccaccacgcccggcucccagcugaguccguaaaaagucugccuacauagugacccauagccacccggcucccagcugaguccguaaaaagucugccuacauagugacccauagccacccuuguagcagugcuccgggcagguugaacucuuuggauccaagaaugaaagacacacacucacgccaguuaauuuuaaaaugccuuagcuaccucaaaggcuggucaguucuauucucugccugcccaggccaaaucagggaaguggccaguggccacuuaucuugauucuuacaugguucuauggcucucuuuccugcggcucuaaaucugauccgucucccaccacaugauggugaucuucuggcuccucucucccucgaguccuagcccaggcaaauuuuaaggguuccaccccgccuuccuuuucucagccauuggucacugacaucuuuauugauugaucaaaaaccaacuggagacaagggccuuuaguguuuggauaugcagauucccaauuaaaucaaaacauuggaaacaacccccaacauacccacccuaucagagacaugaagugauuuuuguuuucccuuuacuuuucauggcaugaaccucagaagcuuccuggaggcaauauagguggaguccaugaaacuaugggugaggagcucagggcuggggccccuagcagguucucaugcuugcccuccuucugcaguucaaccagugucucuuguaguuuuugccccaaaagcacugaucugagcuguacuucuguaguaggggagcugucaguggacuugucuuucuaaucggguaacuuuuguuucuucuguauuucuuguaagauugaaauaucaucaauaguucucucuucuaccccacuucuuuccccccucauuauuauuacuguuguugcugcugcugcuguuguuguuauuauuauuauauaggguuuuugucuuguuuuugguugacuuuguggguuuuuuguuuuugauuuuguuuuuuuuuuggugguggugguggugguuuguugaaacaggaccucucuacauagcccugacucuccugaaacuuacuacauugaccaggcuggucuugaacucacagagauccaccugccucuaucuccgagugcagggauuaaauguguaugccaccaagcauaccauuccccacacacacacacacacacacacacacacacacacacacuuuucuaaacagguucuuacuaauguaauucuggcuggccugugcucccaguguaguccagacuggacucuagccauguucuugccuuuguguuccaaguguugggauuauaguauaugccaccacacuugagccacuuauugcuucuuagaguugacccuacagguccccaaugucauuguuaaauguguucauugcuagguuucuacugcugugagcaacaccaugaccaccuucucaccuuagagaggaagggauuuaugucaggaacugaagcagaggccauggaggaacucugcuuucuggguugcucccaugguugcucagccugcuuucuuauaccauccaggacuucuugucuagggaugacacugcccccagugcacuuggcccuccccauuauuaaucaagaaaauacccagaaaaucaauuguagccuuaccuacaggcauucuaacgguggcauuuucucuucuuaccagauugagggguuucuucccaucuucccagauaacuuuagcaugugucaaguugaccaaaaaaaggaauuagccauuuauuagagucugucauucuaauagucucaguggacuaacuaaauaaucaaacauaaucuuugcagagacuaauauuagagccuguuuuauguguuuuguugaauucuguaggaguucuguuuuccauucaucaucuccagcuuuccugggucccugugguccccuuucuguugugaauggucaguuggaccuggcugucacuuugacgcuaguaggacccagaccccgcaccuccgccuagcuucugcuggguguuuugguaguaguuuuuuaacuuuguaguacuguaugauuagugucguuuucucugcuuggcacagcaggaaacacuguuacugucagcagagcagugaugugaugguaagaaucaccaacaguuuuguccccaggucccagaaaauauuucuacccaugugcucucacugggccccacgacccugaaaacucccguguuuaguuauagcuaagcuaaaaagaagagcauccuugaagacagaagaguauuugaggagccuaagcucugggcagauguuccuucuguggaacagcuucccugcugugccugcugugcauucugauuuagugaguugacucccucagcuccacuccauggaaacaacagaggguagaguucucauuccuuaucuggguaggacagcugacucucuagccugcuccugauuuguaagaugcagcuagcucaguuuccaaaucuccuuagcucuaaagcucuguaaucucccaggcugucuuugucuuccacauucuucugaggcuuagucuuuuauaguagacuacaauucccagaaugcucucuuuggauuggcauucauuuccugcaaugccuuaacagccaggugcacacguuucccgucaauuggcagaaaauaaccuugaggaaccuugacggaguguguccgaguucagaaaacuuagggauggguaagcuuguuuucauguuuaggccacuuauuacagaaaaucuaaguuuuuaguuuugcaguuuaagauuuuaauaaaaagaaaacuuaaaucaaaagaaaauucauagaaaagccugucuaguuuuuuuaaagagauugaaagcuacaaauaggcuagcuccuuauacuuuuuuguuuuguuuuucuccuaaugaaguugaauuuauauacaguaaaacacaaaguucuugaugcucuagucugauggauuuccacacguguaggauccauaacuggacguuuggguuacagaauggucucugcugccccacacaucagugaaggcaguggcagcaguugcaggcaggggguugggguaguagaagagcagagagaaggagccagcccauccagggugcuccaaguuuccugccaggguggacacacugauuguucagcgcccaccugcugucaccuguccaaauuggcauccuuuaaggaguggucuuugugggguugggggggcagcccagggcucagauagaugugcuuuccagagccuuccuacacugcacugugccuggaccucggcacuuagcauccuggugugcagacacaacggcacguccuuuguuuccaaucauggacuuccuacucaccaucagagaguccuguagucuugggucuccuuucgcuugccaagugucacugcacaacucaggaaucuugcaugucacaggauugguagugccuggguuugcaguucuuccuccagaaggaccagcugaacuucuguuuauaaaguggcugccauagccaagugcauugucccaugucacguugauucacagguaccugcuuaaaggacuuuagccagaaccugggcaaggcagcaagcuagcuguagcccucagcagucuuuccugccuuguuuucagguagaugcccaacccaugccauggugcccaccugccgggcaggcugucccuggugauucuagcccaaggcuacuacccaguucugucccuuguggcccacauagcuuuacucugcccugccauccccuuucuucccuuuuguguccaccccacccuacugugggacaccucuacuuuguuuacugcgugguaucacccuaugccuuucccucuucugguucugauaauucuguccugccaaccccagauuugcaauuugcaguuuauccucauuacaguguuacugaaaggauaaaaggacauagugcccugggacagcaaacauggcuaggcccuaccucagacccacaggccagugugucaggcagugagcagccugguagcuuugcucucugccacuaccuagucuuagccaugcagccccucagacucucucaacaucuauguaccuuuucucuacugauacccauuccuuaauagcauguuccacauuuccaguuucuccacagccuccccucuacaggcucuuucuaucuguccuuuagugauaaccuuuuuuuuuuuuuccauuuaaucaaaaugguuuuagugagugucuccaccuaguuguuuguuuguuuuguuuuguuuuuauuuuuauauguaaguacacuguagcugucuucagaugcuccagaaaagagcaucagauuuuguuacggaugguuuugagccaccaugugguugcugggauuugaacucaggaccuuuggaagagcagucggcgcucuuaaccgcugagccaucucaccagccccuccaccuaguuuuuauuuuauguguuaugggucuuuugucuacauguguguuuguacaauucaugcaugcagugccuacagagcccagaaaaggguaucaugcccugggacuggaauuccagacaguucuaaggcacugaaaugaaacuuacauccucugggagaauaggcucuuaacagugagccaucucuccggcccccaccugauauuaggagagguaagaagacacucaaggacccugcuucuacacaaaaaccuucuggcucugagggcuugguucaaccuggccaagcuuugcagaagugcauuuccugcccuggguuaguauguaccaucccgugcccaccuagcucucacagguauuucaugucaggaucugcugucugcuucccugugcucuuuguugagcuguguaacagaguacucagugggauaauuccuguagcacucgcuguuuucuggaaccuguucccagggugagucuaaacagccugaaggcuauucugagauguagcugagggcuauaucgauuaguccaaaauacccagggccuuuucagccucuacccaaaggaaaggagaguggagggagagacaccaugcccaacagugccaugccuaacuaacuaguagaucaaacagccagggcaagaauaugugguucauaccaccaguuguuuauaauugaacaggucaguuguuauauccccaaaucagugucuuaacuuacugaaauucuaaaguuagcaauaucgcaacaguggaucugugucccagcaugacauguccugggcuccuaggucuccugagccauccauuucuccagucccuaucuuaaacucuuuaguaacugcuuuaagaagguaaaggaaacuagcauaauuaauuuuaacaauuauguuacuugacaucauuauccaaaguaccaucaucucucuaagugacugguaguuuuuuguucugggauacuggaaauuauuuuucuggacugaguuuugggaagccacaucucuagugcuacagaguuggccaccucaggugugcagcaagcauagggugcuggaagcugaggcaagcggugagauagcacccuuguccuuccccugugggcuuguccguuaggccuguuucuccacuauggagaaccacugacuugcuuucccucugugcagugggaacccugaacauuucccaagaguggaaucaggugaucccugcucuuggucugacuucucccacccaggcuuaccucuugugguucaguugggaaucguuugcuuuuacgacugaauaaugucccuccucuggacaugcuguguugcggcucacugggcaggcauuggaugugaguucuacuuguggcuguagugaagccugcagcugcagauaguuaggucuaacuuugguggguacuuaauuucuauuggaccugucccuggggguaaagcuauugcuggguccuacucuaugcucaccuuuuaaaacaguaauuuuuaaauuuauguauauuauuguggcccauaguuuggacuugggggugguauguuuguuucauuuugcaguguuguuucaaguucugagucuuguguguucuggguaagcucuguucacaugugucuucccauuaagggccuuugccgcacugccugugccuguaugccuucacuuuuacauucuuccguugcugccuaguugucuucguuauuuuuccacugcugugagagaacaccacaaguacagcaacuuccagaauaaagaguuuauuugagcuuaugauuucccgaggauaagacguggcaggaaguggcaggcauggugacuggcaaguaugcccacagucagguacuucuuccaacgaggccaucccucccaaaccugccccaaguggggaccaagaguucaaaugccuaauacuauggagaacauuuguuauuuauacugcucugggguucugcuucaucuuucuucuuccugaguuaggcucacucacaccccaccuuuuggucuuugguauuuauggagacuggucuugcacaggcaacagcguugagauguuaaggguuuaguagcuggacuugguagcucuucccgggacucuggaaggugaacagcagcaucucauagucagcuggagucacagaggaagacuugacucagaaacagaacuaagaacugaagagacggcuugugguuagaagugcucacugcucuuccagaggaccgaguccaggccaacacccauuugugggaguucgugcucuccucccacucugugagcucuagguauccaccucaggucggcaugcuucaagcugagcacccucgccuuuuuaauuacuuuaauuccugggagaggcagaaaugaugcugcaucccggauugauccucugacagauuggaggaagaaagagcaagaccaguguuagucucucccugucuuguuucuuuccuucuuucucuacccucccucucugugucucucaucugacauuugagaacuguccucccuugcucucacugucugggaagcagugugaagacagaagcagggccugagcguguuucugcuggaggaacaugucacucaguacugacucagacagaagaaccucaggagggagggcugagugacccuaacagggucuaaaacaaggacaacgccagacacaaguuaggggcugcagaggacacuggggaucagaagaggcgucguggauucugacaagggcugucuggucuggaacuuguaaggcugauugagacuuccucaauaugguguauguggcuagagccgggugugggugugaacauuagugcagggcugcauuccagcucugccucuugagaggguacuugacaccuuccugggaagccaagguguuuccuggggucaccuacacagcuucaccuuguccugagugugcccagucaggagacugcucugccuguuguugcaagccucccacccuagggggcagaccuagaucauccuuauccugccugcagggggaacaaaaugaaaggggaggagaauggagaagacacugccaacugucaggcacaggaccucacaagacaagcauccuugugcaugugauacacaugcaagcuuauaggcacccaaaccgaccgaguagggcaccaguauuggccuacaccaaaggucuuagguguuguuggagaucaugacauugagugaggcagcagacugcccugucuugcucaaaaugacugaguucccuaugcccuguuuuggaauaguuugagaucacaccccacuggaguguuuucuagccagccccugccccuugggguagaggcuucaacuaagguguggaggccaacuagguacccuaaagguagggaguagacaggaccuuggucugccuguucuccaguaaagagauccagaauuagaccuguugcacucacauagacucacaaaaauuuauguaaauaaaaacaauacauuaaauuuuuuguguuacauuuauauauuuuauuuuaugugaaaauguuuuguccggaauacauguauguguaccaagggugugcuuggcuccugaagaagucacaaaacggcgucaagucuccugggacuggaguuauggauggccguguggugcuaggaacugagccuuaguccuccccagagcaagaagugcuuugcuuuuuaaaaagauuuauugauuuauuuuauguauaaagaauacaccauugcuuuggugacacaccagaagagggcaucagaucccauuacagaugguugugagcccccaugugguugcugcaagaagggcuaauagcuagaccauuucuccgacccaauaacaaacauuuuuaaguucugucccgaugacucagugaguaaaagcacuugcugccaagucuguugagccugcauucaguuccuggaccccacaugcugggagacaacugacuccucuacguugucuucucugccuguguucuucccaaggcugaccuaguugucuuggagaacacacucugagcuguuggucuggaaaggcuguguguguguguguguguguguguguguguuggcugaugaagacucuaccugcacugaggagcucuucugucuccaguucugcccucccaugaguugcuuuccagaccgaggucuacguuguaggaagguaccagaaguauccuggucacauguaagaaucagccugguggcucuucugaggcccugcacaaccucuggcagagucagggugagagcaggggugaccuuguaggucaugugacucaguuacugacuacaucuucacgcagcacucaggguuaucccauccucacugagcugccucauagagcagccugccccauuguccuucagcugcuuccagcuccucagcgugccagccagagugccaccuucacaccuacgaaaggagacagucucugcugugaggaagaggcacaguugaauaaaagggagaagccauuuucuuggccaccgucagccuccggcuccagcauggccucccucuccccaguugcuuuucacaucugcuuccguggcccaccuguucucucuuccuugugcaccguuccucccaugcuacauucuggucccagggcuugggugcucaggcuucccuuucauccuccucacuccccagacucuggaugcugcagagguccaagaugaucucagcacggggcaguugaggguauguggcuauuguggcaaaaguacauuccagcagcaugcaggccuccacccaaaguguggccaaagucaucuggacuggaggaagcgagucauuuacuguuccauccuuucauuuucagagccucccaagcugaauccagugguggagccguuguccuggaugcuggguaccuggcugucagacccgccaggaguugguaccuuuccgacacugcagcccuuccaguaccuggaggaggugcacaucucccacgugggucagccuaugcucaacuucucguaagugccaccuugcucacgggcugccugggccuuucgauaacuuacagacugaccaaagccaugccaggcaggaagaugccaaagcaccauuagacaugcagaagcucugucuucugagccuggcagcugaggcacaggguugguaaaaaugguacuuuucugcuccguuauacauucuuuaagauguuaggcagacaguacagugacaaauuaguuaauccaagcagaaaagcaauugguguguguuuaauucaaucagcagcgucugucuaaugucuggacaucaguuacucaggacugcugaaggaagaggguggggcugccauuuaccuuugcccugcacuaggugagguguucuagcaagugugcuucucaguggaaaauaauguugcuuuuaagagcagcugaccuguaauuucaagaguagcagaaaggccuaugucaguggcugagugguuuuguagugugucugagccucgaguuuauuccccagcaccucacuauuaaaaaaaaaaaaaaaaguacauaaguuuaaaaaaagcaaaaauguguuccugcuugagucuccacuguagaguucuagguuaagaaucuuaacuaggggcuggcaggauaggucagugguaacagcacucgccuccaauccugaugaccugaguucaagccccaggacccacagugguagaaggagagagaugacuccuccaagucauucacuggcccccuauacacaaguauacacaaucaaauaaaugacacaaauaucuacuaagucacucacuguugcugcauuggcucucucuuuccugaaauacuuacagaagcauuucacauucagauuuuuuaaauuauuuacuuaugugucugugugugucuguguaugugcccaaggaggucagcgggugucagcucacugaagcuggaguuggagacagugagcugccugguguggguacugggacgcuaacugcaagcacagcgugggauccuaagcacuggggcagcucucagccccagccucagaagcuuugguggaggaauauuagcucaggcuuuccuagggaagcagcucuaauucacaaaccccaaaucagaauucucugaaaaccaaaacggucugaauacugauaugauaccauuucggcuuuuagguucuuagggguuuggagcuuuguuuuguuuuaagguccacugugguuguacuagaacuugcuguguagaucaggcugaucucaaaguccaagagaucugccugccucggccuccuuaagugcuaggauuaaggguuugugucaccgugccuaggcuauuuuggguuugaagauuuauuauuguauauauuuuuaauguguaugaagaucucugagucuggugguggaccacaugugugccugguuucugcagaggccagagaagguauuagaucccuggaacugacacuacagacagcugugagcugccacacgugcacuaggaaccaaacuaggguccuguugcaagaggagcaagugcucaagagguuaagaaccucugagccaugucuccagcccucauuugggguuuucaauuuucuaauuagaguuacucaaccuguauuuguuuuuuugugguuacugguuuuauuuguuuaguuguguuugagacagaguaacauuacacagcccagacuggucugaaagucgcuauguaucuuagauuggccucaaacucaguggucuugccuccauuggcagagugcuaacguuacaagcaugugccaccauacccgcugauacauuugccucguuuuauaaauaaaauaugaaaagguauacgaugacuauuuucuggguuuuuuugauugguugguuguuuuugagauggucucucuauguagcccugcauguccuagaacucucuaugagacuagacuugccuuaaacccuuccuccagagugcugugauuaaagucuuauguuaucagaccugacagugguuuuuaaaagggaucauuugauuguaaggcauaugccuauagucuucagcauucugggcuaaggcaggcuaaucaugaauuccuacucagccuaaacuacucagaaagacagcucacaaagauggaggguagucuuaguuaugguuucuauugcuguaauaaaacgucaugaccaaaaguaacuuggagaggaaacuguuuauuucauauuacaacgcuugggucacacuccaccacugagggaagucagggcaggaacugaaacagaagcuguggaagaaugcugcuuacuggcuguuccuuguggcuugcucaguuugcuugcuuagacaacucaggaccacuucucugaguugguaccaucuccagugagcugggaauucuggauaauaaauuaccuagugcugagagauggcugcgguuaaaaacacugacugcucuaccagagguucaguucccagcacccacgugccagcuaacagucaucuguaucuccaguuucuggggaaucucaaauuaucuuauggccuccaggcaucuguguagggaaugccuauacacauaaaacgaaacaacaacaaaaagucuugggcuagagagaugucucaccaguuaagagcacauauuucuuuuccaaaaggacccaaguucgauuccuagcaccuaugucaggccacuuaaaauuaccuauaacuccagcuccagagauccccaagcucugaccuccauagguaccccaacacaugugucauacacacauauauacucaugauaaaaauuaaauaaucuuuagauaaauaaaucucaaaagagucaaguaacauaaugccuguaaccccaguacuugggauaaugaagcagaaagaucacaaguuccagggcugugggccugauugucucagauuuaagaguaaagaggugugggccuggaguggugguuccguggguaagaacucuagcugcuuuucuagaggaccuagguucuggguuugguucccaacacccacaaggugacuaacaaccaucuuuaaguaguuccaagggagcccaugucuucuggccuugcaauuaccaggaauguaugugguacacagacauacaugcagucaaaauacccauacauauaaaauuuuuuaaaauaauaauaaaauuuuaagagagagccaaggauauauauagcucagugguaaaagacucgcccaacaugugugagacccuggguucaauuccagcacuggaaaaaacaaacaaauaaaugguccagauaguauaaaucaggcucgcuccuucuuucuccucccuccagucucucccuccaccccccccucccccuccaccccgguccccuuccgucuccccugcuaggccucguguauaagcagccucugccacugcauuauacucagagcucagccagagccuuuucgguuuucacgucaggcuaugacaguguagaccaugcuggccuuugucuccuaagugcugcgauuagagaccuguguacuauguucaguaugaauaugugacaaagguuaguagaaauuauacccuaauuauauuuaaguguguguuuguguguguguguguguguaaacaguaccuguucuucuauuucuaccauauagaaugauuggguucuuacacaaaaauaagcacuggauuuaauuccagcacuggggacacgaggcagacaaaucuauuuaaagucaaggucagccaucaauacacagugagaccuugucucaaaacaaacaaacaagcaaaagccuuuaaucccagcacuggggaaagaggcaagucuagucuacagagugaguucucagacagccuagacuacacaaagaaacccugagauuuggcuguaauuaucuacaguguuuacagcagugccuaggacugaaacugaaauacacaaguugaaaggccucuggaaaaggacacuccauauuauuaagaacaaguuacuggggccggguauaucugguaugugcuucagacccugccacagcacccgcgugcacacacacaugaucuccuggccuuaagaguuggucagcguggaacaaugaacaggaauggaagaguguuggcaggggcugguagacagcugagagagccucuucuggucagaguagaucaugucccagcagucccauagcuaaggucucuuccauaauggcuuuguuuguuuguuuguuuguuuguuuguuuugcugagugaacuucuccuagggaaacaugagcuaugagcuauucaccccaagucaacaaccaaggacucuaccaagguucagcuuguuacaugucggacauauuacagagcaugggugggagguuacucacaggagugugggugguccccagacagcgacauuaccacagagcacaccccaucauggaugcacccucacagaagcugcaucacagagcucccuuuuaguuagccuuacacuugcauaugcucuagcaucucccgggaucacuugcacuuguuggguggacaggagagaguaaugugcggaaucucagguaacgguccugugcgaaagaauguugacagcucuauuaccguaagaccuagccgucaccauauugcucuguguguuuuauuaccauuguuucugagacacagaaaucucugcuccaagaugguaguaggaugaccauguaauuccagaaggaaaaggcccuagcaccccagacccccaucuucuggcuacuacauuuuuuacucccucuuuugcaagauucauuuagccuuggaaaggugguacauguauuuuuuuuuuaaacauuggcccaccuaugucacuuaaccaggccuuauuuauucuuagcaguguaaccaguuaugagucuuugcaccuuaccagcucucuacaaccaaggccuaauaaacuaauaaagguacuaauaaacucugaucauaaacacagacacguacaaggucauuugauauguccauucaacaaagcaaaacaauccuccugagacguguggccugcccagccacaggcuucuaucugacauacacuaccagcagcaaggugugacugaucuucuacagcgagccuugcagcuaguuggaaggcugcuggcugcacucagagucgucacagcuacuguugugccgugagcaagccuaccuggcaguuugauaguguagcucucgguacauguaggccaguaagaucguugguggcaguucuuccagcggcaaagccagccagcauggaaggaggguccggcugagucccagcuugauuucuccacguucugcaaccaaagccugcagugucaccagcaggaugauccuaccauccagucagacacauaaccaacaagaguggcaacacuuuuaugaucuggggagccuccauaacaagcagcuguagggagguugacaccuuguagcuuuuggcauggucccgcucugcaggaugcacucuguuagccugguuagcugcuguuuuuucugcuuuucagauggcuuucuaa

SEQ ID NO: 309 - RNA, 39113 nt, Mus musculus
auacagagucucaggcaggaaugugaagucccugccugacacggaugaaggagcagaugccaggaugagacuaggauggacagguaacgggucacguggagggauguggggugggaugugggccaggucaguuguuguuggguuggaauaacugagaaucugccagauagagugcccaaagcuuauaguaaugaauauaagucucucuguauccuuauucagagcaaggguaggcauagaaaguccauuaggguuacagauauuacucauagguauggcaaaugacccugcgcacaaaggauggucagagacagcagguagaauccagacaacaagaaauagcuuucacuucuggcagugguggcgcacgccuuuaaucccagcacucgggaggcagaggcaggcagauuucugaguucaaggccagccuggucuacagagugaguuccaggacagucagggcuguccagagaaacccugucaaaaaaaaaaaaaaaaaaaaaaaaagaagcuuucaccaguggaccacugaccaaaucaucugguaccugaaaaguauguuucugggugcuauaacccuaaugagaagccaggcaagagagcugggagcaagagaccaggagauaucugagaggcccagcuaaaaaccaaccacagcugagcucaaguagcuaagaguauaggaaagagcuuuagcauaaagacccaaaagcucuagccaggccuaauggugcacaaccgugacaucaguuccucugagguaggaggaucccauggcuaacaucugccuaguuauagagugaguccaaggccugucuggcagaguucagugucaucguucaauacacauaaggccagucucuucugagauuuuugucucaaagcaagacaaacaaaagaaaagaacagagccgggcgugguggcgcacgccuuuaaucccagcacuugggaggcaaaggcagguggaucucugaguucgaggccagccuggucuacaaagugaguuccaggacagccagggccauacagagaaacccugucucgaaaaaccaaaaaaaaaaaaaaaaaaaaaccaaaaaagaaaagaaaagaacagaacagaaaaaagagcagggagcauggcucccugguaggaguacuuuguaugucucgccuagguauuucucuuaguaggcagcaaaaccuccuuuaggagccuggguaaaccuuugggaaguuaugcugaaugugucagucauagguuagggugguaguguaaaccuuuaauccuagcaguugggaggcaaaggcaggagaguucaaguccagccugucuacaaaugaguuccagaacaaucagggcuauggaaagggacacugacucaaaagaaaacaaacaaacaauccaaggccagguggugguggcccaccccuuuaauuccagcacuuggaaggcagaggcaggcagauuucugaaaagaccagaacaaacaaacaaaaaacccaguuguucuugguggcucaugccaguauuucccgagcuugggaggcagaggaaggacgucuacaagaccagcagacuaaaacaaugcgauguaggccaacaaggcaauucaaugagacauugucucaaaacacacacacagacacgugccugugcacacacaccaaaacaccccaaagacaaaaaugguaaauuuuauguaguauuuuacgucguaagaggaaaacugggaaaaaaaaauuagauguucaauaacaugcuuaguaauuucuucccucaucuaaugaagcuauuuaauggucacuuaaggcaagauuugugagaccaaacugacuacacaugguaggcuuucucaggugcucagagcuccaccugagcuuuuccagucucgaggaaccugcuguggaccaagacuggccuuaauaggauggaucuggacguuguaagcaaugugaucuuauaaccuuuaucaguguuuagugagcuagauuucuggaguuuccccgccccaauuugggcacugucuacccauauaccauguuagaacauggggaagccaacaucaguccuugcaacacugccucauuuucaacuguuaacaaaacuucuggggcauguucuaugugaaauuguuacggaaacauucugguugacuuguaagauuguuuaacguuacuagguuuuguuuugaaccaggucuuaaggacuggagacuuaauguaacccugugaacuuucaacagauacgugccauucccaucuuuaaauuuuaacaccaaguacuaagagguggcaggaugugcgaagugacuuccaaggcagagucccuucgcucgcuguucacuccuguuggaaaucacaggagaggaccaacugagggagucucgaaagccuuuggaaggcgcggcccgcacaagggccaccgagaacccccuggaaagcccuuuccacggucaucccccgggccucugccagagugcaggaugcgggaggugaucggugccagugccugggccgcaggaccccauaggaaggcgaugagggcuauggaugcaggaaguagagcugcgugcgccgggccgcacuccugccacacaccuccgggcgggcuugccccgccgaggcaagaguggagaacugcccgaaagcaaagaucaggauuaaccugagaaggcgcccuugcagaauacuccugaaauuggcagggccagcccaaaucagugcgacgcccguugguggagguggcggagggggccuccggccgcucugcccgaggcauggccgugcugguccccaaagccggcgguccaagccaaggucauaaagcuccacgacccguccaccucccacaguuacccucgguuagccggccccccacucccgguccccggagcucggcccgccgcgcggccucaguuuccccgcgggccccggccagggcgggggcguggcggacccggaggcgggccgcguaccuguggaaggagacagcgcguuucucgcccuugcccugccuguuggaacaguucacggccgcgcagcagaucaccauugcgggccucggucgugagcgccgccaggcuccgauccuugccgcccgcccgcuggcccgacccgccccgagggagcgcggcgacacagcucgggacgugggccgcggccgagccguacggcaagauggcugcgcgcugccgcccgcaccacgcugcgcucggacugcccggccacggcgccggcgucgcggccgcagcgggcggugaguccguaccgagacaugcgcggguggcugucuguacggaaagauggcggcgccggaggagcgcagcucgggccggcucccggguguuccgaagcggcggcgcgggccgggggcggggcggccgcguccgguuaggaaccacacgcgccgaggccccaccccccgcgugcccaccgccguacggcgagauggcgacgcccgcgcuuccgcugcgccgcgcuuggcugccgcggcuucccgucgccgugucgcgcaguaguccgucggagcgacggcacggucagucggcagccggacagggaagauggacgcagguaaggagggcggacgccugcccugucgcgggcgggcucccguggccgcccgcuggggcggaggccgguguguugggcugggcgggccgcgccuccccgcagcgcucaguaccggguucgcggggccacucgucagcgccucggccuccggcgcucggccgcggcccucggggagcgucccagccugugggcucgcggcugcgggcgugagggcagggagucugagggacgcaucaggacgcgggcacccuggugcccggagaggaccggugcgccgcgagggugggccuugcgguguccauugaagagccgaccucuuuaacuucugucaaguuguuggccgcugguccagcuaccacaacaugcacaucuuuugucuuugaaguucaauaaccuguguaggugagccccgcuccuguucugacagcggaucagucacaugcuacuuugacuucuugagguccuaauacuggguuaaguguggguggguuuuguuuguuuguuuguuuguuuguuuuuaacugacucuugcuucugaagcuggagagugcgguucuuuguuuauguuggccagaagucuuggagaugcaaaucuaucaaauaaguuguuugcuaauagcccuaaaaauacccaccccaccccauuccaccccaccccacccccaacagagguucucucauucccucagcagcguuagcggguuuuuuuuuuuuuuuuugguuuucuuuuucuuuuuuccuuuuuuuaauuuaagagcgaccugccuucaagaauccacuccuuugugaaggaguccugcuaccugauuucauuguacuuuucuugaauggcguugcuuuugaugguuuucuucugacagcuguguuagagaaguagucggcucuuacuugggaguaaugccuacaguuaauacacauuucagcaguuuauggcauccguagcuggaggaagcaggaacguugacuccccaagaugcaugagccagguguauauuuuuuuaagauaauucauuuuuuuuuuuuuuuuagaaugaauaacugaagcugucacaccacagugccucuuggagguguggaaugggauaauacauugaauuacuuaauuauccucucccccacuuuuuuuuuuaaagacaaggccucacuguuuagucuugucuaauauguagaccaugcugacccaagacucacagaaauauaucugcuugcuuguacauccccaaugcugaaauuaaguggguguuuaaugcugcugugagaucaaacucaaaagacaucuguguuugaagacuuguguuaauggugauaaaacacuuuuuuuuaaauacaguaugauggugcaauuuuucuccugauauaauucuggguggcauuuuaugaucuaccuucugaucucccaccacccuuguaauguugcuucugguuauucuuauaauugugugugcuguguuuguguguuuucucucucuuucucucucagcaguaucucuccacaaaacccucacuguacuagaacucaggauguagaucaggcuggccuugaagugcuggacuuaaaaagugugagccauccugcccuaccuaccuugaucuuuuuauaaacuacauuuguuauuggguaucaggaguuucaaucuagacauuggacuagaaaaauggacaaaggaaaagaaaugcugucugaggccccugacauucucuacaggagaccagaaguauauaggccuggauggugcuuauaugggagagugaugugggcuagguuauaggugacuggaacuguagcaggauggacaaaaacaaaucucacuuuggaagcauauuuaaagguuuuuuuggauaauucauuauuuuccccuuccccuacuccccuccaucccaucuuaaguacaccuaccccaugcucugugaaaguacauucuugucgagacuaaaccaaaaacuaaaccaaaaacaaaguggcauggagguucaugccccaggaguucagugagcuggaggacuggagagaugguucagugguuagagaacuaacuuacuggucuucuagaagaccaguucaguuccuaguaccuauguuagguagcccauaauccccgggacucuaguccaggggacccagugccuagggcaccacacucacaugcccacaugcagacaugugccuacacuguugguugguuuuggagauggguuucugugcagcucuggcugucuuagaacucacucuguaggucaggcuggccuugaacucagagaucugcuugcccugccccagagugcugagauuaaagucaugugcuaccucccuccucccacacccaguuuagguuuuuguuguuguuguuuaaguuucaccaaagauggugaaagaugauuuagguucagucaugaauccuugcugggucacugugaggacucacaaguuuauucugaguaggacuccuugggagguuuugagaugaguaugugaaauuuaacagacuugcuaugggauuuuuuaaaaacccaacauuuuucuuauauaauuuguauuuaucuuuugagauuaaaacauaaucacaucauauuucccuuuccccuuucuucuucaagccccucccagacauuuccuccuugcacugugugugcgugugccuguauuccuuaguauauaaauaaaaucugcuuagucuguauauuguuauuugcuuguuugauacuggggaggcucuucaaaggaagacuuucuccuccuacccucaccguuccuugguugacuguaauucuuuuucugggguuggggccucaugagaguuccccuuccauguuagcaugccuguugguguugaccuuguucaggucuuguuuagcagcuaugauaauuggauucuggguagcuucucugauauucuaagagaugugaucucucagcaaacuucccauucuccugacuuaaggguuuuuggcccugccuucccccauagucccugagcuucauugcaggaguuguguugaagauuuaacagcuggggaugggcaccacauggucacuuguucucugcauuuuggccaguuuguucuuuuguagcgguuuccauguguugcaaagagagguucccuuguugagggcugagaucuacacuuaauguggaucuauggggaaauaucuggacuguaguuaggaauuaugcugguguaguaaaguaacaauuauagguucuccaggucccaggcauguguuccaucuuacugagcaggggugugugcaugugagugugaguuggguagugcacaugcacacaugcaguuacaaaagagcagaagucaggauaaagccuucuuucuaccauguggcauugagcucagguaucaggcaagagcuuaaccaucucgauggccuuguucugucuuuuuuguugagagugcacugaagaggguugaagcuggaagaaacauaagguaagaccugcuucaauaagacauguagagaggugcuguaaacuuggagauaauagauucuagaugggugaugaaggucaagacaccagauuuuuauuugcaagcuggaaguuaagaggagugggauggcgcuggguuuuacuguacacgauaaggaaauuggaugagggcgggcaugcuugguagagacuugguuuugguuuugcugagugugagguguguagcuggucuuugcuacuuuguggguucaucucuuucacccuucuccaccucuuuucuuccacccuuuuccuaauacuauauaggagagaaaaaaggauaggggggaagggaagaacucccugaauaaagucagggggcagaaaaguggcaccaauaucauuagacugcuuccugcugaguggcaguucuuuggggagaguuugaucuuuaccaucaggauaucuaauuucuuguuucuucuuugacuacuuagcaaacuuagaccaacaacaacaaccugcaacccaccauaccucucuggggcccuagcauuuauauacccucuaaaaaguuccuagaauuccaaaugucacauaguuguagaaauuaucugcaguggcaaaacugugcuccugcgagagcaugaggcaaaucauagcuacuaugaacagucuaaagcagccucauauuccacaccuuggauuaaugaaaauauauucuuaugauaguuauuauuuuuuuuuuuaagaaaccaaaguucucacugcagaaguccuuguuaggugaccaaguagcguuguuaaggugccauugguuacauagucuuggagcuaaaggaaaaagaaagcugaagcagaaagcuguuaacagcuaaauuguccagggucugcauguaaauagggaaugagagaggccaggagggaguccaaggcuuccaguauggggaaguggaaggcccaagugguuugguucuccucuccaccuauaucccagcacuguguauguaaacaugcuccugguucaaagaaguguuggugauuaggggaaugggucagucaguagaguacuuauugaacaagcauaagagucugaguuuggauccuuagcaucucauaaaagugaagugcaguggccacuggucucuauacacauguauauucagucugugggacuuaaaugaaugacuuagcuauuccucuaccacaggaugaaaucccuaguggaaauuuaguauccaaaaugcucaguaauugccaaucugaugcuagguauggaaaaacuaucugagcucaugucaaaagucucacacuggggauguaacucaguggucgaguacuuuccuagcauguccaaggccuuguuccaucccccucaaaaaagggagagggcggcaguggggguguagcuuaguugguagaguguuugccuacuauucacaaagucuuugguuaaucccuagcauucagugcacuuucccagagaugcugucaggcagagaaguucaaggucauccuugauuaccucuggaguucuagaccaaccugaaaugcacaaaacccugucuacaagcaaacgaaaaucaugaaaugccccaaaaucuuugugccagguauaguaguguguaccuguaaacccaguacuuaaaaaguugaggcaggaauuugagaucagccuggagucuucugagauccuaucuuaaaaacuggauauggugacucaugccuauaaucccacaacugaggaggccuagacaagagauucucucacaaguuugauaccagcuugcauuacuuaguuccagguuaguuugaguuacaguaggagaacuugucucagcaaaacaaagcccauggcuuaucuaguggcccaagccuauaauccuagcuucuuaggggacuaaggcugucgcaacccaccaguuuccuaauagucauagagagacuuauauuuauuuaguaagcuuaggccuuagcuggcuaccucucagcuaguuuuucucacuuaaauuaucccauuuauucuaaucuacauuuucccacaugacccauuacuucucucuguuccucccuccuugaaucaaugaugccugauucuuucccugaguuccuaucucugcauggaagaccugacaauccucuccugcucagcuacuggccauucagcucuuuauuuuauuuuuuuauuuuuuauuuuuuuuaaagauuuauuuauuguuauauguaaguacacuguaacugucuucagacacaccagaagagggcgucagaucccguuacggaugguugugagccaccaugugguugcugggauuugaacuccggaccuuuggaagaacugaacuccggaccuuuggaagaacagucgggugcucuuacccacugagccaucucaccagccccauucagcucuuuauuaaaccaaucagaaaaugcuuaggcaggugaggaaggacagagacacagcuucacaaguguaugaaaagauuaucccaacacaggaggaucacaaauucaaguccaucuugggcugcaaaguguuuaagacuagcuuuaaucccagcacuugggaggcagaggcaggcggauuucugaguuccaggccagccuggucuacagagugagcuccaggacagccagggcuauacagggaaacccugucucgacccccccucucccccaaaaaagagacuagcuuguuguaucauauuuauuuauauacauauuuuuuauuggauauuuucuuuauuuacauuucaaguguuauccccuuaccugguucuccucuccccccucccccaacuucuaugaggguguuccuccacccacccacccacccccuucuccccgcccuugaugccccuacacaggggcaucuauccagccuucaugggaccaagggccucuucucccauugaugccuuacaaggcuguccucugcugcauaugcagcuggagccauguguacuuauugguguaucauauuuauuaacgcuauucuuauuuugaccuggucagccucccaauaauugagucagaaucuuaucgauuuauuuaaucaguuuuagcauaaauacugggcgauuaccccuaaacuauuucucuacgcuagacuggcuauuuccuagcugcguuccccaaguuacuuguucacccgguuuuuaugcuccaucuaucuauccugaggguccacuucuuuuggucuugugccccugguucaucccaucuaauagagaccucccgcuuucccaucucucccucccucccuauaaccccuagucugauaacugaaaccucacugaccucuauuuucuccaguaaguggcugucagccacuguuauuuaaccagucagagaagauuggugagcagaauuuauauaacaucuuugguaucccugagaaugugugccuugggacuuuggggccagugguuagcaucugacuucauagcagcaucagaccaaccccuaacucuagcuagcaugagcuaaccuuuuucuuccaaaauaaagaauaaaauaagagauagagauguaccucagugauagaaugucuacuuagcaugcaugaggcaccagauucaaucuccaguacuguaaaaacagcaggaaaaaaaccagauuuauuuuaaaccaccaucauauuaaaagaauuuugugaaauuacuuucaggugcuggagagauggcuuagcaguuaagagaacuugaugucaguucccaguacccagccuucuguaacgcaagcuccagaucucaugccuucuucuggcuucuguaggcaugacacaugugcaugcauguguauacacacacacacacacacacacacacuuuuuaaaaaguaucuccuggcuauguauaaaguguauagaugaaaccuaaauaaguuucauaauuuuauuugggucauagugcuuuuucuaaugagaucuuguuauguauaugcaaauaucccaaauuuaaaauacucuguuccaguuaauggaggcuaacuuugaacuuauccuucugucaaauuacagacugggauuauaaaugguucacccauaaacccauggcauuagagaacugaaggcuuucuguaaacuauguaagcauucuaacugagcuauguccccagccuccuagcacuggacuuugauguaacauucugucuaguguguauacuaaaguggaguuuucuagcuuuguggcagcuaaaaauuguuaauuuuuuuuacaugaaaacuauuauuuuuuuugcaauaauccgaacccuauggaauuuuuuaaaaaaauuauuuguaugaguaagcuguagcugucuucacacacaucagaagguggcaucagauuccauuauagaucguugugagccaccaugugguugcugggacuugaacucgaguucuggaagagcagucaaugcucuuaaccaucuuaagccaucucucuggcccugaaaaccauuaucuuaguccuaagaauuuuucaaaggaaagaaagacuccuaguagggacuugcuguauaucccaggcuagccucaaacucaucauccuccuccuucagacucccaagugcuggaaguaaaauguaaggauacgauagauugcuguaaucuuuaaaagagacuugcuggcugcauguuuuugugguucuuccugcuugaaugauaguguaaucugugguuaaguaaaaagguuaguuccauuuacugaguauaauucccuauuuuucugacugucggauaaacuauuaaaucauaguacuaaacugucaugaucacagaagucccaguaagaggguauggaagucagacaccuagggugcuugaccaaauaagaguucucucauaggacagaggguccuuagauaccucacuaaaucuuucugcgugucgacuaauggcaaauuuaacuaguugcuugggcguuuacaaacuguuacaaacucuuuaagguuuaccucucuggcucaggagcuguauuagguuuuuacugcugugaacagacaccaugaccaaggcaagucuuaauaaaacaacauuuaauuggggcuggcuuagagauucagagguucaguccauuaucaucaaggugggugcauggcaguauccagacagucauggugcagguagagcugagaguucuacaucuucauccaaaggcugcuaguggaagacugacuuccaggcaauuagggugaggaucuuaugccacacccacagucacacacccauuccgacuaggucacaccuauuucaacaaggccacaccuccagauggugccacucccugguccaaagauauacaaacuaucacaggagccauucaugaugcuuuguaagugaugcauguugggcuauaaagaggcuuucacuagccgggcagugguggugcacgcuuuuaaucccagcacuuuggaggcagaggcagguggauuucugaguuugaggccagccuggucuacagagugaguuccaggacagccagggcuacacagagaaacccugucuugaaacaaacaaacaaacaaacaaacaaacaaacaaauggcuuuaacgagacagcgcaguugaacugaaaaaccucuguggagaauggugcccagagaguccuuugcuggugaacauguuagagauugugagcuuagguuugcacuuguucuggguucucauccccuuggacagagcuuguggugccauuucuuaaguggggugacugaagcuuagagaaguguggcauguagcuauauggcuccaaguguggccuaucuccaaaccucagucaccauuagagccccaguuugaaaagguuccauuuuuuuccacugaaaguagauccagaaggucagaagugucucuucugcaucaguuuugccuggauaaugcuuugugaaugucaccucaaucaugugcuuguuuguuuguuugaguugacacuguggguaugcccagguaaggugccauauugcaugaauggugguguguguuuucuuccugucuuccaaaccagugggaugccugcaacaacaaaaggcuccucuccucuccuuuccucuccucuccucuccucuccucuccucuccucuccucuccucuccucuccuccccuccccuccccuccccuccccuccccuccccuccccuaggagucagucuccucuccucuccucuccucuccucuccucuccucuccucuccucuccucuccucuccucuccuccccuccccuccccuccccuccccuccccuccccuccgugugugugugugugugugugugugugugugugugugugugugugugugugguguguguguguguguguguguguguaugugugagaugugugaguuuguuccuccuuuucuuucuuagacaguuuuacuguguaugccuggcuggccuggaacucacagauauccaccugucucugcugccuauaccaggacuguauguuuuucuugaggaaaguuuguuggguuagaaucucuuuuggugaagaaacucacacauuugcuuugauacuucuguacauuguuacauuuucauauaggaacagaauggauuucuuuacauacuuccucauuucaaggauuggaggcuagcccugugaaaguaugcuuaugucauucccuggaugguucagagcucuagaaucguacuccucagcccagugaggaauguacaccguuucuacuuuaccagugaggaaauggagauucagaaaggauacuaguucaaggggagcacaagcuaguuuuugauggccucagacuccugguuccauagucgggcucuucccacacuacacugcuaggaaugaaggcucuaucuagagagugggacagacauagcuccuacuccaucuccucaggaacagaguaaacccuccugacaugaggaggagcggagaguagcguaggcgcagucugcagcuagacuggggacaggccauucaccguguggagugugggauucuguuggaggucugggccuucuuuccacagaccaacgugacuauuguugcuucuugggugcugugaaguuggugggagcuguguuggccucuuuuuaguucuguuccucucugguuucuucacacccagccuggcuuuugauuugucaagcggcacaacccauaauuuucauaguuaugauagacuugguaauauauuugaauuuaauagagcccuacuuacuguuuucgcuuugaaguuggcuuccuuaccuauaaagauugcuaauaaaccuaagaaauuugccuacguuguguuuugcugcuuuagacguuagagauacaugaugguuucugacuucuugaaaccaugaacaugaauguuaauuuaucauaauuuagccuuuagcaucauguacaugcauaaucauauguaaaaaaaaaugggagaaauuaaguugggcuuaaggucaccaagcagguugugacauuguuuugaaaauagacaguugaaacauagaacaaguucugagaccaggcccaccgggccucugcccugcucugagcuucagcaaagcucuguccgugaggauuugucaguguggucuguacuucugggauauacucuagcacucugucauuguacccagggaagccuugugggcauagugacauguauaugcuuucagcucugugauucugcaagacguccuucugucugccugcagagccucaugggaaaucucucaugaaggcaucauugcaguguggcaaaccugcccuguuauuauaucauuuuuauggaugagugauuguuuauacucagaacuuauauaaauggcccaagagccuauagcuugugacugcccuagggagauuuaaacuuuggcuaccagguagugcccaccuuugucuuauucuguccuaagcauggaaccugagugcacuggguaucugcauccaugguuuauagcaggugguuagaagaauccuagaaggcaccuucucuugggggguguagcuuuguugguugagugcuugucuagaauacaugaaaccaguaugaaguucaguuccuggccuuacauaaacuuguguggugguauaugccguacuccuagcacuuaagagguagaggcagacagaucaggaguuuaagguuauuauuggcuacauuucaaguucaagaccuaagauacaugagacccuaucucaaaaaaaaaaauuaagugggguggugguggcacauaccuuugauuucagcaugugggagacagacacagguggaucucugugacugugugaccagcuuggucugcauuucaaauuccaggacagucagagguauguagagacccuguuugguaaaggaaaaaaaaaauuuuuaagucuuaagucucaaauaaccaagagcuuaccuuuuuuccuugagggggagucuuuugcuccuguuuccuaauguugaucccaacccaaaguuucuuccuauccugucagcugucaaacuuccaucccuaacuuuuaucagagcaacuguuuagcagacugucugucaugugugcucauauauuugcuuguggcuauuagggaaagaugcagguauugcaagaaucuuuaguacagaaaugguauacuugaagcauggaguuuagcuacacugcuuuguucucucggcgggggcgggucgcgcuuccagccacucacccaggaacucuuuggaucuuugaaugaaacacacacacacacaguagcugauuuuuuguuuuuuguuuuuuguuuuuucuuuuuuuuuuuuaaagauucauuuauuuauuauauguaaguacacuguagcuaucuucagacaauccagaagagggagucagaucuuguuauggaugguugugagccaccaugugauugcugggauuugaacuccgaaccuucggaagagcagucagugcucuuacccacugagccaucucacaagcccuguuuuuugguuuuucgagacaggguuucucuguguagcccuggcuguccuggaacucacuuuguagaccaggcuggccucgaacucagaaauccaccugccucugccucccaagugcugggauuaaaggcgugcgccaccacugcccugcauagcuuauuuuuugaaaugccuuggcuacucaaaggcugggaaguuuuaauccuccuguggcuuuucccucugguacuccuggcucaacaucuucuaaaucuaccuuuaacuuugcugcccuguuaccuucuuugaggcccauuggucuuugcugcccaagauggaagggugacccuuccuggggguggggggagcuuuccuucuccuagguuuuggauuaucuucccucugcagcuauaaaucugauccgucuccacucccauggugauucuguuucuccucucccccgcauccuagccugcacaaaucuaagggucccgucucaucucccuuugcccagccauuggcgucuuuauugaucaaucaaaaaccgauucggagcaaggacuuuuagugucuggacaugcagauucccaauuagggaaccaaucaauucaaagcauuagaaccaacccccaacauacaauggucuccaugugaaaucagacaaauguguuucuaugguuuccacagccacuuugacauaugauacucuccgguuugcugaauuugaagauuucccugagaccucagagccuguuuggauucugggcagaaaauacagcauuuucacagguauuguccucugggcucaaaauacucugcagaacucuugagauggcaguugucugcugccucucacuuuguguuugucuuuucuuuuaaauaauuagagaaggacgaaaucuugucugauguugcauccagacuuugguuuacauacaggagaaacuuuccagcuauuggugaguaaucuuuauucuuucaaaugcuuugguucauuugcuuuuaaucucugugucuugugaaauggggguauagccacaugaauguaggccaaaggacaaccuaggccuucaguucuugcuuuucccccuuguuugagacaagugcucuuauucaucccuguguaugucagucuagcuggacuaggaacguccagggauuccugucucuuccucucaucauucuguaggagcucugggauucagaagugugccgcugcauuaagcuacauguagguuguaggaauugaaugcagguccucgcacaggcaugucaaacucuuuacucacucagcugucgccccagcucaaguauugaaaugcauaugcuuucuauuuccuuguuggcaacgugucacuggauuaagaaucaugacaauaauuuuguuguuguuugguugugugauuguuuuugagauaggcucugugcuggauagguucuuuuguuuguuuuucuuuuguaaaacuuaacacaaaaaugccuccauuagauuugccuguaaguaugagcauuuucuugacuaaugauugaugggguuggggguggaauagcucacuguggcugguauuaccacugaacagguaggccugaguuuuguuuaaaaaaaaaaaaaaaaaaaaaaaaaagcuaagcaagccauggggcaggucauuauaagcagcauucuuucagggccucuguuucagcuccugccuccagguuccuguccuauuugaguuccucggcuucccuuagugauagguugugaucaggauguguaagccaaauguuacuuuuggucacaguauuuaauauaucacagaaauagaaacuaaacugugaaguggaaacuuuaggguucuuuggaaagucgguuggaugguguuuuguuggggcaaacacgugaaggaaccuuuguuaaagagaacacaggugugaaaagcuaaggccgacucaugaaggaacauuuagcucaagaagacacgagagaagauguucuacuaaaacaaacaugugaaaggacugucuuaguuaggguuuuacugcugugaacagacaccaugaccaaggcaagucuuauaaaaaacaauauuuaauuggggcuggccuacagguuugguccauuaucaucaaggugggaacauggcagcauccaggcaggcauggugcaggaagagcugagaguucuacgucuucauccaaaggcugcuaguggaagacugacuuccaggcaacuaggauaagaguuuuaagcccacauccacagagacacaccuacuccaaccaggucacaccuauucuaauaaggccacaccuccaaauggugccucuccuugguccaagaauauacaaaccaucacaagaacacaugaugaaagauuaacgacacacauauauuagucugccuuauguugcauaguugagcugcauuugucaggacuccauagagagaaucacaccaaaaaacuucuggugguuuacugcaguuuguugcugcuuccaaggacucaagcugauuggaugcaugugcuaugacaaaauacaugcuaaggcaaugcacaaggaggacacgugaugcuuggaggguauaaauaggacuccacggagugacggagacagagcuugacuuguugguacagcucacuguguguaacacuugugggucuccagucuuugaugaucuucucccugagagaggcacagccaagagcuccucuuggcauuucuucuggucccuccugcugacugaagccaaagcugaggccuggcugucucugauagguugucacugcuguugcuaacccagcucuagcaaacuggacugcugguguaucugugaaguguuugugaguagaucaagcugcuguugccugcugaccugugaacugaacugcugauuuccagacaacacagacaguugcuucaaaaaaccuuuuuacacagguccacuucccuguauccuuucuuuaccacuucccuuaguagguuguagguuacaagggagguaaaagcauuaaagaaccaucauuaaaaaaaaaguuacgggcuggugagauggcucagugguuaagagcgcugacugugcuuccaaagguccugaguucaaauuccagcaacuacaugguggcucacaaucaucuguaaugaaaucugaugcccucuucuggggugucugaagacagcuacaguguacuuacauauaauaaauaaauuuuaaaaaaguuacaaaacugggaccacaaaguuacaaaacugggaccacaugguaaauagugacugccaggacgcuggauaggacaccauggcuagagagcagccuucauuguguggccagcucugaacauccgugaggcaaggucucuguguuguuucuguagcuaugguaaacugcccugacaaaagcauaguuggggagaaagggcuuauuuucccucagaguucagguuauaggcuaggccaucuuuguagggaaguccagcaguaggaacuggagacagcugaacacagcauauccauagccagaaagcccagaggaacuggucagcgccugugugcucagcucacuugcuuuuuaacacaauguagaacccaacccagggacuggggucucuuucaagcugguuuucuuucuuucuuucuuuucuuuuuuuaagauuuauuuauuauuauaaauaaguacacuguugcugucuucagacacaccagaagagggcgucagaucucauuacagaugguugugagcuaccaugugguugcugggauuugaacucaggaccuucggaagagcagucagugcucuuacucacuaagccaucucaccagccccucaagcugguuuucuaguaucaguguaauaaagacuccccuuguagaugugcccauaggacagcccaaucuagaaaaaucugugaugcucuaaauaagaaugucucuccccccaaacaaaagagauuggccccauaggcucauuugcuugaaugcuuagucuccaguuugugaaacuuuuugggaaggauuaggagguguggccauguugaagguguauaaguuuccaaagcccaugcuaggcuuaguuagucugucucccucucccucucccucucccucucccucucccucucccucucccucuccucccucucccucucccucucccucucccucucccucucccucucccucucccucucccucucccucucccucucccucucccucucccucucccucucccucucccucucccucucccucucccucucccucucccucucccucucccucucccucuauuuuuugaucagaugugagcucucagcugcugcuccaguggcaugccuaucugccugccuccuugcuccccaccaugguguucauaaacuaacccucugacacuauaagcaaggcuacaguuauguuuccuuuuagaaguugccuuggucacgguauuacaucauagcaauggaacaguuacuaagacaaaccuucauugagaucucuuccugggugccuuaguuuuuuuuuugauugcugugacaaaacaccacaacugagguaacuuaaaaagaauguugccgggcagugguggugcacgccuuuaaucccaguacuugggaggcagaggcagguggauuucugaguucgaguccagccuggucuacagagugaaacucugucuugaaaaaccaaaaaaaaaaaaaaaaaaguugcaccaccuaaccaggaguguuaaacacgggggcaucuucucauggaggaaauaaaauauuuucauuccauccagaaagcugggagaagauggccuuucacuauccauagaggcagacuccagccuacucccccagaauguuuauuccagacucucccucccuagaccuuuauauuuagcucccagucaauacaacucauccuuaggggagaugcaguuuauggccuccugaucucugugguaucuuagucagagacugcaguagcuucuaggcuuuuaagcaauaauaguacccaucuuuaugaucacauguacuuugcaaaguaguuuucauguagucauaccuuaagcuuuauuguggaccuggaauuggaaugauuguugccuggaaacuuucccuucagauugaauuguguuuaaauaugcuggcaauaaaugcuugcaucagacuugaagcuugauccagacuaagaugggcucaauugaguuuuccuucucaguucuuuguaauucaguuuccuugccuggcuugaugcuugcagugaccauuauggcagggagcacagaaacaggcaggcaggcguggcacuggagcaguagcuaagggcugguaucucagucuaacuaguaggaagcagagagagcuaacugaaaauguccuggguuuuugaaaccucaaagccugcccacaguaauagacuucuuccaacaaggccccgucuucccaaacacuuccaccaacugaggaucaaguauucacacuuuuccuguggggcucauaccagguuauugcagauggugucaacuuggcaaaacuagccugcuauaguuaaagcagcucaucgugguccuaagaaccaagcaugggcuguaugcuucuugaguauuguaaagaugacuuuuugggcuguggugacagguauagaaauagaaaacgccugaguuccuuguucacuguucgcaucacaucucugccucuuauuacuacauacauaggcuauaaacagucuuuuugucuacuuuguggguuccuguuucuaccacccuuuuccacccuuauccuuuccaacucuccaacucuagguaggggaggaaggaggcuagaagggaaagggggcauugauauuguugggcaucaaguuugagcuucaccaucaggauauuuuaguuuuuucucgucucuuugcacacaacugugcuauacacugagugaccuuucccugaagaacugcugagagaauucuccccauuccucucauguuaaaagugacuccacaauucuugucagucuuucaagccccagugaguaggcguuaguggaggggcucaacucagcuugaaagaugcagaguuuguguuaaucauugcauugcuaaugacuuuccucauccuuacugucagcaacaguggacaucauguaacucuugaauuuuugcuuucugguacuaggauaugguucuccaguuuuaauucugugucuucuaaaguaaucaagggaauucuuguuugugugccagguguuccuauuggauaugugacugaucauucacauauuuugcccaucuggagagaauuguuagggcauucuacuccccagcauauguccucagaguuguaccuugucugacaaguucagauuuauaaggaggaucagugccugugguauggagcugccucucucugauugugaauguuucuuguucugucuuccacacagggggaacuggcccuacuucagacacaggcugggguugcaugcuucgguguggacagaugaucuuugcccaggcccugguaugccggcacuuaggucgaggugagucacagugcuuacauagaaucuguguaguaagggaugguuaaagcacaucauagaagcuggacauaguggcacaugccuuuaaucccaaccccagggaggugacaaaauaaaaaagcaugucauaggcaaaacacagauuugugugguucuugucuaucagguucaaagcuguaggcucaaucuugaguagcaacaaauuguguggguguguacacgguuccuugccagugaaaaccagggggucauacuuaaaugcuguggaaaguccauuugaaaguuaucucacuuucuguaggaagcuugcagugcucaacacagguuuuuguuuuuguuuuuauuuuugagacaggguuucucuguguaacccuggcuguccuagaauucacucuguagaccaggcuggccuugaacucagaaaucugccugccucugccucccaagugcugggauuaaaggagugcgccaccacugccggcuucagcacaguuuuaaucuuuuuucuuaguauuuuaauucaggagcuuacugaguugcccaggcagaacuugagcuugcaguucuuuuaugucuuaguuaggguuuuuauuguugugauaaaacaccaugaccaaaagcaacauggggaggaaagggcuuauuccauuuuacaucaggucacacuuugucucugagggaaggaagggcaggaauugaaggcaggaaccuagaggcaggacugaaacagaagccaugaagaaguacugcuuacuggcuugcuccuugcggcuugcucagccugcuuucuuagacaggacaggacuacauguccaggauugguaccacucaaccuucccacgacaauuauuguuaaagaguauguucaaaagaauuuuguauaugucuguguugucuagguauuuucuuauugauuguacaucuuuccaaaugacuccagcugugucaaguugacauaaaacuaaauagugcaucuugcuuuagccucccaaguagcugggauuacaggucugaagcacuaugccugugcuuuauauugauauaaauguuuauucuuuugaaaauuagcuuucuguuuucagccuagauuuguuuugauuagagaguauguauacauuugaaauccuggcagauuugacuucuaacuuaaaaaggguucaaaauuaaagucuuguacgucaucugaauauugaacacugugcaaguggaagguuuguuaguuauguaguggucaaacuaaccuucuguguucuguucucaauagauuggagguggacucagcggaagaggcagccugacagcuacuuuaauguccucaaugcuuuccucgacaggaaggacagcuacuauuccauccaucagauagguggggauuaaguuuguccuuggguuggcucuguacaaagggcagacuucuugggcuucccuuaggagcuuucuaaaucucgcagaguuggagaaugggguucuaggccacucucuggucucuagucucugugagcugcucuggguguuccagcacuagcucaaacccaagccuguccuuccccuguacagccugcagugagugacucugugcagccugggggaguuaggcuccucuuggaagguuugcuuugcuuuucucaggaggguuggaguccugcccagaccuuucuaugaagcguuuacuaauguaccaaaagugaggcgcacacacauacacacacucucucuuuugggauggauguguuugcuaacaugggucuguuuccugcagcgcaaaugggaguuggcgaaggcaagucuauaggccagugguacgggccgaacacuguugcccagguccucaaguacguaaugagcccagcccuucugcuucuuggggucagcaugaguucuccuuggcauuuacccuccuugaguacuuauuggcacaggaacuaagguauuccgauucuuugcuuauagacccaggggagaucccugggugacuaugccaauuguucugugauugggauucauguuuaggucagagcccuaguguggcccuguccucugucuugauauacaaauccaucuguaaugagggugucuuagaucugggaccauggcaguuaugguacuguaucugcaggugcuagagcccucuaccucguguguuugucagacacacccacauaagucauaagccuucccaugcuguugagaaucuguuagaguuuguuccucaugaauguuugccuauccccuccuacccucugugccuccgugguuucuuaaagauuauuuuuguauuaugaguguuuuucugcacauaugucuguucacaucauacaugcaaagcauguagggaaggcuagaagacauuguuagaucccuggagcuggaguuaacagaugguuguuagcugcucugugggugcugggaacugaaccccggguccucugcaagagcagcaggugcucugaccacugagccauuuccuccuugcuugugcuccucucccugcaguguguguuuuguuuuuguuuuugaccugauucacuuuucccuguggcuuugugcuuuaauaucucagugccuuuagaaggcucugaaccaauguccaggacucauucauggagggcccuauuccuguugggcugaaagcuaguaucucccaaauaugucucuagcuaugguuuuuccugaauguccccuugccacccuacccugugucugcaauggccaucuccuauaggcuccaccuagacacuugcuuuuuuuccccuguaccugaugcccagucaucccaggccauggcuggcuguguguccuugguuugguuucuuaguggcaugcacacccuuucuauccccuuuaguguccuuguucaaguugugccuuguuuuacuuugcuguugcugugacagaaugccaugaccaaggcaacuuauaaaaaacaaaaccacagcauuucaauuuagggacucacuguuccaaaguguuagaccuugaaauucauggcaaggagcacugcggcaggcgggcaggcacuggagcaguagccaagagcuuacaucugauucaccagcaugaggcagagcaagagcuaauuggaaaugacauaagcuuuugaagucucaaagccuacuccccguagcacacuuccuccagcgaggccggaccuccuauccuaguccuuuccaaacaguuguaccaagugaggaccaaaccuuaguaugugaguguaguauggggggguccucuuugcaaucacugcacaccuuuagcuugugguaggauuuacggggccgccccggugcugccaccuuucacuguggcucugaguagccugaccaggucaccaucaugcuuuggucauaucucuugccucacuucuuuucugucuucacugacaaagagcagucucuugguguuaggauuuacaucuuucuggaaauggcaggucaggcugcuuaucccugcuuacuguuccugucccuggccuccucugcuuuuguagcuaaaucccuuuuccucucuauuugcuugcuucuucuugcuugccuuuacugacauaucagccaagggaagugcugcuuuguucuccugggucuguauccuugcugcuguggcaggcuuaaugaguagugagaaaauaccagcucuccugagccccuuucaaguuucucauuaacgagaaggggcuuugugugguuuuccuagugcagugguucucaacuuacagguauucugcauaucagauauuuacaugacaacucauaacaguaacaaaaccauaguuauguaguaacaaggaaaauaauuuuaugguuagggggucacgacaugagcagcuguauuaaaggguugcagcauuaggaaggcugagaacugcugcucuagagccuucccagcaucggcuucuucucuuacuagaugcaccagguccuuguagcuuagauccuugguaauugucuccauuggggaaugucucuucuugccuucugucuucucacugauugauaggccuucugccccaucccuguagcacccaguuuacauuuuuucuacacaguauggcugcugucugcucuucuuucagagccauaagucuacagccaugcuuccuccuaaucaguugugcuguucauuagauuucugggcugucaguucacaguguaagguguuggaagagaagcugcacagcagugagcuggaccugccuccauccuggugagaccugaguugcuaugccagcuaggggcuccuguccauacugucuccugacaaagggcagcugaugucuucuauguacaacacucagcacaccuccuguuugagucauuggacagauccuugacuuaagccuugaaacugccucaacugucacugcuguggugugaugcucaugcuguacaaggcucaugggaguguucucgcuuucuguaggaaacuugcuguauucgacacauggaguuccuuggcuguucacauagcaauggacaacacuguggugauggaggaaaucaguaagucgcucaggguuuugguuguaggugacagcccaagagggaaccucagcuggagaguuagaguuucaaagcaacaucagcacuuccagcaggggggaagccuaggugaaacaucuguaaacccaucucuuacuguguucacuaggcuaaaggaaagaaaggaauucaggguagcuguuuguguauaugugugcuguaggccaauccaaaguuccaggccaggcaggacuacauagugagacccuguaucaauaaagggaugagggaugggggccggagagaugguuuggagguaaggagcacuuacugcucuuggagaagacccaaguucauuucccagcacacuugagugauucacaaccaaauguguaacuccacuuccuccaauaccuucuuucgaucugcaggggcaccagacaugaaugugaugcacauauguguaggcagagcauauauaaaaauaaaaugaaugccgggcauggcagugccuuuaaucccagcacuugggaggcagaggccagacuggucuacaaagugaguuccaggauagccagggcuacacagagaaaccuugucucaaacaacaaauaaauauauaaauaguauuuuuuuuugaaagaagacaauagcuaauuaaucuuuccuacaggcuauuuccagauuauuuccuagaaaguucaaucuuguaaaagaguucagugaaucacuaccacuuuuagucucuuaaucuaaaaaguuaucuuccuguuuuuuaaauuuuuuuuauuuucaugcaugugugugucugaguauaugugcagcguguguguguguguuccacaguacgggguugucugaccaccagcagacucuaaucagauguguauugaaggcugcauuuccuacauuuagacagaagaaauacugaaggguagccaggcagugguggugcacgccuuuaaucccagcacuugggaggcagaggcaggcggauuucugaguucgaggccagccuggucuacagagugaguuccaggacagccagggcuauacagagaaacccugucuugaaaaaccaaaaaaaaaaaaaaaaaaagagagagagaaauacuggagggugaagaaaagcuguuucuuggcgcucuucugaaaaggggucugcaugaccugggucugcccacacuacagagacuaaauggcugcugcuucuguuuucuuuaagcugcacaugggagccaaugauucagcugacuggauaaagccacgugccacaccauucuggcaaaccugggaguuugaucacuugagcccauauaaagauugaaggagagccagcuccacagugcugccccugauucucacagaugcacugugggacauacugcucucccauauuguacgguuauguuugcuuguuugagagaggcucucaguauguacaucaggcuggcccuaaucucacagaggacccuccugccucugcuaagugcuaggauuaaaacuguauaccaccaugccauuugaaaugguucaugggagaugauucagcaguuaagaguacuaagcuacuacucagaggaccgagguucaguugucagcccccacaucgugguucacaaccaucuuuaacuccaguuccaggagauccaacacuugagaccuugauggcacugcuugcacauggugcacagauguacgcgcaggcagaacaaccauagagauauuuuaaaaaaaucuuuauguguagaaaauguuucucuccuuuuuuuguuuuuuaauguguauacguguuuuguauguauguauguauguauguauguaugcaugcauacuaccugcauuucugguacccaaguaggucaaaaggcauuagaacuccuguaaguggaaugaggggugguuaugagccacuaugugggugcugagaacugaauguggaucuucugcaagagcagcuuguauuccuaaccagugaaccaacuguccagccccuagaaaauuuuucguugaauagggacauuuuuguuuucaaaauuacuuauauuuuaagcaguugggauuuuuguuguuuguuuuaaaugauuuuguguguauggguguuuugccuguguguuugugcacuacuugcgugccuugugccugcagaggccagaagaaaguguuguaucaccuggaacuggaguuacagacaauugugaguugccacgugcaugcugggaaucagaccuucauccuucgaaagaguagccagugcucuuaaucacugagcugucucuccagccccuuagcgccugguuuuuaaaacauuuuuucuccuuggggauaacuucugucucugcuuagcugaugaaaaauauguauucccuuucaggaagguuaugcagggccaaccuucccuguguuggggcggcugcacuuccuacugauucagagaggcacuguaauggguucccugcuggagcugaagucaccaacaggccaucggcuuggagaccacuagugcuucucaucccucuccgccugggacugacagacaucaaugaggccuauguggagacgcugaaggugagucuuuuucaucuauuucaguguguggucagcuagcuguaccucuaagagucaggcuggaucuuauaggugauguugagaauuuaaauaucuauagcucuauaaagggucuucaagcccacucacccuguugcugaaccugacauccggucuucugucucucccagaucucccagguuucuucuaugcucuuccuguguauuuccaauucucucuagagcagugguucuuaaccuguggcuccugacccauuugagggaaguugucuuagucaggguuucuauuccugcacaaacaucaugaccaagaagcaaguuggggaggaaaggguuuauucagcuuacacuuccauacugcuguucaacaccaaggaagucaggacugaaacucaagcaggucaggaagcaggagcugaugcagaggccauggagggauauucuugacuggcuugccuccccuggcuugcucagccugcuuucuuauaaaaccaagacuaccagcccagggauggucccacccacaaggggccuuucccccuugaucacuaauugagaaaaugacuuacagcuggaucucauggaggcauuuccccaaaugaagcuccuuucucuaugauaacuccagccugugucaaguugacacccaaaaccagccaguacaauugaccccuugucaacuugacacacaaacacaucacuauuaagccucaacccuuaguucuuuuuuuuuuuuaaaagauuuauuuauuuauuauauguaaguacacuguagcuguccucagaugcuccaaaagagggcaucagaucucauuacagaugguugugagccaccaugugguugcugggauuugaacuggggaccuucagaagagcaguuggugcucuuaaccacugagccaucucaccagccccaacccuuaguucuuauucaucuccaagaucuuaaauaacuuuaaaagucccacagucuuuacauauuaaaaguucaauccuuuaaaaaauauccaauaucuuuuaaaauccagucuuuuuauaauuaaaagucucuuaacugugggauccauuaaaauauuuucuuccuucaagagggaaaaauaucagggcacagucacaaucaaaagcaaaaauuaaacucccaacuguccagugucugggauccaacucacaaucuuaugggcuccucuaagggcuugggucacuucuccagccaugcccuuuguagcacacacguugucuucuaggcuccagcugcccguacuccacugcugcugcuguucuugguggucaucucaugguccuggcaucuccaaaacacugcugucauucacuguaacuuggcuuuaacaauagccucucauaggcucucuucauggugccaagccucaacuccuuugcaugaccccuucaguucugggacaucaauugcaacugaggcugcacuuucaccaauggccuuccauggccucucacagugcugagccucagcugcucugcgugaccccuucaugccuucauaaccagcaccaccuggguaauucuuacacauuaccagguccagccacagaacagguacaaccauggcuaucucuguaacacagucucugugcucucagaaaacacuucccagaaaaugucaccucaaugaugcuggucucuucuuaaucaccgcuaauuucuuagcucgagcuaaccagcaucaauugucccaguaauauaaagguuucacuuuacuaguucugguaucuuguuaaucacagcugauucuucagccccagcuaaccagaaccacagaaucuucacaaucaaaguaacaauggcccugaaaagagucuuuaauuuucgcucuaaaauuucauaagccaggccuccaucuucugcacuguacucuacauuaucuuccaagcuccuacaaaacaucccacagugcucuuaacaccgaucuucuagcccaaaguuccaaaguccuuccacaguccucccaaaaacauggucagguugucacaggaauacuccacuccugguaccaauuugucuuagucaggguuucuauuccuguacaaacaucaugaccaagaagcaaguuggggaggaaaggguuuauucagcuuacacuuccacaucgcuguucaucaccaaaggaagucaggacuggaacucaagcagggcaggaagcaggagcugaugcagaggccauggagggauauucuugacuggcuugcucagccugcuuucuuauagaaccaagacuaccagcccagagauggucccacccacaaggggccuuucccccuugaucacuaauugagaaaaugcccuacagcuggaucucauuggaggcauuuccucaacugaagcuccuuucucugugaucuccagcugggucaaguugacauaaaaccagccaguacaacaaacccuuucacaggggucuugcauaucagauauuuacauuacacuuaauaauaguagcacaauuacaguuaugaaguagcaacaaaaucauuuuaugguuggggagucaccacaacaugaggaacuguaugaaauggucgcagugauaaggacauuaagaaccacuggugaagaggauagguuggcccauaggacggaaacggcaggugguuuacugagaauuucauccacacucuuccuuuauuucuccuucgccaucacaaaaacaagagacaaagccuuaaauugcaguuucucagaaaauaaacugaggagccacacuugagagcuuuacuguauggaauggcaaugcugcuuuuuauuaaaaucccuuggggcuggagagauggcucagcgguuaagagcacugacugcucuucugaagguccugaguucaaaucccagcaaccacaugguggcucacaaccauccguaaugagaucugacacccuuuucuggagcuaucugaagauagcuacaguguaaucuaucuauuuuuuaaaaaaaaacuuucccuuuucaucaccuuucaguguugagguaagaugaaauauaaaaccucucccuucccugucuuguucugccccugcguaucucuccacuguccuggccacucccucugcuguagguucugagauugcucugcuucccucucacccauuucccauauuuaucugacuucuguuguccuugccccugucccauugggccaggcuggugucuggccacacuaccuguccagcgugccugugcauguuaauccguaagguaguccccugucccaucaccucuccuucugcaguuuucccagcuagaaccguaagccugugguuggacuguacuggaagcucucugggacaugucuucucguuuuucuugugucauucagguaggccucugaagaccauggccuuucugaggcugugcaugguaaaaugcacacuuaugccugcugggcugccguguguagcgcuguguaggagcacucucuucugagugcugugcagagucaguguccucaguggccuucccucuugucuccugcagcacuguuucaugaugccccagucccuggguguuauuggagggaagcccaacagugcccacuacuuuauuggcuauguuggugaguaugguuugcguacucuggguucauagggaugaucuuucucccugaaggaguggauuuuguucuguggugcuguguuuguaccucacuugccuccccucacucgcugugguggcaugcuucccucaccacuaggcacuuugauugcuaccucccuugugucugcugccucuggugggucuggaugcugcucuggccugcucccucccccugcccagcucgggucagcugccucugacuucugcaccguccuuccuaggggaggagcucaucuaucuggacccccacacuacacagccugcaguggagcugacugacagcugcuucauccccgacgagagcuuccacugccagcacccucccucuaggaugggcauuggagagcuugacccguccauugcugugguauguugcucugggucauccugugccaguucugaaguggaaauacagagaauguucacauaguugaggaucccaagaccucuuaccuucccugaggccacucaccugccgaguggcugucacaaccccaguauauucgaguguugacugauugaguggauguaccgguggggggggggggcgguuucugcuauguauaaaacacaaaugacagcucugacaguuugacaauuuggaucugucauuacagaaugacagucaccugaguagacuguuuuuccuuuuaauuuucucaucauuguuccguuguuuguuuacuuaguguagcuugaagaugauucuucugaauguucuucuccaucucugucuugaugauauaguaggguuuucugaugguuugugcaaacccgccucuucaaaauguguuuggaggaaaggggauaaaaaaccaaaaaugucaaaagcagugccauauccaggaagucauugccuagucaggcugcuucaucacgcagcauguccagugccaaucugcaacgaucacaucaguacacacugccacauucuaaggagaguaaucugggauucuguggcucagacuuccugcagagcucacuggcaaacuccuaaguuaagcaguguguguaccuuacagugagugcauuucagcagcucacagugacugcgacuuaggccaaauagacagccaaccuuagagaagaagcuagacaugugugacuagcagguggggagaacaugaaguuugagccccaguccuagcuuuugagagcugaagucacagggaacacaggguauaaucacucucccuucuuaccauuggauaggcuuuccaucauugggcaguguccaaaugugugaaccaaagugcgggcagagcagacugccuggugcgucuuggcaaguacaugguaggaucucugaagagaagagaucacagccuugugcccacuguagaugucgucacuacucucaugaucauuuucauuuuagggguuuuucuguaagacggaggaagacuuuaacgacuggugucagcaagucaaaaaggucuguagcugccccuguccagagccaagaugaaacuucuggggacccaggcaaugagguggcugggguaaagggagccucuuugcauggccuagcuaggaaccccgcuuacugguugcauggggaguuuguuccugccucacacaugagagcaggcugaacagggcaggguaccucgcauugcgguuucuacuggcuguguguaagucaagacuggccauuuucuauauaugcuuugcccauuaaauuuaugauggggugggguuggcccacucaucugccucaugugcuuauggggugguaauaaauuguaugccaggggcugccccuguucuaguugccuccugcuguccuccccgugccuucugugaucuuacuaguugggcaggccugugcuguguugaucacuguguugucuuuuacuguaaccuuuaguguggauaccaccuccauuuucuugucuauaaaaugagauuagaccucugcaggcuggaggcuauagugacuguugagggugcaucuaacagcuguaucucacugacagcuaucccagcuuggaggugcccugcccauguuugagcugguggaacagcagccuucccaucuggccugccaggauguccugaaccugucccuaggugagugcugaggcuacagaaccaagucuggacggaauagcccgccugucaccaugucuuccuuuauguagucugugccugccugccacaagcccacccucagaucuuuauccuuuuccuuguaaguauuaacacuauuugaggcccaggugcaaaugguugguugaaaggguauuguaaacccaggccugagcuuggcagcaacacagccuguccauguucugcccagggucuugugggaagaaggcaugcucccacagcuuccuuggcugcauaguguuagagcacaacagguuuugugaaguccgucuaagagccaauggggauuagcaguccuggauccuugagcuauggcugguguagcuguaggggucaguccugcuccuguaggccagcacaguagaguucagagaccaacugaccuugugagacacugaauggagaccugaugagaccuggucaucccucagcugguguaaggagucaggugccuugguucccuggguuggugccaagucccauugcuugucugcuggcaggagucaggugcuguucucuucuuucacagaguucccgucucuccuuagggccuugucacuugcucaggagucaggaccucauuaugcccuguuagggauggguguaacuguaggccuuucuauucccgccucaguuuccaaauaaugaaguagaggcuuauauuuauuuacaguucuuuuggcuuuagcuuaggcuugcuccccaacuagcuuguaacuccuuuaucccauuucuccuaaucuaaguucuaccauguggcugguuuguuacuucuuccucccaagccucugucccagaguugcucucucugcccggaggauauccugccuagccacugucaguugagcucuuuauuaaaccaaucagaaggugcuuuaggcaggugaggaaggacaguguacaaaaguuucucccagcagaagggacuuacuuacagggcauagcaagccuguucgaauuuguccccucuuccagcaucuucccagcccacaaccauauaagcuucugagagaugauuaaucuuuuaucuuuuuccuuccagacucuucugauguagagagacuggagagguuuuuugacucugaggaugaagacuuugaaaucuuaucccucugaaaauccugggguugggggauggccuccauggcccucauuggggugcuuugagaacccagaccugccuugggcacucagugucaccgcauuccauccacccagcccaucccugccaagugcuguucaccugugccaccucugucccgagggccugcucugcucauggaccaaggacuauggugccuggaggccuuaaugcuuggagucagacugccuaaaccccaacacaaagggccuguccacaugaagucgcucaucagaaggccuagucaggaagagcagugggucaggagcuuccagaauucuccacuggauucugacacugccagcccuggucagcacaucagcuuugguucugcuuucuccugggcaccugggucugugguuuauuuggaauuaaagcccuguuugaaguuguuuaacaaagacaugaauuucuggggcacuucccaggucagucuuagacgaucugcagguuauguacagagugacagccacaucauggccucauacugcugggcggggugagcuuugggcugucuccucugcccagugugauuuaucaagggcuaccucagugggaaagcauauggagagaaucccaaggcugcuacuugcuuuggagagaaaguauucuuguggggcauuuggaaaauccaaagauaucagugugcaugggcacaggauggaccccugaacccuggagcaacugacaagcuccuagggcuucuggaguugugguccugggauuccccauuaggaccucgcuagggaagagagagguuuccucugugggguugaugcguuucaugacacaccgccugcugcuuuuagcgugccacccagcuucccucugggaggaaagggaagggagcagagcugcucuaugcuugagacaccgugcccacuggugguaggguacacacugcuacuugagccuuccuccauguucuuucucuucucagaaacccaucugggucacaggaaauuguagaugguuuggggccaaaaagguaaaaguacuacagcuuuuuggugcacaauagacauuuagacagcagguagcuccaggcacucacaagugaagaguucagaccuccuuggcacucauuuccauaccugccaccuaacccuggcuuucugggccuucaagcuuuugaugcucuaggucugcugucuuagaaaaacaccuuuccucccccuagauaugagcagaguauggcaguguggggaggaccguucaagagccuuugcuaaaagcccuucccaagaacucgcagaugggugaggccagagcuacuccagaugcagcagcucuaaguagcccacaagguagcaagagaucccugccuaucaaguguugaagacauauuuauuucaucuuacucuuucucucccauaucuugucccuugacuucagauggggugggacgggggggggggaaaggccaggacaguuuccauucccccggagcuuguuuccugaggccaggagcuauugugcugcugucgcccagggucucgcuguaacuccuguuguugguaguaagggguggacauauggaacacuacaaccugagggaacucucagggcuugagaaaggcuuccugagguuguucauucuuaguguaguuugcaauucuuaaugauaaauaaguuucaguagaaaacaaagucuuguguguguguguugauuuuuuuuccccuccaguuaugauuagcuuugauuuuaguguuaacaaguaaagacuuccugaaguuggacaagcagauccugcccuguuccuggccuugcuguguagccaaugucuguuuucccucauauuaaacucaugguccuaaaaaagaaaaagugaaaggagauauaaaaaugagccagcgaugccgggcagugguggcgcacaccuuuaaucccagcacuugggaggcagaggcagucggauuucugaguucaaggccggccugguuuagagugaguuccaggacggccagggcuacacagagaagaaacccugucucgagaaaaccaaaagccaaaaacaaaaaaaaaaaccaaagagucaguaaugcuggcauacaaagucaauggcagcuacucaggaggcagaggcagccaggcuaaccaggucgagagcaaaggguugcacaaagaaacccugucucaaaaaagagcuggggaguggggauggggcacuggagaaaugaaaugguucagugguuaagaguucuaggggacuagaguucuguuugcacacugggcugcaguuguaaugcuuacaaccccagcuccagaagaucuaacaccuucugaccucauggguacauacagaaauagauguaaaaugagccaguagcucuucaguuggagaaaguguugaaaagcacucauacaaagcuugccucagggucccuccaggcaaccuguucccagcuuugucuaggggacaaguagauuuugaggaauaucucauccuauuagugaaaucucaguggggcaauccuagaagaugccuaccugcccucuugaguccaaauaaaggaaaauugcuggcccaaguacaauggcccaaggggaaggcuucccucucccuguacucagcuggcuuucuguggcuguuaugaccaugugaacacauuuacccacagcugaaacuuguuaugguccuagagggcagaaaucuauaguaagcuaguaacagcuagcuuucagcauccagaggcugcuacauuccucccucaggccugcaagugcucugcaucuccugacuuuggacuguaguaaucugccuggccagucuccuaucguuuauauauauauauauaaauaaauaaagacugucucacuauguag

SEQ ID NO: 310 - RNA, 39113 nt, Mus musculus
cuacauagugagacagucuuuauuuauuuauauauauauauauaaacgauaggagacuggccaggcagauuacuacaguccaaagucaggagaugcagagcacuugcaggccugagggaggaauguagcagccucuggaugcugaaagcuagcuguuacuagcuuacuauagauuucugcccucuaggaccauaacaaguuucagcuguggguaaauguguucacauggucauaacagccacagaaagccagcugaguacagggagagggaagccuuccccuugggccauuguacuugggccagcaauuuuccuuuauuuggacucaagagggcagguaggcaucuucuaggauugccccacugagauuucacuaauaggaugagauauuccucaaaaucuacuuguccccuagacaaagcugggaacagguugccuggagggacccugaggcaagcuuuguaugagugcuuuucaacacuuucuccaacugaagagcuacuggcucauuuuacaucuauuucuguauguacccaugaggucagaagguguuagaucuucuggagcugggguuguaagcauuacaacugcagcccagugugcaaacagaacucuaguccccuagaacucuuaaccacugaaccauuucauuucuccagugccccauccccacuccccagcucuuuuuugagacaggguuucuuugugcaacccuuugcucucgaccugguuagccuggcugccucugccuccugaguagcugccauugacuuuguaugccagcauuacugacucuuugguuuuuuuuuuuguuuuuggcuuuugguuuucucgagacaggguuucuucucuguguagcccuggccguccuggaacucacucuaaaccaggccggccuugaacucagaaauccgacugccucugccucccaagugcugggauuaaaggugugcgccaccacugcccggcaucgcuggcucauuuuuauaucuccuuucacuuuuucuuuuuuaggaccaugaguuuaauaugagggaaaacagacauuggcuacacagcaaggccaggaacagggcaggaucugcuuguccaacuucaggaagucuuuacuuguuaacacuaaaaucaaagcuaaucauaacuggaggggaaaaaaaaucaacacacacacacaagacuuuguuuucuacugaaacuuauuuaucauuaagaauugcaaacuacacuaagaaugaacaaccucaggaagccuuucucaagcccugagaguucccucagguuguaguguuccauauguccaccccuuacuaccaacaacaggaguuacagcgagacccugggcgacagcagcacaauagcuccuggccucaggaaacaagcuccgggggaauggaaacuguccuggccuuucccccccccccgucccaccccaucugaagucaagggacaagauaugggagagaaagaguaagaugaaauaaauaugucuucaacacuugauaggcagggaucucuugcuaccuugugggcuacuuagagcugcugcaucuggaguagcucuggccucacccaucugcgaguucuugggaagggcuuuuagcaaaggcucuugaacgguccuccccacacugccauacucugcucauaucuagggggaggaaagguguuuuucuaagacagcagaccuagagcaucaaaagcuugaaggcccagaaagccaggguuagguggcagguauggaaaugagugccaaggaggucugaacucuucacuugugagugccuggagcuaccugcugucuaaaugucuauugugcaccaaaaagcuguaguacuuuuaccuuuuuggccccaaaccaucuacaauuuccugugacccagauggguuucugagaagagaaagaacauggaggaaggcucaaguagcaguguguacccuaccaccagugggcacggugucucaagcauagagcagcucugcucccuucccuuuccucccagagggaagcuggguggcacgcuaaaagcagcaggcggugugucaugaaacgcaucaaccccacagaggaaaccucucucuucccuagcgagguccuaauggggaaucccaggaccacaacuccagaagcccuaggagcuugucaguugcuccaggguucagggguccauccugugcccaugcacacugauaucuuuggauuuuccaaaugccccacaagaauacuuucucuccaaagcaaguagcagccuugggauucucuccauaugcuuucccacugagguagcccuugauaaaucacacugggcagaggagacagcccaaagcucaccccgcccagcaguaugaggccaugauguggcugucacucuguacauaaccugcagaucgucuaagacugaccugggaagugccccagaaauucaugucuuuguuaaacaacuucaaacagggcuuuaauuccaaauaaaccacagacccaggugcccaggagaaagcagaaccaaagcugaugugcugaccagggcuggcagugucagaauccaguggagaauucuggaagcuccugacccacugcucuuccugacuaggccuucugaugagcgacuucauguggacaggcccuuuguguugggguuuaggcagucugacuccaagcauuaaggccuccaggcaccauaguccuugguccaugagcagagcaggcccucgggacagagguggcacaggugaacagcacuuggcagggaugggcuggguggauggaaugcggugacacugagugcccaaggcaggucuggguucucaaagcaccccaaugagggccauggaggccaucccccaaccccaggauuuucagagggauaagauuucaaagucuucauccucagagucaaaaaaccucuccagucucucuacaucagaagagucuggaaggaaaaagauaaaagauuaaucaucucucagaagcuuauaugguugugggcugggaagaugcuggaagaggggacaaauucgaacaggcuugcuaugcccuguaaguaagucccuucugcugggagaaacuuuuguacacuguccuuccucaccugccuaaagcaccuucugauugguuuaauaaagagcucaacugacaguggcuaggcaggauauccuccgggcagagagagcaacucugggacagaggcuugggaggaagaaguaacaaaccagccacaugguagaacuuagauuaggagaaaugggauaaaggaguuacaagcuaguuggggagcaagccuaagcuaaagccaaaagaacuguaaauaaauauaagccucuacuucauuauuuggaaacugaggcgggaauagaaaggccuacaguuacacccaucccuaacagggcauaaugagguccugacuccugagcaagugacaaggcccuaaggagagacgggaacucugugaaagaagagaacagcaccugacuccugccagcagacaagcaaugggacuuggcaccaacccagggaaccaaggcaccugacuccuuacaccagcugagggaugaccaggucucaucaggucuccauucagugucucacaaggucaguuggucucugaacucuacugugcuggccuacaggagcaggacugaccccuacagcuacaccagccauagcucaaggauccaggacugcuaauccccauuggcucuuagacggacuucacaaaaccuguugugcucuaacacuaugcagccaaggaagcugugggagcaugccuucuucccacaagacccugggcagaacauggacaggcuguguugcugccaagcucaggccuggguuuacaauacccuuucaaccaaccauuugcaccugggccucaaauaguguuaauacuuacaaggaaaaggauaaagaucugagggugggcuuguggcaggcaggcacagacuacauaaaggaagacauggugacaggcgggcuauuccguccagacuugguucuguagccucagcacucaccuagggacagguucaggacauccuggcaggccagaugggaaggcugcuguuccaccagcucaaacaugggcagggcaccuccaagcugggauagcugucagugagauacagcuguuagaugcacccucaacagucacuauagccuccagccugcagaggucuaaucucauuuuauagacaagaaaauggaggugguauccacacuaaagguuacaguaaaagacaacacagugaucaacacagcacaggccugcccaacuaguaagaucacagaaggcacggggaggacagcaggaggcaacuagaacaggggcagccccuggcauacaauuuauuaccaccccauaagcacaugaggcagaugagugggccaaccccaccccaucauaaauuuaaugggcaaagcauauauagaaaauggccagucuugacuuacacacagccaguagaaaccgcaaugcgagguacccugcccuguucagccugcucucaugugugaggcaggaacaaacuccccaugcaaccaguaagcgggguuccuagcuaggccaugcaaagaggcucccuuuaccccagccaccucauugccuggguccccagaaguuucaucuuggcucuggacaggggcagcuacagaccuuuuugacuugcugacaccagucguuaaagucuuccuccgucuuacagaaaaaccccuaaaaugaaaaugaucaugagaguagugacgacaucuacagugggcacaaggcugugaucucuucucuucagagauccuaccauguacuugccaagacgcaccaggcagucugcucugcccgcacuuugguucacacauuuggacacugcccaaugauggaaagccuauccaaugguaagaagggagagugauuauacccuguguucccugugacuucagcucucaaaagcuaggacuggggcucaaacuucauguucuccccaccugcuagucacacaugucuagcuucuucucuaagguuggcugucuauuuggccuaagucgcagucacugugagcugcugaaaugcacucacuguaagguacacacacugcuuaacuuaggaguuugccagugagcucugcaggaagucugagccacagaaucccagauuacucuccuuagaauguggcaguguguacugaugugaucguugcagauuggcacuggacaugcugcgugaugaagcagccugacuaggcaaugacuuccuggauauggcacugcuuuugacauuuuugguuuuuuauccccuuuccuccaaacacauuuugaagaggcggguuugcacaaaccaucagaaaacccuacuauaucaucaagacagagauggagaagaacauucagaagaaucaucuucaagcuacacuaaguaaacaaacaacggaacaaugaugagaaaauuaaaaggaaaaacagucuacucaggugacugucauucuguaaugacagauccaaauugucaaacugucagagcugucauuuguguuuuauacauagcagaaaccgccccccccccccaccgguacauccacucaaucagucaacacucgaauauacugggguugugacagccacucggcaggugaguggccucagggaagguaagaggucuugggauccucaacuaugugaacauucucuguauuuccacuucagaacuggcacaggaugacccagagcaacauaccacagcaauggacgggucaagcucuccaaugcccauccuagagggagggugcuggcaguggaagcucucgucggggaugaagcagcugucagucagcuccacugcaggcuguguaguguggggguccagauagaugagcuccuccccuaggaaggacggugcagaagucagaggcagcugacccgagcugggcagggggagggagcaggccagagcagcauccagacccaccagaggcagcagacacaagggagguagcaaucaaagugccuaguggugagggaagcaugccaccacagcgagugaggggaggcaagugagguacaaacacagcaccacagaacaaaauccacuccuucagggagaaagaucaucccuaugaacccagaguacgcaaaccauacucaccaacauagccaauaaaguagugggcacuguugggcuucccuccaauaacacccagggacuggggcaucaugaaacagugcugcaggagacaagagggaaggccacugaggacacugacucugcacagcacucagaagagagugcuccuacacagcgcuacacacggcagcccagcaggcauaagugugcauuuuaccaugcacagccucagaaaggccauggucuucagaggccuaccugaaugacacaagaaaaacgagaagacaugucccagagagcuuccaguacaguccaaccacaggcuuacgguucuagcugggaaaacugcagaaggagaggugaugggacaggggacuaccuuacggauuaacaugcacaggcacgcuggacagguaguguggccagacaccagccuggcccaaugggacaggggcaaggacaacagaagucagauaaauaugggaaaugggugagagggaagcagagcaaucucagaaccuacagcagagggaguggccaggacaguggagagauacgcaggggcagaacaagacagggaagggagagguuuuauauuucaucuuaccucaacacugaaaggugaugaaaagggaaaguuuuuuuuuaaaaaauagauagauuacacuguagcuaucuucagauagcuccagaaaagggugucagaucucauuacggaugguugugagccaccaugugguugcugggauuugaacucaggaccuucagaagagcagucagugcucuuaaccgcugagccaucucuccagccccaagggauuuuaauaaaaagcagcauugccauuccauacaguaaagcucucaaguguggcuccucaguuuauuuucugagaaacugcaauuuaaggcuuugucucuuguuuuugugauggcgaaggagaaauaaaggaagaguguggaugaaauucucaguaaaccaccugccguuuccguccuaugggccaaccuauccucuucaccagugguucuuaauguccuuaucacugcgaccauuucauacaguuccucauguuguggugacuccccaaccauaaaaugauuuuguugcuacuucauaacuguaauugugcuacuauuauuaaguguaauguaaauaucugauaugcaagaccccugugaaaggguuuguuguacuggcugguuuuaugucaacuugacccagcuggagaucacagagaaaggagcuucaguugaggaaaugccuccaaugagauccagcuguagggcauuuucucaauuagugaucaagggggaaaggccccuugugggugggaccaucucugggcugguagucuugguucuauaagaaagcaggcugagcaagccagucaagaauaucccuccauggccucugcaucagcuccugcuuccugcccugcuugaguuccaguccugacuuccuuuggugaugaacagcgauguggaaguguaagcugaauaaacccuuuccuccccaacuugcuucuuggucaugauguuuguacaggaauagaaacccugacuaagacaaauugguaccaggaguggaguauuccugugacaaccugaccauguuuuugggaggacuguggaaggacuuuggaacuuugggcuagaagaucgguguuaagagcacugugggauguuuuguaggagcuuggaagauaauguagaguacagugcagaagauggaggccuggcuuaugaaauuuuagagcgaaaauuaaagacucuuuucagggccauuguuacuuugauugugaagauucugugguucugguuagcuggggcugaagaaucagcugugauuaacaagauaccagaacuaguaaagugaaaccuuuauauuacugggacaauugaugcugguuagcucgagcuaagaaauuagcggugauuaagaagagaccagcaucauugaggugacauuuucugggaaguguuuucugagagcacagagacuguguuacagagauagccaugguuguaccuguucuguggcuggaccugguaauguguaagaauuacccagguggugcugguuaugaaggcaugaaggggucacgcagagcagcugaggcucagcacugugagaggccauggaaggccauuggugaaagugcagccucaguugcaauugaugucccagaacugaaggggucaugcaaaggaguugaggcuuggcaccaugaagagagccuaugagaggcuauuguuaaagccaaguuacagugaaugacagcaguguuuuggagaugccaggaccaugagaugaccaccaagaacagcagcagcaguggaguacgggcagcuggagccuagaagacaacgugugugcuacaaagggcauggcuggagaagugacccaagcccuuagaggagcccauaagauugugaguuggaucccagacacuggacaguugggaguuuaauuuuugcuuuugauugugacugugcccugauauuuuucccucuugaaggaagaaaauauuuuaauggaucccacaguuaagagacuuuuaauuauaaaaagacuggauuuuaaaagauauuggauauuuuuuaaaggauugaacuuuuaauauguaaagacugugggacuuuuaaaguuauuuaagaucuuggagaugaauaagaacuaaggguuggggcuggugagauggcucagugguuaagagcaccaacugcucuucugaagguccccaguucaaaucccagcaaccacaugguggcucacaaccaucuguaaugagaucugaugcccucuuuuggagcaucugaggacagcuacaguguacuuacauauaauaaauaaauaaaucuuuuaaaaaaaaaaaagaacuaaggguugaggcuuaauagugauguguuugugugucaaguugacaaggggucaauuguacuggcugguuuugggugucaacuugacacaggcuggaguuaucauagagaaaggagcuucauuuggggaaaugccuccaugagauccagcuguaagucauuuucucaauuagugaucaagggggaaaggccccuugugggugggaccaucccugggcugguagucuugguuuuauaagaaagcaggcugagcaagccaggggaggcaagccagucaagaauaucccuccauggccucugcaucagcuccugcuuccugaccugcuugaguuucaguccugacuuccuugguguugaacagcaguauggaaguguaagcugaauaaacccuuuccuccccaacuugcuucuuggucaugauguuugugcaggaauagaaacccugacuaagacaacuucccucaaaugggucaggagccacagguuaagaaccacugcucuagagagaauuggaaauacacaggaagagcauagaagaaaccugggagaucugggagagacagaagaccggaugucagguucagcaacagggugagugggcuugaagacccuuuauagagcuauagauauuuaaauucucaacaucaccuauaagauccagccugacucuuagagguacagcuagcugaccacacacugaaauagaugaaaaagacucaccuucagcgucuccacauaggccucauugaugucugucagucccaggcggagagggaugagaagcacuaguggucuccaagccgauggccuguuggugacuucagcuccagcagggaacccauuacagugccucucugaaucaguaggaagugcagccgccccaacacagggaagguuggcccugcauaaccuuccugaaagggaauacauauuuuucaucagcuaagcagagacagaaguuauccccaaggagaaaaaauguuuuaaaaaccaggcgcuaaggggcuggagagacagcucagugauuaagagcacuggcuacucuuucgaaggaugaaggucugauucccagcaugcacguggcaacucacaauugucuguaacuccaguuccaggugauacaacacuuucuucuggccucugcaggcacaaggcacgcaaguagugcacaaacacacaggcaaaacacccauacacacaaaaucauuuaaaacaaacaacaaaaaucccaacugcuuaaaauauaaguaauuuugaaaacaaaaaugucccuauucaacgaaaaauuuucuaggggcuggacaguugguucacugguuaggaauacaagcugcucuugcagaagauccacauucaguucucagcacccacauaguggcucauaaccaccccucauuccacuuacaggaguucuaaugccuuuugaccuacuuggguaccagaaaugcagguaguaugcaugcauacauacauacauacauacauacauacaaaacacguauacacauuaaaaaacaaaaaaaggagagaaacauuuucuacacauaaagauuuuuuuaaaauaucucuaugguuguucugccugcgcguacaucugugcaccaugugcaagcagugccaucaaggucucaaguguuggaucuccuggaacuggaguuaaagaugguugugaaccacgaugugggggcugacaacugaaccucgguccucugaguaguagcuuaguacucuuaacugcugaaucaucucccaugaaccauuucaaauggcauggugguauacaguuuuaauccuagcacuuagcagaggcaggaggguccucugugagauuagggccagccugauguacauacugagagccucucucaaacaagcaaacauaaccguacaauaugggagagcaguaugucccacagugcaucugugagaaucaggggcagcacuguggagcuggcucuccuucaaucuuuauaugggcucaagugaucaaacucccagguuugccagaaugguguggcacguggcuuuauccagucagcugaaucauuggcucccaugugcagcuuaaagaaaacagaagcagcagccauuuagucucuguagugugggcagacccaggucaugcagaccccuuuucagaagagcgccaagaaacagcuuuucuucacccuccaguauuucucucucucuuuuuuuuuuuuuuuuuuugguuuuucaagacaggguuucucuguauagcccuggcuguccuggaacucacucuguagaccaggcuggccucgaacucagaaauccgccugccucugccucccaagugcugggauuaaaggcgugcaccaccacugccuggcuacccuucaguauuucuucugucuaaauguaggaaaugcagccuucaauacacaucugauuagagucugcugguggucagacaaccccguacuguggaacacacacacacacgcugcacauauacucagacacacacaugcaugaaaauaaaaaaaauuuaaaaaacaggaagauaacuuuuuagauuaagagacuaaaagugguagugauucacugaacucuuuuacaagauugaacuuucuaggaaauaaucuggaaauagccuguaggaaagauuaauuagcuauugucuucuuucaaaaaaaaauacuauuuauauauuuauuuguuguuugagacaagguuucucuguguagcccuggcuauccuggaacucacuuuguagaccagucuggccucugccucccaagugcugggauuaaaggcacugccaugcccggcauucauuuuauuuuuauauaugcucugccuacacauaugugcaucacauucaugucuggugccccugcagaucgaaagaagguauuggaggaaguggaguuacacauuugguugugaaucacucaagugugcugggaaaugaacuugggucuucuccaagagcaguaagugcuccuuaccuccaaaccaucucuccggcccccaucccucaucccuuuauugauacagggucucacuauguaguccugccuggccuggaacuuuggauuggccuacagcacacauauacacaaacagcuacccugaauuccuuucuuuccuuuagccuagugaacacaguaagagauggguuuacagauguuucaccuaggcuuccccccugcuggaagugcugauguugcuuugaaacucuaacucuccagcugagguucccucuugggcugucaccuacaaccaaaacccugagcgacuuacugauuuccuccaucaccacaguguuguccauugcuaugugaacagccaaggaacuccaugugucgaauacagcaaguuuccuacagaaagcgagaacacucccaugagccuuguacagcaugagcaucacaccacagcagugacaguugaggcaguuucaaggcuuaagucaaggaucuguccaaugacucaaacaggaggugugcugaguguuguacauagaagacaucagcugcccuuugucaggagacaguauggacaggagccccuagcuggcauagcaacucaggucucaccaggauggaggcagguccagcucacugcugugcagcuucucuuccaacaccuuacacugugaacugacagcccagaaaucuaaugaacagcacaacugauuaggaggaagcauggcuguagacuuauggcucugaaagaagagcagacagcagccauacuguguagaaaaaauguaaacugggugcuacagggauggggcagaaggccuaucaaucagugagaagacagaaggcaagaagagacauuccccaauggagacaauuaccaaggaucuaagcuacaaggaccuggugcaucuaguaagagaagaagccgaugcugggaaggcucuagagcagcaguucucagccuuccuaaugcugcaacccuuuaauacagcugcucaugucgugacccccuaaccauaaaauuauuuuccuuguuacuacauaacuaugguuuuguuacuguuaugaguugucauguaaauaucugauaugcagaauaccuguaaguugagaaccacugcacuaggaaaaccacacaaagccccuucucguuaaugagaaacuugaaaggggcucaggagagcugguauuuucucacuacucauuaagccugccacagcagcaaggauacagacccaggagaacaaagcagcacuucccuuggcugauaugucaguaaaggcaagcaagaagaagcaagcaaauagagaggaaaagggauuuagcuacaaaagcagaggaggccagggacaggaacaguaagcagggauaagcagccugaccugccauuuccagaaagauguaaauccuaacaccaagagacugcucuuugucagugaagacagaaaagaagugaggcaagagauaugaccaaagcaugauggugaccuggucaggcuacucagagccacagugaaagguggcagcaccggggcggccccguaaauccuaccacaagcuaaaggugugcagugauugcaaagaggacccccccauacuacacucacauacuaagguuugguccucacuugguacaacuguuuggaaaggacuaggauaggagguccggccucgcuggaggaagugugcuacggggaguaggcuuugagacuucaaaagcuuaugucauuuccaauuagcucuugcucugccucaugcuggugaaucagauguaagcucuuggcuacugcuccagugccugcccgccugccgcagugcuccuugccaugaauuucaaggucuaacacuuuggaacagugagucccuaaauugaaaugcugugguuuuguuuuuuauaaguugccuuggucauggcauucugucacagcaacagcaaaguaaaacaaggcacaacuugaacaaggacacuaaaggggauagaaagggugugcaugccacuaagaaaccaaaccaaggacacacagccagccauggccugggaugacugggcaucagguacaggggaaaaaaagcaagugucuagguggagccuauaggagauggccauugcagacacaggguaggguggcaaggggacauucaggaaaaaccauagcuagagacauauuugggagauacuagcuuucagcccaacaggaauagggcccuccaugaaugaguccuggacauugguucagagccuucuaaaggcacugagauauuaaagcacaaagccacagggaaaagugaaucaggucaaaaacaaaaacaaaacacacacugcagggagaggagcacaagcaaggaggaaauggcucaguggucagagcaccugcugcucuugcagaggacccgggguucaguucccagcacccacagagcagcuaacaaccaucuguuaacuccagcuccagggaucuaacaaugucuucuagccuucccuacaugcuuugcauguaugaugugaacagacauaugugcagaaaaacacucauaauacaaaaauaaucuuuaagaaaccacggaggcacagaggguaggaggggauaggcaaacauucaugaggaacaaacucuaacagauucucaacagcaugggaaggcuuaugacuuaugugggugugucugacaaacacacgagguagagggcucuagcaccugcagauacaguaccauaacugccauggucccagaucuaagacacccucauuacagauggauuuguauaucaagacagaggacagggccacacuagggcucugaccuaaacaugaaucccaaucacagaacaauuggcauagucacccagggaucuccccugggucuauaagcaaagaaucggaauaccuuaguuccugugccaauaaguacucaaggaggguaaaugccaaggagaacucaugcugaccccaagaagcagaagggcugggcucauuacguacuugaggaccugggcaacaguguucggcccguaccacuggccuauagacuugccuucgccaacucccauuugcgcugcaggaaacagacccauguuagcaaacacauccaucccaaaagagagaguguguguaugugugugcgccucacuuuugguacauuaguaaacgcuucauagaaaggucugggcaggacuccaacccuccugagaaaagcaaagcaaaccuuccaagaggagccuaacucccccaggcugcacagagucacucacugcaggcuguacaggggaaggacaggcuuggguuugagcuagugcuggaacacccagagcagcucacagagacuagagaccagagaguggccuagaaccccauucuccaacucugcgagauuuagaaagcuccuaagggaagcccaagaagucugcccuuuguacagagccaacccaaggacaaacuuaauccccaccuaucugauggauggaauaguagcuguccuuccugucgaggaaagcauugaggacauuaaaguagcugucaggcugccucuuccgcugaguccaccuccaaucuauugagaacagaacacagaagguuaguuugaccacuacauaacuaacaaaccuuccacuugcacaguguucaauauucagaugacguacaagacuuuaauuuugaacccuuuuuaaguuagaagucaaaucugccaggauuucaaauguauacauacucucuaaucaaaacaaaucuaggcugaaaacagaaagcuaauuuucaaaagaauaaacauuuauaucaauauaaagcacaggcauagugcuucagaccuguaaucccagcuacuugggaggcuaaagcaagaugcacuauuuaguuuuaugucaacuugacacagcuggagucauuuggaaagauguacaaucaauaagaaaauaccuagacaacacagacauauacaaaauucuuuugaacauacucuuuaacaauaauugucgugggaagguugagugguaccaauccuggacauguaguccuguccugucuaagaaagcaggcugagcaagccgcaaggagcaagccaguaagcaguacuucuucauggcuucuguuucaguccugccucuagguuccugccuucaauuccugcccuuccuucccucagagacaaagugugaccugauguaaaauggaauaagcccuuuccuccccauguugcuuuuggucaugguguuuuaucacaacaauaaaaacccuaacuaagacauaaaagaacugcaagcucaaguucugccugggcaacucaguaagcuccugaauuaaaauacuaagaaaaaagauuaaaacugugcugaagccggcagugguggcgcacuccuuuaaucccagcacuugggaggcagaggcaggcagauuucugaguucaaggccagccuggucuacagagugaauucuaggacagccaggguuacacagagaaacccugucucaaaaauaaaaacaaaaacaaaaaccuguguugagcacugcaagcuuccuacagaaagugagauaacuuucaaauggacuuuccacagcauuuaaguaugacccccugguuuucacuggcaaggaaccguguacacacccacacaauuuguugcuacucaagauugagccuacagcuuugaaccugauagacaagaaccacacaaaucuguguuuugccuaugacaugcuuuuuuauuuugucaccucccugggguugggauuaaaggcaugugccacuauguccagcuucuaugaugugcuuuaaccaucccuuacuacacagauucuauguaagcacugugacucaccucgaccuaagugccggcauaccagggccugggcaaagaucaucuguccacaccgaagcaugcaaccccagccugugucugaaguagggccaguucccccuguguggaagacagaacaagaaacauucacaaucagagagaggcagcuccauaccacaggcacugauccuccuuauaaaucugaacuugucagacaagguacaacucugaggacauaugcuggggaguagaaugcccuaacaauucucuccagaugggcaaaauaugugaaugaucagucacauauccaauaggaacaccuggcacacaaacaagaauucccuugauuacuuuagaagacacagaauuaaaacuggagaaccauauccuaguaccagaaagcaaaaauucaagaguuacaugauguccacuguugcugacaguaaggaugaggaaagucauuagcaaugcaaugauuaacacaaacucugcaucuuucaagcugaguugagccccuccacuaacgccuacucacuggggcuugaaagacugacaagaauuguggagucacuuuuaacaugagaggaauggggagaauucucucagcaguucuucagggaaaggucacucaguguauagcacaguugugugcaaagagacgagaaaaaacuaaaauauccugauggugaagcucaaacuugaugcccaacaauaucaaugcccccuuucccuucuagccuccuuccuccccuaccuagaguuggagaguuggaaaggauaaggguggaaaagggugguagaaacaggaacccacaaaguagacaaaaagacuguuuauagccuauguauguaguaauaagaggcagagaugugaugcgaacagugaacaaggaacucaggcguuuucuauuucuauaccugucaccacagcccaaaaagucaucuuuacaauacucaagaagcauacagcccaugcuugguucuuaggaccacgaugagcugcuuuaacuauagcaggcuaguuuugccaaguugacaccaucugcaauaaccugguaugagccccacaggaaaagugugaauacuugauccucaguugguggaaguguuugggaagacggggccuuguuggaagaagucuauuacugugggcaggcuuugagguuucaaaaacccaggacauuuucaguuagcucucucugcuuccuacuaguuagacugagauaccagcccuuagcuacugcuccagugccacgccugccugccuguuucugugcucccugccauaauggucacugcaagcaucaagccaggcaaggaaacugaauuacaaagaacugagaaggaaaacucaauugagcccaucuuagucuggaucaagcuucaagucugaugcaagcauuuauugccagcauauuuaaacacaauucaaucugaagggaaaguuuccaggcaacaaucauuccaauuccagguccacaauaaagcuuaagguaugacuacaugaaaacuacuuugcaaaguacaugugaucauaaagauggguacuauuauugcuuaaaagccuagaagcuacugcagucucugacuaagauaccacagagaucaggaggccauaaacugcaucuccccuaaggaugaguuguauugacugggagcuaaauauaaaggucuagggagggagagucuggaauaaacauucugggggaguaggcuggagucugccucuauggauagugaaaggccaucuucucccagcuuucuggauggaaugaaaauauuuuauuuccuccaugagaagaugcccccguguuuaacacuccugguuagguggugcaacuuuuuuuuuuuuuuuuuugguuuuucaagacagaguuucacucuguagaccaggcuggacucgaacucagaaauccaccugccucugccucccaaguacugggauuaaaggcgugcaccaccacugcccggcaacauucuuuuuaaguuaccucaguugugguguuuugucacagcaaucaaaaaaaaaacuaaggcacccaggaagagaucucaaugaagguuugucuuaguaacuguuccauugcuaugauguaauaccgugaccaaggcaacuucuaaaaggaaacauaacuguagccuugcuuauagugucagaggguuaguuuaugaacaccaugguggggagcaaggaggcaggcagauaggcaugccacuggagcagcagcugagagcucacaucugaucaaaaaauagagggagagggagagggagagggagagggagagggagagggagagggagagggagagggagagggagagggagagggagagggagagggagagggagagggagagggagagggagagggagagggagagggagagggagagggagagggagagggaggagagggagagggagagggagagggagagggagagggagagggagagggagacagacuaacuaagccuagcaugggcuuuggaaacuuauacaccuucaacauggccacaccuccuaauccuucccaaaaaguuucacaaacuggagacuaagcauucaagcaaaugagccuauggggccaaucucuuuuguuuggggggagagacauucuuauuuagagcaucacagauuuuucuagauugggcuguccuaugggcacaucuacaaggggagucuuuauuacacugauacuagaaaaccagcuugaggggcuggugagauggcuuagugaguaagagcacugacugcucuuccgaagguccugaguucaaaucccagcaaccacaugguagcucacaaccaucuguaaugagaucugacgcccucuucuggugugucugaagacagcaacaguguacuuauuuauaauaauaaauaaaucuuaaaaaaagaaaagaaagaaagaaagaaaaccagcuugaaagagaccccagucccuggguuggguucuacauuguguuaaaaagcaagugagcugagcacacaggcgcugaccaguuccucugggcuuucuggcuauggauaugcuguguucagcugucuccaguuccuacugcuggacuucccuacaaagauggccuagccuauaaccugaacucugagggaaaauaagcccuuucuccccaacuaugcuuuugucagggcaguuuaccauagcuacagaaacaacacagagaccuugccucacggauguucagagcuggccacacaaugaaggcugcucucuagccaugguguccuauccagcguccuggcagucacuauuuaccauguggucccaguuuuguaacuuuguggucccaguuuuguaacuuuuuuaaaauuuauuuauuauauguaaguacacuguagcugucuucagacaccccagaagagggcaucagauuucauuacagaugauugugagccaccauguaguugcuggaauuugaacucaggaccuuuggaagcacagucagcgcucuuaaccacugagccaucucaccagcccguaacuuuuuuuuuaaugaugguucuuuaaugcuuuuaccucccuuguaaccuacaaccuacuaagggaagugguaaagaaaggauacagggaaguggaccuguguaaaaagguuuuuugaagcaacugucuguguugucuggaaaucagcaguucaguucacaggucagcaggcaacagcagcuugaucuacucacaaacacuucacagauacaccagcaguccaguuugcuagagcuggguuagcaacagcagugacaaccuaucagagacagccaggccucagcuuuggcuucagucagcaggagggaccagaagaaaugccaagaggagcucuuggcugugccucucucagggagaagaucaucaaagacuggagacccacaaguguuacacacagugagcuguaccaacaagucaagcucugucuccgucacuccguggaguccuauuuauacccuccaagcaucacguguccuccuugugcauugccuuagcauguauuuugucauagcacaugcauccaaucagcuugaguccuuggaagcagcaacaaacugcaguaaaccaccagaaguuuuuuggugugauucucucuauggaguccugacaaaugcagcucaacuaugcaacauaaggcagacuaauauaugugugucguuaaucuuucaucauguguucuugugaugguuuguauauucuuggaccaaggagaggcaccauuuggagguguggccuuauuagaauaggugugaccugguuggaguaggugugucucuguggaugugggcuuaaaacucuuauccuaguugccuggaagucagucuuccacuagcagccuuuggaugaagacguagaacucucagcucuuccugcaccaugccugccuggaugcugccauguucccaccuugaugauaauggaccaaaccuguaggccagccccaauuaaauauuguuuuuuauaagacuugccuuggucauggugucuguucacagcaguaaaacccuaacuaagacaguccuuucacauguuuguuuuaguagaacaucuucucucgugucuucuugagcuaaauguuccuucaugagucggccuuagcuuuucacaccuguguucucuuuaacaaagguuccuucacguguuugccccaacaaaacaccauccaaccgacuuuccaaagaacccuaaaguuuccacuucacaguuuaguuucuauuucugugauauauuaaauacugugaccaaaaguaacauuuggcuuacacauccugaucacaaccuaucacuaagggaagccgaggaacucaaauaggacaggaaccuggaggcaggagcugaaacagaggcccugaaagaaugcugcuuauaaugaccugccccauggcuugcuuagcuuuuuuuuuuuuuuuuuuuuuuuuuuaaacaaaacucaggccuaccuguucagugguaauaccagccacagugagcuauuccacccccaaccccaucaaucauuagucaagaaaaugcucauacuuacaggcaaaucuaauggaggcauuuuuguguuaaguuuuacaaaagaaaaacaaacaaaagaaccuauccagcacagagccuaucucaaaaacaaucacacaaccaaacaacaacaaaauuauugucaugauucuuaauccagugacacguugccaacaaggaaauagaaagcauaugcauuucaauacuugagcuggggcgacagcugagugaguaaagaguuugacaugccugugcgaggaccugcauucaauuccuacaaccuacauguagcuuaaugcagcggcacacuucugaaucccagagcuccuacagaaugaugagaggaagagacaggaaucccuggacguuccuaguccagcuagacugacauacacagggaugaauaagagcacuugucucaaacaagggggaaaagcaagaacugaaggccuagguuguccuuuggccuacauucauguggcuauacccccauuucacaagacacagagauuaaaagcaaaugaaccaaagcauuugaaagaauaaagauuacucaccaauagcuggaaaguuucuccuguauguaaaccaaagucuggaugcaacaucagacaagauuucguccuucucuaauuauuuaaaagaaaagacaaacacaaagugagaggcagcagacaacugccaucucaagaguucugcagaguauuuugagcccagaggacaauaccugugaaaaugcuguauuuucugcccagaauccaaacaggcucugaggucucagggaaaucuucaaauucagcaaaccggagaguaucauaugucaaaguggcuguggaaaccauagaaacacauuugucugauuucacauggagaccauuguauguuggggguugguucuaaugcuuugaauugauugguucccuaauugggaaucugcauguccagacacuaaaaguccuugcuccgaaucgguuuuugauugaucaauaaagacgccaauggcugggcaaagggagaugagacgggacccuuagauuugugcaggcuaggaugcgggggagaggagaaacagaaucaccaugggaguggagacggaucagauuuauagcugcagagggaagauaauccaaaaccuaggagaaggaaagcuccccccacccccaggaagggucacccuuccaucuugggcagcaaagaccaaugggccucaaagaagguaacagggcagcaaaguuaaagguagauuuagaagauguugagccaggaguaccagagggaaaagccacaggaggauuaaaacuucccagccuuugaguagccaaggcauuucaaaaaauaagcuaugcagggcagugguggcgcacgccuuuaaucccagcacuugggaggcagaggcagguggauuucugaguucgaggccagccuggucuacaaagugaguuccaggacagccagggcuacacagagaaacccugucucgaaaaaccaaaaaacagggcuugugagauggcucaguggguaagagcacugacugcucuuccgaagguucggaguucaaaucccagcaaucacaugguggcucacaaccauccauaacaagaucugacucccucuucuggauugucugaagauagcuacaguguacuuacauauaauaaauaaaugaaucuuuaaaaaaaaaaaagaaaaaacaaaaaacaaaaaacaaaaaaucagcuacuguguguguguguguuucauucaaagauccaaagaguuccugggugaguggcuggaagcgcgacccgcccccgccgagagaacaaagcaguguagcuaaacuccaugcuucaaguauaccauuucuguacuaaagauucuugcaauaccugcaucuuucccuaauagccacaagcaaauauaugagcacacaugacagacagucugcuaaacaguugcucugauaaaaguuagggauggaaguuugacagcugacaggauaggaagaaacuuuggguugggaucaacauuaggaaacaggagcaaaagacucccccucaaggaaaaaagguaagcucuugguuauuugagacuuaagacuuaaaaauuuuuuuuuuccuuuaccaaacagggucucuacauaccucugacuguccuggaauuugaaaugcagaccaagcuggucacacagucacagagauccaccugugucugucucccacaugcugaaaucaaagguaugugccaccaccaccccacuuaauuuuuuuuuuugagauagggucucauguaucuuaggucuugaacuugaaauguagccaauaauaaccuuaaacuccugaucugucugccucuaccucuuaagugcuaggaguacggcauauaccaccacacaaguuuauguaaggccaggaacugaacuucauacugguuucauguauucuagacaagcacucaaccaacaaagcuacaccccccaagagaaggugccuucuaggauucuucuaaccaccugcuauaaaccauggaugcagauacccagugcacucagguuccaugcuuaggacagaauaagacaaaggugggcacuaccugguagccaaaguuuaaaucucccuagggcagucacaagcuauaggcucuugggccauuuauauaaguucugaguauaaacaaucacucauccauaaaaaugauauaauaacagggcagguuugccacacugcaaugaugccuucaugagagauuucccaugaggcucugcaggcagacagaaggacgucuugcagaaucacagagcugaaagcauauacaugucacuaugcccacaaggcuucccuggguacaaugacagagugcuagaguauaucccagaaguacagaccacacugacaaauccucacggacagagcuuugcugaagcucagagcagggcagaggcccggugggccuggucucagaacuuguucuauguuucaacugucuauuuucaaaacaaugucacaaccugcuuggugaccuuaagcccaacuuaauuucucccauuuuuuuuuacauaugauuaugcauguacaugaugcuaaaggcuaaauuaugauaaauuaacauucauguucaugguuucaagaagucagaaaccaucauguaucucuaacgucuaaagcagcaaaacacaacguaggcaaauuucuuagguuuauuagcaaucuuuauagguaaggaagccaacuucaaagcgaaaacaguaaguagggcucuauuaaauucaaauauauuaccaagucuaucauaacuaugaaaauuauggguugugccgcuugacaaaucaaaagccaggcugggugugaagaaaccagagaggaacagaacuaaaaagaggccaacacagcucccaccaacuucacagcacccaagaagcaacaauagucacguuggucuguggaaagaaggcccagaccuccaacagaaucccacacuccacacggugaauggccuguccccagucuagcugcagacugcgccuacgcuacucuccgcuccuccucaugucaggaggguuuacucuguuccugaggagauggaguaggagcuaugucugucccacucucuagauagagccuucauuccuagcaguguagugugggaagagcccgacuauggaaccaggagucugaggccaucaaaaacuagcuugugcuccccuugaacuaguauccuuucugaaucuccauuuccucacugguaaaguagaaacgguguacauuccucacugggcugaggaguacgauucuagagcucugaaccauccagggaaugacauaagcauacuuucacagggcuagccuccaauccuugaaaugaggaaguauguaaagaaauccauucuguuccuauaugaaaauguaacaauguacagaaguaucaaagcaaaugugugaguuucuucaccaaaagagauucuaacccaacaaacuuuccucaagaaaaacauacaguccugguauaggcagcagagacagguggauaucugugaguuccaggccagccaggcauacacaguaaaacugucuaagaaagaaaaggaggaacaaacucacacaucucacacauacacacacacacacacacacacacaccacacacacacacacacacacacacacacacacacacacacacacacacacggaggggaggggaggggaggggaggggaggggaggggaggagaggagaggagaggagaggagaggagaggagaggagaggagaggagaggagaggagaggagacugacuccuaggggaggggaggggaggggaggggaggggaggggaggggaggagaggagaggagaggagaggagaggagaggagaggagaggagaggagaggaaaggagaggagaggagccuuuuguuguugcaggcaucccacugguuuggaagacaggaagaaaacacacaccaccauucaugcaauauggcaccuuaccugggcauacccacagugucaacucaaacaaacaaacaagcacaugauugaggugacauucacaaagcauuauccaggcaaaacugaugcagaagagacacuucugaccuucuggaucuacuuucaguggaaaaaaauggaaccuuuucaaacuggggcucuaauggugacugagguuuggagauaggccacacuuggagccauauagcuacaugccacacuucucuaagcuucagucaccccacuuaagaaauggcaccacaagcucuguccaaggggaugagaacccagaacaagugcaaaccuaagcucacaaucucuaacauguucaccagcaaaggacucucugggcaccauucuccacagagguuuuucaguucaacugcgcugucucguuaaagccauuuguuuguuuguuuguuuguuuguuuguuuguuucaagacaggguuucucuguguagcccuggcuguccuggaacucacucuguagaccaggcuggccucaaacucagaaauccaccugccucugccuccaaagugcugggauuaaaagcgugcaccaccacugcccggcuagugaaagccucuuuauagcccaacaugcaucacuuacaaagcaucaugaauggcuccugugauaguuuguauaucuuuggaccagggaguggcaccaucuggagguguggccuuguugaaauaggugugaccuagucggaaugggugugugacuguggguguggcauaagauccucacccuaauugccuggaagucagucuuccacuagcagccuuuggaugaagauguagaacucucagcucuaccugcaccaugacugucuggauacugccaugcacccaccuugaugauaauggacugaaccucugaaucucuaagccagccccaauuaaauguuguuuuauuaagacuugccuuggucauggugucuguucacagcaguaaaaaccuaauacagcuccugagccagagagguaaaccuuaaagaguuuguaacaguuuguaaacgcccaagcaacuaguuaaauuugccauuagucgacacgcagaaagauuuagugagguaucuaaggacccucuguccuaugagagaacucuuauuuggucaagcacccuaggugucugacuuccauacccucuuacugggacuucugugaucaugacaguuuaguacuaugauuuaauaguuuauccgacagucagaaaaauagggaauuauacucaguaaauggaacuaaccuuuuuacuuaaccacagauuacacuaucauucaagcaggaagaaccacaaaaacaugcagccagcaagucucuuuuaaagauuacagcaaucuaucguauccuuacauuuuacuuccagcacuugggagucugaaggaggaggaugaugaguuugaggcuagccugggauauacagcaagucccuacuaggagucuuucuuuccuuugaaaaauucuuaggacuaagauaaugguuuucagggccagagagauggcuuaagaugguuaagagcauugacugcucuuccagaacucgaguucaagucccagcaaccacaugguggcucacaacgaucuauaauggaaucugaugccaccuucugaugugugugaagacagcuacagcuuacucauacaaauaauuuuuuuaaaaaauuccauaggguucggauuauugcaaaaaaaauaauaguuuucauguaaaaaaaauuaacaauuuuuagcugccacaaagcuagaaaacuccacuuuaguauacacacuagacagaauguuacaucaaaguccagugcuaggaggcuggggacauagcucaguuagaaugcuuacauaguuuacagaaagccuucaguucucuaaugccauggguuuaugggugaaccauuuauaaucccagucuguaauuugacagaaggauaaguucaaaguuagccuccauuaacuggaacagaguauuuuaaauuugggauauuugcauauacauaacaagaucucauuagaaaaagcacuaugacccaaauaaaauuaugaaacuuauuuagguuucaucuauacacuuuauacauagccaggagauacuuuuuaaaaaguguguguguguguguguguguguguauacacaugcaugcacaugugucaugccuacagaagccagaagaaggcaugagaucuggagcuugcguuacagaaggcuggguacugggaacugacaucaaguucucuuaacugcuaagccaucucuccagcaccugaaaguaauuucacaaaauucuuuuaauaugauggugguuuaaaauaaaucugguuuuuuuccugcuguuuuuacaguacuggagauugaaucuggugccucaugcaugcuaaguagacauucuaucacugagguacaucucuaucucuuauuuuauucuuuauuuuggaagaaaaagguuagcucaugcuagcuagaguuagggguuggucugaugcugcuaugaagucagaugcuaaccacuggccccaaagucccaaggcacacauucucagggauaccaaagauguuauauaaauucugcucaccaaucuucucugacugguuaaauaacaguggcugacagccacuuacuggagaaaauagaggucagugagguuucaguuaucagacuagggguuauagggagggagggagagaugggaaagcgggaggucucuauuagaugggaugaaccaggggcacaagaccaaaagaaguggacccucaggauagauagauggagcauaaaaaccgggugaacaaguaacuuggggaacgcagcuaggaaauagccagucuagcguagagaaauaguuuagggguaaucgcccaguauuuaugcuaaaacugauuaaauaaaucgauaagauucugacucaauuauugggaggcugaccaggucaaaauaagaauagcguuaauaaauaugauacaccaauaaguacacauggcuccagcugcauaugcagcagaggacagccuuguaaggcaucaaugggagaagaggcccuuggucccaugaaggcuggauagaugccccuguguaggggcaucaagggcggggagaaggggguggguggguggguggaggaacacccucauagaaguugggggaggggggagaggagaaccagguaaggggauaacacuugaaauguaaauaaagaaaauauccaauaaaaaauauguauauaaauaaauaugauacaacaagcuagucucuuuuuugggggagagggggggucgagacaggguuucccuguauagcccuggcuguccuggagcucacucuguagaccaggcuggccuggaacucagaaauccgccugccucugccucccaagugcugggauuaaagcuagucuuaaacacuuugcagcccaagauggacuugaauuugugauccuccuguguugggauaaucuuuucauacacuugugaagcugugucucuguccuuccucaccugccuaagcauuuucugauugguuuaauaaagagcugaauggggcuggugagauggcucaguggguaagagcacccgacuguucuuccaaagguccggaguucaguucuuccaaagguccggaguucaaaucccagcaaccacaugguggcucacaaccauccguaacgggaucugacgcccucuucuggugugucugaagacaguuacaguguacuuacauauaacaauaaauaaaucuuuaaaaaaaauaaaaaauaaaaaaauaaaauaaagagcugaauggccaguagcugagcaggagaggauugucaggucuuccaugcagagauaggaacucagggaaagaaucaggcaucauugauucaaggagggaggaacagagagaaguaaugggucaugugggaaaauguagauuagaauaaaugggauaauuuaagugagaaaaacuagcugagagguagccagcuaaggccuaagcuuacuaaauaaauauaagucucucuaugacuauuaggaaacugguggguugcgacagccuuaguccccuaagaagcuaggauuauaggcuugggccacuagauaagccaugggcuuuguuuugcugagacaaguucuccuacuguaacucaaacuaaccuggaacuaaguaaugcaagcugguaucaaacuugugagagaaucucuugucuaggccuccucaguugugggauuauaggcaugagucaccauauccaguuuuuaagauaggaucucagaagacuccaggcugaucucaaauuccugccucaacuuuuuaaguacuggguuuacagguacacacuacuauaccuggcacaaagauuuuggggcauuucaugauuuucguuugcuuguagacaggguuuugugcauuucagguuggucuagaacuccagagguaaucaaggaugaccuugaacuucucugccugacagcaucucugggaaagugcacugaaugcuagggauuaaccaaagacuuugugaauaguaggcaaacacucuaccaacuaagcuacacccccacugccgcccucucccuuuuuugagggggauggaacaaggccuuggacaugcuaggaaaguacucgaccacugaguuacauccccagugugagacuuuugacaugagcucagauaguuuuuccauaccuagcaucagauuggcaauuacugagcauuuuggauacuaaauuuccacuagggauuucauccugugguagaggaauagcuaagucauucauuuaagucccacagacugaauauacauguguauagagaccaguggccacugcacuucacuuuuaugagaugcuaaggauccaaacucagacucuuaugcuuguucaauaaguacucuacugacugacccauuccccuaaucaccaacacuucuuugaaccaggagcauguuuacauacacagugcugggauauagguggagaggagaaccaaaccacuugggccuuccacuuccccauacuggaagccuuggacucccuccuggccucucucauucccuauuuacaugcagacccuggacaauuuagcuguuaacagcuuucugcuucagcuuucuuuuuccuuuagcuccaagacuauguaaccaauggcaccuuaacaacgcuacuuggucaccuaacaaggacuucugcagugagaacuuugguuucuuaaaaaaaaaaauaauaacuaucauaagaauauauuuucauuaauccaagguguggaauaugaggcugcuuuagacuguucauaguagcuaugauuugccucaugcucucgcaggagcacaguuuugccacugcagauaauuucuacaacuaugugacauuuggaauucuaggaacuuuuuagaggguauauaaaugcuagggccccagagagguaugguggguugcagguuguuguuguuggucuaaguuugcuaaguagucaaagaagaaacaagaaauuagauauccugaugguaaagaucaaacucuccccaaagaacugccacucagcaggaagcagucuaaugauauuggugccacuuuucugcccccugacuuuauucagggaguucuucccuuccccccuauccuuuuuucucuccuauauaguauuaggaaaaggguggaagaaaagagguggagaagggugaaagagaugaacccacaaaguagcaaagaccagcuacacaccucacacucagcaaaaccaaaaccaagucucuaccaagcaugcccgcccucauccaauuuccuuaucguguacaguaaaacccagcgccaucccacuccucuuaacuuccagcuugcaaauaaaaaucuggugucuugaccuucaucacccaucuagaaucuauuaucuccaaguuuacagcaccucucuacaugucuuauugaagcaggucuuaccuuauguuucuuccagcuucaacccucuucagugcacucucaacaaaaaagacagaacaaggccaucgagaugguuaagcucuugccugauaccugagcucaaugccacaugguagaaagaaggcuuuauccugacuucugcucuuuuguaacugcaugugugcaugugcacuacccaacucacacucacaugcacacaccccugcucaguaagauggaacacaugccugggaccuggagaaccuauaauuguuacuuuacuacaccagcauaauuccuaacuacaguccagauauuuccccauagauccacauuaaguguagaucucagcccucaacaagggaaccucucuuugcaacacauggaaaccgcuacaaaagaacaaacuggccaaaaugcagagaacaagugaccauguggugcccauccccagcuguuaaaucuucaacacaacuccugcaaugaagcucagggacuaugggggaaggcagggccaaaaacccuuaagucaggagaaugggaaguuugcugagagaucacaucucuuagaauaucagagaagcuacccagaauccaauuaucauagcugcuaaacaagaccugaacaaggucaacaccaacaggcaugcuaacauggaaggggaacucucaugaggccccaaccccagaaaaagaauuacagucaaccaaggaacggugaggguaggaggagaaagucuuccuuugaagagccuccccaguaucaaacaagcaaauaacaauauacagacuaagcagauuuuauuuauauacuaaggaauacaggcacacgcacacacagugcaaggaggaaaugucugggaggggcuugaagaagaaaggggaaagggaaauaugaugugauuauguuuuaaucucaaaagauaaauacaaauuauauaagaaaaauguuggguuuuuaaaaaaucccauagcaagucuguuaaauuucacauacucaucucaaaaccucccaaggaguccuacucagaauaaacuugugaguccucacagugacccagcaaggauucaugacugaaccuaaaucaucuuucaccaucuuuggugaaacuuaaacaacaacaacaaaaaccuaaacugggugugggaggagggagguagcacaugacuuuaaucucagcacucuggggcagggcaagcagaucucugaguucaaggccagccugaccuacagagugaguucuaagacagccagagcugcacagaaacccaucuccaaaaccaaccaacaguguaggcacaugucugcaugugggcaugugaguguggugcccuaggcacuggguccccuggacuagagucccggggauuaugggcuaccuaacauagguacuaggaacugaacuggucuucuagaagaccaguaaguuaguucucuaaccacugaaccaucucuccaguccuccagcucacugaacuccuggggcaugaaccuccaugccacuuuguuuuugguuuaguuuuugguuuagucucgacaagaauguacuuucacagagcaugggguagguguacuuaagaugggauggaggggaguaggggaaggggaaaauaaugaauuauccaaaaaaaccuuuaaauaugcuuccaaagugagauuuguuuuuguccauccugcuacaguuccagucaccuauaaccuagcccacaucacucucccauauaagcaccauccaggccuauauacuucuggucuccuguagagaaugucaggggccucagacagcauuucuuuuccuuuguccauuuuucuaguccaaugucuagauugaaacuccugauacccaauaacaaauguaguuuauaaaaagaucaagguagguagggcaggauggcucacacuuuuuaaguccagcacuucaaggccagccugaucuacauccugaguucuaguacagugaggguuuuguggagagauacugcugagagagaaagagagagaaaacacacaaacacagcacacacaauuauaagaauaaccagaagcaacauuacaaggguggugggagaucagaagguagaucauaaaaugccacccagaauuauaucaggagaaaaauugcaccaucauacuguauuuaaaaaaaaguguuuuaucaccauuaacacaagucuucaaacacagaugucuuuugaguuugaucucacagcagcauuaaacacccacuuaauuucagcauuggggauguacaagcaagcagauauauuucugugagucuugggucagcauggucuacauauuagacaagacuaaacagugaggccuugucuuuaaaaaaaaaagugggggagaggauaauuaaguaauucaauguauuaucccauuccacaccuccaagaggcacuguggugugacagcuucaguuauucauucuaaaaaaaaaaaaaaaaugaauuaucuuaaaaaaauauacaccuggcucaugcaucuuggggagucaacguuccugcuuccuccagcuacggaugccauaaacugcugaaauguguauuaacuguaggcauuacucccaaguaagagccgacuacuucucuaacacagcugucagaagaaaaccaucaaaagcaacgccauucaagaaaaguacaaugaaaucagguagcaggacuccuucacaaaggaguggauucuugaaggcaggucgcucuuaaauuaaaaaaaggaaaaaagaaaaagaaaaccaaaaaaaaaaaaaaaaacccgcuaacgcugcugagggaaugagagaaccucuguuggggguggggugggguggaauggggugggguggguauuuuuagggcuauuagcaaacaacuuauuugauagauuugcaucuccaagacuucuggccaacauaaacaaagaaccgcacucuccagcuucagaagcaagagucaguuaaaaacaaacaaacaaacaaacaaacaaaacccacccacacuuaacccaguauuaggaccucaagaagucaaaguagcaugugacugauccgcugucagaacaggagcggggcucaccuacacagguuauugaacuucaaagacaaaagaugugcauguugugguagcuggaccagcggccaacaacuugacagaaguuaaagaggucggcucuucaauggacaccgcaaggcccacccucgcggcgcaccgguccucuccgggcaccagggugcccgcguccugaugcgucccucagacucccugcccucacgcccgcagccgcgagcccacaggcugggacgcuccccgagggccgcggccgagcgccggaggccgaggcgcugacgaguggccccgcgaacccgguacugagcgcugcggggaggcgcggcccgcccagcccaacacaccggccuccgccccagcgggcggccacgggagcccgcccgcgacagggcaggcguccgcccuccuuaccugcguccaucuucccuguccggcugccgacugaccgugccgucgcuccgacggacuacugcgcgacacggcgacgggaagccgcggcagccaagcgcggcgcagcggaagcgcgggcgucgccaucucgccguacggcggugggcacgcgggggguggggccucggcgcgugugguuccuaaccggacgcggccgccccgcccccggcccgcgccgccgcuucggaacacccgggagccggcccgagcugcgcuccuccggcgccgccaucuuuccguacagacagccacccgcgcaugucucgguacggacucaccgcccgcugcggccgcgacgccggcgccguggccgggcaguccgagcgcagcguggugcgggcggcagcgcgcagccaucuugccguacggcucggccgcggcccacgucccgagcugugucgccgcgcucccucggggcgggucgggccagcgggcgggcggcaaggaucggagccuggcggcgcucacgaccgaggcccgcaauggugaucugcugcgcggccgugaacuguuccaacaggcagggcaagggcgagaaacgcgcugucuccuuccacagguacgcggcccgccuccggguccgccacgcccccgcccuggccggggcccgcggggaaacugaggccgcgcggcgggccgagcuccggggaccgggaguggggggccggcuaaccgaggguaacugugggagguggacgggucguggagcuuuaugaccuuggcuuggaccgccggcuuuggggaccagcacggccaugccucgggcagagcggccggaggcccccuccgccaccuccaccaacgggcgucgcacugauuugggcuggcccugccaauuucaggaguauucugcaagggcgccuucucagguuaauccugaucuuugcuuucgggcaguucuccacucuugccucggcggggcaagcccgcccggagguguguggcaggagugcggcccggcgcacgcagcucuacuuccugcauccauagcccucaucgccuuccuaugggguccugcggcccaggcacuggcaccgaucaccucccgcauccugcacucuggcagaggcccgggggaugaccguggaaagggcuuuccaggggguucucgguggcccuugugcgggccgcgccuuccaaaggcuuucgagacucccucaguugguccucuccugugauuuccaacaggagugaacagcgagcgaagggacucugccuuggaagucacuucgcacauccugccaccucuuaguacuugguguuaaaauuuaaagaugggaauggcacguaucuguugaaaguucacaggguuacauuaagucuccaguccuuaagaccugguucaaaacaaaaccuaguaacguuaaacaaucuuacaagucaaccagaauguuuccguaacaauuucacauagaacaugccccagaaguuuuguuaacaguugaaaaugaggcaguguugcaaggacugauguuggcuuccccauguucuaacaugguauauggguagacagugcccaaauuggggcggggaaacuccagaaaucuagcucacuaaacacugauaaagguuauaagaucacauugcuuacaacguccagauccauccuauuaaggccagucuugguccacagcagguuccucgagacuggaaaagcucagguggagcucugagcaccugagaaagccuaccauguguagucaguuuggucucacaaaucuugccuuaagugaccauuaaauagcuucauuagaugagggaagaaauuacuaagcauguuauugaacaucuaauuuuuuuuucccaguuuuccucuuacgacguaaaauacuacauaaaauuuaccauuuuugucuuugggguguuuuggugugugugcacaggcacgugucuguguguguguuuugagacaaugucucauugaauugccuuguuggccuacaucgcauuguuuuagucugcuggucuuguagacguccuuccucugccucccaagcucgggaaauacuggcaugagccaccaagaacaacuggguuuuuuguuuguuuguucuggucuuuucagaaaucugccugccucugccuuccaagugcuggaauuaaaggggugggccaccaccaccuggccuuggauuguuuguuuguuuucuuuugagucagugucccuuuccauagcccugauuguucuggaacucauuuguagacaggcuggacuugaacucuccugccuuugccucccaacugcuaggauuaaagguuuacacuaccacccuaaccuaugacugacacauucagcauaacuucccaaagguuuacccaggcuccuaaaggagguuuugcugccuacuaagagaaauaccuaggcgagacauacaaaguacuccuaccagggagccaugcucccugcucuuuuuucuguucuguucuuuucuuuucuuuuuugguuuuuuuuuuuuuuuuuuuuugguuuuucgagacaggguuucucuguauggcccuggcuguccuggaacucacuuuguagaccaggcuggccucgaacucagagauccaccugccuuugccucccaagugcugggauuaaaggcgugcgccaccacgcccggcucuguucuuuucuuuuguuugucuugcuuugagacaaaaaucucagaagagacuggccuuauguguauugaacgaugacacugaacucugccagacaggccuuggacucacucuauaacuaggcagauguuagccaugggauccuccuaccucagaggaacugaugucacgguugugcaccauuaggccuggcuagagcuuuugggucuuuaugcuaaagcucuuuccuauacucuuagcuacuugagcucagcugugguugguuuuuagcugggccucucagauaucuccuggucucuugcucccagcucucuugccuggcuucucauuaggguuauagcacccagaaacauacuuuucagguaccagaugauuuggucagugguccacuggugaaagcuucuuuuuuuuuuuuuuuuuuuuuuuuugacaggguuucucuggacagcccugacuguccuggaacucacucuguagaccaggcuggccuugaacucagaaaucugccugccucugccucccgagugcugggauuaaaggcgugcgccaccacugccagaagugaaagcuauuucuuguugucuggauucuaccugcugucucugaccauccuuugugcgcagggucauuugccauaccuaugaguaauaucuguaacccuaauggacuuucuaugccuacccuugcucugaauaaggauacagagagacuuauauucauuacuauaagcuuugggcacucuaucuggcagauucucaguuauuccaacccaacaacaacugaccuggcccacaucccaccccacaucccuccacgugacccguuaccuguccauccuagucucauccuggcaucugcuccuucauccgugucaggcagggacuucacauuccugccugagacucuguau

SEQ ID NO: 311 - RNA, 18168 nt, Mus musculus
uguuucuucccaaaaauacuuuauuaaacaauauauccauaauccaugauccaaaaauacagauauacaucuuuacauuauuuaauaaaaagauuuaccauaguaucucuccuuuacaaaggggacauagguaauaauuccuugaaaauaaaaugugacauucauguuaaagcuggaucauccugauggauggaguguggcgaagagcaacgaccacagcacauucugagggaaaagacacuucuuagaccuccccugcuuuaaagcuccuuugggcauaggcagugaagaccaaucaaucucuguucauagaaaacagaguuucaaagccugaaacaaagguuccucgcuguuugauuucaaacccuuaagacuuaccuaaccucccagcccucuaacagggccaacccuggcaccgugaucacauggagaaguugcucucuggaugaagcauccccgccaaggccuucuggggucaaaugagggauagaaggcaagaugcuguauacacaggagcaagcaggugcccacuuccccagccauccacaaaaccucacacuacagggcucuucacuguagaguggaagacacggcuggcagccugccuccuacugaucccaccugcuggauaggcgaauggucagugcugcuuggacccauuacaccacuaacauguucacagaucuaggggcucaauuuuuuacuaauucaucaugcuucuucuauaauaaacuauugauaaugugcacagaaaacaagaaagaugaccccuccucucagcaaaacacuccuguacuuacaaggggaauuacacagggaagacccagccuuggcucaggcaaagcagcugccagucuguugaugaagcaaggacagcuuaagagccaggucucgaccagcaggcaugagagugucugauccagcgauggagacacucaggcuucuggagcagggcugaggggugugcucguggcuucuccacaucugaggcggagcuggugccggaacgcgucuccugaaguucccucuuugcuuacacacagaagcagugggaacaagccuuccaucagaauaccagccacaacccacagauuuuccuuucuguuuuccccccauuuuguugccagggaucuaaccuagaccaucacuuuuggaaggcagcuuuguucaccuacauacagccaauaccacauuacacuucacacuuguuaggcaugguuuuccaccauggagguaaauccccaaacucacgaauucuguuuuuuuuuuuuugccaagcuauaugcaucuuauuuucaugacauuauaacugucaaaaaggagauaaucauaggaacucacaaaauaaauaaaaaucagaagccaguauguaggguggccccagguagaagaccucagggaaagagccagcaugaccucaggaagccagaagauggaacucauccagccucuaacaccgccaccaguaaacgccacuucuuccugaucaucaaaggacucagcugccucaggcugaaucucacauaguaacccagcuucuaaggcauuaccaagcaagaucugauuaaaaacguccuguaguuacagaaacuguaaaaagcaguccagacacaguggcggccaucuguggucccagcauugccuagcuccagcaagaugacugcaaguucaaagcuagucuuuuacauaauaaagcccugccucccaauaaauaaauaaauaaucuaaaauuuaagauuaaaaggaagcaugaggccugaccccaagcacugaagaaagagaacaaaugguagaagaauaaagagaaggcuggggugugacucaaucugcagaaggcuuaccuaacacucaagaguucuggguuggagcuggcggugguggggcaugcuucucuaguccuagcacuuggaaggcagaggcaggagaaucucugaguuggaguucagccuagucauauacacaguggguuccaggacagccagagcuacacagagaaaucuugucuugaaaaaccaaaaaaaaaaaaaaaaaaguucuggguuuggucccuaccauugcaaaaccagacagaccuauuggugcacaccuauaaccucagcauuugggaggugaagaaagaccaaaagaugaacguuauucucagcuacauugugaguucaaagccugccuaggauacaugagaucuggucuuugggggaggggggucccucacaauuuuuaaaggcuaaguuaugucuaucuaaucugacccugagagggguccccaagaagaaugccagccccauucccaaagcucuuccuagccuagagacaaucuugugcacuugccuaucaacgacagcuaaccugccugguaccuacagcccaggaaaggucaacgcagaccaacauauucaguagcacaaacacaagccacuccugucuuccucuuucacuaggauaggcugugcaagacauuguccaguaagaacaugaccauggugacacagguauggggcagagacaacacccuucugcuuuguuugugaccaucagaagaaaacaaugugccugucauuauauaaagagccggccucuucuuacaucagaaauugcauaacccagcucugucuugcaggucuuuuucugaggugaggccagguaccgguuggacucuuuuaauucuucucagagagccugaguuacugaagaacaugccagaggaguucuaagucaaccguggcuuucaggagccugucgcucuuaaggaacaccacagaugcaucucaacaggccccggguagacauccccccaauauuucaagacaguucaacacugguuuuguggacaguggucaaacaaagaguacacuccaguuuccuaccuucauuccagaacugcuauugggcacagagucacaaaucaugucacauaaucaucguccccuugaacauaagcugcuggccuagugggaugcagcacagcagaguucuuacgaucagcucacaguagacagacucacuucauagacacacagacccaugaccuucaugcuaguacaauaauuucaucuucacaguaaaaaaauauaggcgggaauccccagagagcuggaagcucagccuggcugucuggcuguccgcugcugggcagugcuggcugugguaacugacaguccaaggcuaacggaagcucaaucuccagggagggccguaaguucacaggaaaagguggugcacaaaacgacagaggguacuuccaccugggaagagcccccggucccuuccagacacgucagagggaucuuggccaagagugccuggucuccaguaagggucagagcacagcauggggcagugccugacaauacuuuacucacagagcaccagcugugcuuccaugcugccacagacaguccuggaaaccguggacacgcaaggcugacccucuagucacaaagcaguggcaguguaacagguuaaaaugcguucacccugcaccaugcacuuugccuacagcucaaacugacacacaucacugaugguguggccauucccagugcugggagguugugggaugggggagccugcuccuaaagucacuguggcaagucccugugagauuguucugugcaaauggugcagcggcuucuuguuuuaggaaauauccaaaauuacaacuggccacugaauuauuaaauaucagucaaaauaagguaguuuuaaaaugaaagaucauauugcaacaugagugaggaaauauauuagcuugcucuucagucuggcacaacagccucuucuuuacuucuucuuccucuuuuccugaacacaucguggacaaaaccugugacgagaaaagcguugggaucaucguuucuccuggagcacaggaccccagguagacuuccugcauaucucagggugucuggacucuaggaaccaagugccauagagcagcuacacugaguaagaggugcucuuuucucugaggaaagcugacauuucaacuacugguucgagcauaucugaagcugacuaauaauaccuaucagcgcagccuugggaucaaguugauaaggcuggccauaauaugagguguccacuauagagcugacaccaauagcuggcuggcagauuggucauacucaagaccacauguacagacacgagccuguaagccagugaacaacagcuccuggcacagcuggacugggcccuauaugggucacacaggucacacagugcuaugguucaagcacacagaacaaacacacaucagagacucaguguucaccaacacucaagaauguaauagccacucaugacccaaagggacauucuaauaaguuccccaugugagagacaacucuaacacacguaacagcuaucaucacaucccucuguacuaagacgcucugagcaccuaggccaguacuacagugacugugucucucugaggaagcccauucugguaagcuacacaaagacugcacuggaaccccacuccccaauuccucugucuggcuuugggcccagcacaugaggcggcugugaggccuccagacucucagagggagcaccccaacagcuuugccagugcgguuggacucccucaccuggaaaucccacaaacaacucacugcaucuaccuugaacucaaagucagaccccacgccucacagggucgcucuuucccuagcccagcuacacaccugcucacaugccuaccaccacugcagcccagcuacacgccugcucacaugccuaccaccaccgcagcccagcuacacgccugcucacaugccuaccaccaccgcagcccagucaauucccacaaggcacagugccauaugggucuuguaacaugagguuaacacucacaccacacacaucaucagggcacugcggcagggcaugcacucuccuuuccuagcugacucuccaacuggccacaggccgaucuacacacugagaauguuaccaugagaugcuccgagugcuccucugagaagggcuggguuccuacuacuucauuuuaagaauaugcauccguauuuuacucaagucaacaccaccaggcucucaaaccucagagacaagcugaacacuagucuacugcugagcagcuguaggacggggacaagaauacacaaggcuccucugcacugucagcuuuggagaccugcgggagcagcagagccuggccuggcauacuggcugcacaccaggauggagcccaaacagcucuucuucacagagugccaguauaaacggcauauaaacccggguaagcugggaagcagaucucucuaaguguaccaccaccgcagccccuccccagccaggaccaauguugcagaaauagagacauacaagacccagagcaccagacacacuugcccaagggcagucacuccauacuaaccacuuuccuuugggcuuuguggugagauccacgcaggcaaagugaaaccacucaaugggacacugcaaagcaagggggaaagccugugucacacccaugcaagcugcacauuaaacacagaaaggccaacacccacccaucucuacaacguuuguccccagguauauguguccuucacgagccacucacaucuggauugucacagccgaucaucuccccguaggacaccugguggcacaagcaguauguaggcucauucggauccacaggcauguccagcacaucagaggggugcacagauaggauacugucaguaaacucagaccugaugggagagaaaggaucugaugagcacagggcaccaggaagaaggcaggaaacagcauacaaggccacacugugaaggccacacugcagccuuuccaccagugucccagggcuccuuuacccuggaacaaaggaugcuugcagcuuccaaggaaagacccuacaaugacucugagcuaaugaccaugcauaaacuuacuucuaauuuucuuguuagccuaucacugagguacgagccucaaaucuuccagccaaaucucuccuaagaauuuauaaugagaauaauacggugugcuaaugaucaguugaagagauucccuuggacuauucccagccacacaccuuggggcagcagcaaacagaaagcacacugcccucacaccagcugaggccccagugaucacucagaacucacuacacaacaacaaccaucacugucuacuggggacauagaccccaaaaggacaaggcuacugcuuucucugggcccccuccugauagggacauggagcccuaucagcagacagcuaacauuugagaagaguccauuugugucucacccaagucuggccuaaggguugaggcaggcauucaccaggcuacgacagccaauaaacugcucuuucucccgugagaggggacagugcauccucugcacuuacacaggcauccucaccccaaacaauacacuggcagccccucuuaccucccuuggguuccacguaucuacccacuacucacccagcugcccaccaggguaacaagagccaguaugguacacacugcccugcucauucaugcccuaaugccuacagcugccuuugggccucuguacaguggccuagugagacuccuguccuguaauuucugccugcucaguccagcaccacccuccacccucacuguagagcuggacauaagacuugcgagggcagucuagacaguauagucccuauaccucuauuaccacuaucccuaccugucgcuaaaccaggaacauauagugauaaauacauguggccagucccuaugagggaaauggcaaacagcauagcugcccccuuucaauuuccaaaaguuuccccgggccuuugcaguuacugcugauacacgugggugugcaucuacgguccagcccagcaccucaggggcucgagaaguggggccuccauagcagggaaccaauaccuccacucacuugucucucugaauagaaaugucacaagaacauguccaaguccuagugcuccacaauacuguuuguaagcaacucccaagagguccuucaagcaggaaacuuucuuuuuuuguuuuguuuuuuuguuuguuuuuuucaagacaggguuucucuguauagccccagcuguccuggaacuuacucuguagaccaggauggccuugaacucagaaauucaccugccucugccucccaagugcuggaauuaaaggcgugugccaccacugcccagcaggaaacuuucuuuaagaucugugacucugugccuugccuccuggcuuucauggccucuggauggcccuaccaucaguagccaaggccaggagugugcucaauucuauuggcuaccucuguacuuuccuaugggaagcuccacccaacagucacagacagucagcuaucaggugaccuagagcucagcaucuccagguucagucagugagcuauggggucacccaucuuuaaggcagcacuuggaaagcugggacaagagaauuccaaguucaaagccagcugagcaaugaagaaaauucaagggcagcuuguacauacuagaaccuugucucugacagagaaaacaaaagacagaaaugagcagaagaggacgagaagauagccuaggaagugggaccuaaagguaaucucugucccuugggcaugugacuuguucuggcucuuggcuagguaagcuuuccucccagauguggccaggaaucucgcacuagacaugaccacuuaugugauucccuaacaauccaggucgggcagaagggacccagcugcuuguccaagcuuuagaauaaggacuacagaagaagcugaccccuugguuuccacacguaagccuuggcuugccagaaaauguggcccuggggcagcuaaggagcuggcuuugacuuuagcucacaggacccaagaugggaaacagauggucuaacaguccuaggagaggaacucugugacacccgucgucuggucaaguggucacugacccacaggaaccugacccagcacugcuccaagucccccauggaaaaugacagcuaucgccaagcuggaacugaaauauuuagcuuaucucaucuagguagugauagggaccaggacuauacagcacuccagguuagcaacaggcaagugaaagccuguucagguucugaagccacacuaagcuaccuccaagauccagcaagggcaggauuucaauaacucuuguagucuucagaugccugcucuguagucagauguuaaggcccaaccacaccccuuguuccucaagucugcccugucucaacacaaguaaauuaggauagugucuacacugacguucagagacaauauaaagucaaugcagagcaggugccgcaccagucaccauucaggcaccacagcaggcagcccagcaaaugggccuguaacaggauggcucccaucaaaggagaaagugaacagcccgccucaauugugcguuuuuaggagcaguuauaaugucugaggccucaggaggaugccagccugugggcacuggucucccuaccaccuagaaaccccucuucugggcucuucaugcugaggacacucugugaaacacucuguaaagagagcagcaagaacgucuaugcaaacccagaagcagcaaaaccacagagacucugggaaggagcaaagacaucacacugccaccaaaagcucagaaccaccucuucuaggcagcaggacacuggugaccuauagugggagagggcuuucuccaucugcugaauuuggcaggacugguggcccagcuaccaaugugacacuuuaggaccugcacauggcagccaucuacacucagaauauguaccgaaugugggaacuaaaugaguacacuuacacaaaggcagagugacaauucccucagcucuggaaucugugagaccaggaauuguuuucacacccagccuccuucaacccacaagugguaugggcaggaugaacuggagguaaaaaaggcagacugaaaucgagggcaaccugugggaaaccagaacucccaacugagagccagggcaaguucccacaauuccugaaggaggguguguggaacaguacuaggcagacccuggcucagucugccugaaccagagaggaagaagucacccuaagggaucaggacggucacucuacagcuuuuauaacuacagccacguaagucauuuuaaaagaaagcacugggcagugguggugcacaccuuuaaucccagcacuuggaaggcagcagcaagcagaucucugugaguucaaggccagccuggucuacagagcaaguuccaggacagccagggcuacacagagaaaccuguuucaaauaacaccaggcaaagcaaacccucuuacccgcuuuuauguuucuucuucuuugggguauccucuucugacguccgccggccucggccccgggagcuucuuuuuucuuucugacuccggccuucugaagaacaaagacccccauuauucucacagaacagaccaaagcagagcaagauccaucccgauucauugaccaucgugucccuaacacauuuagacgagaccucaaagcuacaaucacuaguaaacagaauggcagccaacuugcuuuucaagcuccgugcuccagugcucucaaagucacuuccauccauccuguccuucaggucagccucaaagcgcgccaggucagcaucaagucuucggauguguuuauccaccugcaaaaggacacuuaaaaagcugaccucaggguaaaaaggagggcuagggauacagcucgguggcucagccuuugcuuugugugcaaaagcccuggauuagaucccccaggaccccaagaaaacucgagcaaacaaaacaugguuucaccaacaaguaagagaaacagcuccccccacccccucaaaaaaccaaaaucaugggaagaggcccagaugaagacccccaguguguccucucuaggugcuccaaacuccuauuccagauacacauuucuacacaccuuacacauuuccaugcaccuuuacacacucucacacagccuuacacacucucacacacccuuacacauuucuacacaccuuacacauuuccaugcacccuuacacacuugcuugcacacucuccuucaggggcacggaaggcagcaggaggcugcacuggccccugcacucaccaucucguaggucugcauggccagcugcaccuugucaucacuguacuccuugcacuugcuguaggcgcucuggaucuucuggaggugcuccacacgcugggcugacgagagagucuucacuguggaaauauacucugcagccaggaugucgaucucugcuuucuuaucuaaugaggacaggugacuuccguaagaggcagugacaagcauucaggaagcuggcaagagcaucgcuggccaugucacuguacaauuucuagacagcagcacacccauauggucaccuugccugguuccuguugcacaacuuaagucacauagccaaaggagugaacaauacagcaugacacauagaaacauccuggaugcuuccaugaauagcaacagcagagacaugugcaacucuuugcucugacugagaagugggacucucugugguuucagggagagaggcuacucccacaagguuuccagguaccacggugggucucuccagcugagaggugggaaagagaagcuggccuaauggcagcuaugaacucaucuacaaacgcuuuauaacugucugaaugucagucauauuuccaagaagugaagucuccucguuuggaaaucagugcuucuaauuuguaaacagucccagcaaugagcaaugaugucccaaagaaugccccugugaaacuuaaaaaucucagagaagggcuggagauauggcucagcgguugggagcacugacugcucuuccaaaggugcugaguucaauucccagcaaucaccugauggcucacaaccaucuguaaugggaucugaugcccucuucuggagugucuaaagacagcuacaguguacucgcauacauaaaauaaauaagucuuuuuaaaaauauuuauuuaucuaucuauuuauuuauuuaauguguaugaauacacuauugcucucuucagacacaccagaagagggcaucggaucccauuacagaugguugugagccaccaugugguugcuaggaauugggaagagcagucggugcucuuaacugcugagccaucucucuagucccaauaaauaagucuuaaaacagaaaaaucucagagaagaaagcuggagagacgacucagagguuaagaguacugaaugcucuucuagagagccuggggguucaacugccaacacccacacaguugucccucuuuuccucuacuaccagggaguccaaagccuucuuuuggcaucagacaaacaugugacacacauaugcaggcaaaauacccaaacacauaaaaaaauaauuaaaaaaacauucacauuacacuggagaugguggcaugugccuuuaauccccagcacuuaggaaaugguuaucuguaaguaugaggccagacuggccuacaaagcaaguuuuauuuauuuacuuauuuacuuauuuauuuuuaaagauuuauuauauuuauaugaauacacuacugcucucuucagacacaccagaagagggcaucggaucccauuacagaugguuguaagccaccaugugguugcugagauuugaacucaggaccucuggaagagcagucagugcucuuaaccgcugagccaucucuccagccgcaaagcaaguuuaugacagccagugcugcugcagagaaacagugguugagauuuggucucuugcuauguauuguaaugcuaaauucuguaucccaaggucuaguugccccagggugaauucucacaaguaugucaucuuugguuguguaaaccuugcuacuuaaagcuauagguugaauaaagaugccuacagccuguagccaggcagaagagaaguaggcggggcuaugguuccuaggcuuagagucugaggcagggaucuugagggagagaggaaaaaggugcuauggaggagguggauugugagcacauggucaugagggcccacuuguuggaguagaaguaacccaggcaauacaugacaacuggaagguacugacaggaaguagacaaaauacagcacagaauguugauaucugcccagcucuagugcuuuaaggcuuauuaaaaauacaaagguuuugugucuuuuacugggaacuaaaugaucaaagguaggguagauauucccaaauaauauuuacuguaacaccuguuacaaaacaaacaaauauauauauauauauauauauauauauauauauauauauauaaauuauauacauauaaauuuaaaucucauugccaggcaguggucaugcaugccucuaaucucaguacauaagaggcagaggcagaccucugagcuauaggccagucuacagagucaguucuaggacagccacggcuacacagagaaacccugucuugaaaaaacaaaugaauaaauaaauaaaucucaaaagaaaagagaacauuucuuuucucauuuuuauaaagauuuuuuauuaguuuuuuuguuuguuuuaguuugguuggcuuuuugagacaaggucucacuaugcaauccuggcuguccuagagcacucugguuagaccagucuggccuaaacucucagagacuugccugccucugcuucccgaguguuggcauuaaagcucugccccauucucauuaguuuuuaaugugugcauguauggaguucucuggaguuccacacccagacaaacagcacucaaaugaaggcugcaacaacuacucuucacaugagugcugucaccggaaguucaccucuauggcaaauuuaccuguccuucuaagucccugucaaaacaaacggagcaaaucaaaagggaggacuucaggauccaaggaacaggguucuccaaagagaauguaaacagagauuuucaagagcagcaaagaaaggugggcaaacacacauuaaucaacagccugggaaauggggacccuccagugggaccucacucugacagucuagggguugggcgguggcugaaagcaaagggcagaaagugggaagcaaagaaaacaaaguuaucaguaacuccaaggaaaacaguuacucagaaaaauccuguaagagccaggcuuagaggugcacaacagcgccaggaggcagagaggagaguaucugugaguucaaggccaguuuggucuccagagugaguuccaggacagccagagcuacacaaaguaaaacugucucaaaacacaauaagucauguaagcacaacacaggccugcccugcaaacacacccucuucaccagggacuauaguagaccacaccccggagacagggaaagugcuagcgguccagaacaucuucguguucacucggcagcacauguacuaaaacugcaaugauucagagaagauuggaguggccccugcacaaggacaacaaauucaugaagcguucauacuucaaaacaaaacaaaccagaagacaucuucacugucauaacaacaccagucuggagcugucugaaaauaagaaaaagcaacaagaggauccagcauccagugcugggugacaggcaaguaaaggagcuugccaccaaaccugacaaccugaguucaauucccaggacacaugagggaaagaaaauaaacaccuucaacaaacuguccucuaaaccucacagagacuguugggagcacagguacacauacagacacauguacacaaaaucaucaaauaaaauuggaagaaaaagaagccuagugugguugguggugcgcaccuuuaaucucagcacucaggaggcagagacaagugcaucucuggugaguuccaggcuagccuggucuucacagugagauccaccaaagacagaaaggaaggaaugaaggaaugaaggaaggaaggaaggaacaagggaaggaagggugagcaacaagagcauguugcuuagaaguagggaguugaaagccuggcaggacagcacuuucuacacucccaguaccugagagauagaggagguaggauuaggccaugccuacacagcaaguucaagaccaacccaggcuaggagaccccauuugaagggguggagggacagacagugaaaauggcucagugguugaagguauuugccaucaagcccgaugacccaaguuucaaucccuagaaagaacagauucccaaaguuauccucugaucugcacauauguacacucugacagaaacacaugcguaugaguauacaaacacacacaaauaaguuaacuuuaaaaaaaagugagcuggcugggcgugguggcgcacgucuuugaucccagcacucgggaggcagaggcaggcggauuucugaguucgaggccagccuggucuauaaagugaguuccaggacagccagggcuacacagagaaacccugucuugaaaaaccaaaaaaaagaagaaaaaaaaaaaaaaagaagaaaaaaaaaagaaaaaccaauaaaauaaauuuuaaaaaauaauuaagaaauguuccuaaguaugaaaauaucaaaagacaaaacauuacuaacuuucuaaacauugguggaauauuccuaauccaccaaugaaaauaugaaaauauuuucauuuuauguacauguuucgccugcauauaugcagauacacugugugcaagccugguagcuggugaaggaccuggaacgacaguuggaugugaaaagcaugugauuccugguaccggacccucugagagaacacuucuccugacugcugggacaucucuccaccuccccugaaacugucugaacacugacacgaugccaugacgggagagcccacaccugaccucaggugaaggccguuaacaugcacuuuagcauaagcaugauuucacacacacacaaucaauagcaaggugacaaaacugccuuccagacacacauuuucauuuguuuacacuugaguugcacucccaagauaggucccuacacaguccaaaauugaaaaacauaaaaacccaaaauacuucuggcccaaagcauuugggauaaggaacaaucaacuuauaaacagugcagaaauagaaaagaacaacaaagaugcugacugcaaaggacaacaguugaagagguaagacaggaaccuaugugggaacgggagagcagagcagugguggacacaugaaaucccagcacuugggaggcagaggcuggugcaucucugaguccgaggccagccugggcuacagagcgaguuucaggccagccagggcuacaagagauaggcuagggagauggcucagaggcaaugagagcauacggacacaagccugaguccucuaggaccucaaggaccgcacuuaaaagccaagugugguaggacgugcuucugcgauuccagugcacuuacuggagaugggcggcagaaacuggaaaaucccagcuagccugguauauacagcagugaagaugacaagagacugccuuucaaauaagguggaagaugaggucugaacccaaggcugacccuacaagaaacuaacccugaauuaaaaguaucagcauugcuccuccuucccaaauacguggaaggcuauggaaggugcacugagaguucaaggccagccugggcuacagaguaagacccugucucaaaacaaacaaacacaaaaauuaggcaugauaguggacaccuuuaauuccagcauuccagagguagaggcaaguggauccgaguuugggccuggccuggccuacacagccaguacauagcaagaacaaaacaaacaaaaaacaaaaaaaggaccagcacuccuuccaagacacugugcaauguuaacccuccaauauacaaggucccuucagggcccugugacaccccacgcccgcuccugucucucucuggugaaaacccagcccaggcuauacccaccuucuguucucuggucuagcucucgcaucagcuggaaguuccucugaaguucacagggaagguucucaaugccugaaagagacaagaaaguugcuauacuucucaauaagacaaaaaccugccuccauggaugggagagagagauggcucagcuguuaagagcacuuacugcucuaccaguaaucucaaguucaacucucacccacaaaaaagcucacagccaucuguaacucuaguuugagggauccaaugcccucuuucuguccuuggagagcauugcauacaugugguacacagacacacauguaaaacacccauauacauaaaauauacagggccuuacaccaaagccuacaacagcaggcuucaucuauuucuguccuaguuuggggaccaaaugauuaagacuuuguaggggcuggaagguaccaaacagugagcacaacaggcugacaguuucagaagugccaaaagcuggaggaugcagaaaccuggcccccagcagacacaggccgggaagacagcucagacuccuccccugaaccacacccucccucgccucuaugucacacacagugaacuucauccucccaaacucaagccagaaccuuaguccuccuugaucucuccaacuuuguccagauuccuacaaugccaggagcugcagaccauguggucucaagacacuguucucucggcaaggcccaacauaccagucucuagucacacacugcuaugagcacuggaaaggcagccauuagcaccgagcaggucccacugugcagcucaccagucccugcgguucaagugagcuggcuggcaaaccaacccauguggcuuuucugccccacacugcauccccuaguacagauacaccucaguccuuaaguuuacagcaggcuccagcugccucucugggucuuucugcacucaaauaucuccacagccaacaaggccagcaauuuagggcuaaauuuuauaaaacuugcuguucuaagccuauaacuuccugagcucaccaagacauuccuaucuacagcuugacuccagcgacccugucagcuacuuaaccuucuacccuccagucgcccucucuacucucagauagagagaccuuuaucagcaguuucuggaucuauauuuaccccaugccuuaaucuugggagcuauauauauauauguauauauaugugcguguguguguguguguguaccccaacuaaucagugaguuguagagaaauagggcucuugccaacgcauggguggcacagggcagguggagagagcagaaaggggccaucacacaaugucagcagugaaaugaacucuccuugaacccuccucagaaugcccacuggauggacaucagaauaaagauaguucaccuuggagucccacugcccaggcccaaggagaaaaugggcgccccacuggcuugaucuaccucccuccaaagggucucaauucuuccacuauagagugggaaauaauccuccuccgaguucuugcugggagccaaucucacggucuauaaauaaacggaguugccaauuucugggaugucaaaggucaacccguuauacagagcauccucccuuaccgggcuggcucgugauagcacgaguucccucgaaaaaggcaccccacuagccuagaguuccuuccuacagcuccacaagcaaacacaguggcuuuggcucuacagagggauuugagcaccacaagccgcaggugaagaaggggcgggccuccccgcaaccuagaccgaaguagagaggcgggaacagaggcguggucagcgucggggguguggccgaagcggagaaggcgggcugagccccaggccacaccccuccgugacgcaccuggaauuggcgcggcggaggcggcgggaccccgcgccgcgccccacgcccuccaucugcggccccgccccagacccgccgugagcccccacaguccccaugaucaguccccauccuccuccgcaucccggagccucgcacggaucgcggugggccgggggcggcggcggcggcgcgaacccgcgcgggcggcggcucggccagagugcuuacuguccagauagugcuccaaguacauggcagucgccaucuucgccucggccacgcucggggucugcgcgagcgggcggugccgcggacucggggcggggcggcgc

SEQ ID NO: 312 - RNA, 7886 nt, Mus musculus
caggaggcuucucagaagccccagagcuauuagugguugaacaggacagugugcaucacggagcuuguggcccagacugugccuggcagacccagaggaccuaaggcuuggcucuagugguggucagcacagcccucgguggucugcggagccugauauugcuuuacgugagugacugucuucuacuugucuaucuuguguuccaaucugugaggucauacuaaguuccuacugagacuuaaucuuuguccaggugcuaugcuaagaugccuccucuugguguucugagcuaguuucuucuguguggcucuugguaggcuggucaggaguggcuggugugggcugugugucuggcuauguccuggccuggggagccugaccaugagcuguuuggcuggugguggucuggccuagauggcagugggcucuaacuguucauguccugcagguaaagcagacgcugcucuuuuuccccaucagcuauauacacucacuuucuggucugccauggugccaaucagacagcagucucuggcagauucgguucaugcccccaacauaccucuaauaggucguucugugugggaggcuaaguggggagaaaauauucucugggacugccauccucugguggcuccaguuccauguggaaguauuuucuagcugucacucgguccagggacccaccgauggggaugcauggggaaggggguagcuguauggacaagaagggguaagguguucauaagcagguuucugaucgcacagagacugauugaugccuacuugauccuuggcuugugggugagguuaggaaauggcaggguauagaguaggaggcaggacaguagaugaucaugaggggaggccuuaguccuuccuuguucgccgcauccucccaguucuggaauucuguccaccaauccucuaccuucucagccucacacugacccugcucugacagggaggaauccacuuagggcuaagcuagggcuucucugcuuuucuuggcuuuucuuuuucugccuuuugaucgaccccguccccugguaaucucucuggcgcuuaugagaacuacuuggggguauguaugcugcagguaagggcuguucugcugugcaucuccugugucugaagcuauucgccauggagacugcuggagcucccuucugcuuccauguggguaggugccaggguucaucugccccugcugugugaugucuggucucacauaccacagguguugacacugaauacuucucccuaacuuuuuuuuuggucugauuuuguccagaacucuuguugggugaguuccaugaagaugaguguccaggacacaccagcuggcagggcaugguuucucugcccagcuccccagcacuagcuagccgagcaaaggagaagcuuagaaaggagggaggggccagauucauagacauuugggguacagugguagugaggggccuggggauggguugugagaaaucugggcugaggcagauagaaagcgccauuaagaugaucaggugacccugugauccauccaauagcugagguggaacaacaauaugaacuaaccagaaccccccggaacucaugucucuagcugcauauguaucagaagaugaccuagucggccaucacugggaagagaggcccauuggucuugcaaacuuuauaugccucaguacaggggugggggugggggaacgccagggcccaagaagugggaaugggcggguaggggaaugagggggguguaggguauggggaacuuucgggauagcauuugaaauuugaaguguauauaaagaaaauaucuaauaaaaaauaauuuuaaaaagaugaucaggugggcaugggucgugccuguggccauguaaacuugugaagccuccuccccaacagacucccugguaccuugcuccuacuggaagguuauggggcccacgcguguucccaggagaacggugcucuuccagagggaaaggacgggccugaccuaccgugugccugcguuacucugugugccucccaggccuacucugcuggccuucgcggaacagcgacuuagcccugaugacucccaugcccaccgccuggugcuacggaggggcacgcugaccaggggcucagugcgggugaguguuaggugcagaggaaacugagcccagcucuauagaucucccuggagacugaggccaggcuccagaagucucaaccaucugcuucucuucccucaguggggcacucugaguguacuggagacugcaguacuggaggagcacaggucuaugaacccuugcccggugcuggaugagcacucugguaccaucuuccucuucuucauugccgugcugggccacacaccggaggccgugcaaaucgccacuggcaagaacgcugcucgccucugcugugugaccagcugugacgcuggccucaccuggggcaguguucgagaucucacugaggaagccauuggugcugcauugcaggguaggugacaucugaugugugggaugggcugcugggguggggcggacggggaaagauggguguggacucuaguggacuugggcuuguccuuugcuugggucaauccaccauuugguggaccauucugucucucuuaucuccagcuuccugccccaccuccccugagagcaaugaccuccuaacacugucggcagaacugucugguauuucccacgcacuuuuagugacaggccaauagguguuggccagcuucuucacacugccuguuggcagggaacuuaagcccaccagaggcucuccuugucugugaugagggcugaaucuuuuauuuccaaacccaucuuuuuuuaccucuuccuuuugcuuuuuuguuuccuccucauccagcucugaucuccgggauucagucucuuuccaccucugcagucccuacuccccagggacugaccgccuacugcucucccccaccacccugaacccugcugguuggcagcuccccaagggacugggcacaugagugccacauagagggauguggcagguucugggaggaggaugaggaaacagggcugucuuaguuaggguuucuauuacuaugaccauaaagcaaguuggggaggaaaagguuuauuuggcuuacacuuccagaucauagucccucauuggaggacgucaggacggggacucaagcggggcuggaacccagaggcaggagcugaugcagaagccauuggcuugcuuuccauguuuuccucagccuguuuucuuagaaaauccaggaucaccagcccagggauggcaccacccgucaugggcugagcccucucccauugaucacuaguugagaacaugccuuacaccugggucuuuuggagucauuuucucaagggaggcuccuuccucccugaugacucuagcuugugucaguuugacacaccaaaccagccagcgcaagggcucauccgaggccuccucccuccacuguacuuggguggcaucugcuucagaaguugagcucugauggugaucaucaagccucugguggccaguggcugcggagugguagacgacuuguuugguuugacuucugggcuuagcaucccaagacaaacaaagcaaaacgcuugacccaggggcuggagagaugccuccgagguuaagagcuuguaugauucacagcucuuguaaagagcuguagaguucaguccccugcccguggauuggguggcucgcaauuaacuguaccuccggcuccaggguaucugucuuucuagccucuauggguaccugcauucaugaggaugccuuccacaugcccauaguuacaaauacaucuuuuuuaaaaacuaagaaagcacuugcccaagcagaccucuaggauucugaagacagccuugauaggcuccuccagucugagugcauuucugguccgauauauggaggcagucagcucuccuaacccaagggucuggcuccuucucucuguagacugggccaccuuugcuguggguccgggccauggaguucagcugcgcucgggucgccugcuuguuccugcuuacaccuaucauguggaccgacgggaauguuuuggcaagaucugcuggaccaguccccacuccuuggcauucuacagugaugaucaugggaucuccuggcauuguggaggccuugugcccaaccuacgcucuggagagugccaacuggcugcgguagauggagacuuucucuacuguaaugcucgaagcccucuggguaaccgugugcaggcacugagugcugaugaaggcacguccuuccuaccaggggagcuggugccuacauuggcagagacggcucgugguugccaggguagcauugugggcuuccuagcuccacccucaaucgagccucaggaugaccgguggacagggaguccuaggaacaccccacauuccccaugcuucaaucucagaguacaggagucuucgggggaaggugccagaggucuucuugaacguuggaugcccagguugccucucugcuacccacagucccggagcccagagaaucauggccuagagccugggucagauggagauaagacauccuggacuccggaauguccuauguccucugauuccaugcuucagagccccacauggcuacuauauucccacccagcagggcguagagcucggcuccacaugggaaucuaccugagccgaucccccuuggauccccacagcuggacagagcccugggugaucuaugagggccccaguggcuacucugaccuugccuuucuugggccuaugccuggggcaucccugguuuuugccugucuguuugagagcgggaccaggacuuccuaugaagacauuucuuuuugcuuguucucacuggcggauguccuggagaaugugcccacuggcuuagagaugcuaagucucagggauaaggcucaggggcauugcuggcccucuugauggccucacccucucguagccgccuggagaggaaggguagacuauauagaggagguuagggguaggucagcaugaugcuaggauggagagagcucuguccccucguggauggugguggugacucacccggggggccagcugcuuucugagugcaaaugagaaaaauaaagagcugcgcugugacuuuucuuuccacaucaaagcuugggugucagugcuuuagcuugaugcucugaucaccaugcaaaucuuccaccggcgccuugcucagcuuucauaucccaagggugccugggaggaaggcaacagggacaguggacaucacugcaccacuuuccacgacccugugugccaaccucagccacuuugaaacaugcugaugacugaggucuguucacuuucuuaauuucaagcaggagaagcagguuggggagccagccuccccagcuagaggggacagaacuugacuugagcagggggguaccuccuaggaccugcuccaugugccuacuucuuuacccuucucuagagagggcucuuguccugucagagcuguuuucucccuucucuuguuuuuucuuuuucaagacuguuucucuguguuagcccuggcuguccuggaucucacucuguagaucaggcugaccuugaguucaaagcuccaucugccucuacuucucacauuacugugauuaaaggcauauacuaccacugccuggugcccuuuuguauuucuuauuaaaguccuaaugucugauuauaaaaacagucugugugggcuggagugauggcuuacucaguaaagcacuugccauggaaucugggcaaucugaguuucauuuuuagcauccuguaaaaaucccaauuugaugguguacuuguaaugucagcauggagaggcagagauagguaaguuccccaagacucuuugaaccgacagcuuggccucacuggcacauuccaggucucagugagagacccugccucaaaauacaaagaaagagcugcugaagagugggucagaguugaccucugaucuccggaaguauaugauacacacccgugcaugcacucuuccuuacaaaauaaaaagcaaaacaaaaccccaacagguauauggccauuuuagaaaaauuagaagauuuagaaagcuauacauaaaaaaaaaugaccuaaagaaaaaucuuuacuguucugggcacuaucccuaucaaaccacuguguucuuuggccaagccuugggguggacacuguuuugagguggguccuguuaucuccacuagguaguggaguuuugugucagacuaacugggucuuaaagcugucuuuaaggccaucaggagcuacugacuugccugccucagcagagcauauccugaaggucgggguuaagucuccuucccgagcgaguugccuuccagugggccccuggacuccuagguccucagcgcucaucagcugccaaggacucugagggaauguccucugacuguggccccgaaagguaggggagggggaugugcuuaggcuuaggacaggguccuguuucagucugccuucacuguuaguagcacugugccacauggcacagacugggcgagcuuuaaaggaaggagguugauauugguucccacuucuggggaucaugguugagcagccuugucugaugaugguugucuugaugguagaucgugagguaguugaugaagguaugacauggugagaaacucuguguguguguguuauuuucucuguguucuaccuauacaucuaucuauguauauauguaucuaucuaucuaccuggaggcuggagagauagcuuagugguuaagaacauuuguuguucuugcauaguccuggauuuaaauuuucagcacccacauggcagcucacaacaacccauaaauccaguuucagaggauccaaccucugauauaccaugucagccagagcagacacggcugaaggugguuugauccccguauggagaggugacaauugggaagagagaaagaucaacuuaaccaugcaaggaacaggaaguuaaauacugaacagggaagguaaaggcaggaaguagauguagagggcaaaucaaugaaacccaaacauacccaaauuacgcuaaacacacacugacaugccaauuaaaaggacaaauuggcuccacuggcaaaaccaaaacagacacugaagauccaaacagucacaugccaacuaccgcggagggagacagacacagagaagaccgugacagacacuuggacacucuugagaguggaugugcaggaagagagcucugccaguggagaagaaagcacucagaagaaagugacagcagcuguaaauuuguauucugcuaauguuauguuccaaaguugaaagcaaaauuguaccaauucauaagaacaaacaggcugacucucaguugugacugaacgucucucaguaacugacggggcgagcaggccaaaggagagucggcucagaagggugcauagccacgccaaaucaaauaagcaaguacaaccggcaggcucuauuucuagcacaaaggggucugugccucauucugugcuugggucagagcuugggucucucauuuggauguaagugguguaguggagaagcaggaaauaauccggagcgcauauuuugauuuuaacauaagugcugauuugggagggaguuuugucaaauuguguuuuuacaauguuuuuuuuuuuuuaaaugaugcuuuuuuguaaaguguacaaaugugauauaagauugguucugcuacauucaguuucuauaaaagugguucuaaaauauuguacugucaaucaucucaugauuauucuacuguacacauuacugacuuuguauguaauaauuaauauuagaagaaaauauaauuuauuugaauauaaaaaau

SEQ ID NO: 313 - RNA, 962 nt, Mus musculus
guaggcuucauggcuagauauuuuuuuguuuguuuguuuguuuguuccauuuagguuucuauuuugaaaaaaggauccuggagaguuucuuguggccccugaugcucuguggaaccaaggguacugggauaggcaacugacuuccucagggcuauuggugcccagacagcauuuggggcaggaucccugagagugguuacugugacagguuuugggggugggagcagaugcugugugcacaaugcaggcugcagcaacagccucaguucagcuucuuguugucuguguuaugcacagaagcuaaaaagucgacaaugagcuuggcugucuuccucggucucuccaucacuacugaauggccacaguuuuccagaaccucuaccugggaguuagugauugacuuggcuaauaugucugcccaggacacaucaagcaccuggucuuguuucccccaaaugaucugugucgggaccuugaucuuguccauauucucaugcagagaguaucuggauuucucguugacgaucuccaaaaacaauuuccgguagaagcuguuaugagggaugcgaacaucaacaagaccuugaaggaucugcuggggcaacuugaagcggacauaggagcagagcugcagcaucucacucaucucuuccgggauggaugggaucaagggaaucuucugaauggcagcugacuccuccagcucuuugagccguuguacaaaaggauugucaguugaauacugcaggccuucucuaggggcugcuccuucuguccucaaacuuuacuguuaaaggagcaaacgauuucagagccggugcagcaggacacacgagagagacgggcugcagacaucagauggguaguaagcagcauauacuccauuuacguggccacucauggaggugccuauaaggugaaagggcuuuuuguucagcuuaaggcauucuauaaacuucaug

SEQ ID NO: 314 - RNA, 55910 nt, Mus musculus
cggagccagaaaagaaaccagccuuugccgaucguacucacacaggagucuagagaaccuuucuugaccaugcagggcuccaaaggaauagagaacccggcuuucgucccuuccagcccaggcaccccacgccgugcgucugcuucgcccucccagguggaggucucugcuguggccuccaggaaucagaauggggguucgcagccucgggaaucugaggagccucagaagucaacugagccauccccgccuucuucgaaucccccagcuucugaugagccgccggggucacagcuaagcgagcuugaggagggaccuugcggguggaggggcuuucacccccagugucuccagcgcugcaacaccccccaaggcuuuuugcuucacuacugucucuuagcccuaacgcaagguaaaguccagcgccagcuucugggggucuuuggcugagcugaugguuggguggggucaagcuuggggagagaaagaggcaggugcaggggaacccaccaacuguucgggucuuugacucugcucuagguaaccccccacccccacuuccccaugccuggguuuggaacuugaagacgcucuugccugcggguguucgcucuugccugcggguguucgccacauucugagugguccauauuuuaacacaccuccccccucccccuuagcauuuuuacuaauuuuguguucugccucauuuuagcagaguggauuccucuagggaagguucugagaauccuccuuugggaaaacgauaagucauagucuguguuuuaaaacccuacuaucuaacugagaucuagggaagggauuuguuuauuuguuuguuuuuacagagggaggauuaaaggcuuugcaaauaggaguggacugauuuuccaaaaggaggaacgaggauagaaguacuuacauuauguagcguagauuagauguagguaaucuuauuuucucgauauuugagaauguggggacaagcgcaguccugugaguaaaugagagaaggcuuccagcugugcagggugaaccuuaaucagcucuucagucucaggaguuaucgagugucuguuuguucuaggagcccuuuuaaacucccuugggacuagcagauuaagccaagauuuauccccccuggaguuuacaaucuaaacggagguuccuugagugugguggagggagcgagggagguguuuuuugaaaaggaagcagaaaggaagaaguugaaguugcuggguuugcuuucaacucaagggauagaaugaaggggaaguucuucuaagaagacuaucugaggagggaugggcuaaaaguggaacaguuugaaggaccugaugaaauuuaaguugaauuugguaugcagacauuuuugguauaaucccaaacuuuuuguaauagucaaggauagguugaaaggaaugaaacccaagagucaguggaggguuacuggaaauguuucucugcuaaauuaauagaaaacuaaauugaagucucucaucuccuguucuuauuuuauuucuguuuccccuacuucaagacacccaguuccucuucuucuuuucuuucuucacccucugggugcuagguaaauauuuguugacccuaaguaggguucagcuccuuuuccugaagguuuuugcuguaguugaauuccuuuccuuauugcaacaugguuucauucuaguugaucuugguuguaguuaaucccaaaguaaugauaguagaggauaguugcuagagcuguauagaauuaaaaaauaaaauauaccuuguguuuuaccuuagauuuuauucugcgaugucuguuacuccaagagauuuuauauucaacauaaacuauuguuuuaaacuauuauugaaaagaauugguacucucagagggaaaauugugucuacuucaguuuaaagcaucauuuacucuaguuuaagaaaaauaaccugagaagaaaauaccccaauauauuaguuuaugcccaaauugagguuucaguagcuggauguguauuguguaucuucuuauagauauuugcaaaaugaaggucuacuguaaaaguagugauaucugugacuauuuauuauuuauuuuuauuucauuuucacuuuauuuauuuacuuauuuguaaaaguuuuuuucuguguagucuggauauccuggaacucauuuuguaggccggacuggccucuaacucacagagaccccacauccugggauuaaaggcaugcaucaucaggccuagugugacuaauuuuuaauuagaguuauaguagguauauuggaagguugaccuuuggcguuugggugagaaauguuucauguuaucagguaacuaugucuuugugaaagucguuuuuaggugcuuugcacauuucauuuuacaaucuucaaauugcucacugguuuauagucucuaaaaggagccacagacaaacacgauuuuaggaccuugaaagguaugauaucaauuuuguuaaaguauauuuucagucacagucuuuuuuuguuuuuuguuuuuguuuuuguuuuguuuuguuuuguuuguuuuguuuuuguuuguuuguuuguuuguuuguuuuugagacagguuucucuguguagcccuggcuguccuggaacuuacucuguagaccaggcuggccucaaacucagaaauuugccugccucugccucccaagugcugggauuaaaggcaugcgccaccacgccuggcucagucacagucuugauaaagcaaaaguacagacuguugauauuaugaaauguuuauguucaccccagugaaugaugaacauaauacauaguaacucauaagcauaaucagcgaaaacuuuucauugcuuuuggauuuucacuuaucuucacauuucuguuccuauggauuuaacuuaggacaucuugauaucagucaccacuggacacucacucagccuucuuuaccugcuaguccuucauuucucuuaguagaggcagguggacuguacauagccuuuucuuccauauuuuacuuugaauaugauguagaacauugguggucaaaacgaugcccacguuuuuguuuauuuuuaauccuggcucuuugaaaucauccaucuaaaaugguccuggugaaccaaccuauauucccagcaccugaguacccaagccaguaagauuguugauucuaggugagucaagggacuucaaagaaccauaucucaaagugcgugaaggaggcuuuagcauuugugaaaguguuagaagaaaaggcuugagggcucagcuuccucuucuugaacuuaauucagggugaguugaaguuacagauaaauauggcugagacuauggagguaauugaaccuggcagucaugcccauuugugugauucuaguauuugcucuuuccagagaguuuuguggagaggaguguccugaaugaacuuaagaucucucuagcacacugguuucaugggacuuuaccagucuggcuuauguugguaaauuagagaaaagugaaauuagacaaauagccauaaguuaguacacaguaaugcaguaggcauugcuuuuguaaauaccugaagacgugacauuuuauaaugugaaaggcgaaauggcucuggaggaagcauguuuggacuggccuaacuuugauacuucagacacaucugaagccgagccugacaaacacagagguagaugcucacagccauccauuggacugagcacaagguccccaguggaggagccagagaaagaacuggaggagcugaagggguuugcagccccauaggaagaacaauaauaucaaccaaccagagcccccagagcucccagggacuaaaccacccaccaaagaguacacauggagggacccauggcuccaccuguauauguagcagaggauggccuugucuagcaucaauaggagaagaggcccuugguacuguaaaagcuugaugccccaguguagggcaaugccagggcaaguucggggaguggaugggcaggugaacacccuuguagaagcagggggaggggguuucaggggggaccgggaaaggggauaauauuugaaauguaaauaaagaaaauuuccaagaaaaaagaaaaagaaaaaguagaagaaacaaugaagcaaagcccaguguucuuccucacgaaugggaugcauguaguaaagcuauaauaaggcauuuguucuuuuccagguauuguaguaaacggccugguaaacauuagcaucuccaccauugagaagcguuaugaaaugaaaagcucacugacaggccugauaucaucgagcuacgacaucuccuuuuguguguuaucucuauuugugucuuucuuuggggagagaggacacaaaccucgcuggcucgccuuugcauccuuuaugauaggccugggagcgcugguguuuuccuuaccacacuucuucaguggaagauaugaacugggauccauuuuugaagguaacgucucauuauuuagguuuuuguuugcauuaauccucacgauuacauagaaauagguuugcugacacauguacaguaaggucaggucuaaagucauuccugaugcuuuguguaaauuguuaagguuggagaucagagagauagacuguguguuauuuguuagcucagcggcucuccaggucucugauuuccugcaucucuuaucccauguugugcacgguccccuuuaaacagaaaggaauccauccugcuugcagguguugaguucccugagcuucugagacuugcaggguuuuguuuguacuuuugcuauuugcagugauuacaacucugugcgcugggcuugcacauuccugguuuaagacaagacaggugaguuggccuguuagggccuuuucucucaggauugaaguccagcuuuucuuuuggcucuagucugaacuuagagcuugagagugaccucugaagacuguguuacuuugaguaaacaaagcccauuguucaacggcuugggaggagguuuagugaaccuuuugaguaaacaaucauuuuuaaaugcuaaacucaguuacacuagaguuagaggaaccugcuuaugaauuguggaaguucaccuggacaguuuuauguccuuucugggauuggcaauaacaaauauugagaagcuuuuugggauugggcaacugagaagaggccuggagagaaaaggagaaauugaaauauugcaguaaaagcauucuuuucuaaauuucuugaaaaacuacuuuuauauacauugguguuuuguugcauguuuguacauugggauucacuggaacuggagauauagacguuugugagcugaccuguuguuugcuaagaaugaaagccugguccucuggaaggacagucauuccuccuaaccaccuagccagaucgccagcccuggcaguucuuuuaaaguuaauauuuuaauauuuuuguguuaacauaaaaauaauauuaaggcaggcucaaugguucagaacauuugcugcucuuacugaagaccugaguuugauuuccagaguccacauaguagauuaugaucauccauaacuccaguugcaauggaucaguuuccaugagcacggggcaugcaugucaugcacauaccuauguauagacaaacaaugcauacauauauacauauauguaaacauuuaaaaaauaauauuagcauguuaauguuuuccaagacugacugccuuccaaauugcgugauaauaaggaauaagaccuuauucccaauaaaaagguuuguguuaugcgcuugguuugaagacuguacuuauuguauaagaauauuucaucuagauauaaaaaugggaaacaguauauggaagaagagaggaugcacugaaaauacaaaaauugccaaauaaguagcauaggagaagauacugucaguggacugaguucuuaagcggauucuuuaucugacauugggcaauguugcguaagaccgacugcaucauuucacuggggguaguuuuaggaacaaggcacacauugcagcauagacucugcuguuacaccuugaaaucuaaacaguacagaacauucaauccaacuugccucugcagaacacauccuacugauucugugauagggucaauguauuuauuuguguuugcaauguuuggggccuuauugcugcagugggccaggugccugucuucuucauugggcuguuagcguguguguuuuaauuuuuuguaauagaauuauaacauuuuccccuuccguuacuuccuuucaaaacuucccauguacaccgccuuguucucuucuaaguucauggcauuuuuuuuauuauuauuuguuuuuacauccagauaugaauauacauauacauuccuaaauguaaucucagucuguauaagguuacuuguaugcauguuuucagaauuggucacuagguauaagauaauuggugugcucaugucuagagaauauuauucucauuuugauuugguuuguuuguuguuguuauuauuguuauuugagauguaguuucucugaguagcccugacucuucucaaaauuuucugaaugcugggcuuaagggagaaugcaaccauugccucaaaaacucucuuguacuuaaagagacuuuguucacaagucucagauuuuaucaggggaaauguaaguaccuuuucuacaaaaccuuggccucugucccggugguccucagagucuaucuccuguaguacacauccugaguuacaguuagugugaacucuugauauccaaagggcaagagcuacuaauuacgguguuucuggggcauggaaagacuuggcucacggcugaaccugagauauuacugaagcgagagcagaaaguuuuaguaaauguuguguaguaugcaagcuugcccaaaauucuuauugcuguuguagauauuuuucaauauuuuaguagauuagacuacuuaguaguccacugaaauauauacuggauauaacaguauauauguguaucuuaccuaauaguuaucuguuauuuugaauuuuaugaguguuuuuccucaaaaagaaaaaugaugucauguacagagagagaacuugcacuuaguacacguagacuacaggacugaaguuucauuauacaucuguaagaagcccugcauuuaagcacagaaugaauguuccacucaaacccuuucuuugucacuuucuacaacuuuacaucgaaugaugcagugacuuauagugguuucauauucaauacuuccuaaaacaaauccuauauuuaauauucugguuuguuuguuuuaagacuuuauauuuauuauucauaguuuauuagauauugaaugauuugagggcacuuuuuuuuuccucuaaauuuaaacaauuucuucuuuccagagagaguaucauguggcucaggcuagucgugaaguguguauaaccaaggaugacacugggauggagguuaugggauacaggcauauggcaccauuugggagggacucuguguuggucugagaauaagagccuccugcaugauuagcucgcacucuaccaacugggcugaauccuuauccuuucuuccuuaauucaagaagccaaguaucauuuaaaaaauaaaucauaacuuuucugcucaaauaaguuaauucacuuucacaaauauagaaacauggaacaaaaaucugaauuauuuguuuagcugcgagaaauauagaaaaagaaaaaaacuggggauguaaguggcaaagagaaacaaauguguugaaagcaccaguaaguaaauuagaagccugaggccacaguauguucauaaguaaugaaauaccuaagucagggcgcagggaaggaacucagcaguaacugcuuuucuaaugcuauagcagcuggaguucuguuccuagcagagcauaaacugggcauggugccacaccugccaucugagaucugggaggaacagcuagcagaucagaaguucagugucaucuucaggcuccugagcaguucaugaagcauccuguaauacuugaggugcuguuuuacaaccaccuccaccaccaccaccaccaccaccaccaccaccaccaccaccaccaccacaacaacaucuaccaaaaacccuuaauguagaacaacuugagaagcacaacacucauuuuguuaacuaaagucagcccuguaguuucauuugaaaugaacuuugaggaaauugaaaggauugcaugcuuuguuugaaguucucucucucucucucucucucucucucccacuugacagaaaucacuuuggaugaguuaaucucuaggaggagauuaauguaacauaauauaguuaguaaguggaugaaaaccaaauaugaaauaugaguagcccgcaaaaugucuacaggugugagaaaugacaccaaaggagggugagagagcggagguagaaagggggaucuggaucagcaugguuucuuuugucuuguauaaaaccaaagaagacuggagacaaaggauacuuuuuuuuuaaucuggagauuuuauagagacauaaagauuggaagugauuagcuuugcauggagauaauggaauuuaucacagggaaguuuugucuauuauuguuacuggauacaaaaggagaaggcuuuacgaguaagagaaaugaauauuucuagggguuaaguuuugaacuuauugagcuaaaaauggaaaaaugucacaagauguuuccaaauaaguaauuuuuucccauuuuuuauuagguauuuagcucauuuacauuuccaaugcuauaccaaaagucccccauacccacccgcccccacuccccuacccacccacucccccuuuuuggcccuggcguuccccuguacuggggcauauaaaguuugcaaguccaaugggccucucuuugcagugauggcugacuaggccaucuuuugauucauaugcagcuagagacaagagcuccgggguacugcuuaguucauauuguuguuccaccuauaggguugcaguucccuuuaguuccuugggugcuuucucuaguuccuccauugggggcccugugguccauucaauagcugacugugagcauccacuucuguguuugcuaggcccuggcauagucucacaagagacagcuauaucugguaaucuuugacagugcuuagaacuuaccuugauuucacuuuuggcaucgacuguuuuauuguuggauucugugagcaggucaaaccuaggcuggcugugaacucuugcugaggaugccuuaaacucuaggaaauauaauuacagcugugaaccaccaugcacagcaggacacucguuuuugauguagcccugacugucuggagcacuuuugaauaacagguuggcaugacacucagcagagaucugucugccucuugauucuugagugcugggauugaagguaugcacaaccgugccuggcuuuuugguguuucuuaacugagcuguaaucuuaacucgucauuaacaaaacuaugauuugaaauauaacaagucuuuacuauacaauauuuugguucaauucgagguugucuguauuccuuuugaaugaguacuauuuuaacguugcugaucacaauaacuucugcacugaaggucaccuucggugaggaaaauaaaauucuauuuggagaccauuagguuucuaaagguuuaagaucaguagguuacacagaaugaauucacuugggcccaugggggcuuauagcaacucaacugccaagcagagagccugaccuaggcccuccacacauauguaacaagugagcaguuaggucuucaugagagacuccuaacagcagaagcagggccugucucucauggcauugccugccuuugggucccuuucuccuaacugggcugccucuucuagccucaguagaagaagaugagcuuaguccaacuguagcuugaaaugccaaggcugggugauauucaggguaggccuccccucgucuaagaaggggaggaugagugcauggggagcugaaaguagaggugagagggagggacuggaaagagaggagggauggcaagcagugauugggauguauagugaauaaauaacuuaauguaaaaaaaaagauaaguagguuagaaagaaguuuguacauaggauguugguugucccacuuuaaacaauugcucuaagaaagggaguauaaugaaaguugauuucuaauuuuuaucuugucuuuuaucuuauacuugggcagaguuuucuuguuuguucaguugaaauauggaauauuuguucaucuauauuaaagaaagcaugacauaaaaaaguucuaagguauuucagcugucaauucuguacaggugcuaugauuuugucugaccaugaggauucuuucuuugauaccucuuuuuuuuuuuuuuuuaauggaacucaucuuuauuuaggcuucuuccuaauauaauguaacaaauacuuuuaguuuaaauauaugcaauaaaaagacuagggcucgcuuucagggcuaguaaaugccucagaugaaauuaugguuuggcguaccagagguugucuuaguuauauuacuauugccaugacagaaugucacaaacaagguaauuuaaagaagaagagguuucuuugggguuucagaggguuuacccauaucaggagcauggcaggcaggcgcuggagcaguaguggaggagagcuuacaucugcuccaccagaaugaggcagagaagaagacauuggguuacccuaggccuuugaaaucucaaaacccagcuucagagacacaccucauguaacaagaccacaccuucuaauucuuaccagauaguuccauuuaaaaauucaaauaugaaccauuugggggcuauucucauugaaaccaccacaggugauucacucuucccaugacaucuuaaauaguaaucauucauuacccugggggauuguuuuuauuuaauguguccuguauuauugccuaguucuggucuacuauugaaggacaugucuuccuaaggucucugugagaaguauccaugaccugaguauuuugacaugccaguaguuuaucuucagugagaauucuucuaccucacaagguacugaugcccuaauaauauacuuaauaauauacuuagaccuaugagagcaucaagucauucuuucaacaugggcuugcguauucagugaccuagaaaaggagauacaaagaagugagaucaacaaagaaaagacaagcuuggauguucuuuggucaaugaguucagagugacucauugcaauucucagaucauacuugcaagguguguguguguguguguguguguguguguguauuuaacuagaauuuucuucaguaaauugagccaaauuucuugcccaugaaugguuuuaauuaguuucauaucugauauuuuaccauguaacaaaggaaguuaaaaagagaagcauguuuagaauacuguggaaaugcuuugaaaguacuguugaugugucuuucauaaauacuugauaaaguacugauuucauuggcauucuuggaaggggugcuguaguguaggauucuuuuuaagggaugucuaauguguauagcauaguugugucugaguagauaacaugcuugggagguaaagguuaaguaauuuucuuucuuucuguuuuuuguguuuuguuuuuuuuuuuuuuuucuuccucaacauugguaaaaaugcgguuuguggugaggaaaaaaaaagaggaaauucuaucuucauagacauguuccuuaaaagugcacacacuggucaguguuagccuuaaugagcucuuuuguauuauuuuuaaucgucuugcccauuagaugcaauugcacgcaucggagucaagcagaauuucuguuuuagcacugugcgacagcucugugaucccaucuagauaccgucaacuagaaauugccaugguaacuucuuaguuaaggcugugccugguguaaaguucagcaguccccugaacaguaguguagaaauaugaugaagucuguggugauugaaauggcugucugcuuucuguuugucacuagagaugguaguuacaacacuacagaaguaaaaacuuucccauagauuguauuugcauuucguuagaagcaccuuggucuugaugucuugccaaaauguggccaaauauuuugaaacuuccacauuuaagacuuaaggaaagaauuacuaguguagcucagcuaauuggauccuccuaucacacaauuaaauguggccguuuuaguagacaccuuugccuaauuuugaauaacuucauucucugauuuucagcguaguaauggggcguucuaagacuuucaggaaaagauagacuaguaagaauagaauggagaaggaaaaucaucuuaggauagccucaccuaggccauucacuauuaauuuaacaucauccaaucuuuuaaaauguauaugugugugcaaauaaucccaguguggcauugaccuugcuucuacucacgcacucacacccagucuucacucacacucaucacucauccaucagucuaccacaugcaaaugcauagcugcacauacauauuuaaaaugcagcuuagugaaacaacuggcugagccuaugcauauaaauaugucuaguuauaacauauguuggguaucucugcuauuaauagagauggagcuguagaaucuaugucuuguauuacuuaauuuuauagauaauguauuuaauuaagccuccuuuguuauguucuuauuaauauauuuuaugauucugguucaaaagguucuaguuauuguuuguuuauggcugaauaaaauuccauuauggacuggugagauaguucagcagguaaauuccuugcccucaagaaagaugaccugaacuucaccccucaaacccacauagucaacagaaagaacggacuucacagguuguucucugacgucuuuuuaugcacugugccaugucuguacccccauauuuaugcaaaugcaaauaaguguaacaaaaauuauaguaacaaucacuacuguaucuguaaagcaguuuuuauuuauccauuuaucugcugacauacauuugugcagauucgauaacuuggcuuuuacaaacaagacugcaauaucaauggauggguacauaucacugcagugcuuuggucuagauuuggaacuuauuguagagcugcuuuuaguuuuguaaggaacuccauacggacuuuaggacaacauucacaacagcaguauauaaggguuccuuuucucuucuccuuuaccacuguuuguuauuucuuuuuuuuuucauuuuauuuuuuauuuauuuauuuauuuuuuauuacauauuuuccucaauuacauuuccaaugcuaucccaaaaguuccccauacccucccccccacuucccuacccacucauucccauuuuuuuuuuggcccugguguuccccuguacuggggcauauacaguuugcguguccaaugggccucucuuuccagugauggccgacuaggccaucuuuugauacauaugcagcuagagucaagagcucugggguacugguuaguucauaauguuguuccacuuguaggguuguagaucccuuuagcuccuuggguacuuucucuagcuccuccauugggagcccugugauccauccaauagaugacugugagcauccacuucuguguuugcuaggccccagcauagucucacaagagacagcuacaucuggguccuuucgauaaaaucuugcuaguguaugcaauggugucagcguuuggaagcugauuaugggguggaucccuggauauggcagucucuagaugguccauccuuucgucucagcuccaaacuuugucucuguaacuccuuccauguguguuuuguucccaauucuaaggaggggcauaguguccacacuucagucuucauucuccuugaguuucauguguuuagcaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucucuuuaauagcugagugguacuccauuguguaaauguaccacauuuucuguauccauuccucuguuaaggggcaucuggguucuuucuuaucuugauaguuagacauuuguguaugaggaaagauggacucaaugaaucuuuaguuuguauuuucuugaugaauaauguugcuuuacaacauuuaaugugugcuuugucuuuuugagcagggauuguaucauuagcucacuuauugacuggguuguuggaguuucguauuuauuuuuugagagcauuaaauaguguagacacucauugucuguuagcuaugaugcugacaaggaguuucucccauucuguaggcuguuuccugacaguguuagucauguccuuugcugugcagaaguuauuuaauuuccuacauuucugugugccaauucuuagaguccuuuuaaaacagcucauagcuauuucuguaccuuaagguauuuucccuguuugcuucugacaauuuccuccauuuugaauauacuccuugugcagacccaguuucauuccuuuauucaauuuucccagcucauuuuguuaaaaaguauuauuaucuauuguauguuuuugacaguuugguuaaaaaucaaauggcuauuucuguauggguuuauuucuggguccuguguuccauuaauguguccauuuuugugccagaacugugcuguuuccauuuugcaugguugucucaauacuuaaaauccauagcugugauacaucagaccuugcgauuuuucucaauuugacuuugaggaucaagagucuuuugugcuucuacaugaauuuuggaauuuguuuuuucuguuucugugacaaugguuauuggaauuuugaggaggauuccguugaaucuggagauugcuuuugguaucauagacaguuccacaguauuaauuguaccuaucugugaccaugggagguauuucuauuuucuaguguauucuuccauuucccuuucugauauugaaaguuuucauuguugagguuucuuaccuccuuggucaauuuuacacuguuauacauauauuuuaaucuauugugaacugggaagacugcauuucaauuaagaaaauaccucuauugaauagaccuguaggcaagucuguaaggccaucuuuuugcauaauggcgauguaggagggcccagucuauaguauguggugcugcuccucaggaagugauccugggugccauaggaagcagacagaacaagcagauagaaaguccuccuuggccucugcuucaguucaugcuucucgggucuugccuuuaguuccuaccaggagcuguaacucuaaacuguagagugaaagaauucccuuuucucccuuaagauguuuuuugcugugcuuucuuuaucauagguauagaaagucaacuggggcaaucuuuaaaagagcggucaaucaaugucuuauagcaugaaagugauauacagauuuuguuggauucacauggaugguuuaauauauauauauauguauauauauugucuuuugaugggacuacuucaguggcauuguacuuuaaacuucaaugucuguguucauuucuaauaguagaagcauaauaaacuuuauauuuuaucuuguaccuugugaacuuacugaucucauuuaacagugguugagcuuguccaaaaucuuuggugguuuccauguagaugauuguguuuucuguaaauacugacuguaucuuguaaaauauucuuuuuucauuaauuuucuuuuucugcuugaguaaacugguagaacuuucuguuuuauuugaauagaaguagugaaaguuguaguugggauagugguucauguguauauugucaucauccaaagcagggaggcaggaggauugccucaaguuugaggcuaacauagauuauguacugaaugcuaaguaucaaaagcaacauagcaagagcuuauuuaaaauaaguggugaaaacuaauauucuuauuuuaggggaauuuuuuucaaucuucuacaaaugcuguagguuuugcagcuguuugccaaggcugggauaguuuuacaugacucuuugccugagaauucuuacuaaaugaggauuauugaguuuugugaaauauuacuuuguaaaagccuugagguaguagauuauacuuuuuaaaauucuuaauacugagccaaccuugcacacaagacaaauuuuacuugguaguuacauauaauuucugaguucuauuuaguaauauguuaucaggaaauuuuuuauuucuauucaaaaagaagguauucuuccuuauuuuccaucaauguccuuacaugguuggaagaagguguuugguguaggugggguagacacaggcucucagucucuggucuuggugggccccaaauuuaaugccauccaccuuuuuuuuuugcuucuugauuucuagaauugguuugaacauuuuagugugcacuaagccaggccaacugauuauucagguucuuacuuugagaaauuuucaaauuugggggagcaggauccacuuuucccaaauaauuucucuaguaguuacaggaauauucaaaugcccuucaucuuguacuuuuucuacuacugaucuauuucaccuauaauuuacaguuaaugacaaacucuuuaauucucuaguuuauagucuuuaggaucuguugugaaauucuuuuauuugggguauugaaaauugcucagucuuugugucucucugucucugccucugucugucugucuuucugugugugugugugugugugugugugugugugugaaggucucuauuagccuggagcucucuuuguguaucagaguggacaggucugaggagaguaugaguugugcucuauuuuuaucagauaaagaaguccaggaucccuguuggccucuacucuuuagcaaagaaaaaggcucccuguuuacuggaugcuacggaccucucuagaacauuacugauaugcuuucugagagaaaggaauggcuacauggacacaaaauuggaguuugcgggcuuguucugguuagaauaugcagaaaguccugacugcuagguaggcuuucucuuauccucucucagaagaagccaaggaggacaugggugcugcauuguuggauaaagcaauguggcacgaaucagcccagggguggggcuccugacuucucgcuggaggccaguguccuagcucucuuugucuucuagguuuuagcuccaaaggauggaaaagggaagcaaaaauaaaacucaagggaucacuaucauguaauuucuuggguaaucaauaucacuagccaguaggucuucauccucagaaucuucuuauaaucacuucuauuaauuaaacagaaugacuauugugguguuagaggggaaauaggugaaaguauauguauaccaccuucacggagaaauccucucucugcuuuaucauugcaucccucgcguuuuguaucacauuggugaaauguaacucuuugaaugauuugauguugaugaacgagggaccuguacaaccugccgucuggauaaacuugcuuacacauuagcaucaacucucagaucacuauggcuucacgagucaauccuauuuuguauuuacucagcaugguuuucauuagugagcuacagcucaucuguagucaccuuuauaggaagguugcuggugaauaacuuuauguauuuacauucuguaaauuucagaauaaaggaagggaccagucauucucagguuuuccaagcaguugucuggaagugacuuagcucaccuccaccuuuuuacuguguaaaacaacugacaggcuaagugcuaaauaugcucacccugaugucaauggggaaaggaaauuuagucauuuuccuaggggggcaacugauaauuuuuacauaguaacaaccacaaaaggaaguacuaaggcugaauaaugcgauacuuuagauccguuuucaaaaucaacacacagcaagauggaacauggacucguauuugcugaaguuuuuuuuuuuuuuuuuuuugcuccacagagauuaaucuuauuccuguccauucuguuucuuuuaauugucuuauaauaaacaucaaaacaaaguuacuuuuccuaccuauaggaacacuuaccagcacuggggagacaaagagacacagugaacagccauccuguaguguaagaggugaggugucagccaauguugucuauaaacuucaagguaauaaauaguuucagccuuaguucuauucagucuguuacaguugcuuaacacugugguugccccaagaaagcaggccucguaacauauuaaagaaaugggcauguuguguuuccaucaacuccuacuuagaaaagcagugcaggcgauggaaugggguaauuguuuguauucucaggccuuuguggcugcggguguuuggacuuuggcaguacugaauucccaauggagaaaagcucuggaguguucccuuugcuaaagucuaaccuugccuuugcuagaaggugaguuuacugggccgagaaagagacuggucuuguuuauugcuauauuugucauguauugggauaguuuauauaauuacauuuuuugucucucugcucauuuugacauucucaccauuuugcauuucuaucagcucuuaacacacuuuuauaauauucaggucauccaauuuuaugaauuauuaggcuuuuauuuugcaucauuuccauuauuuuugggucagucuuucagccaugcagaagucauaauggcuguuucucagggguuaaagggguuaagguguacauggccuuauaaagucuaauuaauagaacuaacacagaaggccguugcuauuaagucuuacuuuaaaauguauuuuuagaguaaauuuugcuuuugcaacaauaaauucacagaagaucuaaugaaugcucauuguuugaaauguucucucacugcccgcucugaucuaagauucaaaauaacguccaccuucagaagugaaacuggcccccuuucccaaguggguuucaaggggugcacugaggaucuaagcugaagaaaacuguaacucucacgaaaaagacaaaucugaaucuuuuguauaacacaaauucuuuuuuaaccauacauuuuuauaggcuauuuuauuuauuuacauuucaaauauaacacaaguucuuaacauuuuauuacaucaaaagcauaaguggguuuauuggcccagagucauuaucgguggugaaggcagaguaggauuguagacuauguguagucucccuaacccaugccagggaguucagauaucaccuauuuauuuauuuauuuauauugaaacugcuagcaagggaguagaaauauucaggcuuuguacauucaggcuauauauccuggagaguggauaacuccacaaugucaucaaaggucuggaggacuuaggagugauuacuaaaauauuauuccucauugauacguguuuguccagugcaaauucacucaagaacaacugucagucauugcaagcacuagcaggaggugguacuuguugcagcuccaacuccagauuugguaucuguucuuuaauacuuugguguucucuuacacaugggauacaguucuuuguuacuuacaaagacagggaagguuugcuguucuguagggccauacaaucacaacauuauuacguauuuaagacaaagucuuuuguuccuaaaaacuuaugcucuauuuuauuauuuauuuugagugugugguggugucuuaggguuuuacugcugugaacagacaccaugacuaaggcaacucuuauaaagaacaacauuuacuugaggcuggcuuauagguucagagguucaguccauuaucaucaaggugggagcauggcaguauccaggcaggcaugacacaggcagagcuaagaguucuacaucuucauccaaaggcugcuagugaaagacugacuuccaggcaacuaggaugagggucuuaagcccauacccacagugacacaccuacuccaaccaggucacaccuauuccaacaaggccauaccuacgaauggugccacucccugguccaagaauauacaaaccaugacaggugguaugggcaugugugugcgcacagcauugcaagcauguggaggcccgagaauaguuugcagaagucauuucucuccuacuucaucgcuucuugugauuaaacuugggucuuuagggaucugcccauugaccagcauacuaucucaguauuauguaaauucucaugaucuuugcuguaacacuguuguagacaauuagucaugcaugcaaauauuuuuauuacagcuacuagagaauggaaagacucuucugcaguuucuuucuagaguaggguacagugacaugucuuaacaugaggcaaugcauaggaaaugcccccauagcaaacaauuauuuguuaucuaauaacaacaguuccaaagcagugauuauuucauagcauagaaugucacacuggccgucaauauugauggaauuaagcgaauuggauaugauguacugaaagcaacugguaaagugcaugcaugccagaagauaaaggacuacuaaagcagugaaaucugcuaggacuuagcuucugagacccugucacaguguccauugugugccuuacauacuaugcuauaaccacaacacuuagcauggcuuagaguucagaaacaccgucuaaauuguuagucagcuauuagacuuuguauauggcuaccagguuucagugggaagaaaauaagucaaaguucuguaccagaugcuggcuguguugguugcagaguggguggaaaugggcaacuucuggcagguuuuucuagggaaaugagggagacuaauuguguuuuucucagugaaauagcaaccauuuguuucuuuucugcauuacugguuugcaggccuauacugugucuuguaauuaaaauagaaaggaaguaugucuauaaguaacuucuauaauuugcgauagaaauucaaagaauuuuucauaaagauucuaucaagaaaaauaacaaacacuuuuuucagugcuaaaaauugaaccauuugccuugaggguguuaggcaaacauucaaccauauaauauucguaguccugcugcugauuguugaauaauaacaacccuuggccuagcuauugaaaaaaaaugauuagagaagauuagucaagggaucuaggcaguugacucagaaaguaagaagaucucuucuuuuuuaaaaaaauauuuauaauuagauauuuucuuuauuuacauuucaaauguuauucccuuuccuaguuuccucuccaaaaaucuccuacccccuaccccugcuccccaacccacccacucccacuuccugguccuggcauuccccuauacuggggcauagaaccuuuuuacauaaacauggggaccagaguucaacucccaucacuccuguaaaaagcaagauguggucauucauuugcuuuuaacccuagugccaugcgaauuugagggagaacaauugcugggacuuacugacuuccaauguaguucuaguuucagugagagauccugugaucugugucuaggaaauaaggugaaaaaugauggggcaggucauuugaugucuuccucuggucuucacauacauccuguucuccauguuccccaagaguguauauacuacauacauaagggcacaugcaaaaugguauagaaggaaaaugagucuaugucaugccuauaauggauauaaaucaauacaugcaaaaaguaauuuaaaggguuauauaauucuguguagacucuuaugccaaaaauuaaaaccaauugaaauaauuaaaauauuuugcacuauuuccuuuacuuauaccugggucauacuuuuccaaaggauuuccuaagacauguugaauauuaacagcaugagcaguagaaacaaaaugaauaauuuggauacacgaagaucauauguagugugaaacuuuaugagacuauagucuuaauucacugguuacaucauucugagaauggaggcacaaaaacucccaacaaccuuuauccaccuuuguguucugaaauugauucuugugacaugcaauguaguguacagguaugcuuugcaaaauugcaaucagccaaacguguauauguaggaguuaaccagugcugugggugauacaucuaccccaaacaccuccuuacaaagcaaugaaaucuacacauuuacauuccuggugauuaauuugagugucuguccucucucgcucucucucucucucucucucucucucucucucucucucucucucgugaguacacuggagcuaucuucagacacaacagaagagggcaucagaucccauuacauaugguugggagccaccaugugguugcugggaauuggacucaagaccucuggaagagcagucagggcucauaaccacugaacccucucuccagcccaagugucaguuuauuaaauugugucuuuagguguuucgucucauuguuucgggucaccaucucuggucauguacauuuccugugcccguuuacuuuuuuuuugcuuuugugaucaguuuccuugugauugauauaaauauauaucuuucuuuuaaugcaguggcaucucucuuuuaaaaaaaaauacauaccuggaccagauuaggaucagguucucagaggaaacagcagccaggccaacaucuuaggcaggcaaaggcucucggauuuugguucuuuuuacaaagguagacagacauuugggaugccuugagucagcucuuccuacucuacuucugcauugucgaaaugcugcagagcaggaagcuucuguggccacccugcaccugguuccucuccuguuacaggcagagacugcaacuuggaugugggaggauggguggcuccugagugucaggcaaaguagcauuguucccacaucuuuucuagggccccaucaccagcugcccuuagugaguuccagccaggugccgagagggacccacacgccugagagcagagauucuuuaguuuugucuaucacauuuuaaaggacuguucaaaauacugguaagaggauaagcaagaggaauguggagugagcuagaagauacucugacuuggacagaucagaucgaaagaaauucagcaguguuucucugucuuuccagcuccaguugguagguaggaaguugagacaaaggaagaaaacacacucacacaaauccacacacuacuaaguucaaacaaagagggcagaaaugggguagcuuuuguuuaaacuuacuuaccuugaaguaccugcuacaguaauuaaggagucgugguuucuuuugauaacagcucuuuacggucuguucuucagucaagagcuuuucucuccagaauucucacuggaagcugggucagaaucccauucaccccacccccaccccccacccaccccuguggccuuucuuucuacuccugcuguagggugagcaaggggaaagcagagcuuacccucuguuugggcaacuuucuggacuuaauggaucugagcagagguaggggccugggaaguuuaugggguuuugugguaaugguuggacugagcacgugugcagacgugugcagauucucuugugucaauguuaauaauaaguaacuguauguccaauauuaacaggcagaacugaccucucacugguugguccauuuaaaaaaaauuauuauuuauuagauauuuucuuuauuuacauuucaaauguuauccccauuccugguuuccccucugaaaauccccuaucccauccccgcuuccccugcucaccaacccagccacuccugcuucccuguccuggcauuccccuacacuggggcauccagccuucucaggaccaagagccucuccucccacugauguccaacaaggccauccucugcuacauaugcagcuggagucaugggucccuccauguauacucugguugguuguuuagucccugggagcucuggggguacugguugguucauauuguucuuccaauggggcugcaagcucagcaaaugaucugucaauaagacaaaauugcaaccaacagauugggaaaagaucuuuacuaacccuacauccauugcuggugggauugcaagcugguaacaccacucucuggaaaucaguuugguggcuccucagaauauauccaauauauacaaagaacucacucaagaaguuagacuccagagaaccaaauaacccuauuuuuaaaaaugggguacagagcuaaacaaaaaauucucaacugaggaauaucaaauggcugagaagccacuaaagaaauguucaacauccuuagucaucagggaaaugcaaaucaaaacaucccugagauuccagucagaauggcuaagaucaaaaacucaggugacagcagaugcuggugaggauguggagaaagaggaacacuccuccauugcuggugggauugcaagcugguaacaccacucucuggaaaucaguuugguggcuccucagaaaauuguacauaguucuacaggaagauccagcaauaccacuccugggaauaugccaagaagaugcuccaacugguaauaaggacacaugcuccacuauguucauagaagccuuauuuauaauagccagaagcuggaaagaacccagaugucccucagcagaggaauguauacagaacaugugguacauuuacacaacggaguacuacucagcuauuaaaaauaaugaauuugcucuuauacucuugccucauucuugucucuugcccccuuuuccccucuaucuccccauucccuucaccccucucuccauguggucagggcuggccucugcucuccacucucuccuucucucugucuuucucugucucuacuacucucuuaacuccccuccucauaaccugaauaaauucuauucuauacuagaagaacaagaaacaaaacaaaacaaggaaaggccauccuauaugcaguuaccaaacccagacaauauuguggaugccaacaagugcuuacugacaggagccugauauagcugucuccugagaggcucugccagugccugauaaauacagagguggauguucucagccaaccauuggacugaacacaagguccccaauggagaagccacagaaugguugguccauuuacagaaaagccugguucuuauuuuaccugcacugcuuuucugaauucauaaacgauaugagcgcucccucuugugguuauucuugaauugcaugccauuuacuguuuaauuuuaccuaacuguuuaaugcaauguccuacaaauuaauggaauguagugugauaauuaaagacacguguauaauacuuaaugaucauaauuagcauuuagcaucuaccuuucauccuugaguuacucaugggaccugggccccguuugcugguucuuagucuuguugauaaaaagcauuuggaaauggagucagauggaaacuugaagaccauuuaugggaccaugagagaaaagcaacuaggaagcaaccuggaaaucccagaggcuuccuggaagagaaagagagaaaagucaaagagaaagccuugacucugguagaggucaggaaagcagggcuguuucagcaauggaaguuugugugcagcugcuugguaggguugucaaggugaaugagaacucccagguaucgagucugaucagcuucagauuuuggcuccugucugaagagggguaugugaaacacacugcuucaagugagaacuuggaaaaaggaguggcagaccaagcagugggggcuguaguaacugaggaugcucagaggcuugcuacacuugcuacccuucauaaggggaugauugcuccucccaucuuuuuaauuuagcuacacauguaccaccuuuccccaaagauggucucuggcuaagugauugaugggaucagauauauuaacucuugcaggaaaggacggcuguagucuuuauaaacuuguaauauuugggucagguuggaaugucaugucucaacccagaauaagagauacaauuuaggaacuuagggcuccucccccucucccucucucccagaauuauggaacagaguagauuagagauaauucaagaaaauuaaaaauaaaacuggaggucaagugugguagugcaugccuuuaaucccagcccucaugaggccagccuggucuacagacugaguuccaggauagccagggaucugcuacacagagaaaccugucucaaaaaaccaaaaugaaaacaaacaccaaacuaaacuguaaaaauaucuguggguuacagaaggaaaagaauuuucacuaaugagccucgauaagccuuccuacccccuucuugccuaguuuauaagguguuugaaaucuuuuuuucccuuagaaggcucauucuauuuugauaauauauuaaaaucagucuauacuggaagaacauuuugagaauaaaaugaaugaaccauaucguuuuugauuuaauaacuugugucauuucuuuacugccucuauggacuuggcuacacaccuacuuauuuuuucccucucucugcaugguuaugccccacuacaaacccauuagcuuuuuaaaagggucuuucaugguagaaauccugugucauauuuuccuauaauguuuggcacuauauccuggagaugauaaggcuaucuucauuuacuuuggaauaugccuauauuuucuuauccccgauuaucauguguuugcuugcuugcuuuuauaugacuuuccuaacuaacuugcugucucgcuauuuucaucuuuugaaaaaaguuugaaaaauuaauucauauuuucugugcaugaguguuaugccugccuguaugucugugcaccacauacaugucuggugcccauaaagaucagaagaggcccuugugagcugccaugugggugcugucaauuggaccugggcucucucuaccugaggaacaaaugcuggccuacugcugugcugacuccaguucucaugggucuugggguuugaugauuuuucuuacuuaucuauauuucucaagcgcauuuuuuguccuuauguccuccagucuuuacuucccuuucuguguucuguugcuaguaguuuguucuuuuauuucuaguuuguucuuucuuucacaacauuuccaugaguucaucaaccuacauauugaccucuuaacuaaggagauaaauacauuuuguggcccccucauccucuuaaauugguuaccuacaaaaauuuuuagauccaaaccuuaagugauauuucuuuauacucuaaauuuuggcaugauaguaauuccuaaaugucucaaguaacuuagaugcuuauuuuguuguuuuuauauacaccuuuaacuguuuuaaaugugacuaaaaugaagcaauuggaaaagguagcuuaggugaauguaauuuguaaguaaauauuuauguuguuagcuaaacuuuaaauucucauuuuuuucccccacaaagauacgugcuuaacaaggaacaguaccagauguucaucuucaaccucccugcuuucuaacuacuucuaugucuuuguccugggacaauuguugcuggggaccggagggacuccgcucuacacccuggggacagccuuuauugaugacucugugcccacacacaaaucuucucucuauauaggugagugaacccuugcuauaauguuuguaaggagggucggugaacagcuuaccuaauaugguuucccuuccuauugcuaaggggaaaagacaaagaaaaacaaguuaguugucacgccgcaggcguuucauugagaucguuaugauuguccaguuuuacugugcuaucaagucaguugcuggggugcuugauagcuuuauggugucuauccugagcaaccugacauuccugcacaggagggaacaacucagcagcuucugcuuugauuaugaaaccccaggggauugauuuuauucaggguauagaggcuucuuauaaggaugggacaagagaucauaagaaaaaucagaauacuaguugcccagaacacuauggaauucuucauuuggaagccagucuaggaaccuaucaugacugcccucugaaagauccaacaagcagcugaaagagucagaugcagauuucgcaucuaaccaauggauagaagcagcugaccccugguguugaauuagggaaggcugaaagaaucugaggagaaaggccauucuguaagaggaccagcagucucaauuaaucuggaacucugaaaucucucaaacauuggaccaccaaacagacagcauacaccagagcugauaugaggcccccaacacacauacagcagaggacugccgggucuguguucauucagauaugauacaccuaacuaucaggagacuggaagccccagggaauuuagaggucagguggggagguggggagggacagccacguggagagaggggguggggaggagguauggaauguggaacaguuggagggugggucagguggaggaauaaaauauugguuguaaaaaaauaaagaaauaaaauaucacagguucuaaaaaaagggguuuuuuuguuuguuuuuuuguuuuuuguuuucuguuuuuuuuauuuuuguuuuuuuuuuucgagacaggguuucucuguguagcccuggcuguccuggaacacgcucuguagaccuggcuggccucaaacucagaaauuugccugccucugccucccaagugcugggauuaaaggcgugugccaccacaccuggaauguuuuuguuuguuuguuuguuuguuuguuuguuuugucauucuuuucucuauuucuuucuuugaaacuuagcaccagaauagagaagucugugugucuaaauguuuuguaaguuaccgguuugucuguguguuacuguauaauaggggauucauggguaugggugacugcaugucaguauauguggcucagcccugacuguugagaauaugccaacagagaagcuucuguaauugcauuugugucuugacucgaguuaggaagcauccuuagaaguucuuaggccaucucacugaaaaauagucuaucaccacaaaaacuuacaaaucacuaauuucuagcauucugccgggaaagguugagacagucuaacuagguagcccuuggaucuggguuuuagaaucugcuauggaguaaaauaaagcaagccuucuaagaggcuguagaguagaacggcuucuuuaccuuguuuucuuccaugagacuguaagaaauaacuauugcucaaaggaaaacagugcgugugccccucaccauuaguuacacaauguacauggacuuguaaguacauguuuauuuuagcccuuaucauuacaaucauggaguucuauagugagacguuauuuuuaggcucuuuggcauaacuguuaaccacauuauauuucaugauauauauauacauauauuucaaccuaucuaucuauauaucuauaauuucgauauagcucuaaucguuaagaauuuuacuagaauuauuuuucuucccugguguuauaauguuaagcaaagcuguuuauaugaugauuccuaaugcuuuugaucuuuucauagguauuggcuauucuaugucaauccuaggcccugccauuggauauguguuggguggacagcuguugacaauguacauugauauugcuaugggacaaaggcaaggcacuaucuguuuuucuucuaauuuuuuauucuaucgcaguaaagugaaccuuguuucuuauucagaaugucaugaaggauuucaggacauaaaacagugugcacuauaugauaugcaccauugugucugcauagcuuccuggaucuuuuagcauaauauaaugauaauaauaauaauaaauuagcuuuucaguagauuugguugcagauagauagcauguauugucuuauaaguagcugaaugacaacagauucccuuauagcucugauaauauuauaaaaaacaaaauaaaauuuguugcuuuuauaaccaaggaagucaagguaaugauacuaaguauuauuuauccaauauauguauuuuauaccucacauuuuguguuaccuuauguuauguauuauccuacucaguucugcagauaauuacauucaacagggcauuccaugggaaaggauagucagcuuuugaauucaugcacuuuaacaucagaggaagucugccagagugauaugucugagggaaauacuuauugauauuaaauuaugagaguaucauaaaauuuaaaaauuauaauuuagagaaguauauguuacuuuuagcauagaucagugauuugcugugagauguauuuagucugcugcaauaaaugaaaaagaaaacuaaaugauauauugaaauuuucuauguuuuuaaguauuugucauguuuauauuuacuguuaacguuuuuaaaccaugauucuguauuugcugcuuuaaaaaaauuuauauauuuuuauucucuguguaugagcauuuugccugcauaugugacuguguaccauuugcaugccuaguaccagcaguggcgagaagagggcaucagauuuugggaauuagaauuucaagugguugugagccaccauauucugcugagaaucaaucccagguucucugcaagaacagcaaaugcacuccaccacugagucaucugucuauucucccaugguugccauuuuaugaugcuuucuggaccauuacucuuaauucuuguuauacuuguaugucucugcaugcuauuugacucgugauggcuuccuuacaauuuuagauaaagucagagccuaccccuuugcaccugaauuauaagacaugugauugcaaugagcucuacuuaauacugaacgaguuguaacucuuuuucccucauccuuauaguucggaucugacugaggaugauccccgguggcugggggcuugguggauuggauuccuuuuagcuuggcucuuugcuuggucuuugauaaugccuuucuccuguuuucccaagcauuuaccagguaaauccaucuccuuuaauuucagagagcuuuacuguacgucuagaucaguugguuucaagaugauuaauaagaacucuagaaucacccaauuccugucauagauguacauacuugccauuuuuauuuuaggaaaaaauaaauuaauauucaugauuugcacuuauacuuagugaguacugugaacuauccuuuaguaaaacuguccuuguguuuuauuguaauucuugccuuauguacauacaagaugcaauuguaaacuauuacuucauaugccguuagucaguaauuuucaaggaccaauaugugugaaaucauucaaguaauuauuauuaacugcccgauuacuuacucuuucuauuugcuugaaguaauucugccacauuaauuuguaagccuguuuuuaauauuagacagccugaaaaaaaaucucaguagaaaugaauguuccuuucuuauaagaucuugcuucuaaagcauuuuucucaaauuugaaggcauuuacuucuuuucauugccauuugcaacaaagauuuugaaaguggauggcaguauaugaagguguauuuaggugugugagguggguagaggcauguggaagagguggaauuugacagaagaacacuugacacacuggaaccaagggaacucaguagugacuuuccauucuagacuaucccacuauaaagccacaugaggaugcuucucucagaucuacucacagagcugugguuuaaaacaaagggccaugauggcagacagcaaauaguacuuccucuuccaagcucuugcuuauguauuguuuuagugaacaacaaaguacagccacauguguauuuuaaucuauaaagacugccccccaaauuuccaaauaaacaaagacuguuaggagacuucaggugaaaaauaauauauguuuggaacaaaucuaugcuauuaaauuaaaauugauugacuacacauuaauguuuagacagauaggaacuugaguuuuuuaguggauuuuuuuuucuuuuuaauauuuaaacaagguuucagcccaggcugauucugaccacagauucaugccaguccuuuuaucauauuuugaagagugcugagauuauagaccagagccauuguaccugggcauccuucaugcauauuaaugaauaacaauagcccuuagcacagcuugauuacaggcauagauauuuacacauuucauuauguuuaugaaccccaaaagaccaccaaggagccauuuccaguguaaccacauuacagucucuucacuauaaacuugaguuugggcuuacucacuguuaacccacaggacaguuuggugaaacaacccugaacucacugggacaagguuuuauagaaaauggaagcaagggggugggcgggguccauccugcaagcaucaaauugaaugacuauuauaagcugacagguggaugcucugaagcaucuauacaauaaugaacugucugaaaguauauaugaaacaaucagacuaaucuuugauuaacuguugugagguaguagauggggaguaacucuggccaaggauaagccaugggguccuuccugguacuuggguacagcuuagguucaacuuuggaccaaguuuccaggcuuugguuuuuuguuuguuuauuuguuuguuuguuuuuguuuuuaaagauggagacuggucccaagauagaguagguuuuggucucuuaauuaacagauagaaaagaaacaacccugaauucuagugaaauuuacauacccauagaauguauaucaauuaaagaguaagcauuuaauaacugauuaaauaguaaaaaagcacauuuacuaucccuccccccuagggacagcaaaaauucaagcuggcaaaacuucccagacucaucaaaauaauaguacuuccuuccaacauacggaugaaaauuuuggaaaaaguauuaaagauuuuccaacugcuguaaagguaaaacagaaguucucccccucccccaucuguguguguguguguguguguguguguguguguguguguguguguguguauguauguauguauguauguauguauguguguguguaaguuuuaaccagugucucauaggaacacaguacuuacauaugcguauauauugcauacacuuauaaguaaauaguaugcacacuaguaucauuuuauaacuuauuuucuuaucuacuacuauugaagcuuuuauauguaacuuuucugauugaauuucauugcccugugagcuccagaauagaagaauugaaagagcaugauuuauuuaagugacaguguaaauguucaguggcuccucauuaacauguagucugacuguuauuccaugcuaacuccccuaugucauccauugaucaguugucacuaaauuugacugucuuuaaaccuccuuccuuuugugucaccccuccuuaguuucaguaguuucagguuaucauucccucuuucuauugaaaguugugagguccuguguuaguacccuucccuuguguggguacgugaaugguuucaucagucuuuagcaggcagcuaugcuuaucgcuauccaaccaacgugcucaucuaucaguuaggucuggaaauuugguguguuaggcuuauacacuaauauuaugaaagaauuggcaguauagauacauauguaagguuacuuaacuuuuaaaaggcucugugaugguuuguauagguaugacccaggguguggccuuguuggaguaggugugucauugugggugugggauuuaugacccuauuccuagcugcuuagaagucaguauucugcuaacagccuucagacgaagauguagaacucucaacucugccugcaucaugcuugccuagaugcugccgugcuccuaccuugaugauaauggacugaaacucugaacuugugagcuagcccaaauuaaauguuaagacuugccguaguccuggugucuauuguucacagcaguaaaacccuaucuaagacuuaauuacuuuaauuaugaaacaauacucauccaugaucaguuucaaguuccccauuuaguggauucaggaauuuaaauguuuuaaaugaucugguaagagguggauuuauaguguagacaucuauaauaauccaagaaaaacagagucuuuccaaaggggcuuuuccuuccuaugcugggaucuugagggcaauaaaggcauaaugacccaaguaguaagucauuuggucauuugucaaaucucuaggugcuccacauacaaaugccccccucucucugucucucacugacucucucucugucucugucugucucucucucucucucucucucucucucucucucucucucucucucucucucucucucagugugugugugugugugugugugugugugugugucugugcguauuuauccauuaaccuuaauuauauuuuccugccugagggaauauuguaguuuaaauguuuguauuucaaugcuacacuuugcacuguaaucacagguauucacuugaacugcauuuuuuccccuuagaauuugaugaggaauacagucuuuauauguuuaguucuaucaacuacuucugaagcauuaauuacuacgggauuugccacauuuuuaccuaaauuuauagaaaaucaauuuggauugacaucgagcuuugcagccacucuuggagguaaaagaccccccuccccccauuuuuuaacuccuuaguacacugauuuuauauaagcauguugcuuuuauuaggagaguacaucauuuuggauagcccauacuuuaaaguuuuucguagaagugucugauucacugaaaucaguguucuguagccgacuuacgacagaccaaacuggacuaagaauauauuaauuaacacauaaguugauuacccuuccacugccugcaucgaugucuuuuuuuugcaugugauuuuaugucagguaaaugcuuuuaucuguggaagcuguggugaugcugguuuugauguuuuccagcugucaguaugaguuacugagcauaauuguguguuuuucauuaucuuacuuuucauuaggggcuguuuuaauuccuggagcugcucuuggucaaaucuuaggugguguucuuguuucaaaauucaaaaugaaguguaaaaauacaaugaaguuugccuuauguacaucuggaguagcacuugugcugaguuuuguauuuauuuaugcaaaaugugaaaaugagccauuugcuggugugucugaaucauauaauggguaaauauauuucauugcuuuuuauauuccugucagagauuaugugugcauuugcaaguauuuccuuucucaauauacaugauuagaaauugccuuuuuaaaacauuuagacacccuuuguuuuuguuucagugugacacugugggacuuuauuuuguuuuuguuuguuuuaacuugaauauuuaguaccaucuugaaagcuauggguguucagcgaguaagccgaugaagggaauuguguuuggcucagggaucucuucaaagagaaauagaacauuacagagaguuucucuuguaagcguucauagaugguagaguuugaauguauucuccaaaagccugucuucuggaaacaauccccagaucuaugagcaaaugguccuugaagaaaaggacuuuaggaaaugacaggagcccccagaucuaggauuaaugguuuucuaagaagcaccucagcuggcuuguccucucuaacucauccuuugaugaccuccucuaucaucggaggccaagcagguccacuucccuuuguuuggaccuuccauccucugguacucuucccugucucaagcaaaccuuucaccuuuuaaaauuguucacccuggacauucuguuauagcuacaaagagcagacuauggcaacauccuagagagaauuuaacauucuacuuuccuauuaacuuaagcauuuaagaauaggaguuauuucuggugaugaaauucucuuauuuggguugaaacucuaccaaaaaauacauugaaauaaacguaaacccguaucauacugauuguucuauuuauuuugaaauuuauguuuacuguagaggaacaaauuucucccucuaaccaguuuucuuggucagguuuguuuugcucugaaguccuacaccagcaguagacuaggcaggugagggcuccuguguucucuuucacugugcauguguguggcuuuugagggaggagucacuccagguaugagauuacauaguuuuguguaauacugcauucacauggcacuacauuuguuuaggaaaguuugccaauaacaauaauauugacuuguagcuauauucacaugucugucauuuguguuaauaugaugccaaguucucuaaaucaguguuugguuaaguuccauuacauuuaauccaaacaucaucgugcuuccucuuacagagacaauaaacucuuacuuuaaaacagacauuggaaaacaaaacaucaagugaacaauggguuauguaacuggagcucuagaaaguucuguagcagucacuaaaggaagucuuuucaauuuuauuugacuguaagugggaaaggcuugugacuuauuuaaaagcaacuagaguuuaaagguuuuaaggaguugugaaggaggaaaaggagagaggggaaaccaacacuaugggagaggggcaaaugagguacugcagggugccaggagggagagagaaaggacauacuaugggggguauacaugauaucagaaauaaaggccacuuuaagucaucaguuugaggggaaauugaauuacauuuccagaaauaguaaaaaaaaaaaaaaaaaaaaaaaaaaagaaaagaaaaaagcaauguugaaaauacaccuagcaagucagguguggugauauauguuucauccaauacuuuggaggcagaggcagguggauuugugagaguucgaguccaguaugaucuacauagcaagucccaggacagucgggauuauguaaagagacccuaucuuggaagaaaaaugaaaaaaaggaaggaaggaagaaagaaaauaugucacaaacauuuacaaguuuucuaauaauuuucuuuucaucacaagggcaaauuuuuauaaaauacagagaaacugacugaugauuggcaguauguuuuuuuuuucaauauuccugcuguguuuugcauaaugccaucuuacacauugaauauuuucaauaaauguuuggaaauuauaugauaauuaaguaucggaaauuuucaauugaaacaauuuuucucguacuagcuuaaguugcaaagacuguauuucucuagucuccuuuuuguugaccacuguaaguuuuuugugggcagagacuagaauacuuuaauaauaaaauugugcuugacaaaggcacaaggcagcguuuuguagggcauagcuguacgaggagauacuccacucagaaggacagauugcuuacaaucauuugcauuuauuaauuuauuuguguguaucugugggaagaaaucagcuugugggaguuaguucucuccuaagauguggacucagguuauccugcuuggggcccauaucccucugcaacuuuccuaguguuguaaaggcuaguuuuugauuuccauauccuuuuuuaccucuugcugacuuauuuucuaucuucuagcuugaucuaccuccuucaaaaacgucauugccuacuucuuaaguaccguuauuuuccaguuugauauauuaucuucaaauacuuugauguguccacugguuuauauauuuuaccuuccaaggaaguauugauuuacaguugcaugaaugaugcuuucucucuuaucucuggcucugguuuccucguucagcuauguuucuaccacucuguuuuugauagcauaucugaaauucacuaggcaauaaugaaguaagcuaccuccuaagaccuccacuuaucgccuucuauuaguuguauccaaccucaaugcagcuaacgacagaaacaguccaacauaaaauuguaaaguuaguuaaaacgguaugagauuguguguauauuauaguuagauuuugcaaugugugucauaauaucagauagugggauauguuuauacucuguguggcagaucuugucauuaucuugauuucuguuaaauauggaugcaaauggauauuaagauuucuaacaauugaucaguuguccacuaacuugagacuuuuaauauguauaaagccauagugguuaccucuuucucagaauuggguucuccucugcuagauaguaggagugccuuugaauuccuugaaauggcucuauaccaucuaucaauuaacaaauauuacugauucucuguuaaaaaguuuucuccaaucuuucuuauacucaugcuguauuuaaguuucucuuuauauucugaucacuuguuuuggauguuaugacuggucuccuucccucaagcucauauucuaugcaacuuuagaggagaaaugcucccugagcgagugugagaauccauggguauguuggaugagcauggugguccacaucuaaucccaucgcuuagaauauggagacuguagaucuccagagcaagugguuagcuaggccagccuguaucagaaaucucugggauuaaugagagagccuaucucaauuaaaaaaguaaccaagaaagguacucaauguuaaccuuagucacaugcacacauguguaccuacacagaugcaaacauguauauacacauucgcaugaaaacauuuuugaugagccuuugacaauauuauacuugaauguaacauauauuuguaucaauagcagucauuuauuuuaacaaggcaucugagacaacuguuaaucuggacccugacuucuuauaagaacauaccuuuucauuuucuguuucaaauacuguuuccguuucucuuguucccuaguuccuuucucuaauuacccacuaccuggcuaaauuuugcccaucuuuuaaggcucacuuaggaguuagcuucucaggguuccuuuccucaaacuuucccucauguuaguuauccugccuugacguuuguaaaaugcuaucaguaaaccauagucccagaugaggauacaaugguccuaccucuauuccuggacucaaaucguugaaguguggugcucuuccauucagcuucaugcucacuuuagucaacacaaggcauacuuaaugccugcuucagaaacauuguagaguggaugaauaggcaaggcacuggaaaucaucccuugaacuaagccuuuguauugaaaccucuaugaccuuaugaacuucugugcccuguauacuacgacuucucacaggcaggaagagagggcauaaucaaaauauuaccaagucuaaaauuaggaaauuuacuuuucccaaaguaagagauuuuauaaugauauuaauggauuaaacaacaugauuuuacucgucuuuuuuauuuaaaaaaguugucuaccuuuugaggauguuuggaaaggucuaacuauuuucauugccauaauuaaagaaaaagcuacuugcaacuguugauagaaguagaggauagugcuaaccucuugauggauaauccguagaaucaagagcaguuuguugccaugaaaucccaguauuuacugagacauucacuccauucccauuuugugaaaacuauuaauaccucuuauuugacaacuuuccccuuaaaggcuuacucuaaucagguguucuuccccaaaaccucacccauucauugaacaaugugucugaaauaggugauaauuaggccuuguguugaguaaugggagcaugaagcuggguaaaauagcaccuugcguccaagauuucagucuauggauggagguagguuagcuguauacuaagucacauggaaaagcagacauuguguuuuaugcauuuaguauuuacauguugaguggcugacuaaauacaacugcuucugaauuguucguaggcguuaaugucacagaaaaucucacuucaucuaucuuuucuuauuuacagaacuggagaaauggggaauuugacugcaccuuguaaugccaacugcaacuguuugcgguccuacuauuacccacucuguggaagugauggaauccaguauuuuucucccugcuuugcagguuguuuaaacucaguuucaaacaggaaacccaagguagccauguuuccucuuuaccugaaugaaguaaugugaacugugucuugugauuguugucuuggcucuccuauugggcuacuuugucuuuucccucugcuugccuuccuuucccaguuacacagcucuggucuucagacccauuccuucaggucucaggcaauucuugcugaacucagcauggcaaauauaguaccacuuuauauuguuuugguuuuuucucaauuauaagaugcauuaugacagcgugauuauaagagcaugguuauauauaaugaauaucaggaauauaaugaaacugacuaauuauuuuccaauuucacaaacauccaaaucaguaauucugccucaaauauaaauuuacuuuuaauguaucuugguuuacccagaaauuucuccuuaauauaauuaaauaacuuaagacaaacaaagcaccuaucuuagcagccagugugcuugccuuucaaguuugagccagaggacuccauccuaccauggccuaugcuguaugcaugaguuguguugcaggauauuugaucacacugugaacccugaaauuuggcuauugacugaagagagcucuuucuaguugugguguggcucaacucuuagcacacgccuuuaauuccaaacauugaaguugaaguuaguuuguagaaauaagcacccauguuugacaguggcgucucauugaguggcagacaaagugacuaaucagagaaagauuugacagaauugcauaugcacaauucuuaggaguauagacaaacaaaaagagagagcagcacagagagggagaaggaaaggagguaguucuacugcgaugguugaacagagacagauugaagagaggacaaacuagacauugaugaagaaagaacaacacagagaaugagaaggagcuauccggucagaaacugagaaaaaacagauugauuuacucagcuuggagggaaguuuaagccagcacagcugaguugaaucaaccagccaaagaucagaaagaaguaggaaggaaggagcuuauucggcaguaagucucagaggcagaacacauucuaggccuagauaagauuguauggaggcuggaagcuucgaggacuaggucuagguuagcagacaguggcaguaagcuuuggagacaacacuuaauacaggagaauuuaaaaaaagaaauacuuuuagaguguuggcaugaaucugccuauuuuccagcacucaggaggcagaggcagaacugacacaaugagacccugucuaaaaaugaaaagauaaaaaacaaugucagagagcuuaagacuuuagccaccaaauggagaccuauucaaucuaguuaaguuggaaggcuuugauuucaagcacuuugacaaaauuuaauaguauaucaauugucaggaauaaaaauccuacaagugagcuuggcagcaauauagagucagaauuaccuacacgguaggugagugacuaguauuuuccuguaguuggagugugugccaugugugugccugagggagugaagaagauaugagaucccucggaacuguaguuacggaagguugugagccacgauggggguacaggaauugaaccgacucugcaaaagcaauaacuauucuaaaacaucucuccagccagagacacccuuuucuuuugaacuauuuuaugauaaaaucauauauaauaaaauaauaaaugcuugugcauuuucuagcaauauaaacgauauuuucuguuagugacccaaaugcaaaacuggcauuggcugauagcucugucccauuuuuuuuacuugaaauuuucaaugagagugugacagaaaauaccauggucaguuucuugucuuaagguauuuaaguuggggcaucuaacaugccucaauggacaggugcuugcagugaagcgugaauagcuaauuugaauccaagagcccacaugguggagguauagacucucaccaguugucaccuuuccucugaauguguucugugacacaccagacucccucgcccacaguaaauaaguggcaaaaaauuuaaagucuuuaggauaaaugacuuaauuuuuaguauauacaucugauuauuccuauauaauagcacaggauagagcauuguuuucauauuuacucuuucaaaccagugucacugguauuacaacugugucaauacagagaaucuacccuugaaaccuugaaaacacugcuuucuuugucuucucaucucacugauuuuguugauguuuuaaauguguaaaaaguuuacauuaaggauaaacauugagauauacaaugccuuuaggacuuaguaaaguuucuaaauaacugauugucuuucuauucagauaaaacaugaucuuucuuguuuguaaccaauguuaugauacuauacauauacaucuaugccuauauauaaauauaugagaaauaaccaauguucuauuuauguuaacuccuuuuuuguuaucauaagcauacuauaaaaagaauaacuugccuucuauaagguagaucaaaaguucagaaaauuguauuuaaaauauuaugguuaaaagaagcauuuuguuaaaguugugcacauaagguaauuuuaccguggcacuuaucaaaauuauaguguuuguucuuucaaacuagcucacauaaugauauugucagcaugaaugccucuaugcccccuguaaugagaaagaagaguuagaaggaagacauuaucuggguaauuauggucuacugaaaguaauauaugcagaacaagaggaaguguuuaaccauuauauccuugucaaguuguuuuaugucaugagccaauaauaggcuacgagcugaaguuagcagccacaaagucaaauacagguacuucauauauguggcuuguuacaaugugcuuccuuucuuacaaggucuaaugacucucagcacuauuggcucccuauagacuagacaguggcaaggugauacaaagacauguuugaauuguacaacaacuuugacauuuuuguauuuaaauuucagguauauuauaauuguuccuguauagaaaggaaaaucacuucuacugcagaaaguacugauuuugaagcuaaagcuggaaaauguagaacucgguguucaaacuugcccauauuucuuggcauuuucuucauuacaguuaucuuuaccuuuauggcaggcacuccuauaacugugucuauauuaagguaagcacugcacuugagaacuugcauuuccaagaaaagaauguuguaaacuuagagguucaaguaggcuuuuauugauuugaacaauaccugucuggggcaucuuggacucucagacuccauagaagaccaggugccugagguuuaaagaagcuaaugcaggaaacaucuucuguugcccaggucgcaaauguugggcauuagucccuugguggguuucacacaugaccagugugagcugcaaauuugauaaguuguguggaagucuucuggcauaaucacagucuguuuucuaaauugaagagugggugcuggcaaaugaacucgcuacaaaaugcuaagaagcuagcugccaucuccgaaauagauggaggucuuuauuguuguuuuuuuuccauuuaaugcuguucuacaagagucuuuaccuuccaucuggagguuuaccgccuguuuucaaacaaacacuaggcuuucucuuucuuucuuuuuuuuuuguuuuuuuuuccuguuuuuuuuuuuccauuuuuuauuagguauuuagcucauuuacauuuccaaugcuauaccaaaagucccccauacccacccacccccacuccccuacccacccacucccccuauuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauuuuucuugaguuucauguguuuagcaaauuguaucuuauaucuuggguauccuagguuuggggcuaauauccacuuaucagugaguacauauugugugaguuccuuuaugaauguguuaccucacucaggaugaugcccuccagguccauccauuuggcuaggaauuucauaaauucauucuuuuuaauagcugaguaguacuagugguggcuuucucuuucuuaagacauuuuuaguauucauccacuaugguucauauuuuuaauaaauagaaaguauauaguuuguaaaugauauuaaauuuuaacauugcucuacuggagauuagagauauuuaguaaaaagaaacauaauuuaaauuauauaacagacuuuuuuuuuuaauugcuuaguuguuugugcuuauaguuuuuuguuguuuuguaguuuuauuaacauuucaauaucgagcucuggcuggcuuugaaccugcagucacucuucuucuguuguggccuccuaagugcugggauuacaggcuugugucccccugccuugcucauauacuuucuuagaaagaugagucaccuuuuuuguaucucacauggcuuuucugucaugugaugauguuuuuuuuucucauguggugacaucagaaaucaaauagucauuaaagaaagaaccauugagcggauuucugaguucaaggccagccuggucuacagagugaguuccaggacagccaaggcuacauagagaaacccugucucaaagaaaagaaaaaaaaaaaagaacuauuauuauuauugaauccauaaucuguaucccugugccaucuugagauuucagucucaauguuagaagugauaguauuugaagcuuauuuaauagugauacaaaaaaaaaaaagcuuguuucuuuacgcaggaguauaguguuauaugcuuguaauccuagcuuauaaagguagggcgguaggacuuuugguacagaugcuagcuuaauuuaauugccuucuggaugcauugcaauggcuagucaauuaaagugauauguguuucuacucaauauauugaaauacacauacgacaugaaauuauuaucacaaacuaagccaucaucucucaggucuccuuuacuaugcacacaugugguaagaaugaguaacaaccacucuuagcaaauuucaauauauaacauaaauuuuagggggaggcaucaggcauuaaugcaggaucucacauaggccagacuggucuugaacuugcugcguaguugagacucuucuaccuuuguguacaauacaguuaccccacuaugcauuccaucuccagaauuuaacucgcauaaucaaaacuuugcaaccuuugcaagaauugaaccauucauuugcauuuggccuccuguaaucaugucuuuucccccuacaccucaaaacgccuugagguuuuauauuuuugugaauuuauauguguacacguagaccaugguauguguguggaagucauaugacaucuuucaggaguacuuuucucuuuugcucuucuuguucugggaauugaacuugagucaccacucuuggcagcagacaucuuuacccacugaaccuucuuaccagcuugcccucuaugcuuuacuucccaauaaaacugaugcuucaggauccacuuaugagucagagcaugcaaugauaacaguauuuugauuuuacucuguuuuaucucagcacaauguacuguaaguucauucauguucuacaauggugagacuucccuuuccuaaugugguauaauagcauaggcuacauuuucuuuguccauuugaugauugcuuuguuugauaguuuaacuguuuuucauaagagaacaagaagggcagcaaucucuuugacauucugcugagucacauuuuacuuaugauuuuaacuucugagaaacugcuauuugucugucugucuguaucagcucacuuuucuucugguuguuuacacuggcuugcuuuucccuguuccuucaagagcauuuugcuucacuuuaucauaagaagugaacuaauaagagcaagaagccuucuccugugguccugaguggcauuuguucaugacuccuggcuuugauguuguuucccacaguuuucggccacugcgugucuucucuggagaaccgccuacucagaucuuuugucuuauuuuuggaaguuuucucucacuauuaugcuacuaguuuaugauuucuuucgaauggagugccucugagaugccucauuuaccagugcuuucuuguacucugacucuugacuuugcuuccuuugcucugcagaagcauggugggaugguccuauuugccucuauuugcuuuguuagcuuauguuucugguaugauagcuagaaaugucauugcuaaaacgaauaucaagaaauuuauguuuuucuuuuuauaaggauaggacacagggugaguauuuauguuuagucuuuagucaguuugaaugugguuuguauacaguuugagauaagggucaaauuucauuauuuugcauguaaauauagaguauacaauuuucugaacaaaauuuauuuaauacuaucuucuuauuuuuuaaagauuuauuuguuuacuuauuuuauguaugugaguucacucucacucuucucagucacaccagaagagggcaucagaucucaucacagaugguugugggucuccaugugguugcugggauuugaacucaguaccucuggaagaguagucagugcccuuaacaacugaaccaucucuccaguccccaaauaagaucuucuuaccccuuaccccuugggggcacuauguguucuugacauccuugucaaacaucaguucuauguguguguguguucuguucuguugaucucuguguacauuuuuaugaugucagacucagacuguuuuuauuauuauagcuuuguuauuguaguuugaaaucugguaauauuaugccucuaacuuuguucuuauugaacaaaauugguauagcuauucugggucuuuuccauaugaauguuauguuuucucuuuuuaugaaguuucauuagcauuuugguggagauuuuauucuaauugccuuggauagugugggcauguugacaacauuacuuugauucaugaacauucgggugccucucuguaugugggccaucuuccaacaucagcuuuauauuauuuuaauaucuaagaguuuuaucccauuucuuuaauccaagauauuuaauuacuuuuugaugcuauuguaagugggauucuuuucuuaguuuccuuuauggauauuucauaaugaguagaaauguaacugauugauaauguuaauuugauaucuucaaauuuauuaacuucauugauuccugaggauaguuuuguuuguggagguuuguuuuuuuguuguuguuguuuuguuuuguuuuguagguggcauaaccaucuaaaaacagagacuguuucuuuuuuccaauuuguaugucuuuucuguuuuucauaccuaaguccucuagaccgaauacagagagagggcauuguuucuucuucccaaucucagagcaucgacuauauuacaugugauuuugucuuuugggacuuuuauuuugcugagguucauugccccuauuaaggguuuuaugaaagauaagucuucuaauugauugcuuuuaccuccauuuuucuuuguucaaaucacggaaucuagugacuuuuugcuguuaucuguaaugcuuuaccacuccuaauauuuuuuucuuuuguaaucccaggacaacuuauuuguaagguuuucaaaauauuuuuaauuugcacauuugcuugaguagaaaugcuaaacugaagucgauaugaaaguauggcuagaauuaaaauauagccugauaucuuuuucucauuuguuuugaauaugcuugcagguguguuaaucacagacaucggucucuagcauugggagugcaguucaugcuucuucgauugcuagguauguuauuuaaaaauacuaguaugugcuguuuugguucauuagaguuucuuacauguuacauauauguuacauugguguuacauauauguuacauacauguuguacaccaaguaaaugauaaaggauaaagaaggcauaguugucauugguaaaaauuuucuaacauccaugauauagcacugucuacauaaaugagaauacagggacucacaucucagcugucugacuuguuauuugcuguucccaauaccacuauggauuuaacauuaaaggaaacaccugauuuauuugaaauauuaauuauaaaucucaguauauaguuuucucaccaccuuuuauuuaauaacugagaauacucaguaugaauucuuaaaauaguuucagucuucauuuguuuggauucacucauguggaauauauaaagauggagagaacuacuugcauggggaaggaauuucacugguauacauaugucuguguguaagaaauaauccuauaugucuguauucggacauggucaugcauacacauauucauauuacauuauacccacaugcccacacuaguguguguguguguaggcacaaaauguacagacaaagaauauaguaguuuauacaguauucuuuguguaccaaauuuuuuuuuauuuucuaacucuaucauagccaaugucaaagagguauuccuuuguuaccuuaugaaaauaaugaacuaaaauauuuauuaaacuaacauuuuuaaagauguauuuauuuauuuuauguauaugaguacacuguagcuaucuucagacacaccagaucccguuacagaugguugugagccaccaugugguugcugugaauugaacucaggaucucuggaagagcagucagugcucuaaccacugagucaucucuucagcuucuaaaauuucacuuguaaaagcuaggggaauggauuuugagagguauuuuuauuacaaacaauguguuuguagauauaacugcauuugccuuaauuuaaugauuuuguagaucaucaaacauuacaugguauguuauuacuauuuauagauuuuuuaucaauuaaaauaacauauuuuucuaaacuuuuuuuuauuuguuuuuuuugagacaagauuucucuguauagcccuggcuguccuugaacuuacuuuguagaccaggcuggccucgaacucagaaaucugccugccucugccucugccucucuagugcugggauuaaaggcauauaccacuacacccggcuuuuucuaaacuuuuaacacaacauaagaguaaaauucucuucugauauauaugcagcuagagacacgagcucuggggaguacugguuaguucauauuguuguuccaccuauaggguugcagaccccuuuagcuccuuggguacuuuuuucuagcuccuccauugggggcccugugauccauccaauaacugacugugagcauccacuucuguguuugcuaggccccggcauagccucacaagagacagcuauaucaggguccuuucagcaaaaucuugcuagugugugcaauggugucagcguuuggaggcugauuaugggauggauucucggguaugguagucucuagaugguccauccuuucaucucagcuccaaacuuugucucuguaacuccuuccauggguguuuuguucccaauucuaagaaguggccaaguguccacacuuuggucuucguucuucuugaguuucauguguuuaguuggccaucaguggaaggagaggcccauuggucuugcaaacuuuaucugccucaguucaggggaacgccagggccaagaagugggaguggguggguaggggaguggggggcagggcauggggggcuuuugagauagcacuggaaauguaaaugaagaaaauaccuaauaaaaaaaauaaauuaaaaaaagaguaaaauucucuucaauuuuuaaaaccuuuauuuaguguauguuugugugugucuggaaaaauacaugugcccuauauagaaaacagagggcaguugucaagagucgggucucucucucuacuacgugguuucuggggauccgauucagaguaccagaccaggaagcauguucccuuaccugcugagccauccuaguggcccuagggcuaaaguaguuucaaaaauugauuagaaauaauauaauuacauauaauuauuuaaacauuuugacuaagguuuuuauaucgcguugacuuagaugugaauuagcuaauguauguggauaaaguaaagucuauuuguauuacauaagcguguauguguguguguguacauguauguuuugaaaccuauauuauaagcuauauucuuuacuauuuucaucuugccuuuaauuccucuagguacaauaccugggccaauuauauuuggugucauaauagacagcacauguguucugugggaugucaaugaauguggaauaaaaggagcauguuggauuuaugauaacaucaagauggcacauaugcugguagcuauaaguaaguagacaucuuguuaaugacuuauagucuaguuuuguuacaguguucaggaaguccugugaaaccauccugcaguucugaagauaaaagaaucuacccaacaugauuucagaggcucaaguguccucugaaguuuucagucuucuuaaguagaggaagaauaagauuuucauuuucuguaugucaugccaugagcuuuuuaagaagaauuuuuuucaaguauuuggaaaguauauaaauaaaauaaaaaagaauuugaaaaacuucuuaugauaaagugaagcaaaaugcucuugaagggacagggaaaagcaagccaguguaaacaaccagaagaaaagugagcugauacagacagacacuugcuugucaucuaagugucuggacucugaaaacuauauaaauuguagugggggaaugugcugaagcugcaagaaauguuucacaguucagagguuuugccaugauauaauuaauuucauugaugguagucuauacauucuugauuaagggagaaauuaaagauaagauuaaggaagaauaauauauauauaaaggauguaacaauuugacaguugaacauuucauaucaaugcaagacauugcaaugcaugaauauaaagaacccuuacuggaacaugcuaguacauagcuguuuucuuagaacacaggaagcugagcccagauagguaugagcuugaguccaaccuagguuguauagagagaauuuaaggucagcuggggcuaagaaugacucucucucucucucuuuccccucucccucccacacacacacacacacacacacacacacacacacacacuauauauauauauauauauauauauauauauauauauauauagucauacacauacaauuauaucacacacacacacacacacacacacacauauauauauauauauauauaaauguaaaaugcauagaugcacuugauuuucauugcuauuauuuuaaaaauacauucaagacagauucuuuuacucuuuauauaaaccaguaugcugccugaauuuguaauuauauaaacacaauaucuacugaauaaauaaauaauauguaaacuuacaaugaaaacaaauauuaacuaauccagauaaaauuacucuuuauagaguugaguuuaaaagaauuauuugaagucaaaucaaaacuuaugugguaggucugaauagauaauguuuuuagcugauguggcaggauaaauuuggguaaguaugaaauaugauuuauucauauacaguucuuugccuaagaacucuaaagccuguuuauuuuuaacauuuuuuuuauuuugacaugaacuuucuuuauuuuaugcaauuuuaaagauggugagcuauuuuaugucacuagugacuucugauugcuuuuccuucccauaaacaugguguguauuuacaaguuuagaaaggugauacaaagccugaguguaguguugcacauuguaauuauagcuucuaugaagcugaggucacuuaaucugggccccauagcaaaauagugucucuaaaagaaaacaaaaaugggcaaaaaaauaucaguuaaggauuacuuacuccucauaacacagcacuaauuuuguaguuaaccucaagaauagaguaauuguuauuauguauuuuuauuucuguugucuggaaacaaaauaauuguauacacauuaaauuguauacucuauuccauuuauuauaauauuaauaauuauuauuaauaauauuauuauuaauuugagguagggcauugcucuguuuugagcugcccagaaauuccuuguaaugccccgauuagccucuugugaaguuccugcuucugccacuugaauguugugauuuacuaucauacucagccucuguugugguauaaaauuugaaacuauagaauuacuauuccuuauaaucauuacuucaaaauagaaaauguuuuauuugugaagaauuacauacuggaaacuguguuuuuauucaucaguaaagguccaaagccugacauuuguuuuguuuuguuuuguuuuguuuuguuuuguuuuguuuuguuuuguauuuagguguuacuuguaaaguuaucaccauauucuucaauggacuugcgauuguucucuauaaaccaccgcccccaggaacagagguaucauuucaaagucagaaugucauugugucuacuauuucggucgaagaggaucuagacaaagcagaaaaugaagggugaaaaggaggaggagauugcuuugggaacuggcuccugccugugagaacauccugugccaaggcaccauugucuaguuguguagaccacggugugaaacccaugcuccagaacggaggugaucauugccuagguacagauuccucauuuucuuaaaacaaacaacaacaaaauaaacaaaaacaaaaaaccccacaaacucaaaacauaaagguucaugccucuaaaguucaccaaaagccucaaaccacucacauuuuauuuauuuccguugucaaccuaugaaaacaccaaggaguaagaagaauaguugccaacaacacauacuuuaaacuuuaugcuucuaaauacagguaugcguacacacacaaaguaaaacaucguuuuuauuucuuuuguuuucuuuaagacagggccucacauaccccaauagcucaggaacucagguagcuaaagaugaucugugacaucugauucuccuggaguuacagcucauguacugagguuacaagucuguguuaccaccauuggcucacacggucauauuuuaauucuuucauuguugguugauugagcuuauuugagauguuuacagcacaaaaauuuaagcuaaggaaauuuaugugaugcuuuuggggacgaguuguuuaaaacucacuuuacaguguagguuuuauaucuccuucugaucauauauuuucacaguaaauuacuuaacugauagaaugaaggguaguuaucuuuuuuugugucccacuacccuacagccucagaaaucucagcauuaacuacacauuuucaauuuagaguaagaauucuaggaggcaauuuguuaauguuauugacuuuuaacacuaaaacuuaagacugugauaguauuguucaauugccuauuuucagagaaaagaaccagcuucaaugacaaaaagugccaaguagacaugacaagaugucauaaugcacuguugacaaauguuuaucaaguacuuuaaauuuuuauuuuacaaacuaaucaccuagcccauuaauuauaauaacauaagcagaguuucauuuaauagacaucauguaguguuauuuagugaaaguuuaaauucaaugaugugauuacuugaagcuucaguauuuuguacaccuuacaucacaguaacuaaacuccauuuguguaggcuccugacaaauuuacuuaaaauacugaaaguguuggucauugagcaucaacaaaaaaaauugacuauugugaaaacuauuucuaauuaauagaaguauuacauggcuaaggauguaacugagugcaaauucuaaauuucaguccugaaaagaucuauucaaaacuaaggaggugauuauauucguguuguuuuuacaaauuaaaucuucuacauuaauuaguuucccuagccaaccaccccacaccccguaccauccauguuagcucuuuaugaguuucaugaaucagguucuccaucagggcagcacaaguccagaaaaaagaccuggaaaacuccagaauucacagaagacucuagaauucacagaauuuacauugcugugucugguggcaaucuagguguggcucaugauuucagcaccugggagcucuuauaagcugaaauucaagaaggaggagggaugagcuaggaguuagauucacaagcuccuucaauauucaaagauuagaggggucagucucaggaaacugagggcuagaccuacuugucucaggaacuuacuuaccaaaaaucauuuugaaaaaauauagccaaaauucagguauuugggaagccaacacuuccaucaagcaagggaacagcacaagaaagacagggaaagccacaggauaccuccgaugagaauauucuuccccacuuucugggcacaucuuaaauacugccuccauugugaucaaggguaauaggagucagauuuucuacaaucccauguguagaaguauggcacccuguggaauaggauaagcuaaugcaauccuaagaagcuuagcgauagaaccgugaaauaagaacaagaaaggaaauaagaagucugcacagguagaagaguauauggucccuuagggagaagaaacaaaaaaauuccaaacauauugucugauaaauaggacaguagagaauuggucuccauaaugauuaguguucaucaaaaggacauuuucuccaguuuacucaguuuagauauauuccuuucacacuuuuuaaacaaacuugcaagagaaaauugcuaaagggaaccaauaauuuuggcacucggauauacauauuuagaaagaauaccuccauuuggaauaaagugaacacacuacuguaaucuuccauuuguaaauucauucauauuauaaguguugguuuacagcuuuuagaauauauuuucaugauaugugcuugccacagcuuauaauuauuucaaaaucacuuucagguguaccugcuguaauuuuguacauaauuaaaucuaucuuaaaauuucuuauauuuuaauuuucuuaacugcagaaaauaaaaauauaaaacucuuucuuaaccauggaaaaauuguguacauuugacuuugcuauguaaauuggaagaaauauaaauaaaauguagauuuauuuucuuuguugcgaacaacucuguaaauaauugauacguauaauuuuuauuaaaucagaauauuuauauuac

SEQ ID NO: 315 - RNA, 2158 nt, Mus musculus
auuuuuuuuucauugugaaaaagucuuuauuuuaagaaaaaaauuuaguuaacaaaaaauuuaacaaguuucacuuagcaaaauacacccaaaaggaaaucacaguacaaagaaagcuuuaagucaaggccucaccaauuccuacaguauuaguauugugucucaauucucaaaacuaacuuuuaaaaagcuuaaacuuaaccuaaagauuuuaaaugaaaauauaaacuagaaugaacaugagaaaugcuucucuuuugcaucagggaucuagcaccuuuggguucuccagaaaaguacauauccccaguguguucacugugguguguuuaaagauccacucaauauacuuaaacuacuuaacucagauaacaucacucuuaaguauacuaccaaaaauguuaauugagaaaagcggaagaaaauagcuuuaguuuacucaauauuacaugcuagaagaaaaguuugcaugagaaacacugaagagguaauuuuuuaauccagauuucacaaacucauggugcaaagugggucccccaccuuccucuagaguuauaaacugcucuugacugcuuauuggcugccugugaaauuuucugauugaaauaacucaaauguuccuacaguacuaaucauauccacccaugcuguucugaccgcuguagccggcccaguaacagccacucacugacuggcucuccaggccacuguaaguugccugggcagcugacacacccaugcucugcaucaccuggcugcuauaagccccauugcuagccccuguuguugaauucaggaagaguucuauguaucugugcugcauguuggcccuguccuuggacauagcugccacugcuucuucaugaguagcaaacucaacaucagcuucucccgucacucuuccaucaggaccaaucucaauaugaacucucacaggguugaauggagagaagaaguuguaaaugucguucuccguugcuuuguagggcagcccucucauguggacgcgguggccgguggugcucugcacugugaacucgcugucuccauaucuguggucauacauuccugagagacaauagcugaggucucucccaaacaggucaguggugaagccauagccaucacugaggccacuguauucuucauagcccccauagccugcacuauaggcaccagaccucauccuauccagaccugccuguuucacaaugccaauguaccuccgggcugugccaggccugucauaaggcccaggccuuugcacagacauaaacuucagagguggaucugaguaugaucuaacuuccuccugacugcucuuaaacacuucaauauaccugugcccuauucucuccuugugcuucccuaaagcuuucucagcuaacucuugugaggcaaacugaacgaaggccuccccuguaaucuugccuuccggguccacagguagugugaucccguuuggcacaauuuccaacccugagaagaacugaacgauuucuuccuuugugcauccaaaugggaguccccgaagccucacaaagccaucauuggcacugucggcgcuguuuggaccacugugcuucaacacccaauccaucucgguucugugugacuugaacaccucaauauacgggugucccaugcuuucccugucuuuuuucagagccaauuuuacaucaucuucugacucaaguucaacaaaagccucaccacucugacugccuucucuaguauaaaugaaaugaacaccugcgaccccaucaugaauggugcagucggagaggaaguuuuguacguccucaauugagcaggaccaggguaggccacggaguuugaccacauagccuucaccucccucagggcccagcaucauggacacuugacagggcugaugucacacaagcuugggcaauuuuuuguagcuuaaagaaccaccacagaugccuucuguaggaaacacuuaauggaagguaacaaguuuuccaggggaggaagguagaagugacuucuauauucaguaaggaacgcggcuuacuaacucaaacuccacccgacgccuuaaaaacgcagagggcuccggggaaaguccaggugcaucuuuuuguucucaaccuucaggaagacgaggcgcaguccuccuuccacgacggagccc

SEQ ID NO: 316 - RNA, 2135 nt, Mus musculus
auuuuuuuuucauugugaaaaagucuuuauuuuaagaaaaaaauuuaguuaacaaaaaauuuaacaaguuucacuuagcaaaauacacccaaaaggaaaucacaguacaaagaaagcuuuaagucaaggccucaccaauuccuacaguauuaguauugugucucaauucucaaaacuaacuuuuaaaaagcuuaaacuuaaccuaaagauuuuaaaugaaaauauaaacuagaaugaacaugagaaaugcuucucuuuugcaucagggaucuagcaccuuuggguucuccagaaaaguacauauccccaguguguucacugugguguguuuaaagauccacucaauauacuuaaacuacuuaacucagauaacaucacucuuaaguauacuaccaaaaauguuaauugagaaaagcggaagaaaauagcuuuaguuuacucaauauuacaugcuagaagaaaaguuugcaugagaaacacugaagagguaauuuuuuaauccagauuucacaaacucauggugcaaagugggucccccaccuuccucuagaguuauaaacugcucuugacugcuuauuggcugccugugaaauuuucugauugaaauaacucaaauguuccuacaguacuaaucauauccacccaugcuguucugaccgcuguagccggcccaguaacagccacucacugacuggcucuccaggccacuguaaguugccugggcagcugacacacccaugcucugcaucaccuggcugcuauaagccccauugcuagccccuguuguugaauucaggaagaguucuauguaucugugcugcauguuggcccuguccuuggacauagcugccacugcuucuucaugaguagcaaacucaacaucagcuucucccgucacucuuccaucaggaccaaucucaauaugaacucucacaggguugaauggagagaagaaguuguaaaugucguucuccguugcuuuguagggcagcccucucauguggacgcgguggccgguggugcucugcacugugaacucgcugucuccauaucuguggucauacauuccugagagacaauagcugaggucucucccaaacaggucaguggugaagccauagccaucacugaggccacuguauucuucauagcccccauagccugcacuauaggcaccagaccucauccuauccagaccugccuguuucacaaugccaauguaccuccgggcugugccaggccugucauaaggcccaggccuuugcacagacauaaacuucagagguggaucugaguaugaucuaacuuccuccugacugcucuuaaacacuucaauauaccugugcccuauucucuccuugugcuucccuaaagcuuucucagcuaacucuugugaggcaaacugaacgaaggccuccccuguaaucuugccuuccggguccacagguagugugaucccguuuggcacaauuuccaacccugagaagaacugaacgauuucuuccuuugugcauccaaaugggaguccccgaagccucacaaagccaucauuggcacugucggcgcuguuuggaccacugugcuucaacacccaauccaucucgguucugugugacuugaacaccucaauauacgggugucccaugcuuucccugucuuuuuucagagccaauuuuacaucaucuucugacucaaguucaacaaaagccucaccacucugacugccuucucuaguauaaaugaaaugaacaccugcgaccccaucaugaauggugcagucggagaggaaguuuuguacguccucaauugagcaggaccaggguaggccacggaguuugaccacauagccuucaccucccucagggcccagcaucauggacacuugacagggcugaugucacacaagcuugggcaauuuuuuguagcuuaaagaaccaccacagaugccuucuguaggaaacacuuaauggaagguaacaaguuuuccaggggaggaagguagaagugacuucuauauucaguaaggaacgcggcuuacuaacucaaacuccacccgacgccuuaaaaacgcagagggcuccggggaaaguccaggugcaucuuuuuguucucaaccuucaggaagacgaggcgca

SEQ ID NO: 317 - RNA, 985 nt, Mus musculus
agggaggaggaaggagcaggugaaauggccugaagguuguuucgggucuuuccaucaaagguaauuuuaaaggccaccagcuuauuucucagcuucuccuugccuuaaggacucaaugacaaagaagacauugaaggagcuaugacaccugcaucugaacacucaguggcuacaaccacacugacuugugcuuuggaggagaaaaccacucccacccuggauuaauacacuuuugugugagauggccgaucgaucugaccuuuaacuucuuugcaaaauggggaaaaugacuucuaauuuaaagcacuuguuagaauuagguauaauguauggacuguaaaaugccggcuccagagcaguugcugaauaagcugcagcccuggagaagaaggaaaaggacaggacuccugaagggacuuggcuucccucccugcagcuacuuuaacauaauugaucaucacugcauuuaaaucuuaacguauguagaugcaaugugaacauguggugucccuuacucccaguuaaugaacuaaaguuauguuuucuguacagguagccccguguauauagagacaggucucugggagaugggaggagaauauuugagcugguuauaagguuuuauuugauuaccuaagguguuuauuugugcuauacauuguugugguuugcuauuaggcuaguaaguauagaaaauauaaaugugaacuauugaucguauacaaugaaaacaucuuaaaaguucaggugaccauuagaguuuggcuaacacugauguaagugacccuuuaugacauaucaucuggggugcuuuauugugaaaauuaccucuuacugagucuggcuuaaaacccuagaguuggaucuaaagggaucuaaaauaaaauguaagcuguucaacaucaagguaugaucauuuuucgauguuuuauggacaucuguaauuccugucuguguacgucugggcuguaaggaaccacuugcu

SEQ ID NO: 318 - RNA, 64371 nt, Mus musculus
cgccugcgcgaaaccuccgcuagucaaacccguccuuagagcagucgaaggggaccguuuuaaaguuacuggaaggcuacgucuccguuuuuaaaaaaaaugaagaaaaaaauaaagaaaaauagguaugacagaacacacuagaacgaccacucaccgaagugguccuaagugcaaacggcagguuuuuaacucuccucucgcgauuuaucuggugcuaccggaagcggaacugccgggggucggaguucugguggcgcuuguggaacaggaaggcucaggcgggucguugguccgccggaaacuguuccggccggugcaguuuccgugggagcccuguggagggcgggcagggaagaggcgugucggaggcuccugaggugugccagugccagcgguuccgcgguggccggcgagggaagcuucagguccacgccuccgagagccgccucggcacaagcguccuucccucgcccccgcaauuaaagggggaggaaccgaaaccuggaugggcucaagcaucucccgcagaucgcuugcugcccgcagccacggcaggugaggaccgggagaggcgacaucuccggcagcccgaggcucgccgccgccuccagguguuugcuuugucucugcuccacggugcggaugcgggacacguggucuugcaagagccacggacagucgcggagggcagcgugcuuguggacgagugacagaacauccccagggucccuuucaggcuugauuucuccuccgcuucccgagucgcuuccucuuuucauuucuagaguuugaaaagcccgaaauugcagucccgcuaguuagggagcuacccacguucgacuuguauuuggaucuccguucaccgaggggugcgccguuguuuggcuucuucuguggggagaggugucuguuucauucccuauccuuugcucugcuugucuuugcuuuccacacccacuuccaaagaacaaaagcacugugugugugugcacagcggcguugcaagguaagagacgagguugcaggucaaugccgcacccgcgccuuaucgauuacacagcguugcguccucccauguagauagugaccuuuggaucucauccuggagguucuggacaacuuccugagaguuaccauucuugagguuugugguaauggucguuuugcuuuuugcguccuggaagacacagaaguaggaagcauggcugacuuaagcauuagccuauaccggggcaggauuuuguuucacuauuacaguuuuuuuuuucuaacugaaacccgugguuuuugagcaauaauauaacgauagcugauauuaguguguaacaguaccacaugguuugcacauauauugucauucauccuuucaagaggcucgugaagguuguuagguuauuauauuuuuaagccggaaaauggaaaguuagugagguaguggaacuuacccugguuacauuuugccacaggaaaaccuuugaguguuuacuagaaacuagaucugaauccagcaucuguauucuauuguccugccauugcucuuguuauuccaguuucuucacuaacuaucagagguuaugcauccauagugugcuuguguauaugugugugacaaaugacagucgugaucuuucugcaaauucuguaugugcuguagaauuacauauuucagacugucgaauguauuuucugcagcauaggcuauuuuuugaaaaggcaaguggaaaaacugaugacuagaaggcucauaauuguacaaugcuugcuaucucaguuuuuagguaauuauaaagguauuaaauuuaacaauugauagacuauugaaucuaauacuaggcauaagaguaguucauuuaguuuuucugauaauuugaaauguuugauaauuagaaacaaaacccugagcacucacaucauugucaggugugaaacagaucauugggaaagguacguauggagcacaaggagacaaaaagguuaagaaauguguuugggguuugguagaugcaugagaagagucugggaagcauucuuugaagucuuccaguuuauuucaggaauaggaacuaccucuaaaauggcaauaaaauccaaaccaaaaagcuaacucagcagaaagguaaauuccaggcagaaaugcugacucagcagaaagagguauaccuuuugaagagggagaggaaucagucauuugccaaaguuguauggaacuuggaacugucuugguuuauauaaucgaaaaaccuauucuagcuugccuuuccuagcaggaagaaaccaauauuuaacacuuuuuauguaacuucuuccuagugccuuggaauuuagcuaucauuuauaauaaaguuuccacuagaaaaugcuuugggaucucaggaaaaccaguuauguguuuguauuccgguugaacagcaguugauggagcuccaguuuccuuuuuaauuuuuuuauuuuuaguggaaauuuacuaauuccggggcuggacuucuggacuuuaguggaaccuauggaaagauagcuugggggacuuuuguaagggaacucuagauacuauacaggacugauggcuuauucgggguguuaauuuaaggaagaggcagcucaagccagaaugaguaaacauaugagagagaggacuguuuguccagggcaguaggucguccgguguggagcagccaaguaaaacuggagccuugaaaaaggucuccacaaagaccaucagaagaggaucugcacaggcagccuucgcuagaagguucauucuaaacugaguugcuuauguuuguuuuuugccaguuaaagucagaaaaaucuuauuuauaaccauaguuaaccaguuauagaaacagcuaauguuuacagaguccuuacugcaugcuagcuguucuggccgccugcguucucauuuaaucuucaaaacuguaugugauguauaaccucauucugucugcugccuagagcugcuaaggaauuuugggguggggagcaagaguuaaaguuaaauuuucaagaguggagcaguucuuacggugagauuccaagcaaugucagcaucaccuuggaauuuuaggaaggcaaaauauugcacucaacccuagaccuuacaguuuaauagcuccaguccaccaagugguucugagagauguuaagguuuccuaguugcuguuugccaugugaggaaacuaguaaacuaaaacacauuucgauuuuuaacuaguguuaagucucaaaccuagcugccugucaguucauuaaaauauaaauucucuacuuaagaauuucugaucaaagcuuuuugugauaggccaguaauauguuuauuauuaugaugcaaccaguuuauuugaggaccauugcuacaaaagcaaucuuaaaacuaaagaaagguucaauucugauauuugaauaauccaugaauacuucagacuaggcauuuaauaucacuuuggagcucgugacugaacauugaucaaauuguugaguauugugugaugcuauggcuauaggcaguggaaguuguaggauuucaagugaaauaaucauugagaauguucuagaucuccucagauucaccuuaaauuucauuuugugagaaaccauauaccacaugagagggaaaauauacuccauauuuucuuagaauuuauugaacauuuacacugugauaaagaacaaugaaguucuguuuuacugguggugguuguuuuuauguuuguguugucauuguuguuccuuguauuugugaccuuagauuuaaacagaccuggcuuugcacguuuuuuuuauuaacuauuugauaacugauugauuaacauaguuuagauuauuggaagacuugaaccucaccuguucaguacuauugaaaugauaggcauuuaucuauguacuucaaguauuuauaaauaauccaaagaugguugagagaccauucauuugcaaaguaguuauugcuuccuuuuuguuuuuuuguuuuuacauuaagacaucuaucgaaaauguaucaaagggaaaacuaaagauaguguugcucauuaucugaguaggacguuaaagcuaucugaauggcucagacaauuuguuugugugccuaaacugcauucauuguugagcgacauguuaggaagcccugcauguaaaaacuaaguauuuaacauauaaaaacauaacuucucuuaagcuuuaugguuuggagaguuauauaaaauccaugcuguucuauaauaagaggacgguagaugaccaaggucaaaugaaugaagaaaucuuggaagcugguaaauauuguggaggaguaguuauuauuugacauaagccaagcaucgguaggauggagauucugcuucuucagcuuuuauccuucuucauuauaggaguguacuggcuggguuugugugucaacuugacacagcuggaguuaucacagagaaaggagccucccuugaggaacucccuccaugagauccagcuguaaggcauuuucucaaguagugaucaaggaugggagggcccagcccauuguggguggugucaucccugggcgauagacuuggguucuauaagaaagcaagcugagccgagcgaugguggugaaggccuuuaaucccagcacuuggcacuugagaggcagaggcagggggauuucugaguuugaggccagccugaucuacagagugaguuccaggacagccagggcuacacagagaaacccugucucaaaaaaccaaaaaaauuaaguaagaaagaaagaaagaaagaaagaaagcaugcaagcaagcugagcaagccaguaagaggccaccccuccauggccucuuaaggauugcaauuaagugauuggaugaaucucagaagagacuuugaacuuuugacuuuuaccauuauugagacugcuguagacuauggggacuucagaaguuggacuaaauguauuuuuuauuaugcuauguuuacauauggcccccauagacucauauguuuggacaagccucuggggaccagggaguagaauguggugguuuguauaugcucggcccagggaguggcacuauuagaagguguagcuuuguuggugugucacugugggugugggcuuuaagacccucauccuagcugcuuggaagucaguauucugcuagcagccuucagaugaaaauguagaauucucaacucccugcaccaugccugccuggaugcugccaugcuccugccuugaugauaauggacugaaccuuugaaccuguaaacuagccccuauuaaauguguccuuauaaaaguugccuugaucauggcaucuuuucacugcaguaaaaccccaacuaagacaaggagauagucugauuuucuauacuauuaaaaguccacagucaugaaaauggugaauauguguuuugccuccugcugcuucuaguguuuuucuucccucuccuucaguuuucuuuucucuuucauggcugcuuguuggaacugccugagaaaccuuaaaugcccgaguccuacucaaacaguaauugauaugggguauguccagaauuuaaaguacagguaccuuuaacauaugaauguauauuuagcccuuacacaggauaugacagguacaguuuacauagaaauugagggcucaagacuucaaauacaauuuuaaaggaugagaaucuaacauugauauuuuaacuccugaguucauauuucuaagcaauugguucagcuuuuaaaucucuuucuuuuucaucucucauauauuaaaauagaauuacagaaaaauaaaugcaagucccauccagccuucuguucuguugagggauaauuguucugccuaucauucaaacaaaauucuucacugucuagccugcuuucucaggugcaauucugaaaaugauuuuaccgucaguccucugaaugcacuguuguuacaucucuaacaucauuuucuccacuuuuccauugcuugccuguccuacuccaucuccuuugaacacaggaaauaaauacacuaaguauacuuguacuucaguauuucauguuccuuccccgaaugaucucaacgaaucacccucuggcuuugauacagugucaugugauuagagaagacuucuaacguguacuccuucauuggcucaucuacuccugucuuucuucagugauuauagaaggccggcuucuaggguauaagcuuacaguuguguggaggacguguacucucguccucugggcagcauuuaauaaagacucagccgaacuucauaagugauaugugccuuggaggugaggcagcagaucaguuacuaaaaccaaggugauguacaugccuucacccccuauuauccuccacgauuucugcucccaauguccacuguucauugaaaagaauaguaugaaauacaaaccaguaaguuguuugcuuguuuuucuuuuaagauuuauuauguguuuaauguagacggguguugucuguaugcaugucuacacaccagaagaggcaucagaucccaugggacuacaguugugaucugcccuguaggugcugggaauuggacucaggaccacccagugcuauuacgaagccuucucuccagcccuucaaaccaguauuuugcaaauagcaauaacaauccuauuucugccucugaucauuggauucuugacuugaguuuuucaaaauuuuacauuuauauauucuaggcauuucacagagaauauuuaaaugggaaaaaaaaaagcuagaaaccaacaguaacaacaacaaaaaaaaugacccuacaguacugccucuaaaaugagguuguuauauaagucauuuuuguuagaauacuuaaacuagggauguaguuguuuauccuuaaugaagugauucuguaugaaguaaauaguauuuauugaauaaauacguuuauuucaguaaauaucuaucaguauucuuuuagauuuucauguuauguuaguagaaagguuaauuuauagcacuucagauagaaauauagauucauuaaguauuucugugcaaagcacuacacuacuucagucuucacaguaccagacuguugguauagucucauucacucacacacagggaaggggguggauggauucagaaaugcuagcauaaguuguuaguuguuaguaacagauuaauauauugacuucaagcuaagggucuuucuacuacuuuuuuuuaaauuagguauuguccucauuuacauuuccaaugcuaucccaaaagucccccauacccuccccccaacuccccuacccacccacucccacuuuuuggcccuggcauuccccuguacuggggcauauaaaguuugcauguccaaugggccucucuuuccagugauggccgacuaggccaucuuuugauacaugugcagcuagagucaagagcucuggggaacugguuaguucauaauguuguuccaccuauaggguugcagaucucuuuagcuccuugaguacuuucucuagcuccuccauugggggcccggugaugggucuuucuaccucuaaaauauuuggauauauuuaaugggaagaacagaagcacacaggccccaaggauguguuuaguaguccacuuaguaacagcaaagcagagcugaacucauguguugugaaguugcagaagguugugauuucuuucuuaguaagaaacacgucuuaauauuaaacaguguaguagaaacaaaaagcauuuuuaauagauaauuucuucuuucagguuuaaugccaaaugauuucagcuuucauaagaauuugcuaaagccaaagcuuacugaguaauuuuauauuugauugaaagccaccaguuaaacuuuaaucagacuucuagaacuaaaaauuuuggauugugcuuugucuaucuagcauauuguucaauuuuuuuuuaaauaucaccagucaucaaaugaaguauuugcacaauuucaucuugguagauaacuaacuuuaauaucaccgguguuuaaauacauguaaacaacuuuguaaagaauacuuugagauuaugucauuagcauaugauaguuaacuaguggguuuccauguuggauuuuuaugagggcaugucacugaaucacuuacaguuucuugacgagcauauuaggaggcuguaguaauuuuucuaggcuugcuguagcaauuguucuggcuuugcuaaauaguuuuaagcucucagucugagaagaguugaaugaaaucuuguuuucagucuacuaauucuuucagaagagcuguguuuugucugucuuugucuacuuuuuucagauacuucuggacugaagguuugaauuuuuaacaaaagguuuuuuguuuguuuguuuuuuuaauaauuuccaucauuuucuuauuaucagguaccuuauggauuugaauugaguguggucuuuuuguuauguuaugucaucuuauccacuugcucugauauauucuucuggaauauaaucuucauuauuugauuuuauggaggaaaauauauuaucauuuugguggccuuugauagguuauuggaccugauugucuaaugucauucaaaauuguuuuuugugaguauuuuugaagaaugcuguugaaauuaauugcuugcacugcguuuuagguaaaaggaggauaucuguuccaacccgggcaagcagcagccucauuguccuugcguuuuaaacuacaacagcaauugggaguucaacaaugaagcaaugauaucugagaacaaaggaacacuggccaacuaaaugucagcacauuucaugcgauugggugaaaacacugcagcagaccugggugucagcuggcagccugagaaugugcucuucugacaccauuuaucugaagcagcuuuaguauagacuauuuaaacuuuauguaugucaaauucaagaaaaaugagugaaccccccagauucuuuguugggcccgaagaugcggaaaucaauccuggaaacuaucgucgcuucuuccaccaugcugaagaggaggaggaggaggaggaugagucuguaagucugucuuuccugaugagccggugcagugcagaaugcuccuugaguacccuaauacaaaugaauucucugauuuuaaauaagacuacuuuguaaugugcaaauuuguuuaaaaaauugaaaaauauaaguaauauugaauagacaggauauuaaagguagcuagcaauaagauccuuacuuaaaggacaguuuagaguugcuguaagauacuaaggaacuacuuaacuaaauuuaucaaguuccacaagacuaucucaaaggcugcaugugugugugucugugaguguuaggucuuagaaacagaccacaacuguuacauccaauuccuuguucugcugcucacugugugucugucuuagucuucauucuccuugcccucaggcagagacuauuuuguuuugggaaccgauuugaaauacagacauaaacuauguguugauuuuuuuuuuucuuucuuaaauuucuaauuaaaaauagaaucucauuuuaaaagaaaaaucugucacaguugguaagagugguaagcugggacugcaguagccaauaguuauuuaugucugagaggagagcagcgcuguucacagagaagucacugggcgugcgccuuugaaggcuagguggagucacacucuucccccucccaucgggagacauuucgguagcagugauauucuaauuaagcagcugugggcgacccuugaccaucccugaggaaauaagcccuccacugauauucuugugauaugcuuuguuagggcugugagaaauagcccgaagaguugaccugugaaggugaccuaucaccuaggaccuaucacugucaccuaggaagcugauagugagcccuuucaacauucuugaugaggaacaacagaggccuuaagaugaaugaugggggguggggaggggaguagagauagagaccccaauaugguugcuguuuauauuguuugauuuauaauuuaguccaauacucauuugaacuccaguuuucauguuagaggaggcaauguagaauuauuuuucuaaauguaaaaagaaaagaacgauuucauccccaaauuuuuauugcuacauuuauggggaaguuuuaugaaccacuuugaacagcuuuauauaguguuauaugaaauacauaaagucauggaagagaaaagaauuagaugcagccuuaugugguugauagaacucugaagcucaggaaugaaaaggccaagaugaagugcaaagaauuaagaaugaauauaacaaauuugugagcaugauguccucaguauguuacuguuuaugugcuguguguauucaaguuugaugguugauuugguuacaaguacaagauuaaugagaucauuaaguaggaaugucaaguaugaauguugcagggagugucaaaguucauuggcauuuucuaucagugagccuuucucuaaguucaaaaagcucucugugaccagcuaaugucccagcucagucuacaaggagacuuaacacugugcagcuuugcacuuagaaaugcauuggauuuuagacaucacaauucuuuaucugacucuuacuggacuuuuuaguuggaauagauggaguuuuguucuuguuuguauuuuucugccugaagauaguuaaguaaaugcuagaagcaggugaagaaggaauguuuauauguacuuuaaaauuaauugaaaauaguagcaauaugcugaaggugggcuuuuuauuagaucuaucuaucuauuuauuuauuuuguuuuuuucgagacaggguuucucuguguagcccuggcuguccuggaacucucuuuugaccaggcuggccuugaacucagaaauccgccugccucugccucccaagugcugggauuaaagcguaugccaccauugcccagcaauuuuaauuguuaaguaguuuaagugauagacuuuggcugacuucaauagugaauuaugucaguuuuacugauuccugucccucgucuacugcugaaaggaaaugaugacagugauauuuuagaacaccuauuaagacaacaugucauccuguguucuuucuguuuuagccaccagaaaggcagauugugguuggaauauguuccauggcaaagaaauccaaauccaaacccaugaaggaaauucuggaacggaucuccuuguuuaaguacaucacaguagugguuuuugaagaggaaauuauuuugaaugaacccguggaaaacuggccuuuaugugauugucuuauuucuuuccauucuaaagguaucagaagguggacagggguguuuuauccuaucucauuguagaaauaauacauacuucuuauagaauauuggauaaaugagaaaugaagcuaacucacagauaagggauguuaacauuuugauauauuucuuucuaaucucuuucuucucaauguguuuuuuuaaaaguuuagugucauaguuuacauguaacuuuauauuuagcuuuucuuagauuuuaucaaaaauuuccacaccauauuuuucaugauguguauuauauaaauguauaacuuagugaacuaauaaccaaacauuuggauaauuccuagucuucacuguuaaaguaaaguuaugauuaacuuuuaauauauaccuuuguuugcacauaucugcagauagaugccuuaauuauuagauauuuuaagucuuauauuucuaccacuuagaaagugaccugguauucuuuauauaagugcacauacuuaauuuguuaagaacuuucaauuaaaaauuuagggcuucuuugcuauuuuaaauugaauggcaauagcaguuaaguuuaaguacuaauguuauaguaaaugcaauagugcaaauuauugcucaaagcccuccccaaaaaaacaaacaaaaagaauuauugcugucuauuucugaaaaucuuuuuaauuuuguaaauuacuuguuuucccaugaauaaguuuguaauuuuuuagaguuuguuuuuguacuaaucauuaccuuuuacuccuaucccccaguaguucugaacugugcuaaguuuuuuucuguauacugguaaugaagauugauuuucauuuuucagcaaaccuagucugaucuugguugccugagacuuuuuucuugagaaauuuuauauucucugcacgugaaaguguucuuucuuacuguuacauguucuuucugugaaagcuguugcuccuaaaagcucccugcugucuuaggacauacccuauauguugucuuuugguaagagacucuuuucucuguaacuaaauugaaagcagggacugauuggcagcaggugcuuuccauugcucaguccuggugggaagcuucgagucaugacauugaaaccuuuacugcugccgaauacguuauagaguucagcugcugcuccaugcauuauuaaaaaaaacuaagagaaauuuacaaguacauuuuagccaaacauagcuguuugauuaaaauuuuaauacuuaacauuucuaaaauuucuuguagugaugcggaaauguaauguccucguaagcgauuaauguccauaguuaaaucaugcacuguccugcugauugauuuuuaucuuccauagagaagauauugaugagagaauugucacuuaaggacaauaaaaaguaguauucuuuuuggaagauaaugccaaguuuucuaaguaucuuauucacacugaaaagcucuuaaucugccagaauccuauugguuagagggcgucaugcucauugacagcugagcuuggcuuuagagauagguaaguuggcuaaacagaggcaggauuuaagcauuuuuuuucuuuuucuuuugucugcuaugguacauuggagaauuuuagugguaauacagagaguaaaauauaaucucugaaauuuuuauaguuuuuuucaaaucuauuguaaucacauauacauuugacucauuuucauuauuauuaaucauuucaguagucuagaaauuuuaguagguuaguuuuuauauccuaagguggcccagcaggagcaugcuucuauucauaucuuuaucuuuuguacauuuuauuguuuauaaauacauuuuuguuuuuguuucuauuuuuaaagguacugucagcuaguucauuuuagacaugaaaauaucaaauaaaagagacuuguguauugagaagauuuuuuaaaaucaaaugauaugaaacauuauuuauuuguagauuucucuuuauauaugaaaauaucuuaccuuucuaucagguaccuuuaaauagucagauacaggcuaacaugaaacagccagugacuuguuaugccauaucaaugauaauaaccaagaaaaguuauuuuaauaguauaaguuaaauaaaaauguacauacuuauuauuucauaucuuuuauagaaggugguuauguacauacugaaauuuuuuuaggggagguggcauaauucaaauugaugacauuaauaaauuuaaaaugccagcuugagacuguacagaauaugauaauaauauguguucuuaggauuuccacuggacaaagcaguugccuaugcaaaacucaggaauccauuuguaaucaaugacuugaauaugcaguaucucauacaagauaggugagugaaguuggcugaccuaagggaaaaagaaaucaaggcuuccuuacuaaucaguguaugcugaugaagcaucagguguucucacuacggucauugcaucccuuagaauacguuuauuaggaagcucugccagugaaggaccuugagaccugaggaaucauucacuuagucacaggaacaaggacuuggacggcggucgcuuaacuuccaaagccuucuaaacccaucaaacuugcaguuucuugucauauggcugaugauuccauagaauucauucauuguaaccgaugauauuuauggugaaguguaccauuacagcaguuuguuacuauacaucuuaauguucauggagcauauguucuaaaugaaguuauaaaagggugugugugugucuguuuauuuaauugguauuugguuuugguagcuacaugcaguucuauuuuccaugagcauucuacuuuuguguuauaacaugacauuacuuauauuacuuacauggaaauacauauauacuaauuuugcaugaagguaaaaucauuuuucauaggauuaugaguguuuuucuaugacauuaaauauuauuuugugguaaggguuuuaguaguuaggcuauauuuugucuuugauauucgucuuacuugacuauuuuucuucaugcauguacauucauguuuuaaaguguagucuuucaaucugcuaccaaagauauuuuauaugcauuuuggugaauauuuugauaggagcaguuugauauuugaaauauuuagaaaaacaaaaaggguaguuaagagugauaauuacuuguguggggauauaauauauugagaaauagaaagccaagcacuaaggauguuucucuguuucuuuagaagagacguguauagcauucuucaagcugaaggcauccuacuuccucgguaugcaauccugaaccgugauccaaauaacccgaaaggucagagaacucagcucugcagccuuccuuuugguucuugacguacucugugacaucccuacaauaaguaggaaaacuuuuaagaauuccugagagucuacuuaauaguuuuucuuaaugaauuaaacaguugugguggugcaugccugugaugccaguacucagaaggcugaggcagaaugauagggaauucaacgucaaagucaguauguauuuaguucugggccaggcugggcuucauacugugagacccccaucucagaaaacaaagcaaaacaaaacacugugagcuaacuggcuaaguaguauuccaggagcuaucuuccuguauuuuguauguauaauugaauauguaugaucugagggcuggccauuugguacuagauagucacuuaggaagcucauuccuggagaaggcuaauucuuacucucucugccgucaucaguggccucccucgggccaagcuuuuuucccuugagguacugaggacugaacucagggucuugcacauacuuuucaggguauuacucugcugcugugcugccucagcucugauuaauguagucugcugaggcauaguuuuacuagaaacuugaaaaguaaauuuuauuuuugcucuuguaaugcuauuaugugggugauaugacuuuucuggcgauuaugcuuuguguuuagaaugcaaccugauugaaggagaagaucauguagaagugaauggggaaguuuuccaaaagcccuuuguggagaagccggucagugcagaggaccacaauguuuacauuuauuauccaacauccgccggaggugggagucagagacuuuuccggaagguaaggaagccuuugaaaucuuccugugaguagucuucauucuucuauacauuuuauuaaaguguguuaaagguuaucaggcucuuaauaaacuaaggugagauacugaacucucaucaucuagaggaagaugaaacugugguaauuccauuaaaaaguauacuuuucuuuuacugugauaaaacaccauggcaagagcuacuacuagaaagaagaagggaugggggagggagggagggagggagggagggagggagggaggaagggaagaaggaaggaaggaaggaaggaaggaaggaaggaaggaaggcaggcaggcaggcaggcaggcaggcaggcaggcaggcuuucuuugaacuaugguucaagcaaacucaggguuccagagcaguaacaguccauugugguaggagaagccaagcugagggcauggcugaggggacagaaacagcugagagcucuuaucuuuuaaccacaagucugacgggaauggccugccagagggaggcuuuauccucucagagcccaccccagggaaccauguccaccugccugccugaaccacuuacauuacaaagcagcgacaccagugggcagcaaguguucaauaccugaguccugagggacguuucccacccuaccaccaccgaaaguguaguuacauaaaauuccugccuucagaauguaaagaaaggugcaggaugugucuucagucuuucacuuguguuucucucagacuagaaauggacuuaaagauaagcuccuuuuuguagaaauuaaauggagaaagugccaguucacacaaaaguaauauugguaauuuuuacacauguaaguacauacuuaauuguucccauaaugaaauuaguauaaaucagaucugaaauauaaugauauuauauuccuuuuuggaauaaaaaggauuuucuauuaaauuggguaguuggaaaauaagccuaauccaaaauguguuaguagcaaugucgucucuuaguaauauaucaagacagagaugcacucauaaauagucaugguuuuguaugucaaugauaagcaaagagcuagaaaaauggcucaguaguuaaaagcauuugcucuuucaaaggaccccaguagguuuuaucucaaaaggaaaaaaaggaagaaaaaguugaauacauuuuaucaugaacaucauagcuuaguuguaugauaagcagaauauguuuauuuucaccuauaguuacuugauugguuaaaaaaaaaaacaaacaaaacccuacauguaacugcugcuguccagcagcauaaaagaguaugauacucauaagggagcccacgagcaucugugacuucagucugugggguuuggugccgucuggcauccacaggcacuguauacaugucgugcauuuacauacaugcaggcaaaacacuaauacauuuaaaauggaaguauagcuuaaaacagaauaaagaugcccuuuaaauacucauuauaguggcaaauauuagaaaauaaaaauaucaaguauagauaagacuaggaaauuuaagccaucuagaagucucuuauauauauuuuuugugagacucagauaacauaguuucuagaagauuuggcaguaucugucuaaguacagauauaaccaugagcuuccuagaacuuucuuagaaacauaacuauaaauguggccuguuuccaucuuaagaauguuuaaaacaguagcauugcauuaugcaagaaacuuggcaaacaacuuagacauauaacuauaaagugaaauguuguuuauauaguggaagcucuguagcagaaauaaacagacucaacuguuuuuauuugugugugugugucuaugcguguggggauggguguaugugugugcguguguuauauauauuugagggagguccccuggaacugaaguaauuguuauagguaauugcuaguugccugauaugggugcuggaagcuuguauuaucuggaaaaacagccagugcucuuaagcacugaaaauucucuucagucucuuagaaacaugauuuuuuuuucauuauauuuuaugguuuuuauguuauguuuaaauaacuacagcagagacuauauacugccaaauuuaaguacuguuaauuauucaugaauuaguuauuuaauaguuaagaaugucuacaguagauaguaaauaaagguuacauuucagauguauuauaaaaaugagggcaccacccugaucuuauguuaauggauauaucuuuucuucucuagauuggcaguagaaguaguguguauuccccagagagcaacguucgaaaaacggggucauauauauaugaagaguuuaugccuacagaugguacugauguuaagguaggguguauuuaggguuauggcauggugggauaaaguacagaugcuccuugaccaauacugagucauguccugauaaaugucgugcuagcucgguacaguaguguauccuacaaucucagcacucaggugugaggcaggaggaucuugaguuugaggcaagccuuugcuacauauccaguuucaggaaggaaggaaggaaaagcuuacucuagguuaagaauacacugaauaaauguaaccucaugaccgucauaacuuagaugcauggugcacuacaugcagaacaugguuaccucucacuuguaauuacccaacuggcaaaagcuacaucucacugcugcuguccagcucaugagagaagaugauacuguauuuucacugaaccagaagaagcagaaagaagaagaaagaaaggauaauuuuaacuggaaguaaaccauugagguaucaucugcagauugcaaacucaaacguuuaacugucauaaggccauaucagucauagagaccacauaguuuuaauugauauuuugagguuacccuuuauuuuagagaaagguaacuauuuagcuucugccuuucucagugcuguuauuauugguacuagggauagaacguaggcccuuaugugagguaggcaagcauucuaacacuaaguucucauuaguccagacuucuuuuuuuuaauuuuuuuaaagauuuauuuauuuauuuuauggacaugaguacacugucacucucuucagacacaccagaagagggcaucagaucccauugcagaugguugugagucaccauaugguugcugggaauuaaacucaggacuucuaugaagagcagucaguguucuuaaccacugagccaucucuccagccccuaguccagacuucuuuuguaugguagacaucacugaacacuauuccuuuuguuuguuuguuuuuuguuuuuuucuagacaggguuucucuguguagcccuggcuauccuggaacucacucuguagaccuguuuggccucaaacucagaaauccacuugccucugccuccuaagugcugagauuaaaggugugcgccaccacugccuggcaagcccaguauucuuaaaugcuuaaaaguagaauacccaguauuacaaagaugacagauuuuagugaauguuguaaaaauguuuaggucaaguuuuaaaaacauaggcuauuuauuuaaaugcuaaugaguaguacaguaucagauugagcauucuaguagcuaccaguuugcagacagugauuaaugucagugauaugaggcucugcuaaugguaauaugauauaaaaauaccauugcgcuugguaaccaacaaagcuuaccuucucccagccagccuuucuugaugaggcugcucuuucuaaacuuacaaaucucaucuugaacuuacccuuuaaaacuuguugguagauucucauuggccacaggaugacauccacuuucguaagacugccauacaagcuauuucuuccaauacaagccauuccaugcaguacauccuguaguguuggauuccuuuccugucccagaaugccuuguguugcuucuuugcucuguccuuucuauuuaucaccucaguaaaaaugccuuuccuuguucucccaaacgaugaauuccccacccuuugaaaaaucauauagacauuuuuucuaugucuaagaauuauaucuuuacaguuuuagugcauaaugcucaguuuuauacuuuugugcagagacuuuuauuuuccuguauaaguaauuauguauaaccuuuucugguauauugaaaaugcaggcauguaaaauagaaagaaauguuuauuaauagucuggcauuugaacuguuuuaaauagaaauuuuuuugacuuuauuguuuucuggcauauauacuauauauauguguauauauauauauauguguguguguauauauauauauauauauauauauaaauuuuaugaaagguuuauaccguggguccagacuaugcacaugcugaagcucgaaaaucuccagcucucgauggcaagguagagcgagacagcgaagggaaggaaguaagauaccccgucauccucaaugcacgggagaagcugauugcguggaaagucugccuugcuuuuaagguaagaugccaugcaagucaugcaagcccacguacucuaagcuuuccuuuugggugcuagacguuauuggacguaaauuagagaagaaagcugaggcgguaguuaguaugugugagcucauauguauguauguagguguucuuauggggcuagcaucacuuuccucauuuucagcauauucuuucuguauuauagagaaguaauaaaccuuauuuauucaaaaauuaaaguuacagaauaauaccacuaacuaguauacuaagugauagugccuaacauucuuuuuuuuaauugguuauaaguacuuuuuacucucauaaaauagauuaaaaauacuauuugaauaaaaaugauccucauuguuuuauucuuuggcuuaauauauaguaaaauuuguuccuguaaacaauauacauguuuuaaagaaaccuuuguuucuuguguuugacuaaccuuucuuaugcuacuaauuuauccaauuaauaguauauaguaaauaaucaaauggaaguaaugcaaccugcauuuaaugaaggaugcaucuuaucuuuuuagagaaggccuauucuagguucauaacauaagcuaauuauauuacugguuauuaauaaaagaacuacuucuauacaguaauuuugugugaagaauaauaaccugugaauaaguuguaaugcauucuuauaaacuguuuuauuguacuugguuuccaaagacuaauauuauucauguuaagggaauaaucacauggaauacauaauguguguucagaguacucaagguuaugguuauuuauaaccuucauuuuuuaaaauguuacaaacacuuacauauaauuaauaaauuagaauauggauucauaguaguuccaaugauacccuaaaauuucuaccuuguuuuaaauagcaaacgguuuguggcuuugauuuguuacgugccaauggacaauccuauguaugcgaugucaauggcuucaguuuugugaaaaauuccaugaaguacuaugaugacugugcaaaaauucuuggguaagcauuuacuacugaaccuuccuccugugugccuuugagcauguguuagccaugggaacuuuuugaucacuugaggguaauguuccauguugauaagauaccucuaaacuaugccagauucugagcugugcuuuaguuuauggggacagcuuaauuaauaacauauuccuaacaauuucacaucagggauuaugcuguaacauuggauuauuagaugcaccauuccuucauuuuuccuauguaguuauauuugaaguguuuuguuaaccuacuuaaugagauaaauaagcauucauaagauaagauacuugagccacagagaagacuuugaaguguaggguuguuuuccuuuacgucuuucugaauguucauuaucugcuguucuaauaagauaaucaaacgaguagaaaagaaaguauguguagaaauaccauuuuuuauauaucauuugauuuagaagauuaauaaagcaagaaguguaucuuucuaagcagcuaugacaaaaaugcguaaagucauuagagucagcuuuuguacugcacuucaaaggcacaagcuuuuuaauaaagagaaauugagccgggcagugguguugcacgccuuuaaucccagcacuugggaggcagaggcaggcagauuucugagaucgaggccagccugggugucuacagagugaguuccaggacagccagggcuacacaaagaaacccugucucaaaaaccagagagagagagagagagagagagagagagagagagagagaggaaauugaaggcaugggugucuuauuuuagcauaaauauauacuaagguauaaaaaaauaguauguauguauguauguaugaaugagagagaaugagaagaggaaagagaagagaaauacgaggagaggagggaaggaaggaaaagagagaguggguuugugugcacuaugcagagguggauguaucuacgagguauucgugugugugcaggagcuuguggugauggaagcccauccugacgugucauucucagcuacaauccacuuguucuugagauagggucucuugcccucucucuggccuggaacucucugccuucccaacacugggauuccccacacauggcuuaucuuuuaaacugagcauuguuugguucaaacucagguucucauauuugcaagguaagcacuuuaccaacuaagaaaucucucagcccucaaaucaguuauuuaagcaucuuucacuguuucuccuauuaguaaaauauaguaauggcuuguuagaaauuaucauauuuagauuaaguuugucagagaucgaagucagugaaggagugcucugugcacacggcucugguuacuaugaacaguaccucacacagacaaauagcauaauagguguuuaacagacaauuaaugaaugauucaaaaaacaucuaacuggaaauguaguuagagcaacauguuuuauuuucaaacuauauaaauuaaucgcaaauaugucauuuuguuaauguguucaauuuagacguaucuaaguuuucaugaucaguacuugaucauaacauaaucauaauauacauaaucaggguaauauuaccauuugauaguucgacuuaaauucuuauguuucuuucuuuuuuuuuuuuauuauuuauuuauuauauguaaguacacuguagcugucuucagacacuccagaagagggagucagaucuuguuacagauggcugugagccaccaugugguugcugggauuugaacucuggaccuucggaagaacagucgggugcucuuacccacugagccaucucaccagcccccuuauguuucuuuaucauggcauaauuaaauaaccacaucuaucuuuggauuaacuuuuaauaauucuuuuuugucuuaaagcaauaucguaaugcgggagcuugcaccacaguuucauaucccguggucaauaccauuagaagcugaagauauuccaauuguaccaacuaccucuggaacuauguaaguuucaauuauucaguuuucauucagaaauuccuuaggcuuuccacauuagucugucuucuuauugguaaaaauuuauuucugaaugacuuaguuacuauauauauuuucauaugauucaguuugaaguugggggaagggauauguuuuuacaaggguaugcuaaagcuuagacuauuacauuaugaucuugcacaaguauagaaccauguaaugaaaccucugaccauggugaugcccugggagcauuacguagguuguagcaucagucagcuuugucucugucuagguauaucuuagguaaguaaauuagaacaagacugccauaggguuugauagcauucugcuagggaaagucacucacuuuaaugucagacgaugugacugaauacuucauagucacaaguuuacagauauauauuaccauguuucaguauuuugaaaaguccuauuugggaggaaaguguaugagauagauggauggauggauagauagauagauagauagauagauagauagauagauggaaaguacuuaaguauauuuuugaggcagcauuuucaaauuaauucaacauagacuauuuuggacuguuaaugucuuucaggcauguguucaaugguuuguacuuugaaaauugaaauauuaccuuuuaacucuagcaugcugcuaaacaaguuuuuaaguugaauuauaauaaugcuuuucuuagaaagcaagauauaaucauacagauaccacagccaucauagaacaguucauuuuugcuuugauuuaauggcgucucuccugauaauucuucagggcggauguuuagugaacaauaaagcucagguuaggaguccauguacuuucucccagguuauggucaucaccugaagaagaaggacuacuguguaaaaaugaccaccacucuucucuggcuucuuaaccugcucuaggauuuggucuucuaaaauuaggucaaaagaaaccuuugauguuagggaauugagaccagagggguuuuuugguuuuucuguuuuuuugucacuucaggauggaacuucgaugugucaucgcugugauacgacauggggaucgaacaccgaaacagaaaaugaaaauggaagugaggcaucagaagugagucugaggcgaacgcucuguuugugugggguuugagacaucugcuagccuuagcucuucugagugauagaucacaguaguuuuacuuacuuaacuauuuuuuugaucaugaaaauauuuaauccacugaauguguacaaacucauuaaagguguguaagcaucuaaauuuuauuguggguuuaucuguaacugucagucuauuugcccuucauucaucaucauaaauauauucuacuuauucuuaguuuauuguuuuuuuacauuguacuauaagaaacaacaucucagcauuccagaaguaaaucuguagaaaggucucauuauuucuguucaguguuugauauguuugauauggaaaccugagccauuaaauauguauugacaucugaugcauugacaacagaaacuauuuuuuucuuaaugggaugcugcuugcguugugcacacauuuugaaaguacuauaguagguauugguuugcugugcuuuagaccuacguugagugauaucaggaaaagaggagcagaugcuaagugcaguggguaccacaaagcacaugcacucgagucucagaaguggaagcaggaggaucacuugagccaaggagauaagauaccaacugggaaauauguaacaagauucuuugccagggagacaagguggaggaaacgcaaaguugaauuaaaugaagaaacacauuuguguucauagauuuuauucccauaccucuuauuuuauuugguugacuauuuggugagggcuuuguuugcuguuuuuguucuuuaguaaaaucuuacuauguugcccgggcugaccuugaacucauggugcuccugguucagcuuucugaacgcuaugauuaucagugugcacagcaugcccagcuucauaguuguaacacuagugauugcaaaugacuaacugucuucuauccuuuuauaagguuuuuugaccuuuuugaaaagugugauggauauaaaucagggaaguuaaagcucaagaagccaaaacaauuacaggcaaguuuguugggguuuuugucguuguuuguuuagugauauuuuuuaaaugaaugcugagcuuaauuuuuaauggugaaacuauauaaaaauuuaaacucuuuuuauauuaacuugcauaggaaguccuggauauugcaaggcagcuucuuauggagcuggggcaaaauaaugacucugaaauugaagaaaacaagucaaaacuugaacaacuuaagacuguguuagagaugugaguaccucuuuggaccucuuccuuacaauacaauucuucuguuugguuuauaugacaaaauauacuauuauacugaauuacugcuuuaguuuccacuauuaauuucaaugaggagaaagaaagcagccuuucacuuggaccuucuugaauacuuaggaugaagaucacauagcuaacugaaucugacauucagcccugcuuagcuaaacaauuuugaaguguccauucaaaaauuaauaccuguuaguauuucuguugugagguuuacauggauuaccacuucuguucuuauaucuuguaacaauacuuaaauuguucuuuguuuuaaaacauuuuucuuucauuuuuaaggauuuccuauaugcauacaauaaguguuaucauagcugcuucucaucccccucuaacuuccuccuccucccccaacacaucuucuuccuaacugggauucuucgugaaagccaacucguacugauuaucauguguggguauggggcauccacaggcgauugggagaccuauccaugguuguauucugcagaaagagugauuguccccagaagcucucaucuaccaauagccucaguaaugguggguccugcagaguaccccccaacccccaaccccauacacacacacacacacacacacacacacacagaccagaauuuucucuggcuucaucuugugccagcagccauggcuuuugugaguucaugaaugcagucaccaagcucugcucaaaugacaacuucucccggaacuccuucccauaccccagcucgcaugugugucugugccuaucuguacaguguuuucagacuugucuaacuuuuaucaaacaguucacaaaugaucgccuauuaguacugauuugguuuugcuagguuacuuuugaagaacccaccaaggcaguagaagagaacugguuuuuauccauauagcuuaguuuuucucuaggaauucagucuauacuucauucauauuuuacgaucuaauuggcauuuuauuuuucagguauggucauuuuucaggaauaaaccguaagguccaauuaaccuaucuuccucauggcuguccgaaaacauccagugaggaggaagguauaucauuuuuaauuccuauugcaauuauguguauacuauaguaguaacuuuaucauuuccuguucaguagguuuugggauuggugugcugcuuaaaaacaaaacaaaacaaaacaacuaaaaucaguauuuuguuaacuaugcuucuauccuuuuaauaaagagacucuuuguuuuguuuacuuuugagauuaugauuuaguuacauuucucccuucccucccuccaaaucuuccaaaauaccucuccccacucuccuucaaauucauggccucuuuuuuuuucacuaaauauaaacuauucggcccauauaauguuacguguauguuuucagggcugaccauuuggcgcuggacagccaauugguguguucuucccuggagaggacccccucuccacucccagguccgcucaguugccuggagugcuuuguguaggguugaagccuccucggcuuuuucauguccagcuugcugugugugugucauagcacauauauguucagcuuagauguggacaaucauguuagugagacuuugaagguuaguuucugcaguuacuaggagacacaauuucacagcagacuccuggagccucuagcucuuacaaucuguuugcuucuucuucuacaguguucucuuagaugugggaguguuuugagaacuuauuuugaagacugggcuccauaacugcauuuugauugguugugguuuucuguaguggucaccaucuucugcaaagaagagauuacuugauugggggugaggacuccacuuaucuguggauagaaggacagauguuuauagauuguuguugggguuuaugcugguuaauagauuagugguuguagauucuccuuuaauagcccggacuucacuagcacagaauaguuagcuuauuucuaguaguaggcuuguuaucccucaaguugaggaagccuuagguacaguuagagagcuguugguuccugccaggguagcaugccacuacugcacccugcauccauaggguuauugcgaccguuacuguacccauagggcuauugccacuuaccagugugguucauaggugucaugccugguuggacuguugguugccucacuccuuuggaagcuuucaugaccuucuuauauuaugaaagcuaguuccuaaggauggaucuuucagguugguuccagccuaguagucucuaggcccugugucuugcuguuuucaacaguacccccccccccccccccgcaaccccccugagggggggggcgguaaccacaggcaacaacaauagacuguguuuugggaaucugucagacagccuuggccaacugaucaaaagagggcuucucaugucuaauagagacuuucguuagguggucuuuggcgcuuggagggagcaccaucagcccagaugagaaaauuuccauaaagauauauauguuuguuuacauggaauuuacauggaguuacaugcaugauagguuuuugaggaggagcaguauguauaaauaguuaauggaaugaguggcauuuucagauacccuguguuauuuugcccaccucccucauuaaggagccccauuucccaucaggucucuuguacccugcuguucccucacuguccuccaaccucauucuguaucuaccuuccuucccucccuaugagacccaccaucucacauuucccuacaaguaaucugagaaaaauagguuuuuuuuuuuuucaauuuuaaguaaaaaaugaauuuuguuauuuuuuuaaacucagcaggacuucuuuuuucuccagaguuauuucagaaagccuuuuacugauaaccuaguagaucccauuuuguccauuuuagguaggagaugacagcacagacagggaaaaacucgaaacguaugaaaaaaaaaaaccuuugaaaguacacauagccaaugcauuucugaaauaucuugauauuauuuuucuaaaauuuaaauuuaaguccaguauuuaccuaaauaagguuggucuccuaauagcauaaaguccugaaagaaaaccaggcagguuuuagagcagcucuuucaugcaugauauuaauaauacaugcugaguaucuuaaagcucuagacucauugguacaacuuuguauuuuuaguauagaacuuuuguguuugugccugcaugugugcauguguguguguuagguagggcucauauguaccuuacaugugacuguacauacauguacaugggaaaaguuuccuugugaggaauuugaacuugcugcaucauguuaguuuuucaaacucgcuagagccuuguguuuggaucagguauguucugguuucucuugccaucauacuggcacaaugcuuucuucggaguugccuuuuuaaacugguaaucaagagugagcacauacaguguuagcuucuuggucugcuggaaguuguaaauagacacaccuguuaagaguaguucacaaugcauauugaaaacuucagugccugccuugugcucugaccuuaguucugaguucaagagucuuuccccucagguaagcaagacugagcuaucaugguacuucauuauaccagccuguguugaagcucugcccaucuuaaauagaaauacaaguuugaauguuucacuuuacguguuuaacauuuccagucaucgcuccgugaugaagaacaauagggguuuauuucuuauaucuauuggugcuuaugaucaaaaaugaucugugagagauguaauaauaaaaaucaggauuuaggcuaacaagccaaucuuuagguuaaagauuaauacugagauguguuuagacacuaguuuaaauguuauuaugcaugauauaacauuuguuuuaucacucacaucugucuuagauaaccgaagagaggagccguccuuacuuuugguucuaaaauggggaggagaacugaccccugcgggcaggguucaggcugaagagcugggaagagcuuuucgguguauguacccuggaggucaagguaagugcuauguaucacuugaccguaucuguacacuuuacuuuaccuugugauauucuuaagcauuuguagaggcaccacaaagcagaaauauagcuuaagugaugugagcauuuguuuucaggagauuaugcaggauuuccugguugugguuuacuccgacuacauagcaccuacaggcaugaccucaaaauauaugccucugaugaagggcggguccagaugacggcggcugcuuucgcaaagguacgugcagcuuuauaauugcuaugaaucccaaaucaagccauugcugacaaagaugucauaguaguaguaaaguggaucuaugaugaguagcuuaugcauuguaacguuuagcaucuuguaaaauggccugugauuuugcauauguguaaaacacugacgcuuaucuuuguacuuagggucucuuggcucuagaaggagagcuuacccccauucuuguucagauggugaaaagugcaaacaugaacggccuuuuggauagugauagugacucuuugaguagcugucagcagcgugugaaagcgaggcuucaugaaauacuucagaaagacagggauuucacagcugaggacuacgagaagguaggccugagcacuucuucccucagcuugugccugccaaggucagcuggacucuugguauuuccauuuucacccaggucauuaauaaucuuugcuauguuguuaaaagaaucacguaauaaauauuguguuuugugggccuguugagguuacuuuuccuguugcugugaucaaauacaacaaaaauaaggaaggaaagguuugacuugguuccagccccuugucucaaagaugacaccguagccgaguuugagguagcugggcacaguccgcaacuucuuuccuuuuuauauaggccaggaaugguaaagcccacuucuauaaugguugucuuaccucagguaacucaacuaagauaauugccuacagaccugcucggaaacacaugaacacaagggauauuggucucaucaaguugacaggaacuauggucucuguagccucuguagcccuguucucucucucucucucucucucucucucucuucucucucauguguauguaugugugucugugugugugcaugugcuuuugguggugguguuugggguucuuuuuccuuugguugguugguugguugguuuggugcccuuugaaaaauguuaaaaccacacauaccuuacaggcuuauguuaccaacccugcuuggccugcagaacuuacuuugcuguaccuuauuuuauuuuaugaagauucuguuguuuaugaugugaucaacugguugcaguauaaggcuguuaagauuagagcucgugucucuagcugcauauguagcagaagauggccuagucagccaucauugggacaagaggccccuuggucuugcaaacuuuauaugccucaguacaggguaaugccagggccaaggagugggaguggguggguguguguguguguguguggagggggggauagggaacuuuugggauagcauuggaaauguaaaugaagaaaauaucuaauuaaaaaaaaagauuauugcugacaugaacauccuugcauaucucuugguuccuaggagacccuguuucucuucaauguauucuaagagugaagauguaaauuggguaugcuuauauuuaguguuacuggguaaagucugacuguuuuucaaagugugggccaguuaagacucaaagucugaaagcugccauugcuccguacauucuucacuugggcauuucucagguuaucucugaugcucauuuuggaacauaagccuaugauauaccuuuucauuucuuuccaguuuacugcucagauguccuuugucaugaguuuuuaaauaucuuauccuuuuuuuucugcuuggugccugcuuuuuuucuuacucucuguguuauuuaugcucuguuacagauaaaauuuuaucaaucuugauacaaaaguugauuuuuuucuguagguuaugagauuaauaugugaaaaucaguuuuuaucuuuaacucuauguacauuuagcacuagcugaagcgucucuuccacucuccuggaacauuguuuauguuucuuccucugcacuguuugcugaucauuguguaguaauaaugaauaaaaucuuaugcuuucuacacaaacucuuucucuucguuuuuuggcaugucucaaauugccauguaagcuuuacaauaagcuuauuaaaaauauuauugggauuuuuauuaagcuugcaugaaauccuguuuccaugucuuguaccaguuuacauucagccuuucaacauguaaaaauuugauagcacauuuauuuagauuccuuaaaauuuugaauaacauuuucagugauagucaguauauccuauuccuguuagacuugaggugaaguaaaugguauuuuuaaugcaguugguuuuggcacuccuugaaaauguuugcuguucuuugauuguuuugauguagaaguauagucuuuaauauuaauguaaaguuaaucugagcuauuuuccagucuuuauaguuuguuauugguggucuuaaagagcaugcagucuuccugccugagcccccugauucugggacuggaggguuacagcaccaccccuuccuuaaaauagcacuuguuuuucuggucacauuuucccagaggaagauuuaauacuugucuguuagacuugacuuuuucucuguuuuuguuguuguucuauuuuugaaaucaccuuuuaacaaacuaugcaauuauauauggucuuuuaaaaauuuuuuuacuaaguuaaugucaugaaaaugcuuugcuccuagaauaacgucaacuuuuuuuauacgguauuaauuugagcuuacaaaugauaugguuuggaguuuggcaucuauagucauggauucgccagccuuucugucuucauuuccuugucaguaauaugcugaaggaaaaaaauagcaaggaaauccuucccuacuuggggagaaggauucauaaacagcuacuucauuucugcucuaaacacuguggaguuacuacuaaauaagaaauacuauuaaauaaugaguacuacuaagccccguggaaacuucuugugugaacuuuguuuuuuuuuuuuuuuuccauuuuuuauuagguauuuagcucauuuacauucccaaugcuauaccaaaagucccccauacccaccccacccccacuccccuacccacccacuccuccuuuuuggcccuggcguuccccuguacuggggcauauaaaguuugcaaguccaauggaccucucuuuccagugauggccgacuaggccaucuuuugauacauaugcagcuagagacaagagcuccaggguacugcuuaguucauauuguuguuccaccuauaggguugcagcucccuuuaguuccuugggugcuuucucuaguuccuccauugggggcccuguguaauuagcaaaacuaagaaugguucagcacgugucuguuaggucugcgucucuauuguucuguacuuacaggagguuuucugacuccaucugaguuuuuugugcuguauguggauucuguggaguugucacuguuguacaucaucagcccucugaguuauuauuuacaugucuguuucucugaaugugauugccuucuuaguuugagucuuagccacaucauuaauuauagcacacaacacuagugacaaguguacugugagcuuguccugcgcuuugcuggguuuaucagguccagcguucuuuucagucucuguggcgugguggccucccuccuuucuguuuuuaagaggaggauuuacuucaucgcuccagcucuccuuucacuugggaaucuccuccuccagcuggaagaguagcugcgcuugcugucauaagucauuagcuggcuuaguggauggugucuugggcuuuucugcuucuagaauuaugcaguccacaagaaggauaacguucccucuucccuuaccuauuuggagcucaugcuuuguuuuuuucucuuaccugauuguucuggcuaaguaagucuaguagaacugugcugaccgugguaaaaaugguaguuauuucccucuucuggucucagaaaaaacugagcuuccccuggccaguguggugcuggcugaguuacucugcacagccuuugguauauuaaaauaagugccuccaguaccaaagucagggagauuuuacuguuaagggcuauauaguuuguauuguuucccuuuuuucuuuuuugagauuaucuuauaauuauaucauuuuccucucucuucuccccaaacccuccuccuugcuuggaugcuuuuucuuccucuacaggagugagcuccugaggcuagugcacucugcuguuuacuuuuuacauauagugacccaucguaaaccugagaagguacuaaugguauaucauuuuuugauguucuguugugcuuggcuugccaguauuuuacauuuauuuauggcagcacagaucuauaaucucccucuuccugcgcugccuuccuuuccucgggccuuuccuucugugucugcucuucaucccagguaaaugcugaucuugugggaugaauuugcaguguuuccuuccuuuucauuuuuugcgggauaguuggagauaaauuggcguuaguuuuuaaguuuagauagaauugagcagugacacuuucuaaugaugauuguguaguugggagacuuguuucuauaugaaucuuuuuuuuuucuuuuuuuacaaccaaaaauuaauagauuugguaagguuuucacaucuggucugcauuaaccauacgagcuacucauuugaggucuguccuauauuuucuaugaaacauuuuaaugaugugaucaagcaucaggaaucucuaguacaauguucucuuucucgcuuauggaauggcacauacagugagucccacuagcccagcauguguucugcauaccugcaugacuguugcagagguaucgugcacaguccuucucugugugauggccauacacauuacuguuagcucagauuuuuaauugugucuaccauaccugugggcaggucauucugguauugucuuagaucagcuucaccaauacaucuuucuuggccaacaagcugauuaauugauggucgguaguuuguugcuuggcuugguuccuuuugaugcacccuuucuguuugaauccuauauacaagcuauuuaccauuuuuuaccuuggugaaucccagauuucauuuugaacuuggugcucuuaguucaacaauauuagauuucuucccaacauuucuguagaaucaacaaacuucucuaaaacaaacaaagcugucuuuuaacaucagguucauguucuugaucccugaccauuuuguuuuucuuuuauaauucuuugugaccuugaugucucuuagaugcuuuaaagaauaaaaugcuauucucccugaaguuccacuaccuccagcaguaacauugguccaaaauaccaaguucacuauaacuggaaguacaauuccucuuugcauuuuguuguauuuguagaaaccuauuucaucuugcuacauaucuugccaauguaaguuuuaaaaguucaguguauaaucugaaacguuaauagcucuuguuaaauaggaaaaaacucauuaacaaaguauaauagauagugguugacaguuugaguucugcaaccaucguuccugugauugaguccucuuccuucaaaggcuugguucuucaccuucuuuagguaaucuaauuguaguuaaaguuuaauguuguuuuagaaugaacgccggagacuuucacaucccuguugaugguauuauguauguuaaauaucuuaauacauagaauauaauuauuuucccugcuauggaaaauuuuguguuuuuccucuuggauaaugggacauaacccaaaauaaaacacuuauccuguucauuuguagcuuacuccaucuggaagcauuucuguuaucaaaucaaugcauuugauuaaaaauccagugaaaaccugugacaaaguguauuccuugauucaaaguuugacuucccaaauuagauaucggauggaagaucccaaaucagcugguaaauauauauauuuuuuuagaauuuagaauagaaguuucuguccuuuuuguuaaacauguuaaauaaaguauaugaaucuuaugauaucaagccuugcuuugaaauaugaguauaaauaguaugagcuagguuauagccauuuaucuaugacuguaagaaaaagacagcagcaucuuacuucaucauugaguauguagcauuuccaaauagauaagcaggagauaggcaucguacaaagaagcagaaagcgcugguuccaaguuuaguuugaaaucgaugguugacaucuuagauuucuuugugauaaaaaugagucauuugaacucuuuaauauuaagaguuacuuucugcaaaauauagucugcuucuucuguuugguuacaggaauuuaggaaaguaaaguauuuaaauuuuugcauagaaagcauuuuaauugagaguuuugccguauuucuugguguuuucauuguuaucaaaaucuguaauauauuguuaucaaaauaauuguuaucaaaaucugcaauauauggaaaaggucucauaaauaucagacuucuaauccaaguacuugugcuaaguacuuauccaagccuaaagccaucuaauuacuaaugauucauguagauaguaguacuuccuagcuucuuagggcuuuacuuuuuucucuuuaaaguuuuuuacucauaggaagccaguuauggaaucacguggcuguaaugacagcaacagagggugagccagaaaaauagggauuuccaggccagggagagcuacaauagaauacaaguaaauuucagaucuauuccuauucagauuuuuaagcuguauauacuaacaagugucuauuguuuuagauauucagcuuuaccacagugagacccuggaacuuaugcugcguagaugguccaaguuggagaaggauuuuaaaacaaagaauggaagauaugauauuagcaagaucccugacauauaugacugcaucaaauaugacguucagcauaacgguuccuugaaguuagaaaacacaauggaacuauauaggcuuucaaaggcauuagcagauauuguuaucccucagguaaguuacccuugggaguuaauuuccuuauacuauuauguaaaaagcacuuucauguacucacuguuggauaaagauaguuugcaagauccuagaaauaccccuuaacuuuuauauuagguaaauuugagguauuauaagcguauuauugguaauauuagucucauugucugauuagcuagccaucugaugauauugacuuuuuaaaaguaggcuuuacuuacuaaagcauuuuuaguuuuacuggaaaauuaaguagcagaucuaaagaguucccguugacaucuguccguucacaaauggagcuugcuuucuucuuccuccaugaaguuacccacugaaguagcauauuuacuaaagccaugcugacauaucauggucacccagaguucacaguguauguuaggauuuaugcuagugccguauauucugugauuuucuuuuuuuuuuuuuaagccaaguuuauuauaauauguguguuacagacuaguuuuggugacauaaggaugugauuuuuuuuaguugaauaauaauacucugacaaacaaagcaaagcaguguggaauaaaugaauuagcaacuuuuuguugcacacaacuuguguaccugccacacugugcugggguagugugugggaagggaaagaaaacauuaauuguggcccuauguaaguauuuucacaggcuggcauagggcucagggguaacagcuucccuaaguuacauagacuuuuggguccaucucugaaagucucauucagcaaaaaagcagacaaaccaaauagucuuuuuacuuuauguauaaauauuuugaaaguacuuagagaucaggauaaguaauucuuucaagagauauugauuuucuuauuauaggagaauaagaguaaaguuauaaccagauuuugcauaacugaauguaauuuuauagagacuaaauuaaugaaggauuaaaggaugaaccccauugaugcagaaguuaugacuaugauagaagaauuaaguuccaguugccauuuuaggaucuuuuucucuaauguagcuacuuuuaaaugacuuggcuguuugaaguagaagcuagaguggauaugagauuccaguugccuugaaauacgugaauaggauaaagguuaugaggaauaauuuaguuugccuuguuuguaaaugcacguauaaagaauuauucaaagaauaccaguauuucuuuccugauagucaaagucuaaaugacugagacuuuguaaagugaaccucagccagguacacccucuguagaugcugugcacauuugacggugcucuucaucacagaggaauagcugugugcuuguuugaucagaaauauaugcuaaagaugaagauuauuuaaaguuuuugaaccuuauaaauguaagauagaacacucuauucuagauaguggcuuaugugcauuuuuuagaauaggcuugcaauucauauacauguaucacuuaauggucucauguacauguaaaugcuuuauauggaaguacagucugcaucauuguuuaacuuaaauuuuaccucuuucuguuacauauacaauauauuuuaagguugaggauuacaguuauuuucuaagaguuuggaccaaaaaagaaugcucauguguuaauggaaucuaaagauaaucugaaauguauuuaguuguuucuuauuucacuuguauagugucuugccucuguguauaucugugcaugcacugucccagaagagggcaucagauucuuuggaacuagaguuucauacaguuguuaucuacugugugggugcugggaauugaaugcagguccucuggaagaacaggcaguagugcuucaccacuaagccagcucuucaugcucaauggugugauccugcacuguguauauacuucaguaucuuccauaugcagcugaagaaacuucucaucagagucuaguaguuuaaauuauaguaaguucugguguugguguuguuaacuauggauuaugaaugggguuccuaagaucuugccauugagauucuaguggcaaucuuguggagauugccacaggacagcuuuaaguaggcucauguggugucuuaauuggcucucuuuguagcagaaagcuaaugauuauuuuacuuaauuucaacaaaaggauggcaacugaacagaaauuuagcugucuugaaaaagaauguauaauaauaaauagcaugcacguagagagguagacaucuauaucauaguuguaaaucuagaaaacauagagacagaauaguugcucuaacuuugcaacuaauagaaaagaauguuaguguuuggaauuuucagucuucuuuccuuaaauucacaugcauguauuuuucugacaagugcauguacauauguauauuuacacauguauauuugcauuuauuuauaauuucauuacaaauauggagucaagaaaagcauacuguuuuucuuuuuuauuuagcaucaggaacuucuuuccacaucaaugaagcugucuaacuaucaauaaucaccauugacauuauuaguuauucugauuagauuauugguaauuuauuugaaaaacuaauuucuagcugggcaguggucgcgcacgccuuuaaucccagcacgugggaggcagagggaggcggauuucugaguucaaggccagcuuggucuacagagugaguuccaggacagccagggcuacagagaaacccugucuucaaaacaaaacaaaaaaagaaaaaagaagaaaaacuaauuucuuuuuauuucuuuuacuaucuuuuuacguguuuaacauuguaugaaauuuucuauuuacuuauuacuugcuaaaucaaauuucagaacaacuuucucuuauuauuuuuuauuucaacauuuuucuuuuauuugcuuauucauuuuuguauacauaccuuucuguaacuaguuuacacuuaaucuagauuaacaagauuuagugacugaauuuaggaaacuuuaagucuugucuuagugugcagauaugauagcaugaaacccugacuaaaaacaacuuggggaggaaaggauuugucugguccauugaagggagccauauugcaaugaccuuguuuucuuacauuuuacauuguucuaauucuuuauaaaucuaauuaacucacaguuauuauaguugucaauuuuuuauuauuauuaugcuuauagcuaguuaaaaacuuuaagaauguuagacaaaggcuuucuuccuuucccucccucccucccucccucccucccucccucccucccucccucucuccuuucuuucuuucuuucuuuucugagacugggucucauugcguugugaucuuaguugguccagccuagccucauauucaacagagaucugccaccugccucugccucccaagugcugggauuauaaacaauucacuacuacaacuaacuagacaaaagccuuuucgaaaaaucuguuaggcuuuuugaacauugauguuagaaugauuuugguuguacuucuuuuaaugguaauuaccugugugcuugguuuaaaaguuucagagcucagguuugugucuuucauauuuuaauucuuuugauaaaaaggaggacuggucauagaacgugcguuaauacauucaacauaccccuuucaguagucagcagacuuucagucccucccuuccauucuuccaaucacacacacaggcuugaaaagaaauauacuuggaguugccaaaaaugaaaacuaaaaguugccugcuuuaaaagccuuuauguaauauuugcgccucacaauaguucuucacuucaggagugcauuugcuaacacuacuuauuauagcuuuguuuccuaacuuaacuuuuuuucugcucaggaauaugguauaacuaaagcugaaaaacuggagauugccaaaggcuacuguacuccacuaguuagaaaaauccgaucagaucuucagaggacacaagaugaugauacugucaauaaacuccauccuguguaagagacugucgcagcuguucacauuuauaugcaccuaguuuugugcauuucacaucuaaagaacuuccugguuuuauguagaaaucaagagugugucacuugauaaauuauguaaucuagauauuccuauuaacuuguccucuuaggguguggcggggguucgagggagguugagacuuaagcaugccauaggcacacccugucaggaccuacaucccugagaugacauacaucccugagagagacagugcuucuuucugucuguugugcuggcugaugucauaucacaaucuagccuuuacccacguuuuggcuuuaugucacauucccugugccaggcucaagcaagguuuuguuuggugccuguaugagaaagggguaggaagauauuuuuuaucaguuaucuguccuaaccacugugaaccccauugggcagcauuauuuccucugaguuccucuguuauugcuacuagaggaacuaaguucaucuuuuuccagugaaguuaaguaaugcuguuuuauguuuucuuuguguuuuggggaggguuuugugugcauuuuguuuauuuguauguuugguuuuuuauuucuggguuuuuuguuuguuugguuugguuuggguuuuugcuggguuuuuuuuuuuguuguuguuguuuuguuuuguuucguuuuguuuuguuuuuacuauucucagagggcuuaguuuguuuuaguuagaagaguaucuaucagagacucucaguugcagaaugauagauugauuuauggggcuuuucuucuaauaagauugaauuccauuuuauaaaauuguuuccauguuugauaugcuuuugauuaugugguuauauuuucacacccucugcuucuaacuucagguauucuagagguguucugucuccugagcggcacguccgcaccagauuauauuuuaccagugagagucaugugcauucuuuacuauccauucuucgguauggcgccuuaugcgauguaaguucggguuacuccauguaacugacagcagugggcauggggcuuguuggguaauucaccauccaaaccuuaggccugacugucaggcaacguugggaagcaaugcaccugaacucugucccaagcucagagggacgacgggguggcuacgggugacuaaggccaacauggacauuuaaaaagauuuguuauggaaauaaaauuauuauaaucaucucggggccuuaacaacacuaaauuauguuucagaagauauucuagguauuuuuuuauuuuauguguucgugggagcagacuuggaaagauuucuaauuguuuuguuuuguuuugguuuuaguuuuuugagacaggguuucucuguguagcccuggcuguccuggaacucacucuguagaccaggcuggccucgaacucagaaauucaccugccucccaagugcugggauuaaaggugugcgccaccacgccuggcgaccuuugccaaucuuacuuccucagugugcacacauguaaaugugcuuucuuacucugcaacuuccaucgccuuaaguuugagauaaaucuuuucugaaguaaaaaggaaauauauacugaauuuuaaaauagaccagucagcauguaguuucauaauuguguucuuguagaauaggagucaugcuaagcuaaaguucauucuauuauuuacccucauuauauacuguaacacugguggauuuuuacauauuuguaaugcuuuguuauacauggacaaugaagaaaccguuccugugauguuccaguuacuauagaccuugcugacuuuaccucgugcuuacaguaguuucuggguucuuuuuuguuuuuguuuuuguuuuuguuuuuguuuuuacaaguagagcuuucugucuuagauguccucauucucuuauaauuccuuucaucucuggugcacugauuacacaugugaagaugacugacuuuuucuaaagucauaucuaaugaugagggauaugauaagaucaguuggauuuuuguaugucucguuauacugauuauuuuacagucacuguaguguuaaguaguggcauuuuugauagacuuaugcuacagagagaagcagucaucuuugaagauaacguucugugccaugaggcauaggacucugcuaggcacuuucagauuuauaagauucaaaagcuauucuuacccuuagaauucaauagcauguguuauauuucaagagauuuuuuuucuacaucuuguaaauugucuugacaaaacuuagaaguauugucauaugugguaaacauugcaaauauuuuuucuauucaccggauguaugugauaacacauuaaguaagcugucaugaugguaagaaagugacuuccaugugcaaugguaugaagaauacuuaccagagacccuuuguucaggacucaaaggaugagcaguggaaacgagcuauggauuaucuaaacgucgucaaugagcucaacuacaugacgcagauuguuaucaugcucuaugaggaucccaacaagguaacggagcucuugcuuugcacaugugaccggagguaagcaaauacuugaaauuccucacuggagacguguucuuuuguguauuucaggaccuuuccucagaggaacgcuuucauguugaguuacauuuuaguccuggagccaaaggcugugaagaagauaagaauuugccaucuggcuauggguauaggccagcauccagggagguaaugcagacguucagugcauagcuacuccgcuucagauuuucaugauguauccacaagcuuuuccauuacucuauaaaucauuuccauggcagcuaguaggaaaaaaggcuuuaccauuuaacaguauaaucugauggaccuggggcuggcucagcacucaagcauugacuguucugucaggcagccccaguguuacaagugaccuguugagaaugcagguacaacucccagugcccugaugcucacaacagucuagagcucguuucaggcccucugcuggccaccgugagcaccuggcacauaacaugguacccagacaugcaugcaggcaaaacacauaacaaauuacacauuaaauaagaauaaaugaaucuuauuuucaauauauauuaaaauuuuaaauauauauuauaccagagcaaauaacaaguugaugucuauuacaccauugagaguuugaucucuuuagauaguuuggguucuaagcuguguuuagaacauguaaguauaguuguaguuuucgguucuuuugucuguugaguacuuacuuuauacugagcauugugcccagcauggcuucuucaguucucaccgguacuguauuuaggacuaagugcuuucuggaacauguuuuagaaaacuagcauuauucauuucugauuuuucuauuauuaaauuuuguuguuugggaagcugcauguauaauuuuuaaaacuuauuuaguaauauucuaaucauaugaucaacuuauugaguauauaauuucguguuuacaugucuuuuauauuuuuuuagguaauuuguauuuuggcuuuauuuaaauuuuaaaauugaggaucuauaguugucaauauucuuggauuaucuuuuuauuuuuuauaaagugaguggugcugcuuuuauggauuuuaccaguaccuuuucuuaucuguauuugcuauuuaaugagcccuagaaggaaguuuuggcauccuccuguuuucaggaagcagcagguucuccuuuggcuucgucuguauacauguuuuuauucaaccugcucucgugcuccguuucuguccaauccacuccuagaccaucuguuuugaaguuugccuuugcugguguuugcacauggagcugcauuacguggaaauauuuuauuagucgguucacuuuuuuucuuugguuucuauauuugaggcauauggucuaauuccaaccucacagaaaauacacugggcuuuuccuaguagccacugccuuaauggcauugucagagaauguauugagugugcuuuaucuucaguguauaaggaucugccuuauuguccugugugugugugugugugugugugugugugugugugugugcgcgcgcaugugugcguguguuucauucauucucuuggucucuguucaauacaagucuuaaguauaagucagguaaaacuuauuagcaguguugcuuggaugguuuauaucccucaaagagucuuuuuggucugauuguuuuuucugcuacuuaaugugcaaaaguaucucaccaagauuaugaaguauucugacaguuuucauuaguucugucagacuucuaagcaguaaggauuuugauuuuuuguuguuguuauuguuguuuuuaguguauauaucuuuuaaacaguuugagacagagucuucauuauguugcccuaccuggccugaacuuccccauguagaucaagcuagucucaagcucacagaaaucugccugucucugcuuuugcuucccagugcuaggauuaaaagccugugccacuacacuguauccauuuucugguuuguuuuuuguuuguuuuuaauuaaaaauauaguugcaucauuuccaccucccuuucucuacuuuaaccccucucaugucccaucucuccagccccucccaucuccccagccccucccauguuccccaccuucucucaaauucuguccuuuuuuauuguuacaaacauguaugaauacauaaauauauaaauaaaacuuagagucuguuuaauguuuugugugugugugugagagagagagagaucuguaugguuaaucuuauucuuugauuugucaugaacaauuacugugauuauugacauauuuaggauaaauauucuuaaaugguauuuguagccuuuuaucucuuuacugccuucucuuccugccuuuuaauucuuucaccauguugacaggauucuuacauuaucuuuguaagcaguuaauugauuuuuauguguuguuuaugacugacacugugguuuaguuuguuuguuuguuugcuuuuuaacacuugcuugaggcacuuaauaaaugucaaaauaaauuuuaaauaauuuuuaauuaguuaaaaaucaacaaauuaauuaaaugauaacuagaauaaauaaauauuuagaauagcauuuugaauaauacucuucuguauauuuuaauuacuuuucucucaauuuaagaugcaacauuucucugcccuucucuuccagcucacuaauuugaucaguaguauuuuucaauuuucuguugaacucuacuuaguaguauuauuacaaauugacaauaggcuuuaguuguuuucaacacaacccuuuuccuuuguuucuuuuuauaaguucuaauucucagcugagccucaguuuuaauaaccuuuauuauuguuuguaacuaauaacauuauugucaacucgacaauggcucauuugguuuuaaguuuguuuaauaauuuuauauucuaauauauaaugauguaauguugguauaauguauuguagcuugucuauaaccuggcuauauucaguucaucuaaguucuuggcauaugucacacaguaaaauaucaaaggggucauaaagugauuauuuuucauauauucucauacuuauuggaaauauuuacuguagcguuuaacuauucuaaagauuuuuaauucaacaguuauuuguuagaauuguucaucuguuugaugaacuuuggcuaaagacuugcuuuauaugauuauaauugccauuuuagcccuaacuuuuccccagaauauguauauuucuugaagcaguuugucucucacaauaccugguauacuaagaagguauaagauuaauaaggaauuaaauuaauauuaauucacuugaggaaaaacuuuuauauaauagcuauagcagcuggcuguuaguuaucagaagcauuuuauugacguuuagaguuuguuugcuugugagaguugacaaguucuuucucuguggcuuuacaaacuugauuuuggggcgcugcugggaauccuggcauguccugucacccagcucaggagaggcguuuuaaucuuaguuuuaagugcaucauauucuuuccucacagaaugaaggcagaaggucucuuaaaacugacgaugaugagccucacacuucuaaacgagaugaaguugaccgggccgugauguuguuuaaaccauuggugucugagccaauucauauacacaggaaaucaccgcuuccgagguccaggaagauuacugcaaaugaggugaguaucuauggagaguguguccuguacagggcaagcuaaccauagucauucaaaggaaaagaaaauacagcuuaaauuguacggcuaggaauaggaacaguuuuaguuaucaacacuuuuuauuuuucaaacaaauauuuaaaaacaaaaacaaaacauagaugcuguuaaaaucaacacagcagauaaaccaggccuagcaucaucuaccuguaagcccagcacuuuggaaguagacaggaagcauagggauucagacauccagugucacccuuggcuacuuagggaauaugaggccagcuuggauuacaugagacugcagaacaaaggaacaaacagcaugcccagagauacagcgaugaguguugagaccagagcucugugugcagcucucagccuggcaugggcugugguggcucgggaagagagagaggcuugucuaagaacuugcugaacuuacccacuuuucuuuugucuucucacuuuaacuauucuucaguaaguaccucaauuaaaagccuaauauaucagcaauuauuuuuguauaaaaguagauaaaaauugccugagauacuuaaaugaugccugauacuaguaacacugcagguuuucuuagccagauugcagaaaccuacauaggaauuugaaagcuugaugauauaauugaaauuuauaauggcauauuaagaucuauaauuaaguuaaaccaguuauucucaguuaaggaauaagauuuaaauaauauacaagucgacuguuuagaagguagcuuagaauuguuuuuagugucuaaguauuuuuaauacuuggaguuaccuucuuucuguuccuugcauugcuugagaccagugcuucuaagucuuuucuaaauauuucauaugaaguaagaaguuaagcucccaagagaaaacucuuagaucgucuacuuuuaauugauguuuaaauauaaaaaguauauagaauuauguuuaacauuauuugauaauaacguaaaaaacaaaaagaauuaccacuaccccacuuauaacaauaauacaaguucugaauuacauauugggggaaaacuaaucauaaaguagaucaccauaacuuuauaaaagaaauuauauguuaauguuccucucauaugcuauuucuacuuaguuauagaagguuaauuuaaaaagaagagagacucuagcuacuugugaucauuuguucuauuaaaacguaaacagaaauugagaaaucugaaacuuuguccagauauccuaacuucaggaaaacaaacaaacaagacagaaauuauuuaaacuaauauagucuaauccgccauuugugugaaagcaguguuuuugauauagugagaaacaaauaauuuucuauuaaguuuuucagaauuucucaguuaaacccuuuccugugcccucuacaggaucugucugugugugugugugugugugugugugugugugugugcgugugcgugugcgugugcgugugcgugugcguguguguguguguguguguugcuagcauggcaaauagaaccacugccguggguaacuacuaaaacagaguacacauuuucaaaucuuuuucuuguggauguuuaaguaguugcuuccaagagauuauuccauugugaugugccaagcuuuuacuuuguaagauaaauuauucaaguaaaaguugaagacuuuuuccagcauccuccaaauccauaggugucaguuuauacuuugaagagacacacagagaaaggcauucccuucauuaucuacaaggagaucucagucugaacucacugucugaaccugcacagugugcacaaugagaauguuugcugcaggcuuggucuccugcaccuauuggcucucucaugcagggcaagcacaaacacuuagagcaaaucuguccauuugauugccucugaauuuugcagcuguggucaacccaguucccuuucuagguuacacacugaauuuguuuuaccugcuuaugcuuuagacuaaaauuuccaaccaaaaauuugcacaaaaucuuuuuaauaucuaauauaaaauaaacucaaauuccuuuuauucuuaaauauuuucauuuaagagaaagacuauaauuuucuaauuuuaaggaagaugggacaacuaguagaaaauauagcuuaugucuuuaaagauaauaaggucuuucuaugauuguuaaugcuauaugccaauuauuuaauuucuuagggauuuaccuauuuggcucacaaaugaauaucuaauaauuugccuuugagggauaagcaaaugcaaauaaacuguauuuuuuuuucuuccugaucauuuggcucuaauguaucuaacuuugcaugcucugcuuuuuuuuuuuuuuugccuuuuuuuuuuuuuuuuuacuuccaggaagagaccccccugagugugucuagcccagagggcacuggcaccuggcugcauuauaccagugguguggguacugggcgucgaagacgcagaucaggggaacaaaucaccucuuccccugucucccccaaaucauuggcuuucacauccaguauuuuuggcucauggcaacagguuuuuaaacuuuauuucauuaaauauuuuccauucuugcauucagagcaacaaacagcuauuuuugaggacaucuaaucccuugucguuuacaucagaggaaauccuucugucuuaaauuuaguaccucaagauacuucugauauuguucaauauuucauggaaagaaaccaucuauguggcaugcauuucgauuuuucacuggggagcuuuuaaauauacaggagauuuuaaaaauccuaacucuccuggguuuguagccaugcuaacaaaaauaaauuagaaaggaaaaaaaucuuucuuagaccuuaguuguccuauaaacuucaagaaacauacuuaacacacuuugaugguuaagaauauuugcuauccccucauuauuugaaaagcuucauucuauuuagaauuugcugugaauaugaaauuuuugaaaauaccaaaaauuaauguggccuggucuuaauuagugacagauaucuaaacauugauuggucucucugugaucccuuuauuuggaaauauuaccauaagggaaauaugcaacuuguucuccaaacacaacaauaggcaugugcaaaguuguaaaauguuuuucacuaaaguaacuucagaaggacuuucuuugaugacauucgaaacuaaaacucucugguugucuaauggaaggccuaccaccacaugacuucucugauaacuucagcuauuuccucuuggaaauuuaaugcauuugauuguaggaaaagggauuaugguauccacuaaggcugaauacuuaaagguuacucugauaaagcccaugcauggaucagaaacuguauggugacuucaacacugucugucugucagucauuucuuuuguuugugguuguuuuuccucuaaauacaggcgcuguuuaacagugggcaaugggcuuccuuuaagagaaagugaaauuacaucaaucugugaauuguuucuucucaucugccauguuucaucaugaaugccugcuuugcaccccuucauugcgaggaccucauaugaaauggacucccuucagaggggaucuugcaugaacuuucauguuuuaaguauuucuacuaauauuuaucauacagcuuauuaaccuuugucugucuggaacagggugcauaugaaauaugcauuuuugaauucauuuuguuaguauauuucagucuccacuuucucuaugcagguugugucugagaaugccaacuaucuccgaacaccaagaaaucuuguggaacagaagcagaacccuacaguagguaugugauguaaaggaaauuguauuuuauacccuccagaaacucccuguuaggcacagguaaaacucuacaguggugaaaucaugaccaaaugcuaugcuuuacuuuguauuuagugugcauuaguucagaauuguugaaccauaaauucaaaauauaagauauaauuuucauacuacaagauauaaauuucauacuauaauuuucaaaacaagugguguuuaguauuuuuguuuaaucauuugaaugacuacucuguggugacuaacugccaguguuggcuuuuguuuguuugcucguuugcuucuuccauccuuucuucugagggagggguccuguuguagugugaauucuauagucucgcuuguccuugaauuuauggaaacccuucauuucagcuucucuaguguugggguuacagacacaagacuuuccaaugcuacucuaaauguauuuuuuaaaacuuuacuuuagagauuaguagucauaagagggcugggcuuacggucaguagcagagcacuugucuaccauguauguguguauuuccuugucccauauuugacacuguaaaucuguuagucggguaaggauaaaaauaugccauuuuauuuuuaaaaauuuuaauccuuguuguuguuguuguuguuguugaggucagucucuugauacauuccuggcuguccugggacuugcuauguaguucaggccuugccucaaacuuaaagaaaucuaccugccucuggagcugguauuaaagauaccaccaugcucagccagaaaggucaaagcuaauuuagcaguuuuaaguaguggcaaaagaaacauugggaggcgacacugcuuagcagucugacuuucuagugaggcuucacccagagcgcugucacaggauccaguucuguauguggagugcugacaugaaacuccuuacuuaggacaaguaauaauauccacuuaaaaugaauugaucacacauuccacagaaagugcaaaaauaucagcugaugaugaccaacgaauuuagcaaaaggugauaccuucaaaugcagauaaaaaagaaaaugagaagacaaaugaggaaauaaagugaagcguuugagggcccucuuggggugagcuagauuucccaaggagcagcucuuugggaaaugaaagugaagucagugcagucuugcucaauacgccuugggcacauugagaacagcguugucagaugggucccccucuccacccgcugaccuuacgcuccuugaugcuaagcugcggcucaguggcauagucuuuccucuaauugguuaucuaagugggcuugacacaaaggaugauucggugucacugugugcuacggucugcaguguccuaacuguguugguaccugucuggguaaaugacucucuguaguuaacuucccgcuuugucuugagagcuuuugaucguccuaugauaucuuuaugugaacauacaugacuccuuuucacugaaugaucacaauuauauauuuauuugacaggaauuauuuauacuuuccucuuuggugaacauuuuuaagucugaacuuuuacuacaaauaagacauugauguauacuggcuguguuuuaugugucaaugauguauuuccuuggaggccuacauuaaaaguuuccuguuuuaagucccuuguuaagugacugaaaaggaaugauuuuugucuauuuucauuaauaaaaaugcuuuuuucauuagaguacaacucuuaguucaggggcaucaggaaaaaccauucauuucuuaaguguauauuaaaaaugucuaauaugacuuaauuuuugcuaaaagguauauauaucauacauauaaucauauguacaugauauauaauacaacauaugaucauauguaugugauaaaauacauaugauaaauauacauauaaacucauuaugauuugcuaugacucuauucuguuccuaauuaacuuuuauggugauauuuucaauaauuuuagcauguacauguugaugauuaguauauuggcauauuauuuuucauagaaggcauuuucuucaguacugaauuauuccauuuguaccuguggugaauagugcuggcuauuagaagcucuguacucaaauaggugucacuagacuguuacaagccuauugugacucucuccaaggcacugccaagguugccugugcauugguaagagccaagucgauugcaugcugcaugcauucccaaugugaauggaagaacaccugcuguaugugucuucucuaacucccaucagggucucacugugcgggccuguuuagcaccucagugcucggggguucuucaagugcaccuaaccuacaggauuaugcccguacucaucguaaaaagcugacuucuucuggcugcauagaugguaugugcucacacgcacacacagauucauaccugcacacaugcauaugcucacgagugguguuucucaaaagcaagucuaaggccacagacugccguggagucccaucguggaguccuaucgccuucccagacgccugucagugcguccugggauucagguucagguucugucaguccagagcaguuaacuagagaguacauguacaguaaguggcuugucaaaaaagagaauguaaaacuucauuauuauuucagcugauggagacucuagauuaugaagaauaaauuucuuuuaaacucuuguccacaguuaacacuuauuuuauuuauuaauauugaaaaacuauuuagcauagaaaugaguggaagguuugcuaguaagagaaaauauaucgguagacauuuuauaaacguagagugcaaugugaccauucuuaagauuccucuugaugugacugacgucaggguuaauauucuggugcugagaaugcuugagaguccugaaaaugugccccucgugacagagggcgcuuucagcccuuucacagucagcacuguuugcucuuagguggacaaauugaccguaggcaggaaaacacagauuuacuggaauugccaggccaucuugcuuuccuuucuguuguguauuucauuaaacguuuugccuguaccaucaagccaguuuacugcuuuuaaccaguccuuggcuuccuuccauuguccccucugcaugucaccuaguccugccguccucacguauuugguucccacucuguuuuaaguguuccucuuuuggcagcugugaacuucaggaaccuguuuuucucuuucucagacgccacacgcgggucugcuguuaaaagguuuucuaucucauuugcucgacacccaaccaaugguacguuugcuuuuuauuuuaaaagauacucccugcuucaucccuuuuuaauuuuuuuuuauuucaaaaugugggguacacaguaucaccuaacuuaccaaucuuuaauuuuaguuggcauacaauuccaacuaauguaccaaaccacugauacugucuugaucccuuuucugccguaauuuccacaauaauugaacauuacuugucagaucgucuaaugaccacaguaaugauuaguuuaauucuaaauuaacagcugaaaauucugauuccuuaagugaucaguuuauacaauuauuuuuuuuaaaaauacaauuaguuucuuaauugguucuuaauucuuaacaauuuuuuucuaauuuuucugaccacauuauuuuauugagauagucgaugacaauacaaagcaauccacaacaaagaccccacugagacuuuuaaaggucuugggagccagggucacacuguacagcagcagucuggcccucuggcugaaacacaacuggauguggcguggacggcuuaagagacuuccaggaucagcuccuccucgggggcuggcugguuuacugcuggcccagcagucauuuccuucuguugccuuuguuuuuccuuaaaaaucggagaauucugauagaaagaaaacugaaguuaaggugcagagacucgauuuguuuauacccagguuccgucagagugaggcuggauaggaguguuuguuacagaugaagucguggcaguauuagagcguuuugggaguauuuacugguuuuuguguauguguuagggaugcuuuuguuuugcuugagauagggugugauauuguagugcggcuagcuuagcuuccugugcagagcagguugccuucagacuuggagucauccagcuuuagacuuccccacugcuugcaguagacguaagccaccgugcuuggcuuacuaaccauuuucaaaucccacauaggcuuuugcuuucacuuauaaugaacauacuuuuauuccuagaaagagugguuuguuuuuaauuuuuaaauuuuuaacggcaaauaggucuuucaaaaacucacuuuuaugaagcuuaagaauucaaccuacauucccuccccaccccagggcuguuuaaauguuacuuuuuuggaaaaagcucauucugauuugauucagcugcaacuucuaaagguaacacaugcuuaguaaccuccuagaagacaaccaggaguccucaggacgccaggcucacagaaacccauaaggaaggaggggucaccuuuguguaaugcuuucucaggagcacuguggguuuacugaaaaguucuauguuuaacugagguguuaggauuaguugugguggugguggugguggugguggugguggugguggugguggugguggugguaguaguaguaguaguaguagguacuucaauuuaauagaaacuaagaguaauuuuauauuccuuugguuuaggcuuuuucuuuuacaugaggcuuuucuacacuaaacagccugauacauugaagcauguuuccuucaauucuaggaacauuuuuuuggagggauuccauacuuccuuuucuuuacugcuguucuuucuaaucuguccugugaacugucaugugacccuuucacuuucuauuuccaaugacuucccauguuguuuccaccuuaacccauggugucauggacuucccucccuucgucuuuaguugggaggaucguggugaaaaaugucuucugacagcaccuucccuuauucucugggccucugugcagaacaccuguccccucuaggugcugguccguguccucugggaguuucuaggcuccagugguauguuuucauggcuuccaacgugcuggcaggguggcuugugagauggccgcacuaacccuucauuguccgcugugagcugaugagauaaauggcaagggucuguagauucuggaacaguuccaucagaccucauuugcugcuuugaaauccagcaggcaaaugaaaggagccgucacaaaugagggugagcaccccgagaaaggagagaggcauauugugcagagugugcuuaugugcacgagccgcuuguguuuaagaagagagggaauugcaaaguuuuguuccucagugugaaccgagugagguggcuuuaacugcugcugggauauuggauuguuccuucuguuugguuuuguuuuacauuacaugaaacaaacggucugucaugcuuugguuugcaccuggaaauccagcauuaauuuuauuaauccuuaauuauuuucauaacaacauucaguucccuuuuuaaaaguuccccuguuccaacugagaauuccagcaauucuagaguuccucccaaauuuugaauaaaucugacagcguguaaucucauaaugagcauauguauguugaaaagugucuguuuugcagucugaguuuagauaauuuuucuuuuuuaccuguaauacucuguuucuaccugaauuugaguguuggagguauuuuccacagaagacuuaguuugaauucugggaaacuuugugauuuuaaaagaaaugaaaacaauuuuuaaagccauucaguuaaauaaagcuuaaaugaaugggucauuuuauucuuaauaaaugaaaaacuaauauuuuugucuuagaaacauaauuuguauguauaugugcuuuugugucacugauucuguuagcacauugcugcaugacucaccaugaaguuuugugugccugugcaguuguuaaacauggagcuccuugcccuucauaaugcugaauguuccaucuaacugcucagccagggauugccaagcaaggacucacugguguucaggaaaguaauguuucagaagguucaauucugccugauugaggaaguguugcucaaggaccaugguaggguguucugggccuuagagaaaaauagcaaucugugcuccacaauuaacuauguaauuaacuccugaagaaguuugugucagcauuuaucuucauuauuauuuaauuguugaaguugauauuaucuugauacuguaagauucugguaucaggaaaauauggcaucagcuuguucaucuguuaaauaacucuaacauuaaaagauuuaaaucugaaaguguaucucucccuuccccagguuuucuucuuuguuauucuuaggcuuuagcagccuugaaggacugugugcaugcugugcugucugauuacauuuaacgugaucaugggucauaccuuguuuugguuccaugucgcauagcaucuggugucaugacuugaaagaugugugaaugcauguaaaaccugaacguuccagcccuaaguaagucgccucccuuuguaaugacugaguugcgaaacagccaaucuuacucucuguccuuuauuucuucucuuguaggcuucgagcuguauuccaugguaccauccaucuguccucuagaaacacuucacaaugcccuguuuuuaaagcaaguggaugacuuucuggcuuccauugcuucuccaucaacggagguucugcgcaagguccccgaaauguguauggaauucaccuucauuguuacuuaauuauuggacaauaaauucuuuucaauuauaaccucaauuuuaaagauguaaacgcagugauauuugugaauagaauuuuuaagagagucagauguaagggaauaauauuaguaacuccuuugugugauauaccauuuuucuucauuuuaucuaaacauuguuuuucuaacaguaaaaguaaacaguauuauguagaguuaguaucacuuucuuuaaaagcuauacucgucugaaagcucacauucaucuuuuauaauuacagaaugguucacauggacuuaacacauuuuugcuaacagauuagagauacuugguugucacuguuguuuuguuucguuuauuggcauggggcuuuucuguguaaccccagcucuccugaaacucacaguaauccuccuuucuugacuccccaggagcugagauuacaacuaucugccaccacaucuagcuuuagaaagaucuuuucuaaaagauaccaaauuagaaccacaggcuuugaaacuauauuuccuagaaaaaccauucugaagcuauccauguguguuaagaagagaguccauggauaaguaagaguuacauuaguguguaaaagcggaaagcucuauaaauaauccagauuuucugcaauauuuuuuguuguuaggguuaaaaaaaaaaaagauuuuucuuuuuguagcgcuuguuuuuagcucccugguaucccucagcauauuggaguuuccagguuggacacaguagcuauacuagcuacccuuugccauuucuucugcuucugguaccagaggcagcugucagccaauaguguuugguaaugaggaugccucuaaacuauuucccucuggagaucccuugggaaguaggugaucauuuuagauuuuauucucuaaggagacugaagcugaagaauuacaaguucaaggcuagccugggcaacagaguuaauguagggccagccugaacaucuuaggauugucuucaaauacaaaguagaaagaggacaagggauauggcuuagaguuauagguucaacuuccaguauuguaaaaugauaguaaaaacaagguuuuguccuacuaagagaagagacuugguacgaaguuauucaauuuuauuuauuucuuuucagccucuauggccacacguuccaguccaggaaugagaagaaaaauuuccuuaaauacguauacaccuacaaagauccucccaacaccaccugcugcuuuaaagagcagcaaagcaagcagcaaagcagguuagagauguugucugaguuugugaaugccauacaacaaugauagcaggggcagccgcuuguccagugauguaaagucguaacccugcuuucccguaguguugcugaauucaaaaucuauuguccugacucacuuauacacaucuuuaucuauguccucuugcuugccucucuugccuucauggucucuccuaaaucucuuaauaagauagguuuccaauucuuuuuuucugaacuccucuguuuugcucuguugggccuaaggaaucauuucauauuuaaauaaaacaauucuguugcccagaguuuuuuuuaucuuccauuuguagucuggcgaugugacugccaaauucaucucuuuugccagcaucuuuguucuucuagccagggugauuguguaucgauacuccaucccuggcugcugacggguuacuuuaugucugugguuucccuguugucuaccucugcugucuggucugaugugguuucuuuucuuuucucuucucuucucuucucuucucuucucuucucuucucuucucuucucuucucuucucuucucuucuuuucuuuucuuuuuucuuuuuuuuuuauuuuugagacaggguuucucuguauagcccuggcugucauggaacucacucugcagaccaggcuggccucgaacucagaaauccgccugccucugccuuccaagugcugggauuaaaggcgugcgccaccaugcccggcucugaugcaguuucugccuguucccuauugcuccuagacgccucggagcuuaccucagugcuccaggcuuucacuauaaaaacucaugguagaggggucuugguuuuuuucaagguuuuaauguuuuuagauauucuuuuuauuaugaauuuaaaguuggacaucagaaggacauacuuauuaagaucucagcucugcuacuuguuaaucaugugaccugccucacacaaauccucagucuccaggaaaaucaaucuggguaaugauucuccuacagaguuggcagaggcaaagcuggcuguguaaaguacuuggcuacauuguaaacauucggugggcgguagcuuccuuugcugcucuuuugccauagcuaaauaaccuccauuucugccagauaaauccuccuggaguucuuaccuuaugaaucagucaguauuuuaaguagauuugaacguuguacaguccaauaaggcuauaaagauacaggguucaaaacugcaguuuucuuaaauaaaguuuugaugcagucuuuuauacaauacaaaacugacauuuguacaguuccuuuuccuacgauauuaauacuguuuauguccauggcaauaaagaaaacagcagaagggguguagcuuguuucagucagcauagccacgaaugaaucaggugaccagagguuuggaugcucucgggauugcaggaccuguggcugaucuuuccgaguuaauugucccauaaaugcagggugugaacauuuuuaaguaacaaacuuaaaauggaguugaacauguuuuguggcccucuugcauuccaggcgaaugcuacuuguucaugaugugugauacacacagccacaggaacacagugggcagcacccaagugugugcgugucuguguuacguacaggaaggaggcuuuacucuggaguuugguuaggguguccuuuuucaugagcaccugaaaaauguuucuccuuuugugucuaaauauguucuaaaagauuuuaauuucuaccugauauccuugguagaaugaauuuuauguuuuauuuuuauggcagauuugauaccucgcauuugucaggaaauuauucccuuugucuuaagaugucugcuuugcucguucuucauaacugucuuaguagcucagguacuagcaguugucuucugccuuuuuguuuccaguuuuuggacuuuauaaaagacuuucuuccacuuguuacucugcuugcuuuauugaaugcuuucuucucuugguuuccauugacccucaguguaauuauucacaaacuuuccuuauuuguuguugguuuuuugguuuuguuuuuucauucuaucucaugcuuauucuuuuaugcuuuauuuugaacuaauucaauaaucuacagaauuucacuuagauauguguguugccuuuuugauuuuuuuccucaggauuuuauugauuucuuuaaauacauguucuuagcauuucauggucuaacuguauaucauccaaaacagugcauaggaggaagcauuuggcagucauaccgauggcuccgucucuuugguucccacuguuucugugagcucuggcuaauuugaagugugcccugcgcacagcacacauucagccugcucugccugugccaugcccgucugugccugugacugacuuucagcagugacuguggcugccucuuccucugcccgcuuuccuucuccauuguguuugcguggugauucucacugcucuuuauucuucugaugcccucaaguugcuuuuaaauccaaccagcuuuuauuucgguuauuuucuuuuuuacucuuaaauuuaaagcauucuauuugauucuucuuaauuuuucuuucucaguuuuuauuuauuaaacauaaugauuuauuucaacauagaucaugaaauuacugcuuuaaaaauuguuuuuaaauuauucauuuucugauagucugucaguuuuauccuuuacaagaaagauguuuuucuauuccuuucuacauuaaauauuuauaauacuguacauuaaucuuguguguuaaguaacuuuuaaauccuagacauuauaaauguuauguuauagaagcuuuggacucugcuauuucaauaauaugucuccaaagcauauuguuuuauuuuaaaaguaaagagguaaauuugccaaacucagauuuuaagaugaugucccugaaguggcugacagcucauguauuaaauucuuuucuuguugucugugcuaccugaggcuuucugugcaugcaauagauuaaucacaguucaagggugaguuagucucacccuuccugucagauguaguugucaucuguuucuuuauacuaguaagacucacuguuaugcuggagauuuagccaaguucugugauggaccuugagaacgauucucagauaaaagguguuaggaaggagugauggaggaccacgcugugcugcuuucuccucacacaaguugauucugcuccaguaacuguccgauucugucacuuucugcuauccugauaacaccaucguuaagguuguucuuucugucuguggccaagcaauugugggucauaugaagaaaugucagccugacagacaugugccuguacaguaaaguagagcuguaacuacacugagauuagcucucugacuaggccugacucugauguugguucugaguugagagggagggcuucuggccuuccagccuuccaucuuggcauaggaaugagauggaaggcauaagaggauaugguuccuagagagggaauuacauccaguuuuaagcaaguuucauuuaaauuuccuuucaaauauaagcagagacaguucuaauuggcaguuguauuucuauaucuggagcuaaggggaaagaccuggcaacaaggaugaaugagauuaauagaauggauuguacuuaugauggaaaugaauauuugcuaugaagaauauagagugaacuauaaaaagcugguuuuaggaacacagccuguuugucguuacuuuucuguauuuguguugacuuguaaaacauuagugucauauugaaagccugcaauguuuuaucauaacuguagcgcauacagccacaucgcccaccagcguucucuuaacccuguugauuggugcaaaucccaacggcacugguucuuucuucuguuuguauagcagccggcggaccaucucaggcaauggcuccccauaccucaucucggaagaagagcauaaauagcaaaaccgaggggcaugaacccaagaaaagcacugggaagaaaagaugagcacacaccagaaccgaaaguuuccaugcuuauaaagggacuuguugcuuagcaaaaagaaugucuaagaaaccuugacugaagcuggucagagccagugauucauguguuaucaugcuuuacuuuauacaucuguguauuucuuuaaacaccucgaaagcuagaggaccuccuguuuuuauucaaacaaggagcucuggcaggaucuagaaauguucaaaagaaugucuguccgcuuuguguaaggaaauucaugacaacugcuauugcugucacugugaugauucccaugugccuguggcagagacaaaggacacaggaacccggcugacugguaccaaagugcacucucuucaggugccucuacacacaugcauuucuacagaauuacacuuagcgagugggauuggacaggcaaagaucauguguugaugacuuuuuuuaaaaaguacauuuccaaagagaucucguugaccauuuacauuacaauguuuuugucauugcuacaguaacauaugcugcaauauuuauugacuggauuauauagaccaugaauuauuuuuucaauuugugcuuugaauuuuuuauugugaauuauuuaaaauauuacaaaugcaggugggagaacuauaccuuuauacacauaaauuuacaaguuaaucuguagaaaauauuuucuuuauacauaucuuuaccaucaagaaaaauuucuugguucaccaagaaaagguuuuuuuuuuuuuuuguauuagcaagagaggcaauuuuuuagaguuucuuuuuaugaacuguaacugcuaaauuuguaaaucuuacacgugauuuucugaguuuuucuugagaccuauggacucaggucuaugaugcgaguucugcuguucauaagugucauccaggguauaguucuuguguuuccauucuuauguccaguguauuugaugauuucaccaagaaaacucaaaagauugaacauuuguaguaaguaaaugguguuuacaaaugaugagauuuggaagaaagauggagaugacuauuguaauuucgucuaauauuuaaauaaaaggacaucauucuccuuggugcucuuucucccugaugcacaaguaauuguuugaaauauuuuaaauuacucacaaacuaaacaaccugcuaaauaaaaaucucaaacauuggcuauaaugcaacuuaagguaguaagcuguagcuucaagcuuauguuuagaaguacuggacccuuauuguauaguuaguguaauucuucaaaagagacuucuaaccuuaaauaaucuuacaugaacugacuucuagagaauaggcguauuauauuaucuugguuguuuaaaaagggaugagauacagaagcuccaaauauauacaaauaaauaaguacauauauacuucacuugaauguaaauggauuauauggugguaaaucuuguaaacaaucgaauguauguauguucucugugugugaauaugugauuaauguacucauggggggugaggagacuacuuuuauuuuuuaaguggaaugaauuaaaauucuuuuuagaauaagagugacuugaauuuaaagcauuuuauuuguguucuuucuuuuauguuuugaaauagaaaauccccagcagcauuuuacauuaaguacuauucaauaaaacucaugagugagcauacac

SEQ ID NO: 319 - RNA, 492 nt, Mus musculus
aguuuguauguagcacuguuugaaaaugcuauccaacccucccuggacauguuugcugaggaaguagcagagggugaacuggaaaccccaacuccuacccaaagagaggaggcagagucaacaggagauggccugauggaugugaugugggaguauaaaugggagaacacgggggacgccgagcuguauggacccuucaccagugcccagaugcagacgugggugagugaagguuacuucccggauggugguuauugucagaagcuggacccuccgggcggccaguucuacaacuccaagcgcauugauuuugagcuguacacgugagcccgcuaagggccccaugcggcacggcagccccuucuuucuugaacuuggcagaggaagcaccagcugcucugggcagugaggauguuggaggccacuuuaaagccauuguuucccaauaaaagccuugacugugcgauggucaagagccagggcuucuccauu

SEQ ID NO: 320 - RNA, 751 nt, Mus musculus
aacgagaccuugauagguucaaucuacuugguccuccgacucuucuuucuuuuacucccauuuccuuccagguuugcggucccccucgcacccacgaauaacugaaucccgcgguaugggauaaguggcgcccaacguggggcgagguccggaucauaauuccuaaucaguggagguuccagagaaguucgucgcgaccccaagaauuuaaaaguagugaaggacaccuuccgcugcucacggaagagcgagaaguccuuggugaguugagucaucuccacuucagguuaugggacauaagcuaucuaaagaggcagccuucaucaaagguuuaaagauagcucucagagaaagaagaguacgaguuaaaaaaaaaaaaaaagauuaaauagacuuuuuauuuucauagaccagguauguccaugguuuauuauagaugaagcagagauacauuguaaaaaauggugaaagguagguagagauuuaaaugauaaacuagcuaaugagggucccgauguggucccugcaacugucuuuucugucccgaugcagucccuacaacuguuuuuucuuauugaaaaguaacuaucaaaagcagccauuguaccuccucucccuucucuggaaguauucccagaagaaggagauaaggaaguagacucugaacaugagagaaagaaaauaaguuuuagaaaagcaguuauccccuguuugagaucuuuuagcaaaaaagagaaaaaaugaaaauaag

SEQ ID NO: 321 - RNA, 1780 nt, Mus musculus
guaaacuacuaucucugagauacuccauucugaaucaauuucucugagcacuucucuugucuugcuuguuccagccaaugucuuuugauuuuucucuguucacugccugggguauccccacuugugcaucccacacuguaguggugcuugaaaaugcuuaucucauuuaucuggaguuuaaucuaaaaaggguuuuuaaaauauacuauucacauuguguuauuagggacaaucagcuauuagaacaaagcacugaggguccuccugagagcuccaacagugggccuuucucuucguuccuuacaggauguuuguuacauccuggaucuuucccuguuucccagaucacugaucucaaugccucccuagauggagagcuguagcccacaagacagucuccuguaauauuccugcccaaugaguuacuguguuacucuaacaggagcuuuucaaagggacuggucacucuuuaacucagcauuugcuuuuugagaacacaguagucagugguuggauauauugguggcaaggaaaugugaaguagaaagaaaagagaaacagaugugacagauguccuucagggaacaaguugauaccuauguuaucucuguuugaacaguaagagaaggcaguggcuguuggcuagguggacuuagccaucccauugccaaggagccucaccugagggaaugguacagacaaaacccugggcucugaauagauagacagacaugcccagagaaggagaaacuauuuuuaaaagaaaggaaagugaaaugggauuauggguucaaaaaaaaaaaaaaagacuuuacacuguaugucagccaugguagaagccaacugaagauaaccugggaucucgaccauucuaccagggaucaccugcuuaaguugaagacacaaauggaaggugcuuggcucaugaggagauucccaaggaguucucaucuuuccugucauccuuucagaugcuuuuggguuaucaaggcuguagaaaauaccagagccugcuuauggaguuggccauggaguacauauaaguguaccuugcuccucucuuugcuaugaaaaaguucuaguucaauuagugagcugugacuuggguacgacuacugcaaaaaaaauaguucaauaauguugugcuuauguucuugcugcugccauuauuauauuuauauaucucaccacuuguauguaugaccucacuugaugguuauagguauggaaauugccagcagucuggggaaguuggccacaaacucccaauagaggacauauguaaccaccaccauguucccuuccauucuuaaagacccaugugugggcuuucuggucuuguauaacacauugcaaucagauggugagauuagugcuguucugaggcuguuaauucuaguuccugacuuguuucauuuauaauaauggagacaguuucuuuggggaagcuuuucuuugaaagggccaaauugcccuacagauaaaugagcugccgggcaguguagaaauucuuguccaaauguugccaaauacugacuucauaggggauaucaagcugcuguuuauuaaucggaaugucuuaaaagccuuccugcuugcucucucuguuauagauggugucuuagccagucccaaguuuuuccaaugaaccugauuuuaauacaugguauuuuuguaugcuaaacuggugucuuguccuuuguauaugugguaauguucauuuuacgacuacuguuaaaacacauuugcuaugauuaaaauucaaaaugauuucaaguag

SEQ ID NO: 322 - RNA, 91336 nt, Mus musculus
caguucucgcgagacuagggaccaggaagacgccugcagagucggcuacuggugcagcagcggcugagacgggaggugcugcugcauaccgggcuccugccucccaguccggccuaggcucuaggugaggagaggugcggucggccugggcugccuagguggucggcggcucucgggaccuaacggggauucaggcugagggccugucgggccaagcagggaagcacccacauuccugacagaauaagauggcggcgauggcgcccggaggugguggcagugguagcggaguaaauccuuuccucagugauucggaugaggacgacgacgagguagcggcaaccgaggaccggcgggcaggacuucggcugggugccggggucggccuagauccugguucugcaggcucccugucgccacaggaccccauggcccugggaagcagcgcgcggccggggcucgcuguggagauguccgccgccccggcggcuccggggggcagcggggagaccccugcccgauugucaaucgaugccaucgccgcucagcuguugcgcgaucaauacuugcugaccgcccuggagcugcacaccgagcuguuggagagcggccgcgagcuaccacgacugcgcgauuacuucuccaauccuggcaacuucgagaggcagagugggacccccccagggaugggggcgcccgggaucccuggcgccuccaucgucggaggcgcuggaggucgggaaccgaguacgacgucgggcggaggacagcucaguaaguaggcgucgccugucacaccugcagaugggggauuagaguuggagugcagcugaaggggauugugggcggguacugagucuagggucgucuugagaagggagaguauguugagugagaugcgagguguccuguguacugcaaacagaaagauccugcuguagcucuucuuugcauugguuuccgaucuuuggcagguguuguacagcuccuggcuccccguugguguugggaccuauaacaucaggguuuccaguuuauugaguauuauggcacucuagaaagcuuccuuauugccugggcauuuuucucuaggcaguuuuccuuuuuuccccaggcuguugaaucacacuacgaggaaauaaaauguuucuuaguaauucuuugacucaagaaaaagaacaaacaggaaaugucagcccucuguacugaaguucaauccacugaagaucuuuugucuuugcuuuuccauuauuuuguaucauuaauauaugcuaauaaaaagaaggaaaugagaugugucugcuucauagaauguuuucuguuugaaaucaguuucacuaccccaauuucaauaguauuccguauacaggaaagcuguggaacaaacagaccaaggaucuuuuaccagcuuucuuuucaacauagcacugggaaggauuguuuuucucugaauaagugacucucacuuauuuucuuuuuuuuucuuucuuucuuuucuugcuacaaucauucauuuuuagcagaguaaucacuggccuagucauuauuuauauauaagcuuuaaugagaauucucacugucaucuuuaagaggcaucaaauuuuuccauacuaaugcuaauacuuugguucugugaacccaacuggaauuuacuaauaaauaagccugauugauuucuaaaugucuauacuuuugcaugauaccagaggcuugaaguugcuaaaguuugaugucauaacacugggaagggugaauucucuaucagaguaauccuaagcacauuuccuucuuuuauaaugucuaaauuaucuaacauugucaccugacaaacuaucucacugggacucaaauuuucacuuauuuuauauauauauuacuuuauguacaucccagacuuaguuguuuuugggggggggggggggaagaugagacaggguuucccuguauagcccuggcuguccuggaacucacuuuuguagaccaggcuggccuugaacucagaaauccaccugccucugccuccgccucccaagugcugggaucaaaggcgugcgccaccaccgccuggcccagacuuaguuuuaaccuacaucauagccuuuaggguuucuuugguuuuuuuguuuguuugguuuuuguauuugauucguuuuaguuauuagcuuggaguucuugccgcucucucauuuuucagaaaugagggggaguguugacggcaugacuacuaacugggaaaugaagacuuuuuauauuuuuuauauuuuaucauuuaaguggcagaucuaauauuugaaccuagaucucuaucauaauauugauuuuuaccacagcuauauauuaugucugcuucaggacacaacugagcaaaaguuaaguuuuuuuuucaguauaugaucaagugaaguaaucagaguaggucuucacucaaaauggccaauuaacacaaaaggcaagugaggugauaaagaauaacguaauggaggaauugagaaaacauugcacuguguuaaggugagaggauaugaaugaucugaaaggagcaucacuccuauuucauccagguagucacacugcagcauuaaacucaaaguuaagacaaucacaaugcaugugauuuaaagcaauccaggaucaucagcuaagccuccacagggaaccaagaauguuuuuuaacagaauuuuaaaaaaucuuccagaacuuaauacuauauuuugaucauaucuaucuucuguuucuuucccuaacuccucacucaucaucuucaugucucccucucuucuuuuuaaauaacccaccaaguccuauaugguacccauauacucaaggaugugagcccauucacuggagcaugguuacucuaccauaggccaugcccuuaaagaacugacucuuccugagaagccaccaacugucucccuggcuccucagguaauuguguggaccugugagucccucccugcucauuguugauuggcuugaucuugugcugguuagcugcugugaguucaugggugccacauuccggugauguccaaaagacacucuuuugcucugguccucacuaaccucuggcucuuagggucuuucagagccccucuuuugcaacagccuauugaaagacauuggugggguuagggguguaugguauaauuuucucauuugcacuccacugauauucccugaucauuugugaguuucuauauuaaccagauccaugcacauuuaucaacuauucucaaucaaauagucuaagaaggccaaauuaguuuguugaucaagaaacuuagcuacaugguugcaugugauauuucuggugacagcaugcaugguucagccuaagggagaauaaaaguuguaagcauggguguagccuucccaauugucucgcccauuucaaaaauuacaagucaguuuguuuuuaaaaccugcuaguccuguuguggagguauaagauugcucaaaguaaugucaucagauuuuuuuauguaauuucugccaucucuugguucuguauuugugugcuaccgugguucauacuugaagcuugcaucugaaccaccaguuuuacccuuauccuaugccuugaucuugucaucuuaucuuuccuuuuacuuuauuuuuccccuacuuuacuauuauuacugauacagauuuauaaauuuccuuguauugggauacaaaugugaaguaauccuauguacaagauauaaaauauuagcagaaauagauaagaucaaaaaguaugaaaugaaaccagugucauggugcacagauuuaaucucagcagguagaaucaggcagaucucugaguuuggagccagccuagucuacagagcaagguccaggacagccaugacuacacagagaaaccuugucuugaaaaacaaacagacaaauaaguaguaugaaaugaauuagcauguaguagagaggcaagguauauaagcauaguuguuaagggaaugugucacaaauaaaaaggcauauguggaacuuucaaaaauagauggaggaaggcagagggugugaaagccucaaugcaagauaacuaguaaaauuaauuuaaauuuuuuuauuuauuuaauguauauuuguauguacucacaagcagaggccagaggacaacuaugcagauuuuaauuuucucuuucuauuucugcaugaguucuaggaauggaacucagguugucacacuuuuacccacuugagguagcucacugucccuacuuuuuuagcauacagaguaauggguuuuauaauggaauuucauacaucuaugcugcuauacuuuauuuguauccauucccuuuuacucacugcuacccaccaauucucccugcuacucucuuguugguuuggccccuucccucccucuaaauugcccucccuucugcuuuuaugucacauguauuccauuacuuccucucccucacagcccuuuauaauuucuucugccuaccaugguccccuuuuuaauucuauuuuucuuuuuuacauacauauagucauauguacauaaauaaauuuaaaucuaaagaccguggaugagagaaaauaugguauuugucuuuuugaaucggaauuauuucauuuaacauaguaaacuacaguucauccacuuuccugcagauaccaugauuucauuuuucuuucuacaaaaauuugucuuccgcguguguguguguuguuguuguuguugcuguuguuguuguuaugaguaauauagaaauaacugugacugggcaaggaucucuaugguguguugacaauauuucagguuuauauacccacaaguggcacagcugggucauaugauagcucuauugcauuuuuuuaggagcuuccacaaugacuuccauaaugacuguaugagcauacauuuccaucaauaguauauaaggcuuccucuuuccccacaucuucaccaauauuugcuguuuuuacuugguaauaaccauuuuuaauauuuuuccuuuuacauuuaguguguaugaguguguucugccugcauauaugcuauacacuguguguaugcuuuguagcuguagagguuagaugagggugucagacaccugcaguuugaguuacagauaguuuugagccacucugugaaugcugggaacuaagccuauguccucuaaaggaacaacagagacccuuaacuacugaaccaucucucuaagcccugccaauagcuauucucacuaagacaaauggaaucucaaaacaguuuuauuuuucauuuccuugaagacuaaagguguuaaaauguuaaucauuucuucaaauauuuacuggucacuugcuuuuuuuuuuuuuuaaauguuauuuuuugagaacuaucugucuggcucauuagcccguuugcagauuugauaauuuguuugguguucuaauuuguagaauucuuuuagaguuuagguauuaguuucugcccuauauguguuucuuucuugauuuuuuuuuuuuuaaauuucaccuuaaaucaguuuggcuacagauuagaagauaauaauucuacuuuuagcuuguuuauuacaaaguuacugaucauguuggugucuauauauaugacuuaauccuaauagcuuauuuaaagcaaagaacaauucuuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcguguccaaugggccucucuuuccagugauggccgacuaggccagcaaagaacaauucuuaaugacauuuauguuuaacucuucucccucuccucuacccucagaacucaauaguuaacccuuccuuuccuugcuuccuuucuucuucccucuuuuuuuuuuuuuuuuuuuuuuuuuuuuuuuucccuucuccauccccucuccccccuuaggacaggaucuuucuggguuaccagguagccauugaacucuuucuguggaagagaggcauaccuugaauucuuggcccagccuccugaauagccauaauuacaaagcugaagugucugacugacugguuaacuauucaaagcuacuuccuccuucccaaaacaauucuuucuaacccacuuuaugauuagcaaaaguuugcauuccaggaaaaaaaaaagugaccuauuuuagaauuugccuccaguuuugucuacuauaugacuuuuaaauacauauguguguguguguggauguauauauguauguauauauguauauauguguguguguguguguguauauauguauauauauauauauacauauauauacauauauauauauauauguauauauaugcaguaaagucuuuccuguaggcuucuuucugccucacagacauguuuuuguaaguaauuaaucuuagucacauuugcucagugcuacuacauuccugauuccugaacugguucuugauaacuuuuccugacauagucacauauucauuuucuucugaaaggaagucccuacaugugaaaucucacuuuugaguugcaggucuguuucuuugcuauaaaaugcugaugguaguaacucuucugcauggaguuguuauaaaaguuaacuaaguugucuauaaaguaucugccacauaauaacuggucagaaagaaugcuaauaaauaauuuauagauuauaauuauccuuauugccuaacagccuggcauaagguaaaaaucacuuauugcuaucaaaauuuuaaccauuuauaugguuuguggauuguuuuagccuauaagcuucuaaguuuaaauauuuugaccuugaaguuuagcuuguagaaucuugugacacagacugcaaauuaaaagauagaaauucuacucuuaaauugugcacaguuuaucacaaaaugauugauuuguuaucuacauauguggcuuuauucucauugcuuguugacucauuuaaaguuaaauaaguuaaauaaaaaauuuuuauguuuaacucuuccacaaagguuagcaaguugauuuaauaaauauaaaaccuucauuucucaucuguaaaauggcaaacuuggaccaucuagccuucaaauauuuugaaaauaguggcuagugaaaaaugagacccagcauuggagauaaagcaguuggcaguagaagacacaucaccuuuuuaguucaugagcaaugucuaggucuugguaugugcaaacauuagcuuuuuuaaacacuaggucaaaugucaagagcuaccaaaguuccuaauauuuguaaccauuucaaacacuaaacuugauuagcaagaggaggcaaacuauuugguuuuacucugguguucauaaacacagugcccauugauaagaaaauaaucuauuaguacugggagcagauuugcauuacugcaaaacuagaaaaauuuggauauuacugcuuuauaguguucauauuuuagaagcacuuuauagguucacuuucucagacaugaauugcuaagaucuauccuuaaguaccuaauguguaugaacuugagcuuugauauaauugauuacuuuuaagguuaaauuuuugaccuauuaaauuuauauauuacauguuuucauugaauuauauugaauucauauauaguuaugaaucaugauaagguuuuaagacaacacuaaauaaaggaauauuuuaccaaaagaacuaggacucaaugccaguuucuuuuuuuuuccauuuuuuuauuagauauuuucuucauuuacauuucaaguguuaucccgaaaguccccuauacccuccuccccaacccacccacucccacuuccuggcccuggcauuccccuguacuggagcauaugauuuucacaagaccaauggccucuccucucauugauggccgacuaggccauccucugcuacguaugcaacuagagacaguucugugggguacugguuaguucauauuguugauccuccuauaggguugccgaccccuuuagcuccuugguuacuuuuucuagcuucuucuuuaggggcccuguagucuauccaauagaugacugugagcauccacuucuguauuuccagucacuggcauagccucacaagagacagcuauaucaggguccugucagcaaaauuuugcuggcauaugcaauagugucuggguuuggugguuguauaugggauggauccccggguggggcagucuuuggaugguccuuucuucugucucagcucaacuuugucucuguaacuccuuccguggguauuuuguuccccauucuaagaaggaaugaaguauccacauuucgucuuccuucuucuuaaguuucauguguuuuuaaggccaguuucuuaaaucccacacauauaccuuuuaauuguauguuugcuauuuuuaugguuuugaaauuauaaaguacaauagagauuaaaugugauauaggaagaaaauagcaaaaauacaaacaaaugaucaaauacuauagcgaggaauauauaauugaaaaauuagcauucugcuccacagagucaauuacuaccauuuugugcauauuuuaaaagcacacuauggacacacuuaugcacagucguacuugcauugacaagguaaaaguuugguuuugucacuucuuuuaaaacagucucccuauuaguccagauuagauagcccuuaagcucaaagccacaauacucaugcuccaacuacaauguuaugauuacagcaagcaccaucacaccggauaccuugcaaggauuuuguguauacacauuugcuuuuauugcuguuggauugguuuggguuuugguguauuugauaucuacauucuuguugaccugguacauaguaaguauucaaguuuugaaggacuggguucaaaugauugcuucuuuggccucccaaguagcuagaaaaugccauauguccaucugguuguauucaugguuuuuuuuuuuuuuuuuuccgagacaggguuucucuguauagcccuggcuguccuggaacucacuuuguagaccaggcuggccucaaacucagaaauccgccugccucugccuccggagugcugggauuaaaggcgugugccaccacgcccggugguuguauucuuuuuaagaaaaagguuaacuuuuccaacacgucccucuuguauuagaauauuugagaaauaaaagacauuuguuuguucuggaaaagaacugugucugauuaauggcccugaccauguuucuguggugcacuauccuacagacauguuagucacaaagaacuccuacagaaaguucuuaaagguuacguuuaaaaaucuguggcuaagcuggucagugguggcuaauucuagcaguggggagauaaagcaggugggaucucuaaguuugaggccagccuggucuacaaucgugaguucuugaguagccagggcuacacagaagaucucugccucaaaaagccaaaagaaaaaaaaaauaguagcaaaauccaaagaaccauacuuaccuuagaccuacaauauaaccuguuagucuacaaauucaaaguacauuuacuuacaaaaucuguugcaguuuaauccagucaaaauuaguauuaauuucuuccauaaauauguauuuaugacaagauggaauuaauuauaaugaguugaaauauuuuaauuaauuucuuuuauauacauggcuguuuagucugcauguaggucuggacauuacaugugugucuggugccccacagaggucagaggcauuagaucacccagagcuggaguaacagacaguuguaaacagugguacauguggaaaucaaaccuagguccucugcagaaacaaagcaaugcucuuaaccuuggagccaucucuucagcccuaguauuugucuuuuaugagauuauaaucauuacuuuuaaagacaucgcaggaauauuuuccuuauuauaaaauauaaaaugaaaucauugacuugaaauauuuuaaaaauaggcacuagguuuauaacuuugugcugaagcagucaucuagcaagcauuugugaaguccuggguuugauaucagcacuuuucacauacacccaaaaaaauguaaaaaaaaaaaaaaaaguuaaaaaaauuagauguuuuuaacauuuuuuaauuuauuuuauuuacaaaaauguaauaaauauauacagauucucacuaagcaugcucgcacccucucaaaaaauuuuuuucagaacaaaaccacagacaaacugaaaccaaaauauacaauuuaaagauaaguaaaacaaaauauaccauuuugaauuuguuuuuuguuguucaaccacucccagguguggggaccuauccuaaaguauagauaauacacccagugaaacuccauuagagaaaacuaauuuuucuuuugccaguggauaucaguuuuagauugcuucuuaggggugagaccuuguguucguacccuuuuagugcuuggaucuugucagacuugaaccugugcagcauuuggacauguuguccuacucuuugugaguucaucaguccuguugugucuggaagagccaucaccuuuggcucuuaccgucuuagcauauccucuucuacauagaucccugagccaugaaaaggagggguuugaugaagguaucucauuuaggcacguuuucagauugugagccucuguauuaguuuguauuaguaccagucugcugcaagaagcuucucugguaauagcugaacaagacacugaucuauagguaaguguagcugaauguuauuagggagucauuuuauucauugcuguguucuuuuaacagaauaauauaguaacuuuucccccaggccuaugaccuaucuagucucuaacuuuggcuacuucagcauucucaggcauggguuccaucucuuagugggucuuaaauccaaucagauaaugguugcuugcucuuaaaccauuugugccacuauuacacagcauaucuugcagguauuucacuauuacaaauuacaaugcuuguagcuaggaauaaagcuucuaguuagauaccaucuugacuucucuauguucaauggcauguguuaaguguuaucuuuggcggucggcccuuaccaucagauuguggagagcaaccaauagccuuggcaauagucugaugguuggauguuucuaggucacuauuuugggcaauaauucaacaagauguaacuuauugcuggcacuggagguuuuacuuggugucuaauugaggcauguuacccuuauuauuuggugauuccauuuagauuuauuucauacauauauagauguagguuucuuuaauauauguuuguauauacauauauguauacaguaguagguuuucauaugguuucucaggugcccuuuaguauuaguugucccuccucacauucacacuuuaucauccucucucauaccucucccuauuaucguccuauucuaucuucccuuuuucuccucauaacaguauauucauauauuccauuuuccuuucuuuaggagacaccugcccccuugcaacugccuccacgggcacccacuagucccuuacuagguaccuaaccucuguggcuauuggauuguaucauacauauuaaaaguuaacauccacaaauaagagcauauaauauuugucuuuuagggucugaauuagugcauucacaaugauuuuuuuuccuggcuccaugaauuuaccugaaauuuucaaaauuucauuuuauuuauuuguuuauuuacuugcuugcuugcuuacuuaauuuuuuuuuuuuuuuuuuuuuuuuugagaccugguuacucuguguuucagcucuuggcuguccuggaacuugauuuguauaaaaaccaggcuagccucaaacucaccgagauccaccuaccucugucuccugaguacugggauuaaaagcaugugccaccacacccagcuuauuucacucuucuuaacaacugaauaauauuucauuguuuaaauguuccacacugucauuauccguccaucuauugguagacauuaugcuauaccauguuauaccaacaucuaugcuguuuuuaauuucugcuauuauggauaagcaccaaugaacaugggugagcagaugucucuguaauaagauauagacuccuuuggguaugugcccaagagugguauagauggauuuugagguagauucauucccagcuuccuuauuaaccaccaaacuagcugauuuccauuauagcuguaccaguuugcacuucuacuagcaaagaauaaguguucccuuuuacuacauccuugccagcagcacauguugucauuuguuuuauugaucuuagucauucuaacugggguaagaugaaaucucaccauaguuuuauuuacauuuccauaauggcuaaggcuguugaacauuucuauuaaguguuucuuauccauuauuccuacagaaauguaggaauaucauaaucgaauugcuaaaaaccaaaagaguaaaaaauauuaaaagguggcaaaggaaaacggccuacucacauacacaguguaggaggauauuucacuacagaugcauucauuugucaaaauucaucagacuuagguugguaucuaugcuauauaggaacuaucugcuuaguuccauaccccauuuuuaauuaaguuuucuugaugcucaagaguuuguuuguguguuuguuuuuuaaguucuuuauauagcauagauaccaaccuaagucugaugaauuuugacaaaugaaugcaucuguagugaaauaugcuccuacacuauauaugugaguaggccguuuuccuuugccaccuuuuaauauuuucuacucuuuugguuuuuagcaauuugauuaugauauuccuacauuucugugcucuguccucauugguguccucuguuuuaaaucuguaccugcccaaccucuuguuuuaucuguuguugcuuccacuucuauauaccuuaaacauauucuuuguguuccauggaaacaauucugcuacuuuuuguuuuacucuuuuucuuuauucuucauguugaaugcuuuacuuaaucuuuuuuuuuaauccuuauuuguauauaucuauguacaugugcccagaagucacuuaaagaauugguuccuacuucacuaucuggagcccaaggacuugccacaugucauuagacuugauagcaagugcuuuuauacauugagugcauuucaccgccccuguaauuacuuuuaaacucauuccucugcuguguuuauuuuguuguuauacucugcauugaacuuuucguaugaagcauuugcuuuccagguuuacugauauuuucuagaauuuccauugaaauuuucuaaauucuguuuuuuuucugcuaggauuuccuacccuguuguuguuguauuaaaauaucauggccaagacaacugguagaaagaaggauuuacuuugggcuuaagguuucaaauagaucaguguccauuaccauuggggauaccaaaguggcagcaggcaggcagacaugguugcagaauagcugagaccucacaucuugcacaguaaacaggaagcagagagaaagucccgcaaaugaugcauagccuuugaagcuucaaagccuauguccaaugacacaccagcuccagcaagcugacacucccuaagccuucccaaaugccaauaacugaggaccaagucuucaaaugccugagacuuaugguggacaccucauuaaaaccacacacuuucauucacugaacauaauuuuaauagcuguuuuaaaaacuuuuguguccugauuguuacauauuucuuguaauugauccuguuugcuuauauuucucuugggacuggaugauucuuugcuguucuuguguaccacgucacuuuggucuguaugauaaacaguguauaugauagauuguuaaggcuggauuuggucugguuuuuccaguguuuuauguuuucagucaacaauuauguagcccagacuuuaucuacaaagucuuugaggugggaguucaaauaacuguuuugggaagguggcuggucugguuggaguguucuagcugguuguacuacuuauaauaugcucuauguaugcuugguucauaagugggacauaaauuugggaaauauaauuaccuaaaguaguugaacugcuuuggacauuuuuaucuuuuuuuuguuguuguuuaauagaacuucuagaacuuagagucauaguuuuguuaagugaaaauauuuauggguauuuaaauuauaaucuccuauuuugcaacuaaguaaaaaaaacuguucuguuacuuuucucuuuuuuauagaucgagcugggagcauuaguacucuugacucauuagacuuugcaagauauucagaugaugguaacagggaaacagaugaaagaguggcggguaaguaagucuggaaagauagauuuauuauguuggagauaccccaguuuucuguuccaguggcauuaggagauuuaguauaaaccuacaauuugcuaaauuuuccuuguggcaagcuguaagaccaguuuuauguuaucauuugcauaguugaaagguaacuaacuguaccuuagccgcauucccuugauacuuccagccagagccaacauucacuuaugucuaucaguacaacuuuggaguuuucaaagcugguugaaauaucucuguucugcuuauuagguuaaacuuugcuuugaguucagugaacacgcaauaacucucacaguuguuuccagaaauucuugauuuuccugugguaucugguucagcaaggucuuccaggauccugcucauucuaauagaauaauaccuuuucuaauugcuuacucaguccaguuuccuccauucccaucccaaccacuuccucaucaguccuuccaaacacauaucaaucaccacuggaucuguagggacuucugagggccaauuugucuuauacuguauucugucaguaccauuugauuuuagugaaaauuuccucagaaucuacuacagaauaugccaguggagaaacuauggcucuuugagugcaaauaucugguucuucaggguuguggcuuccuaucauugaaguaauucuacuuaggguuauaggaauuguuuuuauacgacuuuggccaagaaugagacauugaaagcaggauuuaagcuucaaugaaauguaggcuuccugaaacaguagggccauacagauagagcugugaaggcagaaugugccuagaucuagucuuucuugcacuuaacugggccgaguuuguuaaagccuacacaaugcugaccuacuauagucauuauaguaaaaauaauuaauuccuggggcuggagagauggcuuagugcuuaagaguauuuacugcucuuccagaggauccagguucaauuuccagaaguggcucacaacugucuguaacuacagcucagggaaauaugacucccucacacagauauacaugaaaguaaaacaccaaugcacauaagguaaaaauaaauaaaugaauuaugaaauaaauaauuuuuauaagacccuugcuugcuccaaucuaaacacugaaugcuuauugucucauugagguauaccaccuacccacaagaaacuaaggcccugggagagauuauacagacuugaguaguggagguaggcuucaaauccaaauagccucacagcagagcccacaguuaauuagauuguaugcuaccucuuaaugugaaggauuagguuugaccuaauuaaaaauuccauugcaguaugugaucuccauuccuugccuaagacuaaaaacuugauguuuaaaaaucacaauauuacauaaguuaggggagaggggaaugauuguuuuuaguucaaccaaaacuaagaggacucaacaguauaaauaauaguaauguuaauuuaaugaaaagaucacuggaagaauuuagugugaccucucauucuuuacagcuacuuuguugugagcauaauuuagcaacagucaucaaaacagcaaaucaaaucagccauaguagcuaacagcuauacucuagcacuacucuagcacuuggaagcugaggcaagagaauugcccuagauauaacacuaaccuggguugcacagugagacacuaaccaaagaaagagaauuagaaaaagaaaaaaaccuuacagauccuaucucuaaugucuaaauuagcaaaucaagugguagguuaauugaauaaacucaggauugguuuauccuacuauaucguuuguauaguagcauuguuauauaauuacauaguaaauauuuuauguuauagaguaaauauguggauuucaggggaauuuuuuuguuugacauggguugauugucaugcaccauaggcuauccuggaacucaauauguaacugggaaugaccuugaacucugaccuuccuuuccuuaccucccaaguacugggauuacaguuauaucccaccacuacuuauguugcugaacugggcaucaaauacagggcuauagccucaagacccuguuuaguuuuuuuaaagagucaauauaacagguuuuaugucuauauagcuacaugcuaaaaaauaacucuugccaacaaguuggcuacauaauuauguucuuuaauugccauuugaaauuagaucccaccagauugaaccugaacaaagaguuucuuguuauuuuagguauuuuugguuucuaauuagcagaaagcauuguuaagaaacaagcuuugggccauuccaucuuccuuuguauaagaacaggagugagaagguuaguaaucucuccuccagcugcuuccugauggaggaguggaccucauccuccacacugugacacaacaaagaguagaaagugggacugaaggguuagcucagcaguuuagagcacuuccagaggacccagguuccauucucaacaucugcuuugcagcucacagcagccaguccauaacuuccaucccagaggcuccagcacccucuucuggccucuauaggcaucagcaauccacaugguacucagacauuugugcaggcaaaacaccuauacauaaauauuaaacaacaacaacaauguuucgaaugugacaauuuugaucuuacauuuuuaaucuaaaaaauauuuucugccucuaacuuaugggagauaaccauuuuuuuauuacuguacugugcugauaugcuaaugauuaucuucauuuuccuuagagaaagaacauguuauucuagaaaaugguuuucagucuuguguggaaccaaaccuguguaugugugaggcuuuaagaaauuaaucacauucuccaaauauuuugaucuuuuuuuacuaaucauuuguaguaauuuaaaagugaaucaaaagaccaccauucaugaaagaugguuguccucucaucugucaauagaucauauggaacccucaauaauauagauaacacagauccagaauccauuauccuaucaauguggaucuuuucuaacuuuguauggggugggggacugcuuuuucuuuuuuucuuuuuucucucucuuuccuuccuuccuucuuucuuucuuucuuucuuucuuucuuucuuucuuucuuucuuucuuuuauuuuuaugguacaggucucagguagcccagucaaucuuguacuggguagcugaggcuggcuuugaacaccugaucuucgcaccucuaccucccagguauuggauugcagauaagcaucaccauacuugaacgacuguuauuauuuauaggacagauauuuguuuucuuaucaccuuucugcuaagcuaaaagucuaguuauuuucuaggccuguaaaguuuuuuuguuuguuuuuuuuuaaauagacaccccaccaccaucuccagagauuggauggauggauuuaggacucauucauaugcuuucuuacugagaccuauccugagguuuaaggggaagacucuaaauguuaggcauucugcucaguauugauagaaaauauuuaauacugcuaacaguccugugaaauaaguaaugaaaucuuuauuuuauaaacuaguaaaaugauacuucaaagauuugccaguaacagaacacaaguuuuauuuccaaagccuacagugucucuuaguauaagcuguaccucugaaaaaguauauauuuuuauggauaucaaaauuucauuuuucucaaauaaaauuaauuuaacuuaacuuauuuucaaagagguaaaagacugaagcuuuuuauuguugggauuuuuuucauugaacuauacauuuuaaguugaaaucaaccuggaaguuuuccucaccccuucacaugcacacaaaugucuuugugucgucacgugcaagguuguauacacaguuauucauacacguucaacuauauacauaaaauugauacuaacaugucaaaacaaaugagcugaauucugauuucguuaacaaaugacuaaagcuuuuuuaaagauaagauaaauucaugauauuuaaauugcugcuauuuagcuuauuuuuuugcauuuugaacauagaagugagaaguaguuuuugucaucaaggaguuuguuccuuguugcacgaucccuuuggaauugaugacaagggcuuuggucgcuuuagaacuguggcuaggagauaacucagcccauaaugugcuuacuuugcaacaauaaggacccgaaaggaacugcacgagcuucauucucaauacccauuuaaaaaaacaaaaucaaaaaacagguaugcguagugucauauaccuauaaucacaguacugaggaagaggaggcccuggggcucucuggacagcccaccuagccuacuuagagaguuccaggccgauaagacacugucaggagaacagaauggaucacacccuagaaacaacauggagauuagccucugcccuucacaugcagcaagugucuuuguaccuucacaaaaagguuuuuguauacaguuuuacacacaggaaaaccugcuucacaaaauccaucuuuuaacaucagaguugcugguuugguucuuauguuucugccugcuagaguaaaacuucuauguucacacacuggugaaauccaaagagacacaaagccgcuugcuugcuaauuuucagggaaagauccuccugaaugcuggagaaaggagucauuguugguccauucaguaccaauuuauugaauacucauccuguuuuccaagugguauguuuguucucuucuaaaaugacucucagaucuugccugugaagucauccgucccuauagccugaauaacaaaugcuuaguauuauccauggucuuguuucuugguuaaaggccaaggcaauaucuguaucccauugccuuaguaucuauccucucuguuuugcuuguuuuauugagacauuagauuggccucaacuuuuuuauuuuccucccuuagcuuucugaguauugcaauugcaagcauacacacacacacacacacacacacacacggccagauuuauuuauuuauuuauuuauuuagagacagggucucauuagaauaccauuggcuguccuagaacucacuauguagaccaggcuggccucaaacucauagagauccaccagccucugccuuccaaaugcugagauuaaaagcagaugucaccauuccuggccaggaauuuuuuucugagaacccaauuucucuuauuuuguguaucucccuaguuuaaacaaauaaacaaacaaaaaguguguauguauauucuuuucuauuagcagaaccuuugauuuuauuucuuauauugaacuugguagaugaaucuuauauuuagauauuauuuaaaguuggauugguauuccaacaagguuagauauaacauuaaugaaauugauuuaccuguaauuuguuaccacgaaauuaagguaguauuagaaauaggaaaaaaauauuguaauggguguauauguaaguuaaaaauaaaaguaauguugauuaaauuuuuguagauuucagauuccaaaaauguaucucaugauaguguuaguuccacaaacaaaaggguaguggugggacucguggguaggaaaguuuagaaagaugagguuuucugcagaauauuugucuuugauacuugagcaucuuaauauuaguauauuauuauuaauuggaguuaauagcauaguauuaaauagugauuauuaauauauaacaucacaaaaguuugacauuugagcaguuacagagauaguugaaaugaauugcuaguuacuaaaggauuagauucaguaugauauggacauuaauuagugguaggauaaagacaacauauaugugauaaguaaucuccaaguuucccuuaguuggcuuuccaaaccaguucaguggauggauguacuuuaaaguuuaagugggcagagacuacuaaggaagaccagguguaaaaaggaaaugaugcaauucagugggaacaaauucaaaacuuaggaaacauucaaauggacaugucuaggaaauaagaauguaucuggugaaaggguuuuaagauugugaucaucaaagccacaggcaugcaugucauggguuagguaucaugagaaaaggcccaaaggugaugaugagagaaaccaacuucaagauaagugauagaggaaccugaacagaaagaacaaugagggcaaggguuucuuucuucccugaaaggcuuggaggaagggucucauaucagccugaaucaaguugaaaacaagcauuguaaaauaguuguacaggguugggaccuaguguaauuuaacauugcuuauacugacuuuaauguuaaaauuguaaacaguaaaacuguaaugcaugcuguuaauacacaugcauguuuguaguuauuacaucaccuuaguuuguguuggucaaguagaaugaguagauugguuguuagcuccuacagcauuuuauacacauaagcacacauacacaccuucauauacuuuuagaaagaauggugauuuuaagaauugcguagaacuuguuccacaaaguuuaucuccuuacaggguacucaguuugcacuucaauccaguguuuuaggagacaaauucauguauguauugauauuguguggcauuaagaaucuuuuuugacagugggagggagaaagaaaauacaaaguauacauguguaaaauugccagaaaaucaaaguuuauacuuuuaagaaaaauauauuaauucucccaaaucuguauuugcuugguuauauucuaccuuuuauagagauguacuauagcuucaagcauaaaacucugucauuuagaaccuguguuguauacuaagaaacaugcagcagagugaauucauuuuggaagucugucuuuucaaagcauugguaucuucuaaugacauuuggcaauauguauguagauguuuguaaaauuauaaauucuugccgucugacauggguuuucuggcuuucugugccuauucacucuuuguuuuguuccuggucaccaguuuaauuugagcauuucccacuuuguguuuuaaccaguuuccucccuucgcucccuucuccccaccccccuuuuuuuuucugucauucugguguagggcauuucugaucugcaauuguucuguaguauauuuuggauaauuuuaagcgauauugagagcauaauaucuauacuuuuaccuuaugcauagucuaguuaggugcuuuuucuuccaaaauuucauagaauuuuccauuuuuuuaaaaaaugaacaaaucucuacauaaauguauucaguuauguaaauaaucugacuuuaacaaaaacucuuaaaguguuucaaggaauugcaguucaggggaaaugucuuagcuuugcugcacagaauuguuugcagaucagcuuugcugacuaccaacggcacgcagugacucagugccauccuagcugugcuuucauugcugcugcagcuaaacucugugcaucaaaauaaauggccgucauagcugugacucaacuacauccuaaguuuuuauugaacacaugcaaacugagugaauccuaauuuuuccauauauucuuaaagcuuucuuauaucugauccaucucaucuuuuuuccaccagucagucagggcaaaguugcauuucuuaagaugaaaauuaaacuccuuaguuuuuaugcaagucuguacuaacucuuugugacaaagaucaauuaauuuccccagaguucuaauuggcagaaguaacuccuguacaauaccuauaaauuuuaagaaaacuucauaguuaagauacauacaguuuaaucuuguuccugauaaauaauucacaaagcucaauaagaaauuuucccagcauucauguuaucuauaugauagucagagaaaucuuuaaaguuuauuaaucucuccuaaaagaaaauaauuuauuugaagaccuauuggaaccuuuuaaauucuaccuaauuuuacuucgcacagcuauuuuagaggugguugguauguauguguguaauauuugcauuaggaauaagucauuucuauuuuuugguguuaauacuaaaguaaaacauugaggccuuuuuaugugugucuuuaaccuaucugcuuguuuuuagaaaacaugcuuccuuggaggaaaauguauaggcauacaacauuuguuucacauuuaaauguaacccucaacuuagcaagcagucuagccaauaauguuucuacaguuacaacauucuaaacaguacauuucaaaguaacuuaaaucccuuuauuuaaggcuaguuagucaauuuucauauaaucuuuaccucccuuccuccaaaauuauguuaaccaaaaauauuucauuacauuuucuuacccagauuggcuaaaauagaaguaccuagauuauuacauuuuuaauuacuuaaauaaaaguauuguauuuuaauagcuguauuccuugucagacagcuagaacauauaccccuaauucugcuaaaacuauggaaaacgaucaccaguuugcuugcaaaucaacucugcugcaugcguucacaaguuucauaaagguugcaugcuuccuguuuucaauacaaauuguguuuuuuucauacccaucuuugcuuuuuauuuuuuuuauuuuuguuucccuuuucuugguuggaugccuguguguguuuaauccaaaucccuguccaguccuggaguuugaacuacggaaagccaaggagaccauucaggcccuccgagccaaccuaacaaaggcugcaggugguguacauaaaacuuuuugagccuuuucccacuuuuacaauguagaaguagccggacuauuuuuaaguguaaaauaguaaaacauuaucucauuuuaucucaccagaacaugaaguuccuuuacaggaacgaaaaaauuauaaaucaaguccugaaauucaggugggugauugacaacaccaguuaucuuccauacaacccaagugucaaaggagcaaagcucacauuuucccaucugucuuuuaacuuuuuuuccaggagccaaucaaaccucuugaaaagagagcucucaacuuccuagucaaugaguuuuuguuaaagaauaacuacaagcuuacaucaauaaccuuuucagaugaaaaugaugaucagguacaguuacuguuuuaaguaaugucuacuuuuaaucuacuguuucucuaacuugauuuuuaacacuuaugccuguaauaagaguccauguggguaguuucuaaaaucaaagcagguacuacucaguuuaguauucaauuggcucacaaaccuuuucuauuuaaauaaaccuuuuuaaauaaagacuuauguuucuuuccagguaacuuuuuauagccugauaguaacuguauagccccuucauguuuguauucauucauaauguauguuuuucuaagacugaguaauuacuugcuuuuauugaucauugcagacuuagaaauugaguuuaacuauaaaaaaauuucuugaguagcacuguauauaauucagauguucaguagcaaugguuggagguuuuuuugguuguuuaauugguuuuggguuuuuuuuguaggguuuuuuguuguuguuuuggggugguuuuuguuguuguuguuuuguuuggguuuuugggguuuuuuuguuuguuuugaagcaggguuucucuggguaguccuggcuauucuggaauuugcacuguagaccaggcuguccuuaaacucagagauacaccugcuucugccucccaagagcugggauuaaaggugugaaccauuaccaccuggcuggaaaauacuuugaaaauaaauauauacauauauauauacacacacacacacauacauacauacauacauacauacauacauacauacaccuguaucuauuugguucucugaguaggaaccaauuauccuucugauaaaauguugaagacaaauaauuguuuuauucucaucucucacucuggaaaugugacccacagcuuaguguccugugggucugauagaauuuagacguuguagaaguaaaugccagagaauuuauuaugaagaaagcagaaggcugucauuuuuaucucuuguuauucacuuacuuuugugguguuagagauuuaccuuacacacacuaagcagacacccuaccucuaaagcugcauccucaccccccagaggccaguauuuuaagugaaaguuauucuuuugcuucguaauaccuccuguggauauuuuuauaggaauggaaguucucuaaaaggacauagcuguuuauuuaaauccucaauuaaaauuacguuugucaagacuuaaaugugauauaguuaauuguguaucauuuaauaaugagacacuuucugagaauaguagcagucauucagugauuucaccauugugaaauucguuguaauaaaauacacuuaaggaaacucagcaaaguacuauaauucuacugugaugucauucauauaugaagucuauuguugguuuugaugcaguuguggcuuaugcuuauaaauauuuaauuaucccaaaguaacuuuacugagcuuguacuaugcaaaagacauuaaaaauuuaccuaacaugauggcuguggguauaauuuaaguuaaucauguuuugaucauuagcaacguuuuaaauguaagaaguauugaaaaguggaacaaaguguaaagggggaaagaguaacaaacaacagagaggacaggucaaacaggauacagugucuuuaagccuagacuugucaguucugacuuuuaaaucaaauaauugauccuacucagguaagaggcagacaguaucagagaugucaguagcacucccucaauaugugacuaggaaauagcuuaguaagauauagacgcucuguggucuuucaucaguugauuugacauuaauaaaaauggaaguggaaagaaacuacaguagccaaagcaacuuugauaaagaacaaggaagacuugaaucaccuaccuuccagccuuaaaagauaagacaaugaaaacauauuauguuguuauguagacagguauaguaaggaaccuauucgaauauaauccagggguagacauguacacagccuguugauuucucacaggugcaaacuugaucucauacaggaaagguagccuucuuacaaguaguauagaaaaaugugguguccaugugccagccuuccaaguaggugugaaaccacauuccauaucaugugaaagugaauucaaaagggauuuuaauaugaaccuguaaagcuuauagagauaaaugaaagagugggaaaucauuacaauuuugagagguacauaagauuucuuagauaugacaccaaaaucaugaugugcuucagauguacugucaucaaaauaauguuucuaauuuuugaaagcuacuccuugccaauaagaugucucagcagauaaaugugcuugccacccgggcccagcaaccugauuuugauccccagagcccuggugaaaauggaagaaaagaacugaauccuguguuguccuaugacuuccauacucaagucauggcaugcguguacagauacacacauaugauaauaauaaauucuugaggcaggagggguaccucaacaguuaagagcauccugucuuacagaggacccaaguugggaaauuuauguccaccuguaaauccaacucccacccuggccucaagacacacacacagacauacacacauacacacacacaaaacacacacacccacauaccacagacacacacacaugugcacacagcauuuccuugcacaagcccauagauauaaauaaaaguuaaaaacaauuaagaccacuguugagugaaaagacaaauaauguguguucaaagucaacaaaagauuuguuaaaauuuucuaaacucuuuaauaagaaauaaauguaauuuuuaaaaacauuagcaaaagaauuauaugugcuucaccaaaaaaaguaucuagaugaaaauaagguugugaaagacacucaucacuuuuuccuucaaagaugaacauccaaugagaugccccaaacuuaggaugcccaugaagacuugcuaggcugggccugaauuagguagauugcaauaaagagauguaugcuauauuuguuuauaauuuauguaaucuaaaauguauuuaguucuuguaagccagcaucaugaggccuuuagaaauauuuaacuuauucguagaaaaguccuaagacguaaugaguguuauacccauuugguagguggccccuuuaaccuaaauuaacugauaauaagaagcagugacuaggaauguuguauuuaccucugauuuucuccaaaccccugauuuuaaugcucauaucaacucuuaucuucaauuuuuaagcauaauuauucuguuauuuaaggaagccauuaaaggauuaaaaugccacauuuauaauauaugacuaugguaaaguuuuucagagucucaugaacaaauuauaauaaaaacuuaacacuaaguuauuuuaauuuuaggacaagacagcauaguaagaaagaguaucugucccugauuuauuacuauguaauuucauacagccugucuaaaaaucuuugccauagaguauucaagauacucuuuuugugguuuuaaugaaauugauuuauucugaauuagagggaauguuucaaaacacaauggauuuacagguagcuauuuggguucuuuaaauuuccagaggcauuuuuacuaauacaaguuagauuuaaacaacuauagcaauaucaguagguuaaguugguuauuaauucauuagcgagaacaaugacuauaugcagugugggaugauggaagaacaacaccacuaaccagucuacuuguaacuuguaaguaugcuugauggacuaagaacuuagacuuuuccugucccagugaucaaacucaggauuuccugcauuguagacaaguacuguagcacugagcuccaucccaguccaucuuugauagguuuaacuuaaaaaaaaaaaaaaaaaaagaccaacaucuuauuaacggaauuaaacagaaagcauaaaauuguaagaagaauaauugugcggucuaagaguaccuagaauauacacuuugggcuuuguuguugguugguuuugguuuguuuugcuguuggagacacagccucacuaugugacccuggucaaucuggaacucaauacuggcuggcuucaaacucacagauccauguaccucugccuccuuuguccuggaaauaaagguauugcaucaugcccagcacacuuaaacauuauaauaaaacuauuaccuuugguuuuucaguuuaguaauacauagaaugcaagauaaaauuaccuuaaagguuuuuauuauuaguuacauuugugugugugugugugugugugugugugugugugugugugugugugugucugugucugugugucugugugucugugugucuguguuuauauauauggaaaaaucaggaaacaguuuucuggaguucguuuucuaccucuaccauacuggugccagggauuggaaucaggucaucuaauuuggcagcaagugucuuugcccaccgagccaacauaccagcuucucaaagguuuguuguuguuguugaucuagaucuaauggggauuuuuguguguguguucuauuaggauuuugaauuaugggaugauguaggauuaaacauucccaaacccccagacuuguuacaacuuuaccgagacuuuggaaaucaucaagugacugggaaagaucuuguggauguggccaguggaguagaugaagaugaauuagaggcucuuacaccaauuuuaggcaacgucccuccaacccuugauacuccccugccuauagaggugagaaauaccaguuaaguacucauuuccacaaaacauuuauguaaaaauguuccugugagaucuugaguuucugcuucuuuuuccugcuuugauuuuuagaacaccuugcuaguacagaaauuagaagauaaaauuaguuuauuaaauaaugaaaaauggucauugauggagcaaaucagaaggcuugaaagguuaguacuuaguuguuauuuuuaaguccuaaaguuuguguugacauuggcagcuuauauagcuaacuauaugaagcaggauuucagaaguaaggcuuaguauuuucacuuagcuguuauuaaagccuuuuaauuauuuuucguauuuaaaauagcaaaacaucuucuuucaucaacaaauuagauugaugugguauucuuauacuuaagaaguuagauauuuuaacuucacccaagucuggucaguuucaguaaaguaacuccaaauuaguggcauucauacuuaaccauuauauuuacuuuuuauaauacuaaguggguuugaugggugaucucccggugacaaauggacauuucucuagagcaggcuucaaggcuuuuguuucuccugguugauaguucacagcuacaccuuuaggacuaggaagcuuuagugacucuugugcagaagauccuggucacucacgagcuaauugacuuuaauuuguucugcuuguauucacuccuucgcuggggggguggauacuauugccaaagcuuugaaaacugaaauuguucuccgggcguuuucuuucuucagugagauggacauccucaaagcugaacacuuugccaccccagcaguuggugauucuguucagccuuccuugguuuggucuucccaaaaggauucugaagacaauagacaaagcccagcuguaaauaguucagaccaggaaaaaaccaaggauguucaucuugaaauaccagaugcagcugauuccuuuauuccuaaagagaauucgucagguucuuuccccaggaaggaaagagaagagcugccaccuucuucuguaucaaauaaaaccacgcuccauuucgaucagcccaauagguuagugugugcgcugugcuuugaccugugucuuuucuuauugugcauuggcaggcuggaagaacuucaguuaauauuggaacaccuuuugcagaguuacaaaguuuuauguuucauaugcuuagcauauagaauauauauauaucucaaaacaggacaaauaauuauuaaauuauaucaaagaaaagaaaagcauaaauugacaaguucugucuuuguuaagugcauaagcccauaaguaacguggaguuacuaagugcucuuggccuuccccuccaugcuucuccuuuuuucuguuaucaaacucauauuuuagugcugcauaguugccugugcuauaaccagacaagucaaaguaguuuuguucuuagucauuuuuuucuauaucuguuucauuacaaguagugugcauuaauauucucuuaauucauuuaauuuuugcuggauuguaguacuuaaacucaggaagugaaaaaauuauaaaccugcccuccuuuaugaucaaauuauuuaguugagaaaacaaagcauaaauuuuaaauauuuucaauuggaccuuggaaaaaauacuguuaagggacuauuuacuaauuuguuuuucaugcauaugugcuuaguguauaucaacucacuuaauccuauaguauacuuuuagccaccgacuuacuaaaaaaauaaacagguacaguauacucaacauuaggauaaaauuuuuaaaucacgucuaauugccuaucacaaauuuguugucuuuguauauauggagcucauaaaauuggaauaaggugugcagugcucaaagaguuuuuuuucuaauguggaugagauaaaaaucauggaaauuuauauuguggugcucagugauaauggcucuuguaaaguccuucuguguaagagcauccauauaguucuucuguacucugaagauagaugguguuauauucacucagugggucgucguaacugugugccaggcugugcuaagaacacauuggugacugagacacacuguaauccuuuugugcacaagcauuacaguaugagagagagagccagagaagcaauuacacuaaagcacgaaaaauaagagacuaggacuugcuuuagacauacauaaucaaagccccaaccuaguuaucgaacagaaggguucacugaggagaugccaucuaaucuaaggguuaaaggcuaaguaauaguucacuaggcaaagaaaucagaggaggaguggaugagagagggucaaagaugaacauagaagaaacagauuugcaagguaacuaaaaacugaaggguuuauuugauuugaagugaagagaaaggaaugaguccaguuaauuuuagagaaagacuaguuuguaguuuucugguuucaacagguaaguagauuguggccccuuccauauagagaguagggcagugcauagaagaacaaggguacaagcaagccuagggacaucucucugacuguauucaugggauuacggggugcaacuuuguggugccuacuaaauacagguuuguucauuuugguuuggguauuuuugggggguggggggaggguuuuuggugcucuuuuguuuuguuuuuuuuugaguuuuggcuuuggcuggcccugacuguguagauggagcacaugagcaacccauagucaacuuuaugaguacuauuucauaagcaucaguguuguagaaacaaagauagacuugacuguuuuauuaaauauaaaaauaaguuaauauuuuguauugccucuccaauuuuuuuccuuuaaauuacaucaguaauagucauugcuuucuuuuauaguuuuuauguagguuaaaauugugucauuauagaucagcacaauugcagugccuuuccggcuuuuugucuuguucaaccuuuguuggcuuugcugaagccauagaaaauggaggauggagauaguaugcauuuuagauugcagaaauuuuucuauaauuauggauuacuguaccacuuaguauguaaucuacuaacacuuuaagggccaaucguuuauauggcaucaagcuauuugcaguaggcaguauuuuucucuuaugauuuuauccaucaaguccgguaacugagaaaucuguacaacacaaauccugggguaguauuaguguagggauguggguuuccauauguagauaugcagcuuccuucacccggagauagcaguguuaauucuuggguacuaucucucucucucucucucuuuuccccauuauuuucguguaggaaauugucaccugcuuuccaccaagcacuacucucuuuuugucgaaugucagcagauagucgguuaggaucagagguaaguuuguauuagagauuucauaauacaucucuacuuuuuugguaggguuguuuauuuguuuucuugcuuauaagguuuuauauaaaauaaaaacguuuauucuaugauucuauugcaguugaaaaucuguuauuuaaaaguaauuuaaaugaaauaguaccuaauauuuuaagcaauaaggaaggcagcugauuauugguccauuugcaaucuagaaaacauuauuauaaaauuaggucagcuuucuuggagcacucaugauggguuucaucauacaagcuguuggcaugguuguaguuuuggaggauguuuuuaagagaaaaagcaaaugaauaagcaaccauuguggaggcccugucugaacuauccgugcuucccagaacugaaacauaguauccucagguuucacugcuauuuuuuuuaauaauauuuuaucaugucuuuuaaggaaauauuucuuuuuucugacauguagaauuguacauguuuaugcacauugugacuuuuagauagaucaguguacaaggauccauuggaauaggaugacugacaucugucauuucacauuuuuuguguguguugaacauuuucaaaaauuauaaauuaucucuacaagcuaauuuguaauauuaaauuuguugauuaccauaguuaccuuacaguacuguaucccuaccuacuacgauagacaacuuuuuguguuguccuuagcagcuagggauauagcuuaguagaaggcacuuucuuaaugucaguuagcccuaguaucauaaacauuagacaugaucccucauacccagcuuaccccuguuacuagcauauuuacuccaugacugaccuucggauaggauguuuucuggggcagucauguuauuaucaguaugaauuauaauucucgaguguauuuuuacaucaaggugacaagauccaaaauaacauuuucccaccuuugugcaccaaagucauccacagucuuaacuguuugguuuucuaggugucuaggauugcagacagugaaaaaaguguuauguuaaugcugggacgcugccugccacacauuguuccuaaugugcuguuggcaaaaagagagguaagacacauagaaguguuuucaucccaguagucccuucaugugaucauuuugaaguuuaguguuauauuuuuauuucauuaagucuguuacuugcaaucauauucuuacuuuugugcaugcaucucugcuccuagagaaugguuuuacaccucugucaggugaguucaguaaaccugcaugguauuuauucauguuuuccaacuuugcuuaaagcauuuguauuagcuucugcaaugcuauuacuguagguccauuuacaugucaugaauguagucauuuucacuuuaccaaauacuaauugauuuuuuuuguucuuuugaugucuuugauaugucuacaaaaguugacacucacugaaaauuaacagacuaguaacuaauaauauaacuuuucucuaaaugcauuuguaacugcuuguuauaaauguuaguuuuauuauauguguuugacaauaaauuaucuuauaauaauaggauagugguaauaguaauuaugauaaccuucuaagauuccuuuuaaagguuuuuuuguauuuacauucuuaacagaugcuuuaaauauccuggauaaaacuucgaguacauuuuaguacaugugaccuagaccaugagcccagaacauguuaggaaguuaucuuuauaguuacaaauuauuauuacauauauguauguguauauauauauauacacauacaugcauacacacacacacacaguaaagauuaaaauguuuuggucauuaugguguuaauguuuaccacugauuuuacguuuaaucaugggaccuacaguaugauagguacauaaugcauuggcaaaacccauuuaaagcugaccuuaguuaaucuauuuaagcaaaagaaauuuguacugauccucaagaaaggauauuuagggcuuugaaaguuuguauuccuauagguauuuuuuaaguuuuaaauaaauugaaacuauuuuugcucggggcuguguuuuuaucuaguuuaaaaugauuagagauaauacuauauauggaggguuucuagaucuugaaggaucaguuuccaauuucagauuguucugcaguugugccuggcagggugguguuugagcuuuucccuucucggcuguaauaucgucuguguuaugaauuacuauuugcaucccacuuguccuuccucaguagucuuuaaauguuaccaaaccugauucuuuuaagaucaguuuugccuacuuuauuucccuauuaauuauaaaacacuucuauaacuaaaaucugauuguacugcaugaaauauuuauagauaugcaucauuaucaauaaucagauacuguguguguuuguuuguguguguguguaugcgcguguguuuguguguguucguuuguguguacauguauacuugcuuggcuaauuuaaaaaaaauuuuuuauguuugaaaacuauugaauguucuauugaauguucuuguagaagaacauuccuucuacaagaaggaagaccugauccuuuucucuauauaauuauuuuuaucuuauuccauucaauugaaauuauagcuucucaaaauuaaguuaacaaauaguaaaguguauaucagcuuggccuaaaacaaaucccuggguuuagaaggacaaaaucuuagagcaugugcuuagcacccaugaagcucuagguucauucucuaguaccacuagaggaaaagaaaggcaaaacuuguuuuaguauauccuugacauugaauucauuuuuauauuucacauguuuuaagucuauauuuuuaaagaacucuuaugauuaaaagauugguauuuggagauuauuuuccaaauuuuguguccuuuuuuuuuuuuagcauaagcaaaguuuaaaaguuuagucaacuauuggucauaauaauauuuugauuauauuacauuacauuagaaacaggguguaagacuuguaagcaauauauuaauguaaauuaacuuuuuuaaguaacaaaagggaaacaacauaaacccuuuuuccccguucacauuauaauuuuacuaacuuauaauauuuuuuccaaguccuuugguuugguuugguuugguuugguuugguuugguuugguuugguuugguuugguuuuucaagacaggguuuuucuguguagcccuggcuauccaggaacuuacucuauagaccaggcuggccucgaacucagaaauccgccugccucugccucccaagugcuaagacuaaagucaugcgccaccacugcucggcuucuuuugaucauuuuuaacuagacugucuucauauguuuuuguaguaaccauauaggucuucauauauucuggauaugaaauccuuaucacauaucauuuuauagucuaacuucuuauaugaagaauauugagcugacauauguuaaagagaaaaaguuuugccuauugaaggucuuugcuacugcuguugacaaucagcugacuauagauuguuuaggucuagagucucgugugugugugugugugugugugugugugugugugugugugcgugcgcgcgcgcacuaccugucuuuaagccacucccaugguguuuugauuacucuaguuuuuaguaaguuuaaauaauuaggacaucuaagucuuccaauuuuacccguuucaauaucacgugguuauuuggggacccuugcauucauauaguuuaaugcuuagcuuccuuuucuguaaaaacaggucaugaggauuuugaaagaaauuacacugaaucuggaacucacucuguagaccaaguugaccucgaacucagagauccaccugccuuuugccucccaaguagugggauuaaaggcaugcugcaccacugcucagcuugugucauggcuuucauuucuucaucaguacuuuaacuucuuugauuacauuucuccuuagaauuuacucuuuugguugguguuacaaauggaaauguuauauuacauuucuuucuagauuauucauugcugauauauagaaauuugacagacauauuugccuucauuuauaauaucuuguaacuuuaugugaauuuguuuucauuguuaauaguuuuuuaugaguucuguagugucuucuguauguagaaccacagaaucuaccgagauaauuuuggaaacuuaaguacccuuuauuuauuccuguguuuucaauacucuguguaggauuaggaauaaauuuagaaugguagucauuuuaggaagcagauauaccuuugugacugaucuugugugggcagagauacucucaggcuuuuuugccucuuaaguauuauguuagugugaaauuuuauuuuaaugcucauuaccauauugagggaauuuucuucugaguuuuuuuuuuucaagcuagaaaaaaagcauuaaguuuggccaugugcuuuuuuuguauguauugaugugauauugauuuuuucuauuuguuauguauuuguuguauauugguuuuauguucauucuugacuugcuagaguauagcccuuugugguuuguaaucuuuuuaauguacuauugauuagacauuaguauuuuguugaacauuuuuauacuuguauuauuaagaaauacugaucuauaguucucuagugcucuacuauuguuuucuucuacuuuggguagcuggcuagguauaucuucauagaaugugcuggggacuacuuacugcucuucucucccucacccccuagauuaauuaguuuaaguaggauagaugcugaaaggucucugaugguggaucuucuuaguuugggaacuuuugguuacuuuuugaaacucccuacugcaucaugacccucuccacaauauuuaaacauucauuuuguuuuagauccuuuuuauaugccuauccccuucuuaucuaguacaaaugcacacuauuuuuucaaacuuuaaaaguugaggcuagagaaauagcuaaacagcuuaagaguacuugcugcucuuucccacacucuguguucccagcacccacauaaagugguucacaaccaucugaaacuccagcuccagggaauucaccuccaggcgucuggguacacacacacacacacacaaacacacacaaacacacacacacaccuccaaacauguucauucagauguucaaaaguuuaaaaaaaguuuuuuugaucuuuaaaaaaaauauuuaagguuuuuguuucuuugcaguaugaauacaggauuggaaagauggcuuauaagggaauaauguuauuuccguuauaagccugacaaccuaauuuauggugccuagaaccaauuuaaaaaccagacuuagaucuggugguccuggcucaugccuuuaauccccgcagcacucaggaagcagaagcaggcagauuucugcauucaaggucagccuggucuacagacugaguucuaggacagccagggcuauacagagaaaccuucucucuaacuucauguaguuggggggucagggggaagaugcuauaguacaugugacuauaaucucaugccuauggagagauaagaaguaaagacaggaaaaucaccagaaacuuauggcugccugcaacagugaaugagacccugucgcaugggugaugacuaauauccgaaguuguccucuggcuuccacacuugugcuagggcaagucacagacauacauucauucucucucucucucucucuggcuuccacacuugugcuagggcaagucccccccacacacacacacacacacucacacacucacaaagacagacagagaaauuaaguggaacguuauuaccucguuugcuuugagaaauuuagcugucuuuuuuuuuuuuuuuuuuuuuuuuuuuuuuuuagauaaagcagucagaauuacaaugaaaguuuugaaaagcuagaauucuugaauuagaaugaugauggaaaaagagaauacugauccaguuugugagugaauauguaaggaguaaaaugauggacaguagccucugaggcauugauguguuagugcuucagagacuuggaggggaauucacaguaaaugugaaaagagcacaaagggcauguguuuauagaauucaguauuucaagaguaguguaacuagaaggugggaauaaggcagugauuucucauauguugcaaauuucacuagcaaaaaaauuaaguuaaauagaaauuauuaacaguuaucauuuuaacaaacaaaaaguagguugguuuguugguuuuguuuuguuuuguuuuaacaaaucccagcaucuuaacuuuuagaauaaagggacccaaacuucacugauuugcuuuucaugauucaacuuggauuguuuguucauggcuacuaugcugagaaagguuuuuuuuuugagaagguugagaaaaagcaugacguuuuaugcuacaucuuuuaaguuauuuuuuuaagaccaaagauuauacuccuuguuuuaaauucuauuucugucuuuacaaguaugccaaguagcuuuccuucauuucauaauucuaaaguuacagaugaagaaaagaauaauuuuaugaaaaaacauguagaaacagaaagcaagaaagauaagggguucaagaaaacuguuagggagcaaaagaucagacccaacaggaaguccagaucaaaccuuggagucuguuuugguuucauaagucauuucuucucagugcuucugggagaauuucugacauaugguucuacucuuaguagggugcccugauguuggaacuuggagcuucucucauuggaugcauugacucaguaggcugcauagaaucagcuaagauugaaauacuucuugguguuaaugaucuucuucccuugugucacugaaucuccaagucaaauuaaauauuuauuuuaugagaguuuuccaauaaaauaauuaaucuaucaagcaucauuuaccaucuaaugaagucacacaggacuuauauauucugucuucuauucucagugcagaccaucuuuauuaauuaucauuucugucacauuucaguugcuguuuugucuuaacagccacauaggcuacuaaauacgaugauauaaauaaguacuuuagacuuuuuacuccuuauguuuuauuuguuguaccuccuaucuagauuuuauagcuucaaauuuaaauuuuauauuaguuaauuaaauuuaauaugaaauauuaaaaaccuugaaaaauaauagaaaagaacuuuuaguuauacauuuauuugcaaucccaauucuaaaaauugugucaucuacuccuaaggaagcaauuucauacuuaagacaugcuucucuuacaguauaagcugcuauauguucacuucuuaguuuaauuuugcugacaccuugggacagguacuuagguaaaugggagagagaaucuucccuccauaucacaauaugcuuuagugacuucuuuaaaaugcuuauauuuuggaauauuucucucuaaauuuuuuuuuucacuuuuuagcuuuuuccccccgaugagacuucaaaauccacucaguugagaagcagaauauauucaggguucagaauguugucuaagugaaaauauggaacaacuuuacuuucauacauuucuaugaaaaggaaaguuggcagauacuuuccuaaaaaaguuuauguuacuucugcaugaugaauguguaaugaaauauaguuuaaugucagcuaucucuaaaauaacaguaauacccacugaucugcaccaauagcccagaaauggucucuuuaggcaauugauuaaaugugaaagguacaaaauauugaguaauauagacucuuaagagaugcauguuguaguauagaaaggaauuuuuguuauauuguuugggaaaagguuuuauuagugugauuuuuguuuuccuguguuuguuuuuuugacaugggauuuuauuguuguuguugggggucagggucuuauaugugguguugaguggaggucagggucuuacacauacaagcuaaguaagagccccaucacugaggugacugucuagucacaggaaaaaguuuuguuuuguugguuucucuuuuuuaacuuuugaaguuuuaagauagugaaucucuuuguaggaaauuuaaaacacuuucagaauuaaaguuauaucaguuugucacaugguggguuguuaauuuacuuaaaaacccuaguggaacauuggacaauaccaaauaagaaaauaagguuaguugaaucuuaaguaacuuuuauuacacuguaauuuauccuacuguauaacuaacauauacauauuucuaaugauacucuugauuuuugagguuuaaaguucauuuuaagaauauucuggaagaaaaaaauagaauauacuggaauguaauuuuuauuuugaauuuuucuacccucauauuucuuuaggaguugauuccucucauauuguguacagcaugccugcacccugaaccuaaagaaagagaccagcuccuccauauccucuucaaccugaucaagaggccagaugaugagcaaagguggguguacuuacugcuuuggggauacaaaaugcaaugcugacauaauguuaguuccuaaaugagcaccacauuugaugauuucaucuccagaccuuuuucccuucccaguaucaauuucagugugcuagaguucuccuguugcagugugcagaugacuucaguagugcugucauccaguuggcuauccucuucaccucuuuuuugaaaaggaucccguaauucgcccuaacaaauaaacagauauaaggaaaauuaagccucuggaaauaaauaaguucaugaaguaaaaauaguuaugaaaaguauguacaaauccuguugagagccccuauuacuauaauuacugauaaccaagucuuuguaaagugaaucugugccuuguucuugaacuguuaauuucucauggucucuauauacauguauguacugaaggauaucaccacaauuaucuuacauucugaucuggaaauucuguuaauuagaaucuauuaauacacuuuuuucauuucuaaggagaaguguugggcuauagcugagacuucauuauaaaggagacagaucaagcaguuuaaaccaugauaguaauucucccauguagcucuuuguuuuuccagaaaguacaagaagcaguaguuaggugacauggagaaaauugaucccacucagugaucccccaagcacucuaauauccuuagauacgaaccuagccuuaccuaacaacauguguucucagugcuguuuuugaucagggagaagaccuauaaaaacaagugguaaaaucuugguagguucuaagcuacuucuucagauuuuucuuuuuguuuauuuauuuuuuuuuuuuguuuaaauccuccaacagaaaguaaguuucuuuagauuuguuugguuuuaaucuuaagagagauuuucugguucgagguggcaagagguuggaauuucaaaauaugucuuucaauuuggaauuuucuaugaagaugaacugcuuggggguagggaguaaaguacaagcaguaaguauuugugagaaagauguacuugggaaauagaggucucuaaaugaagcuagauuaggaaaaccacuguaugacccuucaaagagaagaugaguggccuucugaguguguagaaggcacugagucagacaaccauuauuuguguaaggaaacugguugcuucugcccuccuuucaucugcaauccaagauccuugccaguaagaagagcuagacagaaagaaaggaguaaguggcauaauuuugacgaaauuauguggucuuugguaaaagccaauaagaaaggccagaaaucaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggauggucuauguagagacuuccauauccaggaauccaccccauaaucagcauccaaacgcugacaccauugcauacacuagcaagauuuuaucgaaaggacccagauauagcugucucuugugagacuaugccagggccuagcaaacacagaaguggaugcucacagucagcuaauggauggaucacagggcucccaauggaggagcuagagaaaguacccaaggagcuaaagggaucugcaacccuauagguggaacaacauuaugaacuaaccaguaccccggagcucuugacucuagcuacauauguaucaaaagauggccuagucggccaucacuggaaagagaggcccauuggacuugcaaacuuuauaugccccaguacaggggaacgccagggccaaaaagggggaguggguggguaggggauuggggguggguggguaugggggacuuuugguauagcauuggaaauguaaaugagcuaaauaccuaauaaaaaauggaaaaaaaaaaaaaaaggaaaggccagaaaucacucaagaaaguacacaacuaacuuuauuugaaugaauuugcaagccaucucaaauguuuuuaauaaguucucauugugaagaaaauaaguacugagacagaaaugcuagcuaucacuugacuaaucccauacucaggagacagaggcaugugguuccauuaguuuggggacaaccugaucuacauagugagucccaucagagacucugucucaaaaugagaaaaaggaaaaccaagugcuaaaauaaagggaaaggcaauccuagauucaguauagcacauaacauuauuuccuaugccuaaacuaucucaggagaaagcuauuguauagccucuuccuuccucucaaaguaagucaaacaaaguuagaauacuuucuucuuaaaaaaacagaauuaacaugaacacccauaaaaauuucacuauacugugagcauggcagugauccugaaaauucacaauauaugaauuuuauaaugagagacacaucuaugaaaugucaaugaaauuaauccuuuaucaaguauacuauagugagauagauacauguguaaaaaagucauaaugaaaccaauccuuuugucuaacuacacaguuaauaauuaagucauaaugaaacccacaauaacaguguaccuugaaaaaaauuuauuauagaaauauuuauaagcauuauuugguauuuuuaauuuaaauuauuuuauuuacauuaauaauuaauaauuuaauuuuauuuccauuaauaaauuauuuaauuaauaggagaaaacuuuuucucuuucuauucauacuccuugcuuugagagggugcucucgcccccacuaggcccuccccuucccuggugccucaauccucaaggauuaagcgcaagcuagaccagguagaccucugcuacauaugugccaggggccuuggaccagccuguguaugcuucugguugguggcucaguaucugggagcucucagggggucugguuaguugagacugcuggucuuccuauggggucacucucccuuuccgcuucuucacuccuucccuuaauucaacuguaggggaaggauucaguccaaugguugggcaguacauaucugcuucugucucagucagcugcugguagggccucucaggacagccaugccagacucuagucuuuaaacacaucauagaauaguaguaucaggccuuggugcugcccccccaccccaccccaugagauggaucacaaguugggccagucuuuggacccccuuucuuuagucucuucuccaguuuugucccugaagcucuuuuagacaagaauaauucuggaucagggauuuugacuguggguuaguaacccuguccucuacuugaggcccugucuaucuacuagaggugaacucuuuugaguucccuuuccccaguguugggcauuauggcuaaguccugagagugucucaccuucugggucucugguauucucuagagggucaccccaccucccacuucccaaggcugcuuauuuccauuuauucucuuggcccuauggacuucucucuuguccccuucacccccauaucuaauccgguucccccuuucccuuucccuucccuuuccccuccccuuuccccucucccucucgugucccucccuccuuccuccucccacuauuauuucuuuccccuucuaagugggguugaaaccuccucacuugggcauuucugcuuguuguacuucuuauguucuguagauuacauccuagauauucuguacuuuuuggcuaauaucuacuuauuaguaaguauauaccaugcauguucuuuuaggucugaguuaucagggugauauuuucuaguaacauccauuugccugcaaaaaucaugauguccucauuuuuaauagcugaauaauauuccauuauauaaaugaaccacauuuucuguauccauucuaugguugaaggacaucuguguuguuuccagcuucuggcuauuauaaauaagacugcuaugaacaugguagagcacauguccuugugguuauggugaugaaucuuuuggguauuuucccaagagugguauagcuaggucuucagguagaacuguuucuaauuuuaugaggaacugccaaauucauuuccaaagugguuguaccagcuugcaaucccaccagcaguggaggaguguuccucuuucuccacauucucgccagcaucugcugucaccugagguuuggugugagauggaaucucaggguaguuuugauuuacauuuccuuaaugacuaaggacuuugaacgugccuuuaggugccuuucagccauuugagauuccucuguugugaauucucuguuuaguucuauaucucauuuuuuuugauugaguuuuuugguuuuuuggaguuuaccuucuugaguuuuuauauauauauuggauauuaguccucuaucagauguaagguuaguaaaguuuuuuuuuuuuuuucccaaucuguggguugccaauuauuccuauugacaguaucuuuugccuuacagaaguuuuucaguuucaugaggucccauuuaucauuguugaucuuagggcgagagcuauuggaguucuguucaggaaauuaaccccugugccaaugaguucgaaccucuuucccacuuucucuucuuuuagauucaguguaucugguuuuauguuaagugccuugaugcaguuggacuugagcuuuguguaaggugauaaauaaggaucuauuuucauucuccuacauacagacugccaguuagaccagcaccauuuauuaaauaugcaggguuuuuuccacuguaugguuuuggcaaaaaaucaggugucagaguucaaguguccauagguguauagguuuacuucugggucuucgaauccauaaaccagaaaggaacccaaagaaaucaagucuuagaaagaaaaguuuagaauaacaaaauagcagaaagaguaaaauaugcaaguuuuucaaauuuuaguaagacgcugcaauagauuuaauacuacugaaaacugagcauauguugugaaugauaaaauaucaguaaaccacuguguugccucuugaaggacugaagaguuauuugcucagacgucuguuucuaacaauuuguaugaacucuucaauaguaguucauaauuuauagugguggacagaguguaaauguagagcuccucuuaauaugauuauguaaaauaucuugaaaggcaugagagccuuucuaaauggcaugaguuuguuuuaucagccgcuugauaaucuugauagccaaguggcacauuuacuguuucacucaguauaaguuuacagacguucauauaauaacccagcaacuccucuggaaaugucacuauaauuuaaacauuccuauucuaaucacuuuucaugaacuuagccauuuaucuauccauccuucuuuuacucaacacacacacacaaauagguuauaaccucugaaaguugguuucaagcaacuucuugguggugagauccaguuucacuuucauuauaaaaggcuuugaacucugaauuauguacaggugaauaaaggaaccauuauucaguguauugaauaaacagggaaucucugcaguauuuucauucuuauuccagugaccccugucgaguuuguacacuuuaguuaccugaggguaucuaauuuauauuaucuuuuugcuuuucuuuuucaugcuugauuucucuuaggaauuuccauuuuucccacauagaugaacaugcuauaaccauggcuucauuacaauuagucuuuauaaaaauaauacaugaauauuugauaaacugauuuauccuuaaacuaguugcugugagaggaguacaguguuuaggccacaaucaacagauaagaaaaaaaauagaaauuuauuuuuuucuaaagcagugguucucaaccuuccuaaugcugcaugugagugacccuuuaauacaguuccucguguugugguaauaccugaacaugaaacaauuuucggugcuacuucauaacuuuaaauuugcuacuguuaaaauaaguuauauuguaaauaucugacauauaagauccuuguaaaaggguagguugaccacaaaggggucacaacccacagguugacaaccacugaucuaaauggugauuugauugcuagucauacauagaaaauguaugcccuaaaacagaagcuaaaaaaaaaagcucauauuuccaauuguaggagaagaccugcauuguucuuauaacaaaauuuggcucuuugucagaaucucacaaaauucagcaucuuuaccuuuccugaucuucucaagauuauugagaacagaagccauuuuguugucagagucccugaggaagagcaggagcaaguucacuggcuauaguaguucugaaacuuuauugcccaucacaaacauacuugagugacaugacacuauguagguuccucaggaucacaccaguuucugagggaaucagaucuguucuuucaacauccacuaggugaaaacucugcagaguggauggggcagaacuucuggaacaaguccuuccgggagcauucaugcaguccguaacagauaguguagacuugccauuggacagcacccugcacacaggaacuuaaguguguugucuaccucaagaagugaaauguuggagcacuaaggaaagcugcaaggguagccugaagaaagcagccuggcaguagagagagaagaaccagaagauaaaauaaugugcugggauguuuuucucuugcaaucuuuaccuuaauaacaaagguuauuuugcuuuuauuuuguaaaacagaguugugcuuccuaaguauuuaucuaauuuuuacagcugcuuuuuuuagaacgucuucuaaugauucauuuauauaaaagucauaaacaaaugaguccugagacauaaagcugagaaguuaaaauagaaaguacucuaaaguaaugaccucgcagccuaauauacccugaaauuuauacuaugugucucucauucucaaagacucuacccaagagcaaaguggagagaugcauccucaggauacagccaaaguuaggugacauuggcagccagcacgcucacuaaacaaguagggaugagggaauuaguucacugugaaaauacuauucaauuucaauguuuucuaaggacaauuuggugauaauauacaggaaagugcauaucucauuuucuucuuuaaaaaaugugucuuucccugucuuaguagcagaguaauaaauaaaauaccuucuuugaauuugcauucuaaguuuucgaggcaaaacuuaaacauaacugcugccaccugguggcaggaauaaaguaucccugucuacuguguuuuaucuuacagaaagacaacuuuuuauuuuuaaaaagaauaaaaaucaauaaucaauauuauuauauaaaugaaaaguggauauaaauauuuguuaguauuuguuugauagguaaccacuugcuauuuuucuuuaguuaaucucagacuucuuuaacaguaucccaguaaaacuuaauuuacacuccaugaugguucuuuuuucaguucuuugauaauaaccauaaauaauaucagauuucuaacuaaaucauuugauaaucaguuuuauuuuuuacuguauagccuacauccagggcuauuaauaagguguugggcaucugaccuuuucuauuuugaacugcuuuucagaguuaucacuuuuuccuauugauguuuagauguguuuaguauagugguggugcaugauuucaaccucuauacauauauaucaugaagaaauauuuuaaaugcuuaaaauuugugugccaaugaauaugaccacugucuggaggugcauguagguuagccagagggcaacuuggguauuuuucuuaggcaccaauccagcauuuuaauuuuguuggcacuaaugauugaucccagagacucacgaaugauagucaaaugcucuacuacuaaccuacagcucuagaccugacccuuaaaacaguucuuugggggccuagaggagaacaggcugggcugacaggccagagagcacauagaucugccugccucuaccuccccugaacugggcuuacaaguauaccuagauuuuucuguguuauuuaugagaaaauugaauaacuguaauuaucuaacauuuauggaauauauacauauguauguaguugguacaaaaaauaaucaguuauucgaaauuucucaugaggaagcagaugacaggauuucuuguauuuccuguuauucccuuuaguuuaccugacuuccuaaggugggagaauggaaaaaucaaaaagaaaaacugggaaauuaaaacagagggugauaaagacauuauuaacuugaccaauuggggaacagcaauaagaauacuuagaauugauuuuuuuuuucuuguuuauuuuugaguucgguuugguuggaguuuguuuuaaaacauggucuuaccauguagcccuuacuagccuggaacuuaugcaggucagacuggccuccacucauaaugaucugccugacucgccaaggaucacuugggggugggagauguucuugaggaagggguguuugggaggagccaaagaaaugacucccaaguugggugcaagcugacaaccccauguucuacuccugcuggcucucuagacagcucauccagauaacucagcucucacagaccaaaaccuagucuuuuauugcauaucaauucaaucauccacucuagguuccuuuugauuaucucauaagucagcauuuuaugaccuuagccccuggauucuuagaaaaggacuuguacauuuuaaaaaaaaaaaaaaaaaaaaaaaacaauggcagaugauucagagaucugccugccuuuguaagcacaaacaguaagcuacuggcuaaaaucaccguucccaccacaccugagccuaaccuugcucuguuccagacugaccuugaacucaggaaugugucugcuuuuguaagcacaaagaauaaaguggugguuucuugcuccgcaaccaccacuacccaaaucucuuucucuccuuuuauaucuuucugaucugcuagcucauaaugcugccaccucugaccuuuuaggucagugagaccccucauauaauucauauugcaucuauauuuugcauaauugagaaaaccuguuuauauuuucaaacucaugguuuuagaguucuuucccagucuuaggacuguccugaaagucacagcauuuguuuuugcuaagaacauagauacacuguuucuaauuaucauagagucauuaaccuuggggggggguauauuucccaaaggaggaaaauaaauuuaugcacaucauuuuacaagaacaagccauacaguacauacacagcaaccaucagaacaucagcccacacccugcuggcucugcuccgggggcaggaaccaugucacacugucacuuccauggccaccuuuccuucaaagugcuaguauuaaagguugugccaccauuccuggcuauuuaacucuuuuuuuaaguuguggucaugguuuuauuuuauuuuauuuuauuuuauuuuauuuuuggcuguccuggaacucacuuuguagaccaggcuggccuugaacucugaaauccaccugccucugccucccaaguacugggaucaaaggcgugcgccaccaugcccgacauaguucuauuuucugaugcacauucaaggauuuuuuuuuucccuauuauuuuucaggcaaaugauacugacaggauguguggcauuugcacgucauguuggaccaacacguguggaggcugaacuuuuaccucaguguugggaacagguaaguuaacuguuuuuguuaguauuuugcucuuauuuuugaagguuuauaauuucuaaaugccaugagaaaauccauggaauguaaauuaugcuaccuuccauagcucggcacaugguuuauuugcacaaaagaauacucuggaauacccugcuucauucauucauucugcagauauuuuaaaaacacuaauuccagugccgguuacuaguauaguaaugagaauaacagugugaagaaagacagaggcauccuagugaggagaugagaggagacaaagacaugaugugcuuucuuguguugguaugugggaagaaaagcuaaguagaagaaaguugaacaugacagaauguguuguccuccacuuguaaaguccacacaguguuuggugaguuuaaggaagagguagcagugugugcucucacacaaauggaggacauacacaguuuguauauuuagguuuauuuuagauucaugcaguaugcaaaguguagaccauugauauagcagguuuguauauuuauaauaaaauucuuuuucuggaguaguuuuacuuuuauaauguauacuaauauuccaguccuucaaagaacucugauuuuguagacauaauaagucauuagcaccuuuaaaaaguacuuucucauuauagagacaagcuuauaaagccgaauuuacaauauuacagucucuuauucuuaagaaaaauauuggucacagguaacaccaaaaguucuaguccuaauuucuuugggcauuuauuacuaaaguaguagagcuaucagguucaguguguaaagugaacaaugugguaauacuuaccuuugacaauggcagacaacaucuuuuuauuacaaagcauguaaauuuaggguguauuucuaguuguuuaaagucaaaauuaacuucgaugcaccaugaaaccuugaguugauaaaucugugcaauuauucacgugugcauauaaauguuuuauaguuuuuccauuuucccuuuauaacuugcauuuaucaaacugagcauggugguaaacccauauaaucccagcacuuaggagauagagacaggagaagucaaggcuagacccugucucaaaaacccuaaaaaaauuuuuuuaauuacaccagucauggugguacaugucuauaaucucaguacuagugaagcucacuaucaaaagauggugugaguucuaggccaaccaguauuacaguagugaauugaaaggaagccugggcuacuuucucaaaagcauuccagaagagaguuuuguuaaauccagugccaccuagaguguaauuacuaaaugguuuugguguguucauagaguauuuacauucauuucugcauucaguuugaaacuugaagccuuuuauuacucccaacacaacugugcuccuagguuugcuguagcuauuguaggucucuuaaaucuccaugugaauuuuaagaucugcuucucauuucugcaaagaagccagcuggaagguugauugguuggauggguuggguugguugguugguugguugguuuguuuguugaggcagguuuucucggagacccuagcuguccuggaauucacucuguagacaaggcuggccucuuaacucagagaucgcauugccucugccuccccaaguacugagauuaaagguaugugucaccacugccugacuuuuaaauuuauugauucuacagauugaucuggaaaggauuucaauccuaaucuaaguuuagggugacuuuccauacaucaaagucuuuuauaauauccuacaacagugguuuguaguuuucagaauguacguuuuguacuucauucuuuaaguacuuuaguuguaaacugaaagagacucuuuuuccuuuguuaagugcagaaauacaauugauuuugaguguguacuuaaaugagacacaguacacuaggcugggacggaaugagauggaacuuuauacagcacacuaauguuaagacuuucucugcugucagagcaguugugaguggauuaaauuuagcuccaagauguuaaugcaugcaucuuugcuauagcucuuuggaaaucuuuguaauuauggaucaggaaucuaccuagccaccuaccuuuaguuuguugcccaguagauuucuauauaauuucuuuucuuaauuuuaggcaucuaaaccauuauugaauuauaucaucuuuugauaugggaauaugagaacagauauacuuuuccagugaaagaaagauuuauauucuaugaagaagacauaugggaacaaaacccaguaugugucuuuuuguuuuguuuuguuuuuuuguuaugguucaguguaguuagcacauagcaaaacuccacuguuuugcauauacaaacaggaaagaaaucuucuuuaaaaagaaacaauucucaucucgcugguuaagucaugauuaaccuguuugcuagcccuuuuagcagagagcagacugaugucuaucacauacuacaagcaagauuuccaacuaagacuugugcuucuguugcuaagagaagaucuugcuucuucugauauccuaagaaaaguguaguccuaggcaaauacuuaauuucuagauacauugccaauucuucaucuuuuauuuuuuuuucccuuuuuuuucuuuaacagauaccccugugccuuaauauuuagacuauccuugauucccuuauuccugauccagguauagccacacaggaauugccagaaauggaaaaggaagacaauauauuguagucuuagcaggauguauggugaaaaguaauugccuuugggagaagagaggguauguugcuuacacuugacuaauaugcuugguuuuuuacuccagauuaaucacaaauauccagaaagacgacugcucguggcagaguccuguggagcauuggcaccuuaccuuccuguaagaacgguuuucuuuuucuuuguuucuguuuagugucuuaucauacauuuuaauccaaauccucuuagacaugcuuuuuaaauaaaauaaagagaugggcaaacaaaaaaaaaaagaggcuuauacaaauguaauuuuuaaaauaaguauaucguaauugguugugugugcauauaaacauauguaccuauacucaugauucugacaguagguucugagaacccugggaaguuccuugugcuucuuccaaagaagaacauaugguggaaccuaguuuccuaauaagaucuuuuuuucucucguauacuuacacagacauugcugguacagaagcaguggugagcagaagugcuccuggaugguacugaucacagaggcagaccucaaauguccugagaaggaugugcucuucagagcccacauuccuaaaacaaacagcuugauuaaaaaaaauaaauaaccuugcuuauuuaguaaaauuauucauuuuacuaaauuuuaacccuuggauauuuguaauguucuaugacacaaaauuaaaguaauaauaggaaauacuuugacugcauacugagguuuggcaagguuuucaggaaaagcacuuagggcggucacuuuuuucugggccugcuuuucuuggggaaaaacacacacuuuugagcugagcuuauucagaauggauaugugacagacauucucauucucaugacauuguguggaauacauauagacaaaucauuuccagugauuaaaaauggaucuuaaguagguucuagaacugugggaaauguguauauacuaccagaagccuauacaaauuaguagccuuuuuuaagugaugaacguucuggacuuaaagaaaaucuacauuuuuaaaugaacaauauguauauuuuaaaugaacaauauguauauuaucauguauguauauaacaauauguauauuaucauucagucugugauggaguaaugaaauuuaaguagagacuuguuguggaauuugguuugcuuugaguuuugugaaauacagucucauuguaaacccuggacaggcugaaacuugcuauguagaagaugaucuugaacuucuaauccuccugaauccaucacccaugugcuaggauuacaggucuacauaaauacaaucagcucauagucuuaaauguuugcgguguucacuuaagaagacuuaauaaaaagucaaaacaaaagccaggucuguguuuuuauuuuauucuguuuauuauguauuuuaaagauuccaaaacaagcuuaggcuugauuaauuuuauaccuugaacaaguuucaauaacuacaaagaaggauaugaacuuggauauugauaacuuuauuuuuuaugauuuuuuaaauuguguguaaagacagggauaggggcuacacaugaaugcaauuguucaaggaggcaauauucauaccuauauagcuauaguuaacagaugauuuugagcugccugacauauggaauagaacuccaguccuguaacagcaggacagggcuucaaccacugagcuaucucuucagccccugauaacuuaauuuuaaucucauccuuuaagcugauuuuuaacauaacugggaacacuaguaguguggggugcuggagaguuagcucaguuuuaagcccugccuggcauucauguaacucuagguuuccagcauucacaccaaguguuucgcaaccaucucuaaauccaguuguaggggauccaaguucucuggcuaucacaggcaaugaugcaguguacacaagcccacacacucacacacacauaccacuuauaaaucaaugaaaagaaguuggauuaaaaguaagauaaggcacagcuguaauugacauuguuauuaaguauuauacuaaauaacauaaauaaaucauaaaaaaauauugguuauuuucagaaagaaauccguaguucccugguucuuucaauguugcaacagauguuaauggaagauaaggcugauuugguaagagaagcugugauuaaaagccuggguaucauuaugggcuacauugaugauccugacaaauaucaacagguaugcuuuucagcggaaacuucuuuuacccuguuaucaauuuuuaagaaauguacugauucagacauuugguugucugcaagugaggugguguaucuaagcagucaaugaaaaagacagcugcggggcuggugagauggcucaguggguaagagcacccgacugcucuuccgaagguccgaaguucaaaucccagcaaccacaugguggcucacaaccauccguaaugagaucugacucccucuucuggagugucugaagacagcucaguguacuuauauacaauaaaaauaaauaaaaaaaaaaaaaaaaaaaaagaaaaagacagcugcuuucagugcagcagcugucaagaaauuggaaaugagugugcauguuucccacccuaucucugcucauccaugauacauuaacacuuaagaaaaugggaguuaaaacauugucucaauuucuugaaauacauauuuguugcauuuucuuaaguuuuuuagaaauuuauucuuuuaacaaucuccacuugccuuuuucuuuaucagggcuuugaauuguugcucucugcccugggugaucccucagaaagaguuguuagugcaacacaccaaguauuuuuaccagccuaugcugccuggacaacugaacuuggaaacuuacagucucaucuuauaccuacacuacugaacaagauugaaaagcuucucagggugaguucuucccuuuuuuaaauaguuuauaauaguuuaaagggucuuuuuuagaccaucuuugagaaauuuugggaaauagagacaaaauguacuacuaagccaauaguguagcacauuaucacuaaugagagauuugagaagcuagaagagaaagggcauaaugagccuugguagcugaauuagcaucuuccuggacugcacaagcauuauauagaaagccaguucuccucgcauccucugaggacaugacugcuuuacaucaaacaucagcucuaguuccagauugcagagauaaguaaaugcucagucucuguagccuucuuauuuauauguugucaaaacuauuauaacaauaccuaccccaguauacacuucauaaagagaacuucauuguacucagaagauugaaggaacagugagaagauaauagauacuucuuuaucuaauuuuuguucuaaguguucuuugagaggcuagcagcugauauuucauagaugccuauauaaacugauaagaucaauacuuuaguuucuuauaaaagagagaccuuuuucacucuuagaacccuuuaagguauauuuuguguuuuauacagaaauuaggauuugguguguaaguaacuuaccaggguccuccagcugucauacaaaaauuuauaguuguuucugacuccaaacucuuauguucuguguuucaaauuuuucaaggaucuacaaggcucuuaucauaaaucauaaaacuaauagaugaucucauauguauauguauauguauauuggcuuacaucuuaaaacuuucuaaauuucacagugggcacuugaagccugaaguggcuuggucagaaaauguagggaucuuuuuuauauuaaguauuugcauucuuucuaucugauaauuaaccaugcuuugauuuuuguguacuuugcuaugguauaaauaauaccauauugcuucuaagugucuucaauuuucuacuuaguaauguuucuguauagaaauuaacugauuuagaacuuaacuguaacuaaguccuaucucuuagauuauagcagaguuauuuccuauuauaacaaugacaucucaaguagauuugaaugcaacaacuaccuuuaucucuaaucauaguguucagguuugggauuuucauuauaggauuugguucuggguaccauaucaauccuuuuucugucaucucuuucuuuuugaaguuucugcugcauuuuaucuacauagaauuguuuuauaguacuuuuaguacuugcaaauauagaugguaccaagugucucaaagcacuuaggaaauacagaaaacaaaugauucuacagaauuggcagugccauacuuacugugacuucuguggcucacucuaguauacaaaaauuucaaaagacaagacacuccccaaaaaaacuguucccagcauuggaaaugacuauuugcccugaguguuuuauauuaaagauucugguaugucuacagugccuucuugcuucacaauuuucauaaacaucucuguuaagugcauaugcauuuguuaucuaaaguagagguccuuaaauguuaauuggccauagaaagggaguuacgcauccaacuugcagugugauuucaagagccuaagauuagcucccaccccuuauauuucaggaaggagagcacgggcuggacgaacacaagcuccacauguaucuuucugccuugcaguccuugaucccaucucucuuugcauuagugcuacagaacgcaccuuucuccagcaaagccaagcugcauggugaaguaccacauauugaagguacuggacuggguucuugaaggaagguguagaauauuacccauuuagcuucccaaagaguuguuuugauucuaaucauuauauaucggaacagguacuaaaauguauauauaauauauagaaccuuguguuuagagacuauuaaagcuucagauaaauguuauaguuucaucuuuuauggauaagucauuugaaauuauuuugcaauauuugugcuucuguuacccauuagguagguagguggguggguugcuugcuugcuugcuugcuugcuugcuugcuugcuugcuugcuugcuugcuugcuugcuugacuuugguuguugguugguuguauaggauuguuuugggguuuguugagacagagccucacaauagugcaggcuggcaguauuuauagacuuuguuaggaagcuggaauagauaucucugagucaaugaaaaggcucguuuaauaauaacuagugcuagugugcgaaguuugccauuuccuuuuuuuuucuucccuagcucucuuauuuucagaaggguaagauaaauacaauuguaauuuuuaauaauaaauaaauuuuccuuucaugauagaaagaaauaagcaugugguuaagauuuuucucuccccacucccucauuuaaagaaaaugacuugucuuccaaaacucaugaaaucaggcugagaauacagaaugcuuguucaauaugugagcagggguacuagauucaauccccaggacugggauuaaggagaaagaaaaaaaaaacaucaagucacacuccuaguaaccaguaaaugacauguaauguagagcaggugauucauagccacacugcaguacaacuaggaaaaggcuguacagauucuguaccugaauaugaaauacuuuuguagcauuuuuagguuuuugugaaguuauuugugugucuuacuagcuucuguuaaagaauucuuauauuaaagguaauuuuaaaacuucaaacuuuauaaguugagaucccuuaagaauucaaagcuagucacuuuguaauucuaccacagcacuaacuuguccuucuaauuuucucuuccuccuccuaguuuucuguguuaguuugcugaugucuuaacaaaauaucacugguuagguaucuuuaacagcagaaauaugugaucuuguagcucugugggacagaagauauuuuaagaguaaagaccugagaacugccuuugaagccuacccgguccaccguccauaugagcucacuuugucuaaacauaccaauagcaguccaauuuccaaacagaagacuuuggagaggugcagagagacuagcucagccuauaauauugguuaucauucuuaauguauuuaacaaauacuccuugaaugccaacuguugccauccacuugucauucugaacacauuccuuauauaagcacuacuucaugugacucucuuuguuguuguaaaaaagauuuaguuccugaccugagguuucuauccuaccuuagcuauuuucaguucuuggaugaaaggcauacauaccuuuauauuuacaauaagccuucgacaacacaagagcugggcagcuaccuacccucugcuguuaagucuacuuuccuauugauaaccccaaguuauuacaauguuucaucuguaacuccaauuggccggcccucagggccauuuucuuauggcuccccuaagccaugacaucuuccccuuccuccucuugcacucuucccucuccucaugguacuguuagaccccaagcccacaaaaccuaaauccuaccuaugucucuucugcccagcuauuggcuguuggcaucuuuauuuaccaauuagaaauaacuuggggcagggccacucagcaucuuaugugcggacucucuugucucaggggcaaccagucuuggaggaaggggggggggcaaauuaacauuucaaugcaagcaggguuaagccaaccugcaacacuucauuaugcaauaauaauccuuugguuuuaguuacuguugcuguaccucuuuggcuuguggagguggugguggugguugagauagggucucucuaugccucugccucuggagugcuguuguaaaaggugugugccacuacacccagcuuuuaauuaaauauuaaagucguauccuucauuuaaguguucuguuuauuauaagugaaaauugacuaucaucuuuuaaggaauaucuacuuaucuauauuuauaucuugguauauaccuauguacaacuuaggguauauaauuuacuaugucuaaagauuugugguuuuuuuaugaaggaugauagaugaaaguuguuuauugccaguuauuucauaauguuaaccaaaguuuacaucaggcacuugggguauacucaugaacaaggaagcacugucugacauuuuaaaacuaaccuccagagauucauagcagauguuauucuuuacaacuacugugcacauuucauugcugauaaaacgcuauugcuuuaccaucuuauuaaaaugauauucugagaauuucuauauucaugaaugauagauuucaauuuuuuaaaacaguuguuaaauagacaaauauuuuaaggcuucuggaucucacucugcagaccagaccggccaucaacucagaggccugucucugcuuuccaagugcugugauuaaaggaauuuacuacuaugcccacccacccagacguuccuauuucuucucuguagcucaaaguuauccuccuaauugccuauuuccugucaucauuuuguuucuuuuggacucagauuuuagaaugccuucagucucacucuuuuuauagucaaucucaauccaucuacuuuaauucuaaguauuacauuguuuucuaaucugugccaauaauuuugaaauacaagcauucauuccaucauagaauaucggcuugcgcccaaggugauagaacucugguugaaauuguaucagauaugauuugaugugauguagaaguuuaaacacagguaccccucauuauccauaucuccuauugcugagcaaggcuaguaagaauucaagcagaaauccaggucgugauguuacccacgugaguucacauagcagccaugacugugcucuucacuuaauauauuguugaaugccuauugcagcacaagaguuugauagucuuauauuuagcuuggagcuuuuuuuuuucccugaaauuaaaugagcauuuauuaggauggggcagggcaugucugcagagggcagugguccacagaacaaggguuuaaauugucccuauuauucaauuaauagucauguaaauauuccauaauacuaugguauguauacauauauauacuaucaagauggcucaguggguaaagguucuugccaucaagcuugauggccugagguuacucucuaguacccaugugauagaaagagaaaaccugcuuuuaugaacuguccucugaccacuaugcauauuguagcacauguguaccacccacccaccccacccccugccaaacacacauacaggcaaaauuaaaauauaauuuaaaaaagaaaucugauuaugguccauaggauuacaggcuuuauuaauaugcuuaagcuuuuaaaauauacuaauauuuaccuguauauauucacauuuaguuacaugauuuaaaagugaguuuuuuuaguuuuccuucagaauuuuuaaguuuauaguaugggaccuugguuacaguaacuguauagauugugcuuuagcuuacugucacuggcuuuaauacuuuacauuaacucauuuuagacuaauuuuuuuaaauaaaacacuuaauauugaaaauuaacuccuaaagaaguuuguucagcugagguuuuaguauuuuacaucauuauuuucucuugugaaacauauuuucccugcuuuuaauuuuagucccuaggauaucuuuuauagauuauuucauuggaauaaacaguaugaauuauacauuuuuuuuguuuuuuuuuuuuuaacuuaagccguuuuuuauuggagucuuaccuuugaaccaauuuuaauuuaaccuacauaaacauaauuuucacuaacaaacuuucauuaaagcauuuauuaaaguauggggguuucaaauucucuauaauguuugagauuuaaaguuuauaacauguuaauuaaguauuagacugagggccuuauuuuguuuuggacagaauagcuaaguagccaaacuacuuuuuccuaugugauuuauuuugcuucuguuauuuauagugacuagguucccucggccuaugucaccucugcaagaugugucuacuauuauuggaagucgugagcaauuggcagugcuacuacaacuuuaugauuaccaacuggaacaugaaggcacaacaggcugggagaguuuacucuggguugucaaucaauuguaaguuaccaccucuguguccauuuuauauuaaauuagcucaguagaaaaaagcucauauuuagacuugagacagaaaguuuguaaaauggauuuaauuuguuuaagaaacauaaauuggcaucuucagagcaaagcuugaaaggcaauacuuauuacauacucccugggaguauguaauguuccgugaagaaacugcgucuuuauguuaugucaggacugaccugccaccuugaguuuaguagaaguaaagggcuuuaaacaauauucuaauuuauuaguuuugagucuagaaugaauguuguguaaaccaagguuuuguaauguaccaaacccaugauuuugaauccuguuaccuuaacaugcagaaaacuguuuuauagaaagcaguuaagacugauauuugaggaugugaaagccauccuuugcuuacagagaacauagggaugcagguuuugcaucugugccguugcaggcagauuauggagacagucauuuacaugugccccuccuguuuuucucucuuuucacauucagguugccacagcuuauagaaauagugggcaaaauuaauguaaccucaacugccuguguccaugaauucuccagauuuuucuggcgucuuugccggacauuuggcaaaauuuuuacaaacacuaagguaaauacuuauauuacaucuuuucuuauauucaagagacagaaucauaauaugauaauucuuuaacaaaguaaaugauaacacaucccucucuuuaucuguuaagaaguuaaauuuuaguaguauauuuagccucagccuaggguauacugagauuuuauuaugagaucugccacaguaaaucuaucaaaggcuuuuaccauaggcguaucaggggaaagaacccaguccuuugacuagugaucaaguuuuuugccauauagaacagauuuuggaagcaauugucugcuuagcacuugauaaaaccugaggugaggagccacagcaaccuguaacauuugcuucaaggguuccgcuucuuaaaaacagcauggagacucaaaugagugucuccaucauuaccagggugugguuugucacuguggccugcgauguuuacucuuucacauguuaaaauuuaaggacgcuuacagccaaugucuucuucaauucugucuucauagucuauugcuaggauaguugcuuaagagaacuaauuuuaaaagaguuuuaauguuuuuuaaaucugguuuucaucaagauacucauaguaaacacuaaauuucugcuccuguugaaucuguauuauugcaauguuuaaagcaaaaaaguauucuguaauagacuguugaguucagacuuccuuuauaguguauuagcugcuuuaauaaguuaaguaauuauuaguguuuugcgaaaugaagagauucaguauuaguucuaugauucugcagauuaaucuuuccccaguguucuuccuuuuagucugcauuaaauaugugaauuaaaaagacugagaugcugacaagaaagcaaaauccuuuuaccucuuccccagucuguuaccauuaucauuggaaauugcucaauaguuccugaguaaauagcuagcuguauggguucagaaaaacauuuaggagucauuuaaauauugaacacugcagaauugucuucaguaguuugaaaucuaugauaauuccauuuuuaaaaaccugagcauuugcucuaccuuaagauagugaagaaaaaaaucuuacuugaaggaauuuauugauugugaacaugcuaaccaugacaauucuaaaggagacuuuuuuuucaaauauagccagaugcuuuuuccaauaauucuaaucauauuauggugauauaauauuuacucauguaaugguaugcaggugagcuuuuuggucucuaaauuuaguuuuuaggaggaaauaauuuuaaguacuuaaaauuauauugaaauuauuuucagaaaagaaaccaaagacuauucugaaaauaccugcugauuugaauugauuuuuaucuguaaaggcccuguuaauuaaauauaauguguuucuaaccauuucaauauauaccuguaucaguaauaaguauauauuuuaucacuaauuaauccauaggucuuucuuuugcauuacuuagguaaaaccccaguuccaagagauuuuaagacucucugaagaaaauauugguaaguauguccauuauuacuuuaaaaaaaguugaaccuuuuuauucaggaaaaauacuauauucaguuacuauauucaguaucauuaaauuacauacauuuaaaagaguaauugaaaaggaaaauguguaucaugaagcucuuagucaucccucugagccaugucaguuaucuucccauggggugaauucuuccuuccucgcuuuaauuuuaaauaacuacuuugugaccaaacuggccuaaggccaaguuucucaaacuaggugcuuaauccuuagagugugcccuggugugcucagaauacuucauucuuaacaagcagcauuaauaaauaagaguggaaaugucauaaaauaacaguggaaaguaaugaagguuauggaagguuuuuguuuuuuaaugaaacagaaaauuuaaagaaacuaugggucugugugaucaaaccuugcauugaucauuuucacccaugugucuuagacagugcagguacagcaucacucuaagccaaugucacuggccuaagaaagugaucguguauaccucuuguaccccgguguauuuuuucaguucuaagaauaaauuauaaaacauauuaaauggaauauguagcaacuucuauuucaucagucuugaacacauagacaauucuuugucuaaaaucuuaccucaauauugugauuaggugguuuauaaaauuucugguguccuuagaaguaguugaagaaugaauaaaaugucaaugacaugugcaaaguacagguauuuuauuauuuuguuuuguuuugaaggaagcagaguuuaagaaauacuucccaaaauuuacagucucaguugggguuucuauugcugaaaccaaucaccauaaccaaaaagcaaguuggggagaaaggguuuauuuggcuucuacuucuguagugcuguucaucauuaaaggaaaucaggacaagaacucaaauaggacaggauccuagaggcaggagcugaugcaggggccauggaaggauguugcuuacaggcuagcuucacauuauaggacccagaaccaccaacccagggaaggcaccacccaccaugggcuggcccaucucccauugaucauuaauugagaaaaugccuuauagcuggaucucauggagacauuuucucaacugaggcuccuuugucucugaugacucuagcuugugucaaguuaacacaaaaccaaccagccaauacaguuaguuacuuuuaguagcuuuuuuuaaagaguugauauuuagaaugccuaauuguugaugcuuaaguugguuacuaauucugaugaugaguuagugaagaaaaaauuaauuacugagaauugacagcuuuuaaaaucaaguuagcugugaauauguagccuccccucccccagccuuaaugguuccacuguuuacaccuggguggagcuuaccggcucaaucguucugccacgcccacugcuggaaccugucgcuuuacuguucggagcgguacacgcggucacccugcuauuggacuccaagauuaauuggcgggaaucgggucccucccccuuccuuuauaauggagugccggaauaguaaaaauugaaccuugagcagagaccuuugucuugguuccuuccuuaucucgcgcagccuagccccucuucucuuccagguuuccaaaaugccuuuccaggcuagaacccaacccuaugaucugcuggccagacacaacaugaauaguugauuguucagaaugaaaaugaucauuaaccccauuuuuaaagucaggauugcuaaaugccacuuacuccagcccagauuuaaucuucuacuaccacugucauguucagcugacaccaauauccucccaugaaaaaguuagcuuuaccagcaaaauaaacuuuaaaugcuaacuaaugggaaaccuguuuuguuguugaaaucauaugaauuguuaaaucaacucaauuucuuuauguauggcucuggaacuaaauaaacuauaaaaauagagguacaguaacaacaucaaaaagaaauuuaagaacauagaaacuaaaacaaguguguaaacgaauuaaauaauuuaccucauugucaugucugaaaguuuucuuuuuuuuuuaagauuuauuuauuguuauauguaaguacacuguagcugucuucagacaccagaagaggacaucagaucucauuauggaugguugugagccaccaugugguugcugggauuugaacucagaaccuuuggaagagcagucagugcucuuaaccacugaaccaucucaucagcccuggaaguuuucuuuuuaagucucacuuuauuuauagacaacgacucuuagagaguggucauaugucacacagucaugguuggaaucucuugcuuuucuuucuuuucauuuauguaaucuaauuccuccuccaugaacauuaacagggcacugucuggccaaaaaccuacaguacauauaguugaggccuuuggaaacuagaauccccgagauaaaacaagcuaaaaaauguauaucuggguacuacuuuuaguuaagugccuuuauguuuuacaaaaugcuacaaccuaaaagcauacauauuuaccaagaccuggcuauauaggugcuugagagacucuuaaagaaagguuuugggggcuagagagauggcucagcaguuaagagcacugacugcucuucugaaggucuggaguucaaaucccagcaacuacaugguggcucaaaaccauucauaaugagauaugaugcccucuucuguugugucugaaaacagcuacaguguacuuacauauaauaauaaauaaauuuuuggaccagaguaagcagaaguccugaguucaauucucagaaaccacaugauggcucacaaccaucuguacagcuacaauguacucauauacauaaaauaaauaaaucuuuuaaaaaaauaaaaguuuaaaaaaggaaaguaaguuuuugguuuuuuauucuagaaacaggagucuaucccaauuuggcuauuaaguucacuuuccaucuauuagaagugugugugugcuaaugccacuucagaaguauuaaguugugguuaacaacacagaauguugucuucaccaaaaugcuucccaaaagaaucuuguaaauaguugugcuuuuaaauacaauugugauuuucugucuuuacacuuaaaguauacuagaacuuuuaaaaauauuuuaauaauuuuagauuccucagcaggaaaugggguccucacuaaagcuacuguccccauuuaugcaacaggaguccucacguguuacauucagguaagagaagaaacagucuuucuccccagugaaggugauuucucauuagacaguaccugauguuugcuugcugaggucaacccaaaaccucuagcuuaguugaaaauguuacccagaagaaaacaaaaacaaaaguguuacuuaggaaauguuuuauaaugagcauauuugaauaaaucuucaaauuaaguaucaauuuaacaaauaaauuuaauauuacauuacauuuacguagcauaauuucuuuguguuucaugauguuuucaauaaauaaauaacaguacauguauuacauacaccaaauuagaaaauacaguagaaacuuguuuuuaccagaguacccucuaguaauauuuuauuuuucuuaauuaccucuauauauuaaacuaccccaugacauaguauuuuuauagcaguuuuaaaccauugguuuaugauucugcagucagcuugucugaccuuugcugguuccucuguggucauucaugcugcauaagcuaaacguuggcaagggugacugagcuuuaacacccacaggaaaggaccucugucugucuuccauuaccugaccuggugagucaaaaacaugagcggaaugaaaguacaaugugcuggacuaaaaguuagucucagaauugacacaacuuaguguaaauaagucacaaacccaacccagauucaggcauagggaacuaaacuaggaguuguggcucauugcuuacugcugaggcaauagacugucacacuguauucgcuguuacuuuaaguaaauaucaugaucccugacaagguauauuagcaaguagagcauaagaaggaaaaggcauguuuucucugacuauuuucuggguuuucacccacagauaccuagcuucuuugucccuugaauucuauaagcaucacaguuaaaacucacuacuguacgguaaauaccagccaucuaaguucugguucuguuaaaaguagcacaguauuccuuaaagauuuucuaagugaauuucuaugaugucauaauacagauauucaauaaauuucuagguuagauauuuucagucacauagcauugacugaaguacuccugaaguuauguuaaauccaaacagcacugugaacaguaguauaauacuguuuucuucuccacuugauuuggaaguuaugucaacauaggaucaaaucugauaugaauuuuuuucucuuuuuuuuuuuuuuuuuuaaagauuuauuuuuuuuuuuuuuuuguauaugaguacacuguagcugucuucagacacaccagaagagggcaucagaccccauuacagaugguugugagcuaccuuguggcugcugagaauugaacucaggaccucuggaagagcagucgguguucuuaaccacuaagccauuucuccagccccccaauuuuuuucucuuuuuaacuucacaguuuugauagagguuugauucugaccauauuuuaaagcaugauaaguuaccagauacaaaauauggcauguaguaggacugggacauguaagucccuucccucccaaaguuguuuuuguauuagccuuuaucacaauagaagaaaguaacagaaacaaaguuacuuaaaacauacuuaaugcuauuaugaguaaggaccuaucuaucccuggagugacucugaaaucuaacuauauuacaauauucaaaauguuaagagcuuuuccaucacaaaacauuuaauaaauugagguaguaaucacagauugcccagguugcucauuucagaaaacauacaccaacaguuaaugguucuucuugcuaaauacuauuuguauuaggauaaaccacaaccuauaguuacauuaguaaacaagagcuaucuuggggacuagggauguagcucagugccugaguacugcccaccaugcacuaggccacacacaugaaauuucucacuuauauaaagcaauacuauuugauacuuuuuaaaugggaaguaauuacaguuaauuuuaaaaacucaaaagacuccaugcucauuugaaagucuauuuuuagaacuuauuucacuguaaucuuuuagacuuccaauuuguuucugaaaguuauauuuacucuauuugacuuuagugguaacuugguuucuguuacuuucuucuguugugauaaaggccuugccaaaaacaacuuuggaaggaaagggauuauuugacguacgugucccagucauggucuaucuuugagggaaaccaaggcagaaauaaagcaaagaccauggaggaauccuauuuacaggcuugccguccguggccugugcagccuuaugcagcccaagaccacuuguucagggacagcacugcccaccugggcuggacccuucacaagaaucauuaaucaagaaaugcccacagacuugccuauaggcaaucugaugagguaguuuuaucaguugaguuucccuuuucccugaaagaugaaauucucuaucucaucuugauuugauguagugcagucuuccuucuggaccuucugguguguccuugacuuguaucuuuuuuggcuguuuguccuuaaauuaugcauuuauuuccugggagaauaucagauuccuucccuuaugcauuccauucagauuaguuuuaccugugaucuuacagguuuguucauuucuuaaaaguuauaaugauucauugaauaaggcuugaaaauguuacuaauuuauuuuuaaucacaaacuugaacuguagaguaauuggaguuuucaccacugaauacugcaaacauaauucuuggaacuuuuuaccauuagaaaggcaacuguuuuggugguuuguauuagcuguguauagcuacuauuuauggaagcuaaaauugguaauauaaauuuuaauaaaauauuauaccuuaagaugaaccaaugaaacuuuuauaguauauacuauauagcuauauaucauagucauuuaauaccaaggauacuguccucaguauuuaaggcuguuaucuaguguggcuaaagaauuuuuuauguuacuuaauauuuuuaauguaaauauaaauaaucauagcuacuggcuacucuauuguacagcaagaucagauuaugauagccuuugaccuuuguaaccauggauacauuuaaugaauaauauuuuuaagugggaucuauuguccucaugugguaaucauuucuuauuaaagauagguaauuaugacauuuauuucuacuuaauuguuugggaauucaucaucaauauuuuuccucuguaggaagaggaccgaaagcuguuaguuggcuucuuggaagaugugaugacacugcuuucacugucucaugcuccucuugacagccugaaggcuucuuuuguggaacuuggguaaaaacaaaguagcuuauaggugguuuugcuuuuguuuguaaaagcauauuaaaaaaaaagacguaagacucgggaaacugagucuuaaacaaggaagggaagcuccugagugauagcagugggaagucccaccuaggaguuuaaaagaugaaaggagcacccauuccagacugaagcaggacagugcuuuccagaaggggggaagggagcuaucacaugcuucaacagcuagagaagaaacauaguauaaaaaauaugauuuuuuuuuguuuuaagguauauguaguuuuucagauagacuuauacaaugaaggaauuauuaagccuaaucauauaacuauuauuuuuaagaauuaacauuuuacauuuugaguugguuuggguuuuacuagauuauucuuaaauuuuuuuuagucagugugaguuuuuuuuaugagaaaagcaguacagacuaguacuuacuuugaagcuaguagaaaaauaugaucaaguacagauuuuuuaaaauggcuuccuagaaugaagagagagagagagagagccucacagaccccuuacucaguucccuguaauguguuuagucucucuaaucacaagucaugguuacccgaguacuuacagcucagucauucuuucucugugguacuagaaauuaaaucuggacccauaugcaugccagacaaaugcucucccacggagccucuuuuuaauuuuuuuucauuuguugugaacagaaucucacuuaguugcccuagcaggcguugacuugaguucaugcucuagcucaugcagcacuuaaccugguaauccuccugccuaaccuucacaucagcugcgauacaggccagagccccuagggugugcucucacuaauaacaccaucuucuauuugaauaggcuuuaaacuacaaccaugugacaaaacaugcuuuuguagaccuuggcuacauuguggagacuagccuagaguuugcuauccuuugacuucaccuccuguguucuguauaugggaauguccuaccauuccuguuuauauuuguaauuuuaguuuucaugcuauuaaauuguuuagaauuucugucacaacuauagaugcuaagaaaguguaauucugaagguacuuuuuugugggaucugagcugugauguaauaaacguacauuucauccauaugcucugccaguguuuuaucauuaauaugcuuauguguaauaaauauauauacacauagugauuuuucgaugcagcaccugaacauguggcuuagauuuuaauguucucauuuuucauccacagugcaaacccggccuaucaugagcugcugcuaacuguucugugguaugguguuguucauacuucugcacuugucagguguacugcugcuaggauguuugagguagguuacauuaucuugucuuguuucuauuugugauuuccuuuggaaaagaaaaaggguuaagcuuuaauaccauguuauaugugugugaguauuuauuuauugauaugugacauuaaguaguaucuaguuguguacugugugauggggcagaacuuuagcuuuggcaaauuaaagaauguuuucuagccuuauugguucuuuuaaauguuguucuugauuucauuucuccuuuaaaucuucuuugaauggcauccuauuaaauguuuuugauuguccuuuccuauuuacugagguaaauaacuacucaagcuaaaacaacauagaguauugcuuaaguuguaguauucuuauugguauuaaauacaguuacuugccauuauaguauuucuucacauaucauaucugaaauaggaucccugacacugacugcuuauaaggcauauaccuaaaucuuauuaacuuguuaucuuccuaauaugauagauaacuaagaaugccuuucaguuuauacauuagguaguacauuauauuauagacagauguucuuauauguuucuuucaaaucuuggaguccucaauugguuuaguauugaugcuauucaguuuuacuguagagccaggcuaccucaguuuaguuuccaucucuucuaccauuaauucuuuguuaauuauuaggacagaguugaacuugucuauacauuaguuuccucaucuacaaaaugaagauaaugauuaaacauauccuucucaaaugauuuuguuugguuuuuuuuuuuuuuuuuuuuuuuuuggguuuucgagacaagaguuucucuguguagcccuggcuguccuggaacucacucuauagaccaggcuguccuugaacucagaaauccaccugucucugccucccaagugcugggauuaaaggugugcaccaccacugcccagcuuuuuguuaauauucugugagcuaguaaagcccuuaaaauggugucaaacaaacaagcuguuauaaauguugguugacaugucacuguuuuuguaauuugugcuauucacaaaauauuaaagcuguguaaggaaucuauaaacuaaaauuaucucuuuaugccugugauucuuuuuuaauuuuuuucacauacuauacuuugguaauguucuucuccuuccucagcucuuucuagaucauccucaccucuuacauauccaacuucaaguucuuucugucucucucaaaaacaauuaaaaaaaaaccaaccuuaaacucaaauaugcucuuaaaaaagaaaagaaaagaaaaggaagaaaaucaauaggacaaggaaaacacaaaaacaaaacagaacucaaaaacagaacucaaaaagaaagcaaaaagaacucaaaaaacaauaaagagggcaugagcccugcucuggagugugguugauauauaccuagugacacuccauugaagaaaacugauuuuuccuucgcucagccagggaucaguugcaaauagcuucucuauuagggauuagaacuuaaaauguuuuugagaagaauuaauuaaaaucuuccuaaauuuaagaauuucucuauaauuuaagauaaacugcaauuagaaugauaaaauacugaacauauuuaaaauacuugcuuucuauaauuuucaguaacuagauuacucaaaccugaauaaaauucucuuggccaggaaguugaaaguuuugucccuuuuuuguuguuguuuuuaagaugaucuauaauuaagguuauuuguugaagucaaugccagaguaauuuugauguuuuuaucuguacaaauuccuucuuggauaaguaacuuugauuauucaaugugcugaaaaguggacauuaccaugaagauggcuuucuucaugccucucaaaagaaaaaugugucauuucaaaagcugucauuaauauacucuucaugcaauuuuacucuaagacccaaaaaccaacuucuuucucuugacugcuagaagguauguauauuucaagcauuucaaauaaauaaaaguagcuucccccauuucacguuugguuuagcuuguguguugccuugaaugcuugccacucaaaugcccaagguucuguguucugucccagggacacauaagauuagauguggugcugcagaauuuaggcagguagaucaaaaguuuauggucauccuccaaugccugagaguucaaggccagccagggcuaccugagagcuuaccucaaaaguaaaguaacaggauuuaauaauagaaguaagaaauugauauacuaggaauuuaauuugaaauacuuacugaaauuuaacacaaacucagcuuuguuuuuagauagcaagacauggagaaacccaaugggauuauguuauuccuggugcugaacaagaugcuauguuuuuuuugaaguagaaaaugaauguaauucuuuucuagaggaguacagugacuuucauguuaauuaaccuucuagagugacaaaguacaaaaaaaaaaagacaucacgugacuauuaaucgugagguuacugaacuauaucauuaaacuuuaacucaaagaaaggaccgacaucaguuaagacaaauaagaacgagucagucugucgucugguucuacuuucgacccugaacaaaugcacauuucuacaagucugagauuuucaucugcuaaaacuuugauaauguucuguauuugccucaccagacauaaaaaucaaaagguacagaauguaaaauagcuaguaauugauaacuccuaaaauuauugacuaauuuucuagguuuuuuuuuuuuaauuaccaaaaggauccuagagcagugagaaauuaaauuguccucuaaauuacccucuuugaaaugaugaauuccagauacuaggcaucaagauaggcuuugcugauucaaacuuaaaccaucuuaugcaaagaauuugaacuccuuguccuauuuauuccuaccugaacuuaauaucacucauaaaauaacaaaauaucuuuugugauuuuaccccugccuaauuaauauaggcauuuaauaaauuauuucagaaugcugaaauugauucugggaugaauggguugauaaaugguaauggauuauugcagauuaaauacuuucacauguuaacuaaguuuuucauacuuuauaagaggaaugcuagcacaugcacagaggugauuuugauaaugaaaguccaugguagcucugagagcuacaacuagugaacagauugauuaggauucagcaguuagauauacaucagauuuuguuacagaugguugugagccaccauguugcugggauuugaacucagaaccuucaaaagagcagucggcacuuuuaaccacugagccaucucgccagcccuguacuuuaaaauuuauguaagcuuuaagaaaauuacaagaaaaagacuguuucagaaguaaacuuacaaauguaauuaaaugacuucuuuuuauaaaaauuccaaaucauauauuauugaguaguacuauaacuaaauucauauuguaugcauugccuguguuguaugcaauauuucuugcaaaaugcaaaauucagcauuuucagauaaguaaacaguccugagauucuguaacuuaucuaaggcugcauggcuaauagugggagagagcuggaauuugaacccaaagcuaaugucuagguugaacacuccagagcauauuguugcaguuuaugucugcagcucagcucagaugauaaggcugugugaggacagguugagaguuuuacuguguggucuuuaauauccucucuguaaaacagaagcacuuuagugauggcuacaagccauuuugaaguuugcuuucaaaaauguuuauuugucuuuuauugaucauaauaaaauccuacucaguugacuuuuaauaauuuuaacuaacuaguuauuauuaauacaguaugucuccauuuuaggguuuugguuuuuuguuuguuuguuuuuuguuuuuuugagagcugaguauaguggugcaugccuuuaaucccaacaaaagagucagaggcaaggggaucucuguaaguucaaggccauccuggucuccauagugaguuccagggcuacauagugagaccuugucucaauaaaaccaagaagagaaacuuuucauugcauuuuaauugaagaugaaaauugaguauagucuuugaccuaaagaacaaacugccauccaaauggugacaagccucuuuguggacugcuaggcaauuuaagcuuucuuuccuucuaagccuucuaugccuugguaagcacucuaguagcaguauucgcuuagcuucuaauuuugguuuugcuuuuguguuuucucucuuucucuugguuguuccucucuucuucccguggcacacuguuugcuuuccaugcaccaccugugaauccccccugugcugaccaaucagcuguuggugaagggggugaaugagacucugguagcucagaggguuguuccugcucucauuacucucuccagugacccugaaauguaaguguugucccugccuuccauguccagcauuccuuuccuaaugugccuggugagaaauaaccaucaugcuguuaacagucacuugaaaauagugacaguggguuauaggccuauuugauuuucaacuuaccauguugcuauuaguacaccguugagguuguuuuuuaaggcaaucucacaauaagccuaacuuagaggccauauaauagagaaaaaaguauuagcaugaauaaucaauaaacacuuucaaaaccaaaacaugcugauggacuauuucuucaagccaagaaaggaugcucugcuaaucucacuaacagguuguuaccagugaguguaguggcaugaaccaaaggcuuaacauuuuaacgucuuaaguggacaacuaaagcaagaaaggccagugagucugccugcccauccucagucacagcuaacccaguucucauuccaguuuaccaaaccauuuuuuauugcauguugacugguuuacagcugacucuucgaggcaugagugaagcauuaguugacaagcggguugcuccggcccuuguuaccuuguccggugauccugaauugugaguucacagacugugacccugaguuauccugccugucuuauugagcauucuucuuggucugcucuuuaaaaguuuaacugucauugcuagagacuaaugugggauuucuaccuugugcuuauuuuuauauauauguuaaugaugauccuauugucuuucagggaagucucagucucuuuccuuuuucauuucuaacagcucugucaggauugcuacaaucccagcauuuggcacuauuauggaaacaguuauucagagagagguaggacauagacauuuguuuacacucugugccaguggugaugacagauuucugaugacauacccaaagguggggucagggagcauccuagcuuuuauggcauuucuuauuacuuaccagaaauuuaaaaguaccauaguuuagacuaauuguuuauuauuuuuuaaaaaguguuccauuucuguauuagaauucucaguuaaaaaauuaacuuuagccuagcuggauauaaccaaccugcauacauucuuuuuuuucccccuccuuuuagauaaaaucucauuaaauagccacgacuggucugauguuuccuguauaggccaaacugucguuaaacucacaggaaucugccugcuucugccuuccaagugcugggauuaaugaugugcaccaucaugcccagcguacauauuuuauugucauaaaacauuaggaaaacaaagcuaucucccuuuuacagaugaaguagaggagggaccuaaacccuaauaacugucauagaugcuaccuuauaaaauccucuaauauguuauguagaucuuguggcuuguaccacuaugaacccugacuucccugcuucagguguuuagcaagauuuuucuccaugaagauuaucuugauucuaaaacuaugguuucauuucaaagucuuuauguucugugccuaacugcaaccuuacauaugacacacuucucaagguacuggagagaugauucagugguuaagagcuuuugcugcucuagcaaaagaccuggguuuaggucccagcacccauauggaggcucacaaccauccauaacuccacuuucagagaagcaagaugcccucuucuggccucuccaagcaccagguacacacauaguguguguguguguguguguguguguguguguguguauacacacauacauacauacacacauacaugcauacaugcaaaacacucauacacauaaaauaaaaauucuuaaacacuuaacaaaaugaguuucagagguuuuuuugcuuuuuuugucauacugggaauauauuuaguacaaaugaaaaaaaaauuguggacuagaaaauaagugauuuguggacauauuacucaucaaaauaaggaauucaaugaaauuugauuuuguaaagauucuuacaauaaaaacuaaauuuuuaguuauagaaagaauauuuucccccuuuuugugcucuacauauuucacugacaaagcagcagaaaaaagaacacaucuuucugcaaugcuugcagucuugccagaauuucaacauggucuuaaauccuaaaaauacaaugucuuuuagggaacugugaguaagauguaagucagccaugacucacugcuucagggguggauagcugguaccuacacuaugguuugagacuuauaacuuagauacaaaagcaaaaacuugaucaacuuuuccuuacguaguuggcuuuauuuuuuccacuuguuuuuaaguuuuuguuaaguguauuugcuuguuaaccuaaauuaacaaggcuggagagauggcucagugguuaagaacacuguuauucuaaagguacugaguucaaaacccagcaaccacaugguggcucacaaccauacauaaugagaucugaugcucucuucugggguuucugaagacagcuacaguguacuuacguauaauaaauaaauuuuuuuaaaaauuacugcagaaacagaaagugagaucuuuucuuaauaagaaaauuucacuauaaugguuuugcagugugaaucuacuaccacaggccauuuuuaaucacccuaacaauuauuguuauuguucacccuaacaacauacuccaauuuuaauauucuauuucugauuucaaguugcuagaaagagugaagaugcaguuggcuucuuuccuggaagacccucaguaccaagaccagcauucuuugcauacagaggucauccgaacauuuggcagagucgggccuaaugcagaaccccgguuccgagaugaguguaagugaccuuucuaccuguuccucauuguuccaucacagccaggagcuugucugagugucaaagccuugcuguucuuuguuuucguguucuaaaaacuauccuggaacugaucccuguuguguuccuaaauaccagcuauaaaacacugaguagcucgccaccuguaguugcuuaagagacuuucuuaaucaacauuuuauggaugcuuuugugcuucuaaagcacagucacguucuuacuuaucccucuuggcaugcugccauccugguacacuacuuuguuuuaauuuucagugauuagaucuauguaaugauaugcuaacucauuuucucuagauucuacuuuguauccuuuauaguggcccucauccuucauaacaguuucuuggguggcaucaaacccaccccagcauguuugguauccaaaaacauguuuguuauacacucuaaaagcauguuuguuaucacugugauagaauuuuaugguccuauuaguuuuaggaauuugccauccuuucuagaggaucauaggauuggccacuuaagucagugugguuucuacuguaauaguguauucucuaauagacuguuuauuauauagccagguuuuuuuuuaaccaguuuuaagaucagaaugaucaacaaaauauauuaaguuauugggacuauagugcccaaaagguuugugagggcaugggcacuuacuaauacaaugagagucucugcucauuaggugaauguacuuauaauuaguuagccaaccaacagaacaagauugcucuucuaguuaugagcauggacacucucaguguuccagcaccacauuuacaugaggucccagucaaagcucugaagguugacauugagacaguaguuccuuugaaggagagaauaauuccuagcaccuagauuaaggaauaugcuaaguaacaaugggucuuuggcuuaugccaugugguugaaucuaguugcagguagagcauuguguaaccuacuuacauauacccacaagggagauuugggagaagaagccaucgggaucuccgugagcgugcugugcaacaguuccuuucauggauccauggaggcuuuguccuuuguaauucuaggcugacaguuauuucucagagcaagcacuaucuguauuucaaugucuccuagaauuuuuaagaacuguaaaaagcagaucuaauaugugauaguuuuauucauguaauagaugccuaccuauuaaauauguaaaaauuauguaauaggaaacaaaaaacuuuuucuuuucccauuagucccaaaagaacaguuaaagguaaauuuaagaaaaccuuuaguugaauagaucuaguuaacuguugucucugauaccucuuuaaaacauuuuuagggaaaaagggaaauuugauucuuaccaccccuaccccuuuggccuacuuuccuguucaaggggcuuuuaccuugaggaauuuaaugucaaaucuguaaauaugacuuacagugaaaucaagcccauaucaaaaacaauucuauauuguuaacucuccauauuuauaguuaauccuccugguacuuaaagaaagaguagaaaaauuggaauaacuagauuauuucucagucucuuccuuaacuaacauuaguucuuucaguagcccuguuauuucccaauuuuccauugaacuuuaggucuugcaucuauuugaaauuuuguuuugggguguguaucuguguguguguguguguuugccugaauauauaucuacauggaagccugguaccugaggaagccagaaaggaauaucagauccccugaaacuggaaucaaagaugauugugauccaccaugugggugcuaggaaccaaaccccagcccuuugcccaauaagcaccaagugcucuugaccacagaacaauugcuauagucccuugcuucuauuucaaacaucaguuguuuuaucuagaacaauuuucagcuacuugucagggccacuaggagugugccaucauacuuuggaggcuuucuaaagacccauauaaaucuacuuugguuugaguuggcuuccuuugguuuccauacucugccugucccugaacuaaugacagucucuugccucaaccuccaaacacugggauuccaguccagguuucaauccccagcuucagauucucuuucuagauuuacuucagguccaagcauuuaaaaauguauaaauaaauaaauaaauuucuuugcuuuagcuguuguaucugccuuaagaucuuauuugaaagucuccuaaaaucuaaauucuauguauuuauuuuauuugcuauuuuaaaucuuugccuaaucacacuugaauaaaagacuucuuagguauuguaucuuauuuuucuuucccacugaagaugaauuuuagaauuauucccacccugguuauguguuaugcuguguuccuagacauaaauuuccuuauaaaagauuaccacugcugugugucuugguucauuuguuuaucauuuuuuccaaaugggagauugggaggugaggugaaaucaccuguccucagaacuaacuggacaguagcuauagugauaaaaccucugaagugacaaaucacuuaacuuagaaaaacauacauucuagccuuauaagaaaaggcauaauuauacauuguaaaguaugagaguuguguauaugugauugugauaaaauuuaacaauuucuuuuuucuuucccuuuucaguuguuauaccacauuuacauaaauuagccuuggugaacaacuuacaaauuguagauucgaaaaaacuggacauugcgacucaucuuuuugaagccuacagugcacucuccuguuguuguauccuugcugagcugaacuauauuugcugauauaacccacuauaaaccaguguaaacccacagaaaacccagcuguaaaaauugaguagacuuuuuggcaguuuugauucaauuuugccacagcuguuuaccuaucucauaaguuuuuaaaguucuuuuuaguccucuguuuauauuuuauaaaaauuauaaagcccugaugaguuuccuacccugagcuuuacuauacagugaacaguaaaugcagggcagaaugaaucuaggcuuucauguucugguauuggauuuuucaaugaauguuuaacuuaaccagugagauucuaugaauuucucuuagagaaauguuacucucuggagaaguucagggccaacaugguagucaugucuauuaaccaaaccgggagaaaaucagugguccauaucaaccacuagacuauaaaugauuaaaccaaggcuuaaagacuauagugacaacuucugcuuuccauaguuaaaagcaaaacugagcuggaacaaugagcuucaacuguucuguugaaucuucugucuauacuauguuuaguaaagaaaaacuaggaaggaagugaagaugggccaagugaacucuagucucugacucucaauaaaaggagaguucaagaaaaggaaauaagggguugggaaggguggagagcugaauucucaauagaaccacaaaagcaaauucuaagcaaguaauuagagaauuacaucacagaaaaaaagaaaagaaaaagauuaaacuuccuagugguucucauagagaaagucaggugccaggaagaguuucagaauacugcaguucuguguuauaugccaggucacaguccucaccagagggagcaggucauuugaaauacgauaaggauguucuccugauucaucagugcuggauuuuuuuuaacucgaguauaaccauggacgguugcuuuuguucagucuaugggacuguuaauacucaggaagcaggguccacugcucuggacuauuacaagucaguaacugaggacugauuacgcauggucuaccuauauggacaccaucagccaugcuucuuauaauguagaucauacaguaagcagaggucuaauauuuuaguuugauaacuaaacucuguguccuuuauaaguucuuuuccacuaaaagcagaagucacugucacuccugauucaucuugcuggauuuuucaacuuagagaagauagaggaaacagaugaggaacuaauguugugaguuggcaaggaggaaucuuuuaugaagaagugacagaacucuggugagagaaauaugauggugugagaauuaguagcucagcugugaaaggguccguuagaaguuaagcaaaaacuaguguaauuuaauuagcuaauaguuuauaaagaaauaugcuucaaggaaagggaaaaguaucuggacaacuuuagcuguguaaaccagaauuuuaaauaagaaaaccaauaguuucuaaagaacauagaaacuuauacagagaaagugucaaguauuuaaguauguauaaacuauugcugggauagauaaauaaaaagccccuugccaggacaagaaggggaagaagagccauuuuagaguagcucccauucagucaaguacuggguuuguugugcauuacuccaaccuuacuugagucaagacuauagcuauuaagaaagucucauugcccaggucuguuccaaagcugauuagaacaaagcuuccuugcagaacugacauaggaaaguuacagguaacaauaggccuaauagcaaaucaaaugucaugacaugcuugaaggaccuuaaaaauguuuaagcuggagaguagauggcuuaggagugaugagaaaauuugacaagguguguguggcaaggagagacgaaugaaugcaaguuggugcgcauggaggacagcaguuaauguuggguggcaaguacuuuaaaggaaguuacagagaaggaaggucauauacuguauauauaagggauagagacagguuuuacuaauaaaaaaaaacuuuauuacagagcuauccaaacugcaagagcaugucuuaugaaucucuaaaugucuucuuggcagucagagguguuuaaucauuuaccacugagguagaguugcuuuuaauauaagauaggacuaaaugauaggcacauuuucaguccuugaaaauuugauuuuaugaggaaaagauagucccaacaagugaguugaaagaauaacuucccuauuuucuguaagucuggccaucuugagccuccgugccuggguuucaguauuucacuuucugcuaaugcaaaggucaccgcuuacaucuuggagguacuuucccaguaucuagaaaacaagucuguacaguaauuaagcuggagcccucuguaucauguauauauuuaaauuaugcaugcaaauuguacacagugacacagcacaagugcauguggaagucagaagauaacuuuccagaguugguuuucucccaccuucguacuugugucagcaauggaacucaggucaccucaggcuuguguaacaggugcuuuuaauacugagccaucucacuggcccugucuauauuuuaauaacuauugaauuuacaaguuacgcauucauuauaagagcuuuguuuaugaccauagugacauuuucaaggaaauaguaauagaucacaucccuuuuuuucuuaauuaaguucauuguuuaaaaauuaagccaguuucauaaaugaucucuucuuuuuuucacuugaacaugguguuauuuuacacaagagcuacaauaaaaauaugcccgaauugaugugaacuaauaagaugaauuauuucuugauaaaugugacugcuuucugauucuuuugaaucaacuaaaacucaaagauggccaggaccuaaaguaaauugaauguauucuggugucugauucauucuggaccaauagaaagucaccuuagcaggugucaaaaccaaacaaaaaaacucaugugacuggagagaaagcugguuuagaccacuggcugcucuugcagaccaucuguguucaagucccagcacccauauagugguuuacaaccauuugugacucaagucacaggggaucugaugucccuuucuggcuucuucagacaccagaugcacaaguguuacgcacagauauaugcagacaaaaauauccauacacaaaauacuauuuucagaaauaaacaaacuaggggcaacuaguaucccauagacaaguuauuucaaccuaaaucauacacaaguguugucauugguugggcugucacuuaugugagggccugcugguuauagaugagcauaauccucaguuaaaccacauccauaaugcauaguggaucuuaaaagagaaucaaaaaacaaucugaugauaaauaaccaucucuuuguacauguuuacauacuuccuuccaaucuuuugcaguugucuuacauauaacaaauagugaucuuauaagcaacuugccguuagguuguuacacagcuuucaacuuagcugugaugaaagugugcaagcgcaugugcucaucgugugaaggcuagaggucaacucagguggugguccucaggaaccgucuaccugaguuuugaaaagugucucucacagguuuccuccucucucucccucucugaugccaggauugcagacauaccauuacaccacaguuuggaguucaaguucauguccccaugcuuguacggaagcacuuuaucaacugagccuuuuuccuaccccacuggaaauguuuuauauuucauauuuagaauuuacuuaauuuaacagauuacauaauugaauguucaucaucauuauuuuauuuacauaguauuuaauuaauuuauagaauguuagaguaacagauaacaccaaaauaaauagaaaugugagaauacacuuagaugaauguuaguaucaacuuuccccacaaaggcacugucugugaaggaagucugacacaugcuguuugcugugccuaagcacuaucuagaaaacauuuuuucuauaugaucucuucucuguuggcugagguuuuugguugguuggugugguauuuccuuggggagugggguucuuuuuucccccuuuuucuuaacuaucuuuccucagucauuucagaggauuuaaugguaaaucacuucuuaccuggccucagauguuuacggacugacauggaacaucugucuccagaacaugagguaagugccugugacuagccgcgccagguuuaugaaauuuagcaucucucuuuauucacucuuuucucccugggugaggcaagauuauggcagccaugcuuaacacuuuuuaagucuagcucaacauaauuuugugaguguguuuacuaguuguaauacuucagguucuucaauaucuuugaaccucuacaacucucuaaaguaggaauaacacacucuccuucacuugauaugaggagaauuuaauauggaaauuaaauuucugugggauauugacuucaauccacuccuucuugccuauccacuucuguccacuccuuuccuugccuaucacuuguuucuaacucuccgauucuauuucuccccagcauucuguaccuacuccugacugucacacucuuggcacauaagccuacuugcaugucagagccuugacccagccucuuuauaggggucccuaacacuucauccucuuuugguuuuuacacuuguuuagacugugguuuuuaguauuugauaauguuaauuuuauuucacuaaaguaagugacuuuucuaaucagguuauuuuaaguuccaugauaaaagaaugugaacaaaaaguagaaaacaagacuguccaagagccuccaggguaagacauuuauucuuuuuuaaggcuucuucaguuucucucucuaaauuugcuaucuauagauauaauguuuuguauuauuuuguaaucacuucuuuggaagacaagaaaauuaugcaagccagguguggugacauauacuuuaaucccagcagaagcaggcagaucuuugugaguucaagaccaaugguaugcauaaugaauuccaggacagucagggcuacauaguaagccccagucucaaaaaacacaaauuaaagaaaauuauucaagucagcuuuuucucaaguauugaaugaaaucauaagaaccaaaaugagaagcggugaccuuuugaagauugagauuucuagucaaugcuuuguaccuucccucuaaauauucugaugcaaucuugaggaagggugcaugcauggguguacaguauguguuuucugacaggcacaaauaugcagugucacacauggaaagauucaaggacagcuuacaggaggcaguacucuuucuaccauucagcuucugaaaauugaacuuagguugucaggcuugaugacaaaugucuuucuuucugagucgauuuuacaguucccagccuagaaaucuuuauguuuaaaggcuuccagagacauugcuggaauugugcuacuggguugagccuuaccagucaaauaaguaguaccuauacauuuagaaugggaguuuucaaaugugagaguguucuagcaaagcuaaauagaauucagagagucaauuggguuucaaaugcagaugucuaacaguaauauugaacauucgaaaaugggaauaauuuacauguguuacagauacuauuauuuucaaugaagaauuaagauuuuugagcaaugaacaguaaauaaaauugaaacacauuucguuuaagguugaccacagaaauguuucauucagucagucugaguucuaacacauacaaauaagcauauacauguaugugcacaaacacacacauagcucaugcuccucccaaagcuaguacacauacaagucccuugggaauuuuccucaucuucuaugaugaaaagagcuucccaacacacuccauccaguguuuuaccuauaguucugccuccuguguauuuguguugaaauugcuagugugcaccaccauuuaaaacauaaauucauucuaaaauuaggcaaguugauuguaacuugccacacauugcccuugguuuguucacacacguuuccuaauuuaguccucaggacauuuuacaguagaaacugcaagcucuguucuauagacaaggaaacggaaucuaaaugggaucuaaagcaucuugaucaaaaccacaaugcaguacgcuggguuuccugucuacugcaggacguuugucagggcacugaaaaguugugccugaucaggguucucuuccuguuaagcagugugguaaauaagcaaucuucagcagucauucagauuguguuuacucccugcauacuaggcugcuggagaaaagaagaaaugaauuuguaaaucuauucauugaaauuaguauaauuagcugcucacaacaugcgcacucgugcacgcacacacaaacacaaagaaauagguuuauuggcacagugcaaaccucacugugauuuaguuuacucauuugggaaauaaguaauaucuauguuccagacuugcuguaagaauugaaugacgugauagaguuaaaagaacugcacaaggcuaggaggguaacucagucagcaacugcucgccaugcuagcuuuacaggccccagaaccaguuuugagguuugauuugguguguuucuguguccugugugugucuaugucugugugugucuguguguguguuuucguuuugguuuuuuucguuuuugguuuuuggauguagugguaccuccaagguagcagagacuuuauguuuguccugccuagccaaauuaguaauucccaggccaauaagaaaucugucucaggugggggugggaagcgguggauagcuccugaggaacaaagcaugcaggcaaaaggauaaccauuaaacuaccaacauuuguagagugcuauaauguacuauaagcacuuugcacuguggagucccaaagggccccauugucuagauaaacagcuuccucaaggccucacagcuggaaagcaaagucuggcaaacccugauccaugugugguguuaacugcugcugcuuuucauguaaaagagcaaaucuaagauaauacauaaaaauuuuucaucacaaaucuuccuuaccuuugugugauauaaugauaauaugucacuaacaaaugaaauacugaagaguccccaagguggcucaguagguuaaggcacugccaccaugccugaugguggaaagaaccacaaguuguccucugaccuccacacuugugccuucucuuaaauuuuuaaugcuuuacauucuuuuuaaauuuuucuuuucuagcucaaugucaauugcugcaaguuuagugagugaagacacaaagaccaaguuuuugaacaaaaugggccaguugacaacaucaggugccaugcuggccaauguguuucagagaaagaaguagaagcgggaggcccgccccgguggacacuaagauggaccucaaguagacugcuccuuguacuugaagcgcuuaccuuuugauuuccugacuuuauguucuuguguuauaauguuauccuaaccuccaaagauauuugcacugcuuuuaauuauugcuguguaucuauuucuuuggguauuauaacugugguaauagaaacuugauuuaauggucuguaccaagucccuauucuauguucuuauuuuugagaauaacuuuuauauauaauauauauauguauagugaagagggguuuuuuugcuuuuguuuuuuuaauuuuuauuuuuggaugggauauucacaaauaucuguauuauacucuaagcuauuacaaugguacuuaaaauaauguaaauuugaagucauuguuauaaaguaauaaaaguggaaauuacuuaaguauuuaaauuaugaaagaauaaugcagacuuuuuauuauuucuuaacugacuagaaagagccaccagcauuacucugugccuuuuggacuugaguuuguauguucuguaggaacuacaugcauuccuuucacacaguauuucaggcugcuguggugaauuugaauggcagauccuacagucaauagauaaugaugagacuuacaacauuucacaucucucuugagaauccuuuaagugcuguuuagccucccaacacauagaugcauaggauggaguucccugaggaaaacagcacuugagcauggugaggaguagccagggugaauuucacaacauuuguacuagauuuagaugcucaagaauaaauguacugagaagaguuaauaauuguuuauucccaaauugaaauacacaagaaaauauaauuuaagucugaaauuuaacgccuacuuccuauaacacauuuuaggaugcuuucugaugauuuaaacuuugcaguuuacuuuuucauccuguaugagaaguacuaaguaaguuuaggacauuugggguuccuuuuucccuucuaaagugaaagugauguuaguuaaguuauuauugguuuguugccaccugguaccuuaaacucgguggcuauucccauugcuguguuuuauuuguauagucuuacguugauagacagccccacuggaauugaccaauugucuacacagcgacacagaguguuguguaugaaacggaguaacuggcuuaagggguuaaugugaggccuuacacaguugacgcauauacaugauucucauauuuauuguguaaauuggcuuuaauacacuuggaucacauucacuuccuguggaaaagcuagcuuucccaugcagucaaagcuuauaaaguuauuugccuuaggcaaagccauucauuucuuuuaccuauagugaaauuauugaauaguaguuuuucugaacuguuggauucuaggcauuccugagaaauugaaaguggcuaccuuucaugucaaaauguugaucuguuauaaauaaauguuuugcauacuuguuuuugcuguguauuuuguuuucacuuugaaucacuuuauccguacaaaaauaaauuauuuauucaugaaaauaca

SEQ ID NO: 323 - RNA, 32667 nt, Mus musculus
cauccugggugacugguuagcgcgugugcggaugacgaagcggaagugcccgggccagaggcgggaccagagcccuaaggggcucgaaauuacggaaguuuugugcggagggucggguggcugcuggaguuccugcuggauuuacggcuccggagcuggggcugccgcugggggggucucagagccgccagccuccgcacgguuugcgguggugacccgggcgcgacucgacggcgcugcugcgggccuugucuguaguaggggaccccucggaucuccaccauggcguccacgaacaccaaccugcagguaccgcgguccuucugggcuccucugggccccucuggagagccggagcccgcggggaaggagugggggcgggggacugagaagcggccgcgccccuguccccggcggaggagggcgggcccgcgcagacgggacccgggcgaaggggcgcuucccagcggggccggccuuggcaucgccucagccucaaggucugugggacucuugguuugcuugugagauuggaaaacaaaacagcggaguuugggccgaacugggccgaucucuccaaccaggaagaucuccagucuguccaccaagaagaaaggaaaaggguuuuuuuuuuuguuuguuuguuuuuguuauuguuuuucccaaagcaguacuccggaccaguuuagaauaagguuugccuucucaguuccuuacgcugauaaacaaagacguccagguauccggugaauaggccaagaaccuuagguuagagcgagccuguuggcaccauccccaugaauucauuaagaguauguucucccgaauuacugaauuuaagaucagggaguauuuuaaucuguaucuucacuuucccgcccucaucgcaaaacaaaaacaaaaaguguuuucuagguacauuucggauuccuaagauaauguuagaaagggguuauugcugcuucguggaacggugugcauuggcaaauguuuguaacgccgucucccaucauccuugguucguccaugggguccagaagaauaaccaagacuucuagccaaauagguugguuaguuucuuaccaaggaguaggacaaaguacccuuaaauauuggucuucugguagucaaauagguauuuguucagugucugauauaaguaacaaugauaauguaaacauauuuccuuaacguaggauaauugauucugaagaaauuccacccaaaggaagggcauuugaauagggaucacuccacaccaagacggggaguagagguuugucuagugggucuuauccugaaacucaaccuaaaagauuaugaaugauugcucucuuuuauaaagucuaaaugcagccauggcucauuuuuaagaauuaagaguaaguucacuauuaaucuguauguauauuuuuuuuuccacagaguuuuuguaaccuuauauuuuguagcccuuuucggaaaaugcugggguuuuguuuugguuguuuuguggggugguuaguggauuuguuguugaugauuuugcuuuugugaauguauucguugauugauaacggcuuuccuguggauauuaaagauaauuucauuugugguacucaucuuucuuuuucaacauuuguaguuugauucuguaaccagaaugcauuguauguuaauuggauuguuggauguucuucagugagccaguuagagacugaaaaauauuaaaaguauagcugugagugguaagaaggagggauguugagcuacaguuguguuagugguuaguuccacugugguuuuucuccaucagacuuuucagcuuucuaaccaagaaaauuuugauaaagaauuguuaaaugaguaauuuccccaaggaacaaaauaaaaaucuuuguaaauagaugcuuuuaaucuaaugcggaaugcaaauaaccaagaaagcaaacaacaacaaaaugccaccagaauuuaaauacaauuccauaagauuauaacagaauuagagguuagugugagcuggcaucccagaaggguguaucucacucuuccuaggauaaguaagacauguuucucgaaggugcugagaucucagauaaaauaggcaccgacugugauuggcucaguguuugaugugaucucauugacuccucaggacagcucuucaaggccaguguuauuccauuuucacaguauuagaaacucgaacuucuugaggugguggugugcccaaagagagaugccguaaauuaguguugggguuagcuuugaauccaggucugugugcuuauaugcuugugguuuucuuucccuguaaaauucuguguacuugaagaagaaugcuuuccaggaagagaaaaaucgcagaaauguaauaaaaaccuugcagagaacauaaaguuaaaaccaaaggcaaaccacuccuaaauguuugcuguccauauaaaacuaucccacccccaucagucugucccuccaucuguccauccauccguccguccuugugugugugagcaugugccauagcauuuguggguggucagaggacaacuuggaguuuguucucauuuucuguugaaugguuccuaggaaucaaacuuaggucaucaguccugguggcaggcguccuuaccuacucccuaccuacuguggcaggcguccuuaccuacuguggcaggcguccuuaccuacucccuaccuacuguggcaggcauccuuaccuauucccuaccuauugugguagcucacuagccccaugccuauacucuuucccuauuggaguguuuaugcuccuuccuuauuuucauaugucugcauguauuuuaaauuaaaauuuauuguaaaauuacaauuuauuguauuuuauguguauggguauuuugccugcuuuaugccuguguuccauguguguucuugaugcccauggaggccagaagaggacauugcaucuccuggaaaagaaguuauagaugauugugagcuacccugcagguguugggaacugaaugcaggaccucuggaaggccaguguucuuaaucccuggaacaucucuccagccucuaaauuacaaugcuucgucaaaguuuuauuuugaaggccagguaggcaggcagaucucugugaguuccaggacagucaggacuacacagagaaagccuguaaaaaguuuuaucuugagaucacaugcaauuuucagaaaugaugagagguauccaguagacccuuuccccaguugcauguuguaaaacuggcacaauaacacaucaggauauugauguugacacccucugcaggucuuacucaucccccaguuugaccugugcuucuguguguguguguguguguguguguguguguauuaguuugggaacaguuugcucgucaaaccacugaaggcuaucuggaacauucauuuauguacaagcuuugugggauugucuaggagugcaguucuuuguuuauauuauuaguuaacauauuuuguucaguaaauacaagccaguucuccagaacugcaaaaccauuauacgcucucggcauucuuaacagcaucgaaguugucauuggcuuuaauuuuagccauugugauagguaucuguuuuuuuuuuuuucauugugguuuuaauaugaccaauaauaguaugccaucuauauggucucauugaugaaauauauuaguuaauugggauuuuuaaaugugugugugcagccgugucaggacagccugcaagaguugguucucuucuacuguguggguuuauugaaucaauuagguuggguagcaaaacccuuuauccgcugagccaucuucuggcccauucauaaauucucuuuaaacuguuaggucuucaggaucccuuuauguguucuaguagauguuucuuuuugaucugauguuucacaguguucucccagucuauacuaugucuuuucaucaucuugucaggaucuuucagaaaacaaauguuuuaacugauaugcuuucacguuaacaucuuuucauuuuauacauugugcuuuuggaauuaaaucuaagaacuuuuuucuuuuugguuuuguuuucuaaaaguuuuuauuuaagucugugcucauuuugaguuaguuuuuccuggacauacaggauuuaaggcaagauucuuuuuuuuugcucccucguggaugucguuugcucuaauacgauuuuaagagccuacuuccucauuguggacuugguucucugucacuuuuaaauaguugcuuggcuauguuuguaugguucuauuucugggaaggucuuccuuuuuaaaucucuacugaaggucuuaucacacaagauaugaaaagguagaaaaugaauuugggucaaaucaucaacaaaugccccucaaauacuuccauguuucuaaaauuuuauaauauuuuaaugaccuuuuaauauucguugaugugauacuauuuugguuuuuuaauaucugugcucaguaucauuuugggaaccuuucagaauauuaauaucacaauguugcauacagaauuuuaucucugcguucuguuuaugcuuuaggcaaagcagcaccaagguuuuccagaugcuguaaguuuguuuuaugugaauaggucuugugccugugcacugugccugugcaaugugccugugcacuguguguaugcuugguacccacagagggcagcagaaggugucagauccccugaacugaaaucacagaacuauaugaccugacauguggguacugagaauugaacccaggcuucccagaagacuagcuagugcccuuaaccccugagccaugucuccagucuaacaguacuuaauuuuugagaauuucccuaacuacuucuuuuuaauuaaauucacucugugccuccacccccuuauguauguugggggguguuauuugcuucaaacuuaagauuuaugcuuucauuuuaaguguauuguuuugccucccucacacagaaagcaauagaucuugcaagcaaagcagcccaggaagacaaagcugggaacuaugaggaagcucuucaacucuaccaacaugcugugcaguauuuucuccauguuguuaaauguaaggcauguucuauucucuuuaaaccugugcacuaggagggggaaaugguacauuucuaaaaguugaaauacaaagccaagaggauucuaaaaaucuaaaccaccauuaaagagaaacuccuuucccuagcuuuuaauacuauuaagcaaugugccagcuauuguaauuauuacuuuauauaccaguaucuuauugugcauucaguagagugaauuuuauuuuauggauagauaauccagcuagauuauaugauuugaacaaccauuuucugagcauauguugaaaguuauuuucuuguaaaaauagguagggagguauuaaguuuauuuaacaaauucuuauuugauauauauuaugggccaagcucuguucugggaacuggauagucagcacugaaacaaguacaugaaaaccuguaagguccaucaccaaucuuauacuuagcaccauugggucacuaacaaguguuuaacgugaacuuuccuacuuaauuguaggggagaguguauguuaaaacggagaaugaaauguaacauauaagagacaugaggauaguccuauguguugcccauacugcuaaaguccacauuucaaaacaacuacaauagaaacuuuaauauaaaaaaaauuacaauguugguaguccacauaauguagacaauuuccaucucuuuguauacuuugagauaaaggagacaaagaucuuaauaaaaauaguuaacuauugcuuauauaucuuuuauaucaaaauuuuuauucacuucuauuaauuuucucugucaauauaugcaagcaguauacagagaauaaauccagcuucuacuuuccuaacccuccaguuucagcuuuuaguaaucccuacugugcagucauaguugucuguugucgcucuugugguugguuuuaugugagauaaacaguguuuagaugucuacaaaugguuaagggaagaauuugaaaccuacagauuguuacuuauugauuaugauauaauauaacuuaaaauaucuacuauuuugcugugagcuuuuuguuucgauuuguuuguaaacucaaacccaguguuggccuccuacucugaguggaaaaaaaucgaagagggcugaugaucacuggauacaaugaauuagagacgcuuucuccucccuccuccaacacagaaguuccugguuaaagaauauaccucuuugauucuuucucuggaugcugaagaauaccaugacagaaaacacguuagggaagaaggcuuuauucugaucugcauacaguuccagaggggaucuggcccaucaucgcagggaaggcgaggcagcaggagugaggccagccuuguuugggaucagggaguuaacugacuacaucucaucaacucaugggaaaugagacaacaggaaauagagccagguuuuauaaaccucaaaguccaccccagugacauauuucuuccagcaaggcucuaccuccuaaauguucuguaaccuuccuauauagcaccacccacuguagacauuuggauacaugagccugugggggcuccauaucaaagcacaacaaauacuaaugacauagugucucguucccuucuacagaugaagcacaaggugauaaagccaagcaaaguaucagggccaaguguacagaauaucucgauagagcagaaaaacuaaaggaauaucugaagaaaaaggagaagaaaccacagaagccugugaaagaggaacagucaggcccaguugaugagaagggguauguauguauucuaaaguguuagauuuuauauccuauaacuuuucauuugugaaauaggauucuuuugucucagccagggauuuucuaaccaugguucaugagccuaaguggguuuaagccuauuucagucauuaaguuuuauugagacauagccuugcacauccacuuacauacugucaucucaggcaguuuuuuuguuuguuuguuuguuuuugguuuuguuuuuuuggguuuuuuuguuuguuuuucgagacaggguuucucuguauaacccuggcuauccuggaacucacuuuguagaccaggcuagccucgaacucagaaauccaccugccucugccucccaagugcugggauuaaaggcgugggccacaccacccggcagcaguuuuuguccuauaacagaguugggugguuacaauagagauuguguggccaggaaacuggaaaccaucagaccagaguugcuagucuguacugacugcacucucucucuccuaccuuuuuucaagguguuucaaguaauugggaaaacaccacagucaugacgccagcacaccccugacugucaguaagacaguacuacuguagaagggugugaucugugaauuacaucugaccuugugcacaaagggaaagcaaacucuaacagugucauuaauuuuuauuuuaugcaaaagguuuuuuucucuguggauuugcauuaugucaucaugaagaaagcaacagcauaauuuuugaaguacuaagcuccagguuuugaaugccuuccuagaugcaugagguaucaaaaauguagagagcguuuaguggaugcaugcccaacucugcuaagcagggaggacuuacucuagccagauuugcucuugaugguccuacaaaugagugccagcaugguuccaaaugacguuaggaaagugagauuuucaguugauauggccuggcuggauuugaaacacugaggaucugaugaguucuggagccugagaugcccacaguucauguucugcaagguacaugugaugaccaaagucaugggggcuagggauggagcuguucauucagugcuccccucccauguuuguucauggugaaacuuugcccauuuacuagacaucgucuauuuuaaggauggggcagauauaaaaauuagaguuagcugucuuaaaguguguggcagaguuugaagaaaauuacaaucucagaguuuuauauucucuguugaaauacugagaauuuagguuagguuaggaaaacagugucuguggcaugccaagaguauuuuauauucuguacauacuaguucccaacaugaaaugcacguaaagggaagaauucaucgugagcguacagggcuuccacaucucacaaguaucuuuuccacuagagacauuggaucuucccugucugcugggacacaugcaauauuacugaggaccccguagucaucugcuguccaguggcagccagaggagagucuaucuuucuuuuauacuaauuaucaguuacaagcagucgaacucacuuuggcugauuuaauuaaaaggaaagguauucuugcagggauuauuuuauagaauuuuugaguacagagaaucaaagauggguucccaucacuaagagaaauaaauacccaggauuccauuuggggacagagaauuguaaauucaugccuaugguauuuuauguucaaguagagaucuugcugcugccaccucucccaugagccauuacuagggcucagaaguacacagaagaccucugccucaguuuccucagggcaaaccauggucuuaccugaagauuuguucuucacacaagcaaccuucaccuugggggacuucagguuugcugaggaugaagggaacuuguauugaaugaucuguacagcacgagauaacaugaauaagggguuggagugucugugacucaguucucaguagucacuucaucuguaacucugccaugccacaaauaaccaaggcucucccacccagucauaaguccugucaaguuuuucaacccucuguauauauaaaaaucuaaaaguugguaggauuuuucuucucuguaucacuuuuuuaugcaacauuguagcaggaacauuuccauuauguguuucuacaacauuguuuucaaaagcuguaguguauuuugugauaagccauuauugaacauaauuauuuuugguuuuuuccacaguuguacuauagguaugacuguccuuguagugaacuuuaaaaauuaucuccucaauguaacucccuagaugugauauagugcuguucuaguuugcuucucuacugcugugcuaaaauacuaugagcaaaagcaauguggggagaagugaugucauuuuuuuuagaaaguauaguccaccccugagggauucaaagguaggaaggacucaaggcaggagcuuggagcaaagcaugauggagggaugcugcuuacuagcaugcuuucccuugcuugcucauccuuccuguaucgcccaagcucaaccugccuagggauggcacugcccagagugggcugggccuuccuauguuauuaaguaaucaagauacugccacacagaugugcccaccacacugcaguguguacgaggcaguuccucagaauccuucgaagguagucucgguuaggucacaaaagcuaaccaacacaaguggguuggcaauuuuuuuuuuuuuugaguuccuaagauuuucacuaggaaucuuucucuguucuuguacauuuuuauguauuguacccuuucuuccuaacacaaaguccuguugacuuacaguuuucgccugguccugauguuuuucauuguagcucaucauuuuccuuuccuuuaaguccuuuauagaguagcauggggcacucuccugugauuagguacaugacagguaugucacgagggugcagguguuccugacuuuagcccgcucuugucuguuuccaguguguacuuuccuauugauuauuugccuguucucuguuuuaauauauucuuaaaagcguuauuugaaacacugaaguaaaaaucaauuuugaugucagugucuuugguuguguaaauauuucagguuaucuuuccuucacuuuugcauuguuuauuagcagugagugaucuuuugcauauauuaaauuuuuuucauuaggaaugacagugauggggaagcagaaucugaugauccugaaaaaaagaaacugcagaaucaacuucaagguuacuguggauuucauguuucaauuuacucuuauugaaaguacucauggacugucugcuugaacaauuguauuucccucuuuuucaucaaauuucaaaaaauggcuuuaguugcuggugggucauauacuggauugguuccagauuaggauuuacugucaaaaguuucuaauaguuaggauuucuuuucuucgauagauuuaaaaaaauaaaauaaaaucugccuuuaaaaguaugccaucagggcuggugagauggcucagugguuaagagcacuuagcugcucuuccagagguccugaguucaagucccagcaacaacauggugacucacaaccaucuauagggggaucugauguuuucuucaggcaggcagaguuguaugcagcagaacaugcauacauuaaauaaauaaaaauuaaaaaaauuaaaaggcugccagcaguuacuguuuuucacuuauuugcaccuuguaaacuaggcagcauugccacuauuaucacacuacaaggcccaaggaacagcauggcuuaggaguuauagugauccuacugccauggcugccauuggcuggccuguggcuucauuuccucccuguucuuuuccucuacuuuccaguuucacagauaugcuuauuuuauuacauuuucuuuucucuuuuuauccaauacauagaucaaagcccuuugacucugcuguccuacaguauaguggcauaauggaauggcugcaguuacagaucuggaacacugaugauuugccacauaaaaguuuucuagguuugggcaaguucuccaaccucucagaaucugaguccccauccugaaaguggacauuucuuguagggaaaggaaaucaaggcaauucagagaggucuuaguaaauucuugaggccugaugaugagcucaggauaucuaaaaagguauccacguaauuucugauuuuuuuaguuauucuuuuguaagccagcuaaugaccuuccaaguauacuuuaugcuuaggcguggguaguuuguacuuguaccauuaagucaccuaaaaaauauuuaacuagaaaggauucccauuuuauauacucaguuugguuacuagauagugagagugaguucuuauguguaugcgugugugugugugugugugugugugugugugcgcgcgcauaugaaugugcgugcauguggguguguauacauauauacacauaggcuuguauguaucacacagagguguguguacauaugugcagagggaugugugaauggauaaauguauauaugugcagguguacauacauguauauauguguauauaucuauacuuauauauguauauauuguagagggugugucuauguguguacauaugugcagagggcugugugugugucuguauguguguguguuauagcuuuaacuuuacuacuuccuucacuuugccaauauuucugucuuacauuaacccacuguuauuuaggaaaauauuguaaaccugguacauugaaacccauaagcuagagagcugagguuuuuggguguugguuuuuguuuuuggauuuauucuuuuauuucuacuuagguguguguguguauaucuauaugaauauaugccgcauauguauggaugcccacaaaggucaaaagagggugucagaucucccuggggcugguaguaacaauuguaaauugcccaagguggguucuagaauccaaacuugauuucucugaagaucauugugugcucuuaacacccaaccauuucuccagccccuaagaauagaguguuguuacuguuacuugauugguuugguuuaguguauguuuguaugcugagaacuuuuguggcaauagauaccguccccgagagaacuuugaguuuauacugcuguacugcacugcccucagugauacaauguuuacugugcacauuguugacaguuguacacuaaguagacuuuuuugaguguaggacaagaagcuguucucuguuugucuugcuaguuugaguuucucccugcacaucuccccaucccugguaaaaaguagaucauauauucaauuuugaaaauuaggguuuuuaacagagauuuuuguaaauuccuaucaacuguaaauccaaagacaacuuaaauauagaaaccuuuggagucucaguaugaaauaguaugaauggagcuuuagccuuucuaagguggggugucucucucccucuccuuuuaaauacacacgcacgcacgcacgcacgcacgcacgcacauaugaaaacagugucucacagaggccagauuagcucuaaacuuucuguagcugagaaugaccgucugucuccaccucccaagugcugggaauagagguaugugccaccaugccuggcuuuugaccaucuuuuaacuuaauggguuguuaauggauuauuauuuuuauuucuuccaaccaggaagauaguucaguugguagaaugcuugccacacagcauggugagaaccugaguucaagcccuauguacaaaggccagccacggugacauacgucugucagccuagugcuggggagguggagcuagguguauccaucaggcaggcccgccugccagccuagccugcucagugagcaccgucucuucaacaagguggauaguccugaggaauggaccugacguuguccuauggcuucucauaauacacacaugugugacuguacacauacaaacacauuaucauguuuaaaauuuuuauucgugaaauaguguuuuaauauuuuacuuguguuuuagaugaugggauuuaauauauaauuguuaugauuaagauuuucuguuagguaauucaggaacuuguuugauuuuuaauuuuuugcauuuauuuaauuuacauguacauauaugagugagagagagagagagagugugugugugugugugauguagaggacagagggugacuucaagcaucuucuuagauuauucuaccuuaguuuuugagacaagcuuuguuaaugaaccaguucagcuuggccgacagccugugaacuucaggaauccucccauuucugcacgccccucccccccaaccucugaggugggguuauagaugugcaccauuagaguuuuuacauaggugucagggagucugaacgcaagacccucacacuugcaggugcuugcuuugcugacagccauuucccagcacaagaguggcugcuucucaucuuagacucuuucuuuagugauuuacaguaaagcaguucuuacauaaaauagcuggaagauucuucuaauaaagugcaggcuuuuuuuuuuuaaauaacauuugcuguaguuuuuaaauguacugcuuugaggaacuaaaucaucccuuuaagaaacuuuaauuuuuuuuaaugauucuguuuaaaagcuagacgaaaagugcgacaaacucaagaaagaacuguagaucuuuagggacacguuugucuuuuccaucaucugcuccucucucauuucuaggccuucugacuuuccccucagucuuuaguuaaaaucacggaaguguauucucaccugagaguguuaacaagagaaacaguaaaccagcccuucugggaaguacguugauugcccagggccgguacacagcucugauacugugucaccugauccuugugauagccugucuguguugcuuuccuagguaggauuagugucauugcacuaaugaggcagcaaaaauguaggcauugaguccaauccuuagcuguccagccacccaccuaaguuccuuccucuugaugauuucuaucugcuuccuccuugcauuacuguaaaaagguuuuaguacuuagaacuuuuccagacaauuuuacgcuguggguuuuaaauguugcuuucuagcuuugcugaacuagucuuccucaguugaaaaaugacccaauauuuugcaggugccauuguuauagagcgaccaaaugugaaguggagugauguugcuggucucgaaggagccaaagaagcucuuaaagaggcugugauucugccuauuaaguuuccucaucuguuuacaggugaaauagcuucuuaucaacuuuauuuaaaagaaaccaguggcuaacguagagcacugaguucugacauuaguaaauacaucuucucagauauauuccuguucauguguauauuuguaaguaugcauugcaaaauaaucuaauugucagccaauaaggcuuaagguaacucaguggaaugcuacauacucauuaaaauacagugagcguauucauauuaagaaauuuaagcccacaugauaauuuguugaaacauguccacaucuauuauaaguaucagaaaacaaauuauaaaaaacguacaguaugaguccauguuuaugaaguaaauguguauucuuagaaguaaaugucuauagacuuuaaaaugccaguaagugccuagagaauacaauuacagguuaacuuuacccucugaguuuuaucugaauuugugcaguagucacguguuaguuuucaagguguuuccaguuuuuaaaaagaggaguuaauuaauugacugccucagaugaagugcacauccuguagggacagagaacaccauccuuaacccucugaagagaggucuccugacccccagcaccuggggauaugauagcucugguucuagcugcagcguaagugaccaucugcacugugcugaacugucuuuucauguccuuuuugugacuggugaucucugugccugugauaggacuguacccacagucuaacacagagguguuuuguuuuuguuuugaaaacaaguugguucaugcugcaaacugaacaaguucaaacauugaugucacagagagcagauacagcaaagaaucugggcugcaucucaccuaccucacucuagggggcugcuuauauauagcucaguccucaggacacacacagagggacauggaggaccguauaagucaaugugucuguguacuggccuuccagcucaagguagcauggcauuuaccuuccugccugcuucuuccccagagaccucuaacagaauagauuuuaccuguauuugagcuucaaguuuucuuguuuacuuuuacuugacuauaauuauuuuuaaaacuacuuacuaucuaugaugaaugaaagaagugucugucaaacauauuuaaaagauaaucacuuaaaaguacauauuaccuaaaaucauuuccuaucauacuaguauucugugcaccaacugagcaguacagcguugacuuagaguagugugcauuuaaaagagaaaagugguaaaauucugaaagucaaguaauauuaaucuaguuuuucauuagucaucuagggacaguucuacagacacuagguaccuaucugcaauuuuuguagacuuuuaaauuuauucuauacaucaugguauauuuuaggcaacacuauaauuucugauuagccaaauuaaggcacagaagauugauuuccuauccccucauuucuuuuaagcaguaguaggauuuacaauaauagcucccacaucauuacccaaucuuugaagcugcugaugguagcacugacuugugcuuucugguaaaucaggaacuccuuagaaaucacaagucccccagacugugaguucaugccuuguccuuccuccacaggugauagaagcaagucuuugcagcagcccugcucuauggcugcaguuuuccuguauuagucuaguuuugagcaguacucuuuaacugaacuuugucccuggggagcagagaugcuuuuguccgucuguuucucacagugucgucuccauacaguggcugagcagaugagugagcaaguaaaugaacuuucuguccacggaagcggugaaugcacuucugauaauguuucuagacgagcaaguuauacacacuuaagacauguuagacuuuuuuaaacuaucuuuuuauuuuuacugauagcuuuccaaugaagaccuuuuuacaguaguuuucaguguggcuaaugucugaaguaagugaaaugaauagucuugaaauucucauguuuuuuuuaaauacaauuguaggaaagcggacaccuuggagaggaauccuauuauuuggaccaccaggaacaggaaaaucuuauuuggcuaaagcuguugcaacggaagcaaacaacucaacauuuuucucaauaucuuccucugaccuugugucuaaguggcugggggaaagcgaaaagugaguggugcauugaaagucuuuacguuggucccuggacgcuaugguaacuugggcugucugugguuaauggguuucaaguaccuuuccuaagaacucaggggccgggggagggagcauguaacaauagauauucaucucuuggucaagcucugggccaggcuaggaauuuauuuuguaggaaaaaaaauaguaaguauguguaugcguuuguaugcugucaugugggugcuucuauaacucaguggacuguguaguuguaauuuaucauucucuaccccgacagcaugacuaggccuuggugugcaugguucuuagaacuccuguguauugcuuugaucgaugggggccuuuagugccguucaggagcugagcuuuacuuucucuucguagacugguuaagaacuuauuccagcuugccagagagaacaagccuucuaucaucuucaucgaugagauugauucucugugugguuccagaagugagaaugagagcgaggcugcacggagaauuaagacggaguuccugguucaaaugcaagguaggauuguuggauugcaagacacuuuccaauucuuuuuucacuauuagugggaaagaauuuaagcagaauuucucuaaaauguuauuauuuccauuacuguuuuuguuuugagaggucucacugcauagcccugacuggcuguuaacuuccuacagagaccaagauagccucacagagaucaccuggcucugccucccuagcacuggccugugcaccaucacucccugcaggaaucugucauguuuuuaaauuaucuuacaggauucacaaauguuaucaguaaggagauuaauaucucuacuaauuuaccaggugcuucaugaaagaacaauuugaaaagaauauuaauaguauuugucuguaauauaggguauuugcuucuucagaugauuugacugaaaccugagcagcauggugaagaugaagcacguugcuguuauuuagagcacugccguucuuaauggaacaaacaaacgguguguguguguggugagagagagagagagagagagagagagagaguuaguuuuucuuuuuuagcugcaaagaaugaaauugggucauuugcagaaaaaugaauauaacuagagauaaucauauuaaacaaacuaagucacccucagaaagacaaauaucuuauuuugucuuacuuguaguuccuagauuauaugaaauauguaaacuuacagguaucuauaugguaucaaaguuaagucagcugccuuggggaacaaaggggggucaugggaagggagagaugggaugcugcaggagaaugugcugagugccuuccaugcuucuuuaaaaacaucucucugcagcacugucauccauagugaggaugcaccagggacucuaaagaagaaaguaccaaaguaguacuuuaaauauuaccuauuuuaaugcaggaguugguguggacaaugauggcauuuugguucugggagcuacaaauauacccuggguucuggauucugcaauuaggcgaagguaugaugauagauaaacaucuuauugcuaacuuuagguguagcaauagaugauaauuucccuuuccuguauaagaauuuacucugauggcuuuuugaaaaaucaauuauugacuucuagccuuuuuuguguucuuguguugggcaugaggaauugcuuauuugugugccugcuauaaugaaaauacgugcuuucuauacuggggccuuccacuuuggaaagaacauugcuuggcaucuaugcuuagcuuuauuuuaguaaguuuaagaggaaugaugcuucaaaauugacaaacaguuuuguaucucagugaaaaucuucauacaaaguuuugcaaaaugaguuuuuguuguuuacucuguaccucagggauguacccugacucagagcauccccccuacuugagccuuccauaugcugggauuacgggcaugagcaugcuugccuaggaagauagauuuuuaguugcaaaaaaauaagagauuuaugucugauaugggcaaaguagcaaucaccugaauaccagcauuugggagaagacaggagagccaagaagucaagguuauccucagguuuguagcaaguuccagaccagcucggacuaugugaaacccuguuuaaaacaauagcaagucuuaugcaauucagcuacaggagcaguauguagacuguuugcagcuccucggcucccugaagcccucuuuaauugcauaguaaaaagcaguugaguacuuggcacuuuuauccccuucacuuagacagcaccugauaccuccagaggaaaugugugagguagguuagaaagccugauuccaaaggaaggccagcuaauaaagguaagguaggaaaaacguuuacaaaugucacugccccacugccccggggaucuggaaaacauugucccucacugcuuccucucaguuuccaaaugccugaauuuaaugaagccaaguaaaaauaguaauuacguauaguacaggauuauucagaaugaacucauacuaagagcauuuuguguaauguuuauuuugaaagauuuuaaguaguuuuacuauuuugaauuuagagaauuaugguaacccuuauuuuguauuaugaaucauuacuuuucaucacaaguucagaauucagucuugugagaugugcuuuuaugcuuuaaauuccagacauagaaacagccaaaaaggacucaaaaguugugugagaaagacuaaaccccucaagauuuguucccugacuauuuugcuucuaauuuuaguuuucagcguauuauagauagucuucccuugagguagguaggaauaugugugcgcaugaacacuuaaguaugugugcauuuuacucugaucgaauucacccuaucuuaguauaauaaagacuauccagcuaaucaucugggauuuuucuaaaccugcucauuucacauagaaauuaagcuuauaugcuuuacaucaucuguguaauuucuuuuauuuuaagauuugagaaacguauuuauauuccuuugcccgaagcccaugcccgagcagccauguuuagacugcacuugggcagcacucagaacagccucacagaagcagacuuccaagaacuugggaggaagacggauggcuauucaggagcagauauaaguaucauuguacgggaugcacuuaugcagccugugagaaaaguucagucagcuacucacuucaaaaagguaagaagcauuacuugacccugucguguacuuuuuaagugaaacuucaggacugucccuggcuuauuuuccaaagaagcugaaauggcuucaguguuguaugauaauguaauaaauauauuccugcugcauugaaaauauuuucuccagugaacauuauuuaugguccuaaagauuguguuuuuuuaagaaguaaugugaggcauuucugagucauucuggugcaagugcaacagcucacauggaugagaggcugcuuugagcauagccagagcaauugggagcaaaaucugcuacauuuucaccacaucauaaaaguagauccaguacaugcuuagccuggccuuucucuguccacacuguccagcacugugucagagaggaaacaagagguacaguguuagcagugaaucugaaacuugggugcuaacacacacaauucuguguauuguaguucacaggggcaaagguaugauggaguguauuucagaaucugaagucaggauugucagccuuuucugccuuucccauaugaaugaauugagcuaucugauucggguaccaguugaugagaagauuauagucuuacuauguaauucuuguuguuguuucuuaaauggagauagcacucuuugaagaauuauuguaaggaucuugugagauaauguuuacacacaacacuaaugauaguagcugacuauucacuguguguucuucucagccauuuccucacuaacguguagugcuuuuguacaguagcagcuuguuagagagaaaugugguucaggauuaaauauaugccauagccaucauauuuucuuuuuaauucccuuugcacuuagaaaauaaauucuuaggaccuuagacuuuucuuaccuagaauuugucacucauuucuacauuuugguaccagggaccucauaugugaacaugaagccaggucuuaauaucauaaaggcuaaagcaagcauaauuuuuaaaaaccauaauuaguaauguaucuuaauuguacagauuaguggcuucacugugauaucugcaucacacauggauaguguucuuuauaaucuaauuagcuuuaacacuaggguuuuggaucaccaucugcaguagauauucccauguuuccauccuuccacuuuugaaacuguuacaacuaaaagaacagacguauuugccuguuuauuucaguuaucuaacauaguaagucugagcccagagucagucaggauguaaucagccaaaaacaaagacaaaaaucccuggucucaugcaguugagaaaaaaauauagauauaaacuuaagugugaguguguacacaguagguuuguacacaguuaaggaagccaggguauauuuuacaccuauucagucuugaaauaaaggugaucaucaugaaauagacuugaaagcaaccaccuaaauaaauauaugcuacuuuguaacaaaggguuguuuucuagauauugcuaaaaucuugcuuuaacuaaguuacauuucaugaaaucacauagacauuauuaagcauguaauuuuauuucuguccuaguuuuauauugcugugaugaaacaauauaaccaaaagcagucuggggaggacaggguuuguuuauuuggcuuacaggcugaugauacuccaugguaaagagaagucagagcaggaaccuagaaacagaaacugaugcagagacauggaggagugcugcucaguggcacuccuuucuagaaacacaggacauccaguacagaggugauaucacccacagugggcuggaucuccccacgcaagucauaaucaagaaaggauccauggacuugccuguaggccaucugauaaaagcauuuuucucaauagagaucccuucuucacacaugauucucccuccugucaaguugacaaaaagccaacuagcauaguauguauaugucuucuuaguuucuuuucuaugcucugaagagacaccaugaccaaggccaagacagcuuauaaaagaaaacguuuaacugaaagcuugcuuguauuuuuuagaugguaauuccaugaccaucaugguagguagcauggcaggaggcagacaggcacggcacuggagcaguaacugagagcuuacuuuuuuuuauuggcaagugucaggcagagagagugugaccugggcuuuugaaaccuccaagucaaagcucaaugacacacuuuuccaacaaggccauaccuccuaauccuuccuaagcccucggccaccuggagaccaaaccuucaaaugugugagacugugggagccguccucauuuaaaccagcacacaugggauucucaaguuuuuguuaagagagagaccuaaagauugaguaauuuaagacuaauccuacacaauaucucaagcuuucuuucaggcauggaaaagagcaacuugggagaguuuuguaauguuuguuuugaucuauaauguaacuaccacuuaauaagcauuacaggaagaauaggguagcuagaaggagcuguuucuuuuucaaaacuuuucuuuuuaacccuaguuuauuuuuccuuauauauucuauuuuuccuagaguaaauauuuuaaauacaaucuaaaaauuaauguauuuugccgaagacuauccccuuuuuggguuuccuaucugcauggaaugggucucuaguugcagguggacaaggagucagugaaugaaugacaaacagaagcgacacacgagauucuguagaaucugaaugcaauuugacaaaucaagcaucagacuuuuuauacagaaaauagggaaguuaggugacauaucggccagguacaaaugagauuaccggauucuuauacaaaacagaggaaugcaaacauggaaggacuggcaagaaccaacugggauaaaauucaguguuuaacaacugggaucaaaaacaguuccaccuaagguccacuuaaucuuagaagccagggucaagggucguuuccaugaacuuuucgccuuggaacggugcccagguuuugggggccugucgcgcuugucacugcuggaguggauguagcaauauuuuuaacuuuucugauagugaccggaaucuuaauucuuauuucauuuacucagaugaaaucaagucacuaucauuacagguucgaggacccucaagagcugauccuaacugcauuguaaaugaccugcugacacccugcucuccgggagacccuggggcuauugaaaugacauggauggauguuccuggagauaaacucuuggagccaguuguuuccauggugggacauuuuaaaauuuuauacacuuauaugucauuucguuucuauagcacuagagaauguuaugaucaagcucauguauuuaauacuugaagagaauuguaaguauuaauuuuguuuacauguaaaaauaguuaucuaaaggugugagacuuguguuaaugaaaagguuguauuuugaaagcacaauuugcucugacuuaagucauccacaaaauucucacauauauugcacaaaauauuguuagggcuuaauuaaaauaugaguuuuguccugaaucgcacauguuuaaaaauaaccagaaacaucaacucuugugugauaguauugauaaauaguauuguuuuguuuuacuuucuuaggcugcauagaaaguuuaaaucauggaguucuuuaaauuuuuaauugaaaacauuaaccuuuuucucaaauacuguauaagacuuugggaacauuuuuuuuuauuguguguacauuuacauuguagaaauuaaaguaacuucacgguuuauuuuguaagguguaucuuuauagaaguguggugcugcagaaaucugcuugguuacuggugaacacccagugucaaacagcuuuggccuuagcugccaguuuucagagugcuuugugguagguuggacaggagcauuaagagaggagacugaugugcuagugagcagacauagucugcugugugugugugucuguauagggacacagacucagugcuugucugaguacucagaagucccgcuuacugcaguacuuccagaugagauuauuguuguaaguuuuauguucuguccugauuugaagaauucagaguaacuuacagugguuccuuuuuucauuugugauguaauuuuauaggaaacguucauuuuaaugacuuucugauguuaguguauuuucaccauuucacucuuaguuuuaacuuuaaaaaauauucucauugcuguuccauuuaaguacaaccaagugacuuauagaaauauauuuuuguaguaauaaggaguacaauuuaaaaaggaauauagugauacuacuacaaaaugcaguuuauaguuuucaucagaaggauuagaauaauguagaggguuuuacuauuauugaaugcuaauagucuugacuuucagaauucgauacuucaguuacagaauuccacagagacugugcuaaauuaucaauugcuugugcaauuaccauuuuucuucuggguuacacuuggugugaaauagaccucuuguugaagauaaagaguuagaccaggagugagaugguggcuggacuauggccugucuuuguaggagguagugagcaugguagguaacgaggaggaaguugcugcuaggagcucauaacacagcacauuuuccuaggcaacuguaaauucacaacgaagaaggacauuuauacuguauugaguccauuguuaaugaccucuuuccuuucucugacagugggauaugcugcggucccuguccagcacaaagccaacagucaaugagcaggacuuguugaagcugaagaaguuuacagaagauuuuggccaggaaggcuaacacaaagacagcaagaacauguuuaugcugcauuucuucucuuuuguagguauuuugccuuucuuggaugacauucagauuauuuccagcaaaacucguuuacccagggaaacauacaugucacuugaguguuccuaaagucuguguuguccuuuuccuucacugucuguuaaauucucuaauucacaaacauugucgaauuguaaggaaagcaacaaugguaugaggaacagcagaguggggacaucgaggagccucgcccggcuucauggacagcagcuaggauucucaugaguacuuguucaaagagcaaggccuuuuuucuuuuccuaaaaaugaaauugaaacggggcuaaagcuaaugguauauaaaugucuugaaaaaucuuuaagcauuuuaucaauguaaacuuacugcuuuauuaaaaauuaaugguagaaucuuuacucucagggaugggcagcaaaacgcagagcacugaugaauuugggguuuguggcacagccagugcuccuguugaguuucuagugggcugguuucuccuguauagauuaaagugauuccuuuaaagcagugggcuuuuauaacuccaugacuccuuccacugugcacucgagacuuucuaaaucaguagucaucuuugccuugucuacgcagugucuuuuauagccaagauugaccaaaagagguagcaaacaaguaugcauuuuucgagaauugucaugaaauacuguaaugggaaacuuuaauaagaaaaugacuuucuucuggacuuugggauguuuccuguggaugauguggguauguguguacauauauauacauaauuuuuaaaauauuagcgagagucaugucuuucacuuuuaaguucagggagcaguuuguucuaaccacacaaacauucucagugugguauuucauggagcuuuagagacaaacuaaugucucauuacauaaugaaauaugaacauaccaucguguuauuucaaugucuucaaauacaugaucugaggguguaugucacauacuuguguaccaacucuuaguugugccuuggacauuugcauugccuaccugcaaacaauuacuagguuaacuagaauugcuaugcaguucuaccuugcgagugcuacacgguaauugcauuuuaaaguauauuugcacauuuuacaugcuaugcuauaugauugccuuuggguuuuguguacagacuauuuuuguugauauucaaugaaaauuauaggcuugaaauaauacuguuccuaugugaaguaaauugcuauaaccuacuuuuggcuuuuauauguuuuuuuuuuuuuuauuuuggaaccuucuacauaggagaaaaugucuuaaguugguuagauaaaaagaaauaauuuauauuuauuaaugagcauauaugaaagauucaaggguagaagugcacaccuauaaucucaggacuucaaagcuagucuaguuuccauaacaagacacuguuuuuuaaaagaacauuaaaauucugcucuuccacagcuacugugugaaagcuguaaguuauauuggcagaauaauacugaauuuuuucuaaaugaauuaauuuguguagcaucuuaguuguugaauuagauuuuaauuaauagauccuacuuccagccucagugcuuaacauucccaaagaaagacacacagagagcuuuuauauuuugauaugccuuaaacagugcaacagcuaggccacuuccaaccuccaugugguuaauccaccucccacugauaaucuugaucuaucacuuacuacauucuguacucuaccuugacugcccugggccuagcugggcagcccucuggaccacacugucccaguuccuagauggcagcuaugccucccuguccuccacucuucucaggcauggcaucuccucuccuccacacucuccaggcauggcagaucuccucuuccucccucuucccuagcuuuuaagcccuggaauccugacguccugcuuuugucugcccuucccagccauccucugcuggcaucuuuauugaccaaucaauaccaacugggacagggucccccagugcagacucucuugcaaaccguuuuggggacccaaauuaacauaguacaagcagcacuaggcccaauccacuauagucaguguucauugcgugaagagaaccgugaccaaugugacucuuaaaaaggaaagccuuuaauugggucuugcuauagcuucagaggguuaaacaguugucaugguggggaacauagcaugcugguagacauggugcuggagaaguaguugagaguucuguauaucugcagacagcagaaagagagagagccacuggaccuugcuugggcuuuuaaaaccucagcaccuaacucuggugauacacuucuuccaacaaggccacaccacuaaccuucucaaguagugccacucccucauaacuaaguacucagauauaugagcuuugggagccauucuuauucagacauguaauuugugaauaaauuauauauaaacuguuuuugauaagucucugguuaaugagaauuaauauaaauuuauuuaaauacacuugaaagggagaauuuuugugaauccaaaguucaaaaaaaaucuauauaaaauuggugaaauauaugagcaaaugguaauaauaguguuuaaaaguggaugcuuuaauugcacuuaauuuuacuuuuuauaagcaaggucuuagcuggcuggcuugaaacucacuauguagaucaugcugacuuugaacucacagauaaucccacuuguuucugccucccaagugguaaaggcauacacuacuaugcuuagccccucauacuugauuuuuauauauccuuuaagaccucuguguugcugugacuuggaauuauugcuccauucccuaaaucuauuuauagggaauagauuuauuuauguaaucuagcaucuuuacacuucuggaaugguaggauuugcuucacaagccauuuucauguauuuaaaaaaaaacauuaaauuauguguguguauguuuuucgugauauggugggggagcacauauggaugucagaagacccuuauaaaguuggaggggaaacauggaugucacagugccuuuguggaguugguccucucuuuccacuuaaguucagacugucaggcuugccuggcaagugcuccucccucagcacugagcuaucuugccaacccaaucuguguucuuuguguagaaaaucauuggagccagugugugcauguucugccucucaggucugugacugcucuauaguuuuagguagacaguuucugagcuaucaagaagacccuuguggcugcccaucaugagcugcacaccacaugauuaaaaguguuauaccagucugaagaauuguagacucugaugucaauacaucagcagagaauugacugcugaguucacugucuguuggcaggaagucaagauggugcagcucacacugaaaagcauccuuugccacugcugugagauaagagaaaggaggcaacacuaguggucaagcauagcauugucagugaggugguuuuguuuuuuugguuggacugggauuugggaggaguuggggcucuuuguuuauuuugagaugggaucucaucccaucuuggccucccaagugcuucuaguauauacuucuaguauaggcaccugguaucaagcccugcuuauaaugaacauugcucauugcaggagauuuuuguuuguuuauaaauacugugcaucagauuaaaaaaaaauguaugaauuugaaaaguagacaaacauguuagaguguaucuuuugaaauucauauaauguacaaaauguagagcaugcacugccuaaaacuuuagcacacaacauacuuagcuuaaauaaaaauucuuacccaccuguuaaaugaaaggggcaguagagggagaagcuaacaguacuuaagucuagugaaaggaauaugaaaaacuaaucucuaaacaaauaaaauauaaaagucaguaugaaugacagguugguaguuacugauaggaauuaaucucaaguucugggauauaacagaaagcaagugugcauguguuguguguaauauaucuuaagacauagaaaaacaggaucacaaagauauucaucaaaugaauguccuuugaagaguuucugucuauucaaauuuccuuccugguccaaagcaugcucuggccucuccuaugggaacucaaaugggagaucuuuuuccuucauuccuguccaaggcuuaguggauacagccauuccgguuuucacuuugaacaucuagaacaaagaagggcaaggcauugaaaauaggcuuguuuuuuggugaugguacacaccuucaaucccagcacucgggacagggccagagcaggcagaucucugaguucaaguccagccaggucuacaaaauggguuccagggcagccuggacuacaaagggaaaaagaaagaaaggaaagagggagagagggaggcaggauaggauaggauugugguuaguaguagcaucuaacaggaagccucuuggcagcuauauaguagaaucacaaugaaaacuugaagagcaccugguagagguugaggcaaggauagaggcccagggaucucccuuggcuguguucaacaguucuuguagucacaguacuaaaauaaucuagauaguguuugaucaguauuucaugucacagguuucuaaauuguguuagucauauauccagauuuaccauaugauccauagauacuuguguauaugcauuuguaacacugagaagaaucugagugagagcaguaugaggaaggugugugaagauggaucauguuuguggucagccuggaccgggaguuucagauuucagauguggagggauggaguuggcucagucuuugagagcaccuacuguucuugcagauggcugaaguuugggucccagcacccaaauguuaacuugccaccaucaauccauaggcacagaugugaugcacauauauacauacauucaagauaaucauacauguggaauaaaucuuuuuaaaaauuaaaauucaaauaauauuucaacauggguccagucaagagauucugcaccauguuguuguugaaccugcugacauugguuuuagguccuugcuuggcgguugaagaaacugaacuugacaauuuauacucugaacuccaauaacacaauguaaaaacaaguacucaacaccuucagggaagacaaagcuagaggaaguugauuaugucagugucacugacaaagcuguuacacuucugggagaagacuaagaauccauccucuaaaucaaagcuuagacagauaaacagaacaauguaucuaaggucaggaaaucaauauagaguauaagaaggcaugggauaacucaauuauuucagucuguauugcauuguacuucaagcaguccgaaauacugugggccaggaauugaaggaaagcuuugccguccugacugcaagucccuuacacaguugccugaagcaguggacuagcagagagcugaagcucuaggaguuggcugcacaucugucuccacaaaggcucaaggcuucugccugugaucuuccuagacaccuugucuugagcuuccacacaaugguggccugagaaaagucauuacugugugguugaaaguugccacacaaguccaccauacaacaaaauggagcuauacaacuuuucccagcaaggcucagaagucacugucaccaucgcuuugguugaaguagucacagaagcccacccaguagcaaaugaagagaacaagggucccuccuaccugucacuggaagaaaugucaagauaacacuauaagaaaagucuggguuggagagcaacaauggacuuccgagucguaugcaacaugaaaguauuuauaaagugucucgcuuuagcaaaaaauagguguucugaaccuaaucuaccagugacccaguaauugcugugucuacugggaagagaacacaggaacaaaucagucaaaauaugugaaacauucuucagaaaauggguugguuucuccaaaaagucaauguuaugggguaaaauagcuuagugaugcucaugcucuucaaauacaauugaaaacagcagaauagauaaccuugacuggacaaaagggaagguggaacugagaaaauaugaauguaauauuaaguaacauuacagaauuaugaguucucucagaugugcuauugcuauugagcuugugcuggcgaaugcuguccuucauuuuaaaaggucuaugccgagacaugaauuaucaugauuucuuaacuuugaaauuauuacgcacgcgugcgcgagcacacacacacccaacucaaacauagaccuccuuaaagcaaaugugguuaaaugagauuggaggguuuggaggcgaggauguugcugcuugccugaggaaugauuggcauugcuuccauacuuagcaccagggugugagucaucugaacaaguacaugcugcugcuguccucccugcaugcaacugaaccccagccuuuucuaaaagccaaggcucccaguguacauauuccuuggaaguugccagaacuguaguauuuuguucgauacuuaauccaaaguugucuauauaauugucagugcauucugaaaggcuugagacagcaaugugguuucacaaaaaguauccauguguggaaaagucuagaagacuacaaaaaaugugcuaaaacugaaaauauacuaagauaaugaggauggcgcaauaaaaagccaaguauugugugggcacagcacuacuggaaucaucuguccuagcuguacaaacaugcacaagcgccuccauuccuccaggagaaaaacacucguuccuucagauuccugcuauagguuucagugcaacacaaagaguaaccuuugacuuuuuaucucuguuaauccugagaguuuuccacaagguguagacacuuccuaugguaagucaguuuucaauuugcaaaaugaaauagucauaguuacauaguuacaugugaucacuaaaucaagguuugcuaugcuaaaggaaagcugguaaccuugcuuagaccucuacuugaauauacuguaccaagugauagaagaauguauauacaguuuugaaagaaaaaccuccacugcuuuucauacauugccaacguuuaauugugcaaguggacagaugaagucucagcucucccucacugugccaggagcagaguaaaggaaucuuuugcugagcuuugugucaugguucauauauuuaaucccaacacuugggaggcagaggccaguuuggucuaucuagugaguagccagggcuaccuuuacugggcaugcucauauggguaagaaugcuuguaugcaaauauugagaucucaguuugaauccccaaggacccauuuaaguaugccaaguaugacuucauaugccugaaaccucaacgugaaggggcaaagcaaacuggauccugagagcuugccaaucaaccaacccaggcaaaaucuauagcuucccaauaaagagauaccuugcgucaaaggcagguagugauaggggaaacacucaccaucuuccucuggcuuguaccugugugccugugacaaugcacacugcaugcacaugcauguacuacacacacaaagacaaaacucaugacaaaauuucaugucucaauccuuccccagacuccugccccugccaguaccucugagacagccuguaagugcaggaauacagcagcuagggcgggagagggaugacuccaacccgcagauaaucaauauuguuuugagaugagaccuauguccccauugcugucugcaaaguuccuucugucuacugcucuugaagccacuuagcuuaaucuuuucagugacagcugaggcuaagaugggaaauuuguauuuuauagacaguuaugcuuuguuuauaugaggcaagugaacauaacagccuucagauggcgaaaggaaaacacacagaaaacccccacauguugugacaguauaucaagaaaaugucaagaggaaagucuugggccaaaauuuaauggcauuuaucucggaguaauaaaaugacuuguuuuuucuuuucuauaauuuauguaguuuauuuuggugaaaacaguauguaguggaauuugccauugcaaucacuuuuacauauguaauucaguguccuuaaguacauucaguauuguucagccaucagcaugcaucauauuuaggacuuucucuucaucccauguguaguaacucuccauucugcuacugcucucagccccugguaaccuuuauuccacuguuucuuaagaguuugucugcaucaugcuaaacgaaauaaaucagaccacuuguauauuuggu

SEQ ID NO: 324 - RNA, 3004 nt, Mus musculus
gauguugcaguuacagaugaaacuccugcgcaagaagaucgagaaguggaacaccaagcuguggcagcagaacauucagcugcaagaagcaucagacacaagucugucccaaccucaaaauggacaugugccuaaagaaacaggaaaagguggaaaagcaaaaaaggcccugaaagguucugugccuguggacucagcggaagcacaaaguggagacaugccugaggagaccuuggaaaaugccaaaguuaaaaagucaccccuauagguggaacaacauuaugaacuaaccaguaccccugagcucuugacucuagcugcauagucggccaucacuggaaagagaggcccauuggacacgcaaacuuuauaugccucagaacaggggaacgccagggccaaaaagugggaguggguggguaggggguuggggggggaggguauaggggacuuuugggauaacauuggaaauguaaaugaggaaaauaccuaauaaaaauauuaaaaacaaaacaaacaaacaaaaaccaaauauuacauggaaaaaaaaagucaccccagaaacucacgacuuuagccaacggagaagcagcaccaacaccaccuccuaauucagaaguaaaaaagaaaaagaagaaaaagaggaaaauggcaaaugaugccgggccugauacaaaaaaagcaaaaacugaagaaagugcugaggucugugaggaaccagaagauaaugugaaaaaggcagaugauagcgaggugccuagccugccucuaggacugacaggugcuuuugaggacacuucauuugcuuccuugucuaaucucgucaaugagaacacccugaagaccauagaagaaaugggcuucaagcgcaugagguagauccagcauaaaaguaucaggccacuucuagaaggcagggaucuucuggcggcugugaaaaccuacaguggcaaaacccucccguuccucaucccugugauccagcucauugucaaguugaaguucaugcccagaaauggaacaggaguccugauucucucuccuaccagagaacuggccaugcagaccuuugguguucucaaggagcugaugacacaucacguucacauguaugggcugaucauggguggcagcaacaggucugcugaagugcagaagcuccucaaugggaucaacaucaucguagugcauggccagguccuggaccacaugcagaacaugccaggauuuauguacaagaacuugcagugucugguuauugaugaggcugaccauaucauggauguugggcuugaagaagaauucaaacaaauuauuaaacuuuuuaaaaauauuuuuauuacauauuuuccucaauuacauuuccaaugcuaucccaaaagucccccauacccuccuccccacuucccuacccacccauucccauuuuuauggcccugguguaccucuguacuggggcauauaaaguuugcauguccaaugggccucucuuuccagugauggccgacuaggccaucuuuugguacauaugcagcuagagucaagagcuccgggguacugguuaguucauaauguuguuccaacuauaggguugcagaucccuuuagcuccuuggguacuuucucuagcuccuccauugggagcccugugauccauccaauagcugacugugagcauccacuucuguguuugcuaugccccggccuagucucacaagagacagcuacaucuggguccuuucgauaaaaucuugcuaguguaugcaauggugucagcguuuggaagcugauuaugggguggaucccuggauauggcagucucuagauaguccauccuuucgucucagcuccaaacuuugucucuguaacuccuuccauggguguuuuguucccaauucuauuaaacuuuugacagcacguaggcaaaccaugcucuuuucugccacacaaacucgaaaaguugaagacuuggcaagaauuucucugaaaaaggagccauuguacguggguguugacgacgacaaagagguugccacaguggauggccuugagcagggcuauguuguuugucccucugagaagagguuccuucugcuuuucacauuccuuuagaagaaccggaagaagaaagugauggucuucuuuucaucuuguaugucugugaaauaccacuaugagcuguugaacuacauugaccuuccugucuuggccauccauggaaagcaaaagcaaaauaagcagacaaccacguucuuccaguucugcaacgcggauccgggaauacugcuguguacugauguggcagccagaaggcuggacaucccugaaguggacuggauucuucaguaugacccucccgaugaccccaaggaauacauucauccuguugguggaacagccuggcgccugaauggaagagggcaugcccugcucauccugugcccugaagagucggguuucuuucguuacuugaaacaguccaagguuccauugaaucaguuugacuucuccuggucuaaaguuucugauauccagucucagcuggaaaaacugaucaaaaagaacuacuuucuccacaaaucugacccagaaagcauacaaauccuacauaccagcauaugauucucacuucaaugucaacagcucaaauuugccucagguugcucugucuuuugguuuuaaagucccuccuuuuguugaucugaauauaagcaacgaugauagcaagcuuaagaagagaggaggugguggggauucggcuaccagaaaauaaagaaaguggagaaguccaagaucuuuaaacacaucaguaagaagccagcaaacugcaggcaguucucacacugaggcaaucugccuucagccuggacugacuuugcccaacuuccccccuccccaguacccuuuaaaaaggaacuuuaucaccuuuaggaucuuuuugucuuuucuaugauguuaauauuuuauuuuuaaauacuuccauaaaacaaauuuuaucacuguuu

SEQ ID NO: 325 - RNA, 11996 nt, Mus musculus
gucccacuucaagccagcuucuuuaaucucagcaguugggaggcagugguagguggauagaguaagugaguuccaggauagucaggacaacauagagaaaaacugucuaaccagaguccuaugucagaugauuaaggggcagaggucuagaagacaagugauuucccuucaggaacacacacagcauguacacucacucauaccccacaacuggccccacaacuggacaaaaaggaagcuuaaucaaggagauugacaguuauauucaagaaacccaaauuaguaaaacaaaagcauagaaaggguacagaaacuuacaacaggagauggugacauuucuuacuuccccacaaaguucuuagguucucuuguacacaaauaaacuguagaaaagucuggucagugaaucuugaauacaacugcugaaacugauuugugacaccuacacacuagcuuagcugcaguaacugugggucauuucggacuccuccucagcuccuggacacauguggaaaucuaaaccagaacugcccucucacucucuggauuucauuuccaguuucagaugucugaggcugaagccugacauauuuuggagggguuuagauacacaacuacacaccguccaaacagcaccaaucgguuguuuggugguaguuaagccugaguuucauaaggauaguaaaacugagggaccgaugaagccugaagacaaauucaggacaggaaagggcacagucagguucccaguggcuuuccucacuggaaaaccaaacauguauucuuccuccaacagucuugucugugcuugcaagucacugcacuuaguaaaauauaguagucccuuauaacaacacaucugccuagaacuaugcacagaacgcuggcgggaucacugcuugcucuuccuuuuucucggucuuuuucccccagggcuugcagauguuggggucuuuugugugucuucuuucacugggggcacaggcagcuugagaaugauuucaucaucuuuaucgccaccgacuuccaucaccugcgauuuucgccucuccaaaaacgucgguguacaaacuggugugggacccugaaagcaagaagagcacuauagucuaggacugcacagaggcgcuaugaacacagcccagagucacuacugcccuaguguucacccaacaccacuaccuucuuagccuuuaccaggaacacgugacaccuccagccuccuaguuuuaagguguaccaugggaucuauuuucagccugcuuuuauuuccuguugacacaagggaagaccccuuuuccucauucaaauuaugucuauagcaacugauucccagaaugcaagggcaugcucaccuggcuguccacagacgacuucuuccuccuagaccucuuacgcuucuuaggaauguuauuggaaauguccucuuucaucaucuucuccuuucuccuagguucacccgaaagcccuucuuuuuggucagguaaaaccugaaaaauaaaggcuaggauuuaacacuuugcuuauuucucagcuacgggcgcauguuacaguuguaugccuaucuuuaaacugccaguuagcugacgucagcagggcacaggcugugcuuuccccggguguuauggugcaugacuaucucagccgggaucacaccacagcuuguccucaaguuuugacacaacacuucugugacuugagacuggggcaaaaaagcaacagacaccuagauucugaggaaggcauaauaagcuuggaaauagaugucaccucaccacuaacuaauuacaacuuugggcaaaagguugacagguucuaugaaagauagaaaacauucuuaagauucagucaaggaaaccuucggcaacccuagugaaagacaccuggacuccuuaauguagcagaggagaaagugcagcaaggcuuccuuaucucguuuccuaacuagcaagggagaaacgccucugcuaauucacuucuuguuccugugguugcugagguccaaccuauacacaaccacaaucaaucacagaacccaugcucaccugauucucucugacuuugaguuuuaugacuauuuccaguuugagagaacaugaagcaaaaagcauguucuaaaaugacaagauaaugaggaucaaggggcuggagagaugguuuaacaccggcugcucuuccacaggaccuagcuucaauuuccagcacccacaugguggcucccaacuguguguaugcaagccugcuuuauuuccuuuggacaaagucucuccuggaaccggaaacuagacugguggguagcaaguaucacauguccaugaucccccucuuccaagggucacaggcaugaacaugaacauacagcaugaaccugacauuauguggguucuaggauuugaacucaggaccuuauauuuauguagcaagugcucuuucucaaugggccagcucuccacaugauuuuaggauuuuaaaaauccacaaugcagggccagagagauggcugagcagguaagagcaugacugcucuucuagaggucccgaauuuaauucccagcaauuacaugauggcucaccaccaucuguaaugggaucugaugucuucuucuggugugucuggagacagcuacaguguacucacauacauaaauaaauaauucuaaaacaaaacaaaaaccucaaaaaacccaaacacucccacaaugcaggagagcaggucuaguggcauaagccuucaguucuagcaucaaggaugcgaugugggaggcaggaggacgggagguucaucuucaggacuguaauuuagggguuuacuguguaacauugggacucccccuucagcuacauuaaaaucauuagaucuuagaaaagucccccaauaaacaccaaaacacccaccaacuauaugaaaucuuuaacaaaauguguaguagaaauuacuuuauucagauaauuuaccuuaaaaaaagcuuuuuuugauuacuuugugcguauuugugagcaugugccuggugcucaaaggauuacuuucaggagucagucuuuccuucaacaaugugagaguguucagugucugaacuaggcagccaggcuugguggcaagugcuucguuccaagucuugccaacacuccugaaaguauuucuagcaguggccauuauccagaugaucuuaccugguuacccucagaaucucuaugagcgacagcaauguucuuuggcuuagguaggaccugcaaauaaacaauuugcauauuuaucagcuauaugcauaugcuguagcugaauuccuauuuuaagcaucaguguccaauugccaaauggguugaauguaaccaagggcaagauuuugcuguaaccugggugaguuaucacuuggaaggcugaggcagaaaagucuccaguuuucuggaagccuagaucauguagcaagaucuugguuuaaaaaauaaaaauaaaaaacagccagggacuagagauuguucaacaguuaugagcacugacuguucuuucagaggaaacagauucaauucccagcacccaaauggugacuugcaacuaucuguaaacuauaguuuuaggguacccaaugcuuuucuggccuccaaggccaccuggcaaccacuuggugcacaggcaggaaauuauacuggggguaaaaaccuggcaggggccugggaaugaaguucauacaaaguaaaauacuuaaagcucuguguuauaccucuaggacugcaugaaccuggaaucauuacauauaucugaaaucccagcacuuaggaagcagaggcaggaagaucagaaauucuaaguuugaugccagcuuggaaugagagacccauucuuaucaacaucaacaauaguagcagccacuuguauagggcuguaagcaagcucaucuguguacucaggaucccaugacacagaggcaagaggaucuaugaugaagguuugccugagcuacaaacuacauccaauccaguccaugcaacucagccaggucuuuucucuaaaagcuguuugagggugggagggauggaugacguaugcucagugcccugggucccauccucaguaccagaccccuugccuagcaugggcagacuccagccuggccgccaucaaccaaaagagucgcauauacaaacuaaacccaaccuagcgugugaggagcacugagguagauucuguaucaucagacaugggcuacaacuauugaggcagggagcucaccccaagagaaaccaccaaggaaacuggaaaaggauguuuaccagugagggaaaacuauaaucaauccccuuugcagcuaguuucuuccggaguaauuuuuccuucuucuuaaaccuauacuccaucuucaacaucugcaaauguccucguuuccgauuauagcgcuucacugcugggaaugauggccggugaaacagagcauuccucuggcugaaaaggucuuuauggacuuuuuuucguggcauaaauuuaccuauaaaacaaagaggaaagggucuucuaauuuuauauuucccaaaaagccauuucuugugguaugaacuaccuauaugacagaaauaaccuuuaaacaucaaacaaugauuauuguccaugcauguguguggguucacacacccugcccacggaggcuguggacaacuuuguggaguugguucucucuuauuuugaugugggaucuggggaaugaacucagaccaucacaggagccaggcuuucaacugaacacggaacaccaugaccaugacaaugucucccauggugacuggaagacauugagagagcagcuugaccugcucagccaccucuccgcccucuucuuucucucuuuucuuuucuuccuuccuuccuucuuuucuuuuuuaaacacagggacucacauagccuaagcuggcccuaaaguugccuagaaugaccuugaacuucaggucuuccagcuuccacucccccaaaucuaggcagcaaaggcuugaaccaucagaugcaguguaugugcagccucgugcacgcuaggccaguacucuaccagcuaaacuacacuccuaguccccgauaaucccacucuguccuggacaggguaaggauuuguggcaagagucaaaaaacccaguagaacucagagcccuuucugguaucuuccucaagcaggacagagcagagcacaaaugcccucagguuucugcucagccacuuucucccaacaggagccaggcuuucaaccgaacacggaacaccaugaccaugacaaugucucccauggugacuggaacugggagaaguuacaugaagcccugugaaccuguaaacuggucccagggcaggguacacucuaccauggguguaggcaggcugcacacuuaggucuaccuuccaaagacagagaucuggauggugaugccacagguucccugugacggacacaaaaguucacagcgucucugugguaaacaacuuacacgugcaucugugggugaggcgucugugcagggcaaggaagacuuucuacucucuuacucucugcuucacuucuuucaaacugccucuuacugagcccggagccgggcuacggccagggcugcaccucccucacugagucugaucuugaaaugugauucuuuacuuuuggucuugcccuguguagacucggcuaagaggcugcacccaggccucacagaccuguagcccaucuucugcuccccauuugaauccccuaacaucccaauaacuaaagguuagugaccucugguuuggcauucaccacucacuggguaagaaaugaccucaggcugcacugccauccuuuuccuggcuuaugccuaucuaacccccaguuuucuuuuccuuuuuugaugacauaaggucucuacagagcauuggaugccucuggacuuagagagaucagccugccucugcuucccaagugccaggauuaaaggcguguaccacuaaugcugggcuuuaaccccaccaguuuucaauuugagcaaaauucuuuccaaucacacauuaaagaugggucagcuucucuuccgaguacaaugucacgaguaacuuuguaaucccaucacagugcagaaaggucagaauacuuacaugauagaagucuuucaccaaaaagguaguuauccauuguuucugcaacuaucuuggcaacauccucagacucaaacuccacaaaggcauagccuuugcuguuuccagucuguaacagaaaaacccacaaaagagcaguuaagucuaacuaucaccaagcuccuaaaaagccccagucgcaacuuuuacuauuucaaagccgcuggccccugcccccaucccccaaacuaacacacagacagacagauaagacagucacagcuuggaauauagauuuucugguauccuuaaaauucggcuuaguaugauacaucccugaguauucuggcuacaaugaauucaguaguacucgcuggugguaagaaggcuaucuuuugggcuuucacaguucuggauuugucuacucauuucucauuucauuggcagucuuauuuggcacacaccagcgagggccagauuuuuuuuccuucauuaaaacccuagcagucuggguaaucccagacuggaaucccaguuacacaggaggcugaggcaggaucuugugaguauaaugaggacagucugggcaacuaaguaaaacugucucaaaauaaaauagcaauguaagcccgugcuaaccuaucguguuuccccugguucaguccccagugccagaggagaacacaggcaagcucaaccucaccucacacauuaagggugggaacaaccuccaggaacaagccuccaggaacuugcccugauuuccacagccuaggcaaaggaacuggucuggacuuccuaaccccuguaccagcucaugaguggauucccacacccagaauggucauaaguauaggguggguucuggaguucaaaugucuauauuucgauccuggcacugaccuguguuaaguaacagacugucauuccaugaaacgagggcaauuuaaaaacucucaucagaagccgggcgugguggcacacgccuuuaaucccagcacucgggaggcagaggcaggcggauuucugaguucaaggccagccuggucuacaaagugaguuccaggacagccagggcuauacagagaaacccugucucgaaaaaccaaaaaaaaaaccaaaaaaaaaaaaaaaaaaaacccucucaucaggaugccacgaaaauaccaaugucccacaaagcucaacaacauauuacaaaaacaaacaucagcaauucaaaguuaauuucaguuacacagacagaguaaggccagguugaguaucaaccaccaaccaucuccuaccaacacuuccaaccacaccaaaacaacagacuaccacugcaaacuaacagauccuuugaaagggaauuugaaaggacaugccauuccaagaacaaaaaucaagggcagugaaaugacucaccagacaauggcacuaccuaccaagucuaccugacuccaaccccaggaaacacaagguggaaggaaaaaaaacaaacuagcugauuucuacauucacuccugccccauucuaauaaauaaaaguaaucaagaaagaaagaaaagaaaccaaaaagccaaggguuggaugcccaacacagacaaaaagguggguuuaagccccagcaucauaacacaggcaaaaaucagaguuaugaaguagcaaugaaauaauuucauggcugugggccgccgcaugagaacuguauagaaggguugcagcauuaggaaggcuguaggggcuggagagauugcucaguggcuaagagcacuggaccuggguucaauucccagcacccacauggcagcuucaauuuccuaguucagaagcucugaugccccccauucuggcuucugcagguacuaggcaugcaugcgguucacaaacacauagacaggcagaauacccagacagauaaauaauaaaaauucccuuuaagcugggcauggugaugagugccuauaauccuaguaauugggaagcagagguaggacagcuacaaguucaaggccagccugguccagguagcaagucugggacagccagaacuccacaguuaaucuccgacuccaaccaaccaaaucaaaacccaacacuuuaaaggugcuuagaagauguaaauuuaaaaaccuguugaaauacauggucucugacaugcaagugauggcucauccuagcaucugagccacuucuuggcucucgagcuggaaccaaguuucuggaguaaauauggacucauuuuucacugcaucucacuagcugaacagugaacaaagauugcaucuccugguagcugucaaacaagugcaguaauacaucaagaaucagauguauuuggggagcaaccucuagagcaagugaggaauagcuauccuaugagacuguagagucuacaggauuuagaagccaugacucaggcagaggaaguggcuacuaagauuagcaggaagcuggaggaacugaggagaaacacuugacaaaaggaaagaaagaggcugcuggcuguguuggccauggcaccugcaggagacggcaguuacauuccagacgaguuccaggagacucaaugacccacaaagaaagcgccaaagcccacgagccuccucaggacaaugcaagacucgucuucuccuuccccacacgcaaacaaaagaacagaugggacagcacaagucucccaagaggaagaauugcucagggaacuaggagaggcaaccagcgggaggaguccccaggggaggaaauucucuuccagggaggaaucaguuggcaguaggccucaagaaggugguggucacaaagcgacaauuuccauccccugacuuaaaccccgguaaaagcaaauucacaaaaaaugauuccugugguuuuaggggcucuauuagagaaaccuuacauaaaccaaacuuaaguucauuaaccccaggguuagcagucgcaaaauaaacacgaucuacuugucuguguagucugaggacgagaagcaacuaccuuaguuaaaugaacacuuagaacacugauucugcucuugagauugauauaaauuucaauccuugcugcccgauuuucccgagggaagcccuguaagcaacguguggcugugcccuguaagcacauccagcccucggccugucgggugagcucccagcuagaaccuucuaacaaaggugagccaacuccaaguaugaagucucagugcuguuccgcaaggcgcuccaccaccuugucugugcacaggccgaggccggagcgcgcacaguaccuucuacucucucaagacaggacuuucucuugagcuggucgcuugcucuuuuggcuuaacuggcuggcaacaaguucuacaaucaguggcuccagcuuccaauauuggggucacaccuggccuuucacuuggugcuugaagaaggggugugugugcacguguuccacuucauguuuauggcacaagcgcucggaccucugggcauuucccagggugucucugucauuggccuggagcugagcucggcuggcugguuagcaagccuuacguucccagcacugagaucacaugcgcauaugaccguuccuggcuucuguagguugacaguuauagacugagcuaucuccacagccucaugauuucccgcuuuuuauugagauagaaauccacacuaugaaaccgugacuggccucaaacucugccugucccugucuccugagugcugggacuaaaggcaggccacuacaccaagcuuacuuucuugugauuccacugcaauuuguaaaaucacuuuacuuauauuuacuuuauuuagagacaagcucucucuauguagcuguggguaucuccgaacucaugauguaaacuaggcuggcuuuaaaccgauucaccugccucugcuuccugagugcuggauuuaaggggggugccaccaugccuggcuugugaaaaguucccgagcaggaacuuuguagguaacaacgcugugccuaugaauacaaaggaugacauacaauugacaagcaaaauauacauaguugaauucaggaacagaaucuuacccgcuuacuucuagacaaucugaaucugcuaaugucgccaaacugggcacaguaguuauagauguggcuuucagaaaguguugaagguagguggcccagauaaacuacuccacgguuaaguuuuucuuucuucuuuugcugaggcuaaaacagauaaacauuuuaaaaauacaaacucauacuacaccaaaacguuugugcguauacacauuuuucugagccggaucucacuauggagccuuggcuggcccaaaacucacuacguagaccuggcuggccucuaacugcugaaugcuaagauuaaaguccuauaucaccaugcccugcaaaggucuuuauuuuucaacgaaaguauguuaccauuccauaaccucagaguaaauuaauucuaaugucuuuuucuuuuuuuugagacagaguuucuuuggguagccccagcuguccuggagcuagcuuuguagaccaggcuaggcucaaacucacacagauccaccugccccugcuuccugagugcuaagauuaaagguguguguccccgccacccagcuuccuaaaguccuuucagaggcuagguggagaucugccugccucugccucuccaacacuaggauugaagguaaaagucaccuugccuggccugcaacaaauuuucaacaccauucuuuccccuugguccaggaacaaacucauaacucuaucagggcagaaacugaaaaacuccguguuugguaucucucuucccuuaagcacuugcugagcaaggcugaggccugaguucaaucacacagagccacagacucugcaagagacagacucccacacacgcacgcaccaugaugcacaccaaggcacacauauguccacacccaccugucccuacaaaacagucagcacaacauguguucaagagcuaaauggacaagcaaguaacagucugucauguucagaguaacacugugaaaccaagaccuucaacuccgaaugcaguuggcaguuuauuacaccgaaucuuaacuguuuccgguuguuaaccuucauggugcagacucuccuucucuaucaccauacuaugaccccagagaacaagaacuuguuuccugucagguaggguaccgggugaccuauaguguauucaugaaguggauauaggggguucaagaccucgacugcacagcaaaugugaggugagcuugggcuacaauaaacccuauacugacacuguaacaaaagcgacccucccaaaagacccccaggacaacaacaauaaaaaaagaaaagcugucguucucuccaaugcacuccauggugcaaaccaaagggacuauaaacuuccguuagggacauugcauacaaacugaacucgacagguugacagguugaagcccuauucugaauucugacccugagcuguauucugacucucgauccucccaggacgugggcuucgggacgucuacuccgucuucuaagcacuacaaacuaaggggacauaacacaccuuccgaaugcugcgguagaccaugaacccucauuuugcaggucaaagcggaagcguggcagcuuuaacacauucugagaucugggggugccaugcucccacacgugguaccccuccuccuucaccucacaccgauuccugaccugccucgguccccugauuggaaccaucgucucccagcccgugagagguuggcucccgagccagcccggccgccccgcgccgcucaccuucuucgugcgcccuuggaucugcgucagagccuucucaaacugcgagucuuccugcggguucaaugccagacucggcuucgcggggccugcuaacccagccaugcuggagaacccgaacaagucaauccacgcggagccuucggaagugacguuuccu

SEQ ID NO: 326 - RNA, 617 nt, Mus musculus
uuuuuuuuuuuuuuuuuugcuuuguuuuaaagaaaaugcucauaaauagaacuauuuuaaaaguugggagaaaaaagggccccgggaagugguacaugccuuuaauuuuagcagucgggagcuacaaguuugaggccagcaggggcuacaugcuaagggcuacauagacucugcgccucaaaagaauuauacacuuucaaguaucuaauuccucccagugcuggcuugguguuugaauuaguauauagauuuacuuguaagcuggaugaaaacccaaauacggaacccuuuaucuguauuacaacauuuuccaaagggagcgcuucuuaguguaucacagucuuagggcagcggugagaaagcuggucuccaguaauuacuguccggcugcccucuagcauacaauaaaggaacugcgaggagggcaacaguacacacgcggcuacuuuaaucuuuaaauguuuagguaaggaagagagguuuugugguuuuuuccaaaaauugcaccaagguaaagcagagcucuaaccgaugcagguguguugucaggcguuagcaguacugcccucacuacgcguucauuggacaguagcgcaaccccaagaaaaggaugguug

SEQ ID NO: 327 - RNA, 57243 nt, Mus musculus
guugagguuccagccacauggguuuaguacaaaugguuuuauuugcauucugacccagcacagagcccacauacagauuuuucauuuacaagugcaaaauaugcuuuauuucagguacaaaaacaacauggcauuaugacaacguggguuuccaugacucccuuucccgugaccugccacacauauuugaccagucuggacuaccaccuaaaaaacccuaccaccuuuagaaaagaaucaccccaccuagaggaagaagguaggugagaacaccucaagaaagagucacaucaaagcauggaagaacaugguaaguaagcaagacuuuacccagcaggaagagauaggucagugcuugaaauggucccccuuugcuugucucuaauacuagccccacaaagcucucucccguaguuccgucagcccauuaacaaagccucagggcagccacgugggaagaagcuuguccacguacuucacagauguggccuucguaggaccuggcucaguccacggaagguugaauauccuagauaaacaagccucuaccugggcggguugagaucuugaacuaccaauacauacaaauguaauacaguuaucuuggggaugggguuuacauccacacacacacacaagauccacuuguguuucugcauaugcugcacacaugacccaaggguaauuuuguuuguagcauauccauguuuugaaugugacccguuccaugcagucagguauagaauucuggauuuggaaaacaggauguguaacuuccuguaguuuaaggacccagucugucucucauuuuucaaugguuuccccagcuagaaaccugggcagagggcuugagauaaaaacuccaugagaagcaggucaaugaggaauacaggauagacagguuuggaguggcugcaggaugcaaggggaugcagaagacaggggagggggcgucuacagauagacaagcuaugaaagaugaacaucccuggggaacaccacacucugccccacaaguacuguagaaaucuggguccagggaaggcaggaagcugcccagaaaucacaaccacacaggaagggucuagcauauauggggaggggucuguaggcuccagggaugcuaagcuaacagggguuuagucuucaagacaccugcugaaaucagucuguccuuuccaggcagguucuaguaggcgccucaggccacugcuacccccuacagcucggcaauccauaaauacagcacaaaaguccuuucuucuaucaaacccugaccagaggaccaggacaaaggccgagcaggguuccagguaacaggagcguuugaggaagagaccucuguacucucucucauggaaaggcugggcauagucccugggagccaagugaggaucagaacuuuccagaagugagauacacagaaggcaaggaacucuccagacuucugauugcaccuucuacuucuccuaaguuuaugcaaaaugcauuguuaagauagcccuuggaaauguaaaugaggaaaauaccuaauuaaaaaaaaaaaaaaagauagcccuuaaugcuugagagugcccuaaguaauccuaaggagagagaaggcugcugagguuaggggcuagcucagugguagaacaccugccucacaugugugaggcccugaauucugggucuguucccuaccacugacaaauaagacaauaaaauacauuaaaauguuaaaaaaaaaggaguuggggaguaaauauuucaguauuuaagggcaaagagguaaaauuaaguauguuggcacaagagaaaacaacuuuuaauaguccagacuggccugagacucagucacccuucguuuacuccccggccacagcauugcccugaguacugggauuacagguuugcaccaccauacccagcucuccacaauguuauugguuuuaugguacuagggauagaacucagaaccuugcucgcaguugggaagugcucggccaucgagccccaccacaguccugcauaauuuaacacaagcaauccaauacaguaauuuaguguaauuuuugauggcaaggcuaucauucccugaacuagguuugaagauaaugcucucuaguaacuaaaugauggcgaaaccaguggacagcacugaguuuaguuccugucugcaaauauaaagggagggcacucuuuggaaggaagggaacacagaccucuucacuccaguccuuagaacagccugaaggcccagguuagagacccuuuacagcagugccugcaggggcucagagacuccuacugaggcggagaagcagcuaaggagagcuggccuugggaaaggagucuggguacuuccuagagucucacugcucuuugggcccaguaguccuaucuucaaaggacaaagagauuggaagaggaaagagaaaagaacacucuauacuggccaaguagacuggcucggaugacagcagauagcagcacaucacugaggcccacaccuacacaccugcacucacccagcugcagucagggaaagccugggacuuggugagcaggcauccauccacucggguuuaccugcagcugcagcagcacugguggcacugaauaccgaggacaagcaaaggucaccuguccaccacaugacuuugaugaaugggaaacaaugguaaaguuuucccgaagcucagauucaccuacugacuaguuuccagguucucaggucuccagaucaaugcuucuuguuuuaggggggcaguucugccauucaaacacagggacacucuacuaauggucuacuguucaccuuguauuaaagggagccugggacccuugacuuuugguccugucccuccaguguaccuaaggcagugaccauauucaauuccccuugcccccaacaaccucaacuuuccacugacaacagcuaaagagucuuucuauuucuuccacugauguguuaauaauuuucagaacuccagcuacuugggccagccccugaagcaacacuggacuuaggaacuggugacgugcuuauggguucuagccuuuuccugguuaauagcucucaaggggcuccaggcagacuggguaagaggucacuagggcaaugucugacuguuuucuagacccccacaauggcuaaucuugauugucaacuugaugggacuuaguaucaccauggaaauaaaccucugacuaugucugccagugaguuucuuuucuauuccuuuaauucacucaucgggagcaagaauacauucccccacuaccaaaaauuacucagucaagcacauccagacugcaaagaauaagcauuacccaggaaagaccagcuccuugaucauggacucuccccugccaagcaagugugugaggagucuucuagauuaguuaucugaggugggaaaaccuacccuagcauuucauggcugaaguuuugcagaguaaaaagguauaguagcaguuuugugugucaguuugacacaagcuguaguuaucacagggaaaggagccuccccugaggaaaugccuccaugagauccagaauuuucucaauuagugaucaaaggcgggagggcccauugugggugggaccaucucugggcugguaguccuguguucuauaaggaaacaagccaguaaagaacaucccuccacggccucugcaucagcuccugcuuccugaccuguuugaguuccuguccugacuuccuuuggugaugaacagcaaugugcaaguguaagcuaaauacacacuuuccuccccaaguugcuucuuggucaugauguuuuguaaaggaauagaaacccugacuaaaaaaacagagaugguaagauaaacauuguauccaucugccucugcuuccagcugucccaugcucuggcugccaagacuucucagccacgacaaacuggaccuuuaaacugugagccagaaagaaacccucacuccuguaaguuuuguuuuguuuuguuuuguuuugcuuguuuguuuguuuuguuuuguuuuugucagauguuuuucacaacaaugagaaaaauaacuaauucagaccccaagacaagacuuggaacauuccaugccaucugcucuuuuuacagugugccaucuuuggcucuccaguuuagaccgacuuugguaugagaaaaaaaaaagguaucaguuuagucucucuuccuuuagcccauguagagcuaucacuugggaacaggggccacagauagccugaugggcugaaagucagaggcccaaugaguccuguuucucccaguggcucgccuugagcauauuauucuaagagacucgguugccucucuauccaagcauggaaacguuugggaaacguuuggucauuaccuuccucuagaacuaggaaguguuagugccaggaaaaacgacagaacagaggggcaucauccaguccugcugacaggaggagaggagggaaguggccguaagagcaguagacccaaaugcagaccaagaagguaaaaggaacaagagaucagcaauggucccgccgugcucacaaagauccaggaaucggaggucuccagacuacagaagcuccaguccuuucaguaauuagggguaaaauaaguagacgcucacauguaaaaggaugaaacuagacucucccacuacauaucauauauguaaaacuaacucagacuggagcagaacucauuguaacaacuaaacuuuaaucauguuccuaagagggaccaggagagaugguucagggguuaggagcauuggcuucucuuccaaaggaccaagcuucaauucccagcacccacauggcagcucacaccugcuugcaacuccaguuccagaagaucuaacacccuuacaaggaucuguguguaugugugcauauacauauauauauauauauauauauauacacacacacacacaaccacacauacuauaccaaugugcaaaauaccaaugcacauaaaauaaaaauaaacagcguuuuuaauucuaaggagaaaacacagauuuuccugaguuugcauuaggucaugguuucuuaguauccacaucaaaacuacaaucagcagaagguaacucaggcaucacacacauuaaaauaaugaugacaauuguuucugagacugggucuuacuauguagguugggcuggccucgggagccucagcugaguacugggagugcugguucauacuacuaagcacaaccaauuuagaaacauguacaccccaaggagcaucaaccauuaagagggugaagacagccuacagaauggagcagaauggagaaaaacugaugaaggauuuucaucaacaacuuguacaauucaaugaagagagcccaauuuaaaaacaggcaagacauaaccagacauuuucccaaagauauacaaauggccaaucaaugugaagagacauugaacaucauuagccagagacaugcaugacaccagcaggauauuguaauaaaagacaggucaccacuagggagguggcucagcugguagagagagcucuugccuagcaagcacaaagcccuggauuuugucccagcaccgcauacauuagguguggagguacuuuucuauguuguuagcauuuaagaagcagagucaggaagaucagaaguucaauuuuccucuucuacuuagugacuucgaggccaggcuggacuauacggaagaagaagggggagggagagaggacaggcgggcaagaaugagaaaucacagcaaauguugaugaggagguggagaaacuagaaccauccuccauugcuggugguaauacaaacacguguagcugcgugggaaacacugggcaguuucucaaaccggugaaaaguuaccuuaugagcuguccauucuaccaggcacauucccaaaaugaaacccuguccacagaaagccugugccaauauauucacgacaccaacaucucaauaaagcugucaaccccacccacaugucucaaaagacaaggaacugagagcucaucuuuccugugagaguaguuuuucugccuguaaaauaauauuugccaaaaccuuuggcaaaucuuugagcuuagaaguaacucacuauggcuugaggauuaggaaagaguugaagcacugggugggcauaauaaagaugaauuaagucuaccauagcuacugauccucaaauucccccagaguuaagaaaggugaacaagccaggcagugguggcacauuccuuuaaucccagcacuugggaggccgaggcaggcggauuucgaggccagcuuggucuacagagugaguuccaggauagccagggcuaacaaagaaacccugucuugaaaaaaacaaaacaaacaaaaaaagugaacaauucaaccaugccaacaaagacaaagcaccuaucuauauaccuaugauagaaucuuaaaugagcaaugaaaaaaacaccauacuaccccugggccacuuggcaaacagcagugguuagcugagguugucugaaaaagagaauucaguaaguaccuccugcuguagcgcugggauggugcccagggccucauacuugccagggagggaucuacugagacauaccccaacccaaaugucuagaauggauggucaaggccacuggauaacagaaucuucaccucuuaguacucuuugcucaacagaaaugagaauacacaguagugguccaugaggaaucauucuguccucaccucucuucccuggugaggaagucacaugucaucuccuaguccauagcaucucuaacuagaaaaugugggaggucacaugggcaaaauguguggcuugaaugagaaauguaucccaugggcuuauguauuugaacacguggucccaguuggugauguagucugcugagguuauggggcuuuuagaggaugcagucuugcuggaggaaguaagucacugggguuggugguccuugaaggcuuguaccauuuccugcucuugcucuuucucucugugcugcuuccuacguguaugaaaaugagaucagcuagcuuucuguuuggcaccuuccucaccauaauauccaccauaaucccuacaaaacucuaagccaaaacaagcccuuucuuuaucaaguugccuuugucagaguaucuuaucacagcaacagaaaaggaacuaauacacaaugagaggucacauagguacacugugccaucuaccaugucaaugcagagacucugggcuugaauguagcagauccuuagagacaaggcgacugagaaagaaauggaaggcacaaauaaauagcuccagucuuaucaagucauccaagaacaggagagacauggcuaccaggguccugagaaaggaagucaguauuaggaggagaacuguguguggagcccuugugagauuggcagagcuagccaugaagccagugacucaagaaaaagaagcaggaaucagggugacauaagagaggagacaggaaggaccaauacaucaaaggacccuccaacugcagggcucagaguuuaagagaugcacauccccacuaucugcccaggaaacagaacaagaaacuuaaaaaccuaaaagccaagaggaaaggagaagggaaccgcuggcuuucuucuguacaccagacuuuguguccaugguugucuguagcuuuccuggucuggguagagucccuccuagucugagcuugucaggugagacagcagcugacaguggugcaccuuucacagccagggauccauggggcaggggacaggugcaggcgcugcugcucagaguccacacuucaggaugaugugguagccaucauugcuuucugcugcaagagaaacacugggcaugggcaugcgucacagguacagaguugguacagugugauuugggugucccaaaaggcauguauuaagucagaggcaaaaaucacucaaaugacuucauaaggaagagucuguuuacagaagcagggcuuucuacacagguuuuggcaucuguuuacacaauuacugugugugugugugugugugugugugugcauauacuugugcagaggccaaaagguaucauuccuuaggaguuuuuccacccuguguuuugagacagucucucaucggucuagagcucaccaaguaagcuaggcuggcugaccagugagccugucucugucucaccaggcuaggauggaucacaagcacauaccaccaaugcccagcuuuaaaacaaaaccaaacaacaauaacaaaacauggguucuggagacugagcuagaggcuuccugcuugcauggcaagcacuauauugacugaaugaucuucccaggcacucugguuuggacaaagagccuuuucaccauagauagcccuaggcucaaggaggaggcuuuaggcaaacuauggcuuucugcaauuguuugugcuauauuuaggaucuuaaggcccauguuguaaaagguuuagucaccagcuuaugcuagcgaaugaugaugggagcuuuaagggguggagccaagugggagaaaaugacaucagcccuuggagggaacacugagccuuggcccuccucucccuucacuuuccagcugucuugaagguaacagagcagcucaccacacucacaccuucgugugcugccuugccaaagggccaaaugcaacagggcuaacuggccauggcugaaaccucccaaacugagcccaaauaaccaaccucacacauugucacaguaacaaaaagcuaacacacacagccuagguccccagaacagggugggaguuggucuuagaacagccugaacccagucuccugaucuuuaagacuuauuuuaccuuuaauuuuguguguguguguguauauguguguguacacuugugugugugugugugugugugugugugugugugugugugugugucugucugucugucugucugucuaggugcaaaugaaugaagugacugcagagaccagaaaaugguuugguuccccugaagcuggagcugcaugugagugguugugaaccaccagaugugggugcuaagaaccaaacuuggggacucuuuaagagcaauuuguguucucaucuacugagccucuccuccagcccagucuuccauucugaugaaaccuauccacuuacccucccagacccaagaaagucacagcagaucuuucucugccuugugugaauaaacacaaauccugguauagucucccucucgguagaauguaagcacugcgguauucucauuguggcaucuggcucaucuggauucuccgagucccuuacucacucugcccaucaggguggcccuuacuugggcuucccagaaacugucuaugaaaucccaaacccaaguccauagagaacagauggccaggccugcagugccccuggagauguccauucuggcuuggcuaggacuagguaugagaagacuugguuugccuugcucucaaaggcugcuccaaguucagcaucuucuggaggacccuggacuggcagaucccaccugccacccaucaccuaugacaccaagggacacagaaacacucuucauucaucaggaaggcagagagaggcuuaccuuuuaaugugcugaggauaaaacaagacucaucuuggaaauucugaaccaucugaaaggcaaaggcaagacauguucuucacaaugacaucacaaagguuuagggaggaguuggagagacagcuccaucaauaaagugguugcugugugagcagacaggaggcaccagaaagacaccauucagggucucuuuugaccuccacaggcccacaugcacaaaacaaaaguuagugaaagagccagguggcgcacucagaggcaaguggauuugaguucgaggccagccuggucuacagagugaguuccaggucagccagggcuacacagagaaacccugucucgggggaaaaaaaaguuagugaaagauaauaggcaggcagugguggcacaugccuuuaaucccauugcucaggaaguaggcagguggaucucugugaguucaaggccagccugguauauaaagugaguuccaggacagccaaugcucugucacacagagaaacucugucuccaaaaaaguaaaagauaaaacaucuauuuguuuauuauauguugggucaucuaggucuuuacuggacucauuaaaggaaaguuuaugcuacaacaaaaaauauauuuaaaaaaauugaacacaaaaccaggcaugguagaauauacucuuaauccuaacacacaggaagcagagacagacauaucuccgugagucaguccaaggccaaccuggcccauacagcuaauucuagaccugcuaggguuauuacaucaugagacccuugacucagaaacaagcaacaaauuuaagcacagucaaucccauuuuggucaacaacaaaacacaaauacaauugguggagcugaaauuuucucacugcuuaguggcacugucauccugguaacacaauuauucaugucugugguaaaguuguaagcacccuacuauguggccaguaugguacagaugacccacaguacacacacuugguagugacccuaaauuacuccacugcugauuuacacauuugacacauuaucuuuugugcuacuauguuagaguguccccucacacagcaguccccucgagugcauugaugcuaugcgcagugacuguaccauccgggguugagugccuguaagcuagggugcuuccauagugauguccucacuuagcuaaccugcuucuaaagcaauugugccugaaugcaaugcaaaugugcucccugggccaaugccuuugaaccagagccagagccagugguaccauugggaaagucguggaacccuuaugagguggagcuuugcuagaggacagggucaaugggugugucuugagcacuuauagcuagaugcucugcuuccugauggcccaguggccuccccagcuccugcugcuauacuucccccacacugauggauccuaauaacccuuccucccuugugcuucucagcaggucuucugcuauggcaacaagaauuaacuaaccaccauaauuaauagauguguguguccguggcuuuacagggaccaaacagaaagagguuaauacucccacaugaucaggaaagacaauuuauagccaugucuccuaagcuuucacuaugauuugcaaacacugaccacagaaaagcuuucuguuucuggcuccacggccucaucuguaaaacagaugauaacaacauaagcaggguguacaaugggaacuagcaccucugcaggugauaaauccaggugauaaaucucuagaaaacgccauguucuggauggaggucaccccucaagcucuccugcucaugugcaccuucacacgugcaucuuuggcauucucaguagcaggagugugagucaacugggaucuaaccacucagagguacagugacccucagcugcacauauucacauauuugugaaucagaacauaugguggagggaaaagaggaacacggagagaaugcaugcccaguccacacugggcugaggaaaugacaaguuggaaacaugcgcuuugcaggcaugaagagccaaguuugauccccagaacucagauuaaaaaacaaacaaacaaaauaggccugauacuguggcuuguaaccccaguugcugggcacguagagacagacacaaggauugcugaggcucucugaccagccaucacagucucccuggucagcucuaggacaggaagagaccuguguuaaaagccaugguggguaguagcugaggaacaugaggaacaacggucaaggcuauccuauagccuccacaagcacacagacauguguacugcccuaagcacguuagggagggaagaggaaaugauuaguguaaaauauacacggacaagcaagggccaaacaugauacuacaaaggggccuauaaccaucacagucuagugaccugggugcaaggccuuaaauacuuauuaaaauugcaagucagggcagugagguagcucagccagcaaaagcacuugucaugcgagcccuguaggccuaaguuucauucacaaaacccacucacacacaguguccuaugauuuccacacauauacuuuguaugcacacacacauauacaggcacacauaaagguaaaauaaguuuuaaaaauaaaauguacauuaguuuuacaggaucuuugcauguguaagcuauauuucauaauauacauucagaaguaguuaaaaaaaaaaaaauauauauauauauauauauauauauauauauguaaacaugcaugccaaaaccaacaggguagcaaaucuccuuucuauuaaaaagaaaaagaagggcuggugagauggcucaguggguaagagcacccgacugcucuuccgaagguucggaguucaaaucccagcaaccacauggugggucacaaccauccguaaaaagaucugacucccucuucuggagugucugaagacagcuacaguguacuuacauauaauaaauaaauaaaucuuaaaaaaaaaaaaaagaaagaaaagaaaaagaaaaaaaaaaaaaccagaaacccacauuuuauugccugcucuggacuacugccucaaaucuuacaaaugcauccaccugucgacccugacccuccccgcagggccuaauggugcaugaaguacauuuauucuauaccucagccugcuccagcucggacucuuggccgcccagccacuugggcaugaaaagcccuaagcggggcccacaagggcuuaaucaguaacucccuuguuuaauugagugcccuugcaccccaggggcuggcuccuugcuggccaggcugccuccagcacucugaguaauucagagcugaagguuuccaaauugauucggguugagugggaaggagacuuggggaaugagaauggccuacuuagccaggguggcguuugaggucuguucccugcuucacuugcuuaacugccugcugucgagggcacagggcaagugggggagggugcaagaaacagucaugguuuuuugucuucuuaaacagaaaugguugagggucugaggauguggcuccagggcuugcuuaguuagucuguacaaagcucuggagucugucuccagcacagcauagagaagguaugguacagugcagggcugcaaucccagcacuguaaucccagaauggggccagggcagaucagaaagucaggguuguccuuggcuacacaauaaauucaaggccagccugggcuacagaucuuccuugaggugcaaagugacaugccuuccaguucauuagcauggucgucuaccacucgggcccuucauccuccuagcuucucuuagcccuagaagcagcacugcuggucucaguaucauuuucugugaaacaggagcaaaaaguagcuacuuuaagcuagaccuggugguacaugccuauaguuccaaugcuuacaaggcaguaacaggaugacuauaacaugauuaaggcuagccuggucuacauagugaguucuggaccagucuggguuuuacacugaagcacugccacaaagcaaaccagaacagaacaaggagguacaacuucauugagcugggcuuguugcauacuccucuaauccuggugcccaggagacagaggcaagcagaggauuguagcaaggucaaggccagccuggucuacauaaggaguuucaggucucaucucuuuugagauugucacaaaaccaacaaccaaacaaacaaaaccauagcucccauuucucaagagguuggaucucuuacugguucagcucuccaacaauugguucaucuggauuucuaccuuaacuucacuccauaucagcuguagcaucuuugggcaacuacucaguaucucugugccucaguuuccuauguaugaaaugggaugcuagcagaugcuagaugugcgugugugaguguguguguguguguguguguguacauguauauacacacauacauauauauauauauauaugaauaucauguacauauuacuuaauacaugauacaugugaacuauauacauauacauguaagcaggaguagcagccaggacauaguggccaugugacuaugauuuggauauggagugucucucaaaggccucuguacugacugccucugugcuacugagauauggaacuuuuaagagguugggcccagcaaaaaaguuaggucaccaauguuaguagugaaggggauaccgggaccuuaguaccccacaccuacucccuugcuucuugaccauagugagaacaauuugcucagccgcucuccuaccaugauaguuucuaucucuccaucacugggguuguacugugguuuaccacuaugcccagcuuuugacacgggcucaggacgcugaacucagguguccauacuuuaaaggugagcccuuuacuaagugagccucuccccagacugaaccuuucuucuuaaguucaugaucccagacaucccuuacagugcaaggacacugaccaauacaccaccagacacacauuucuguuaguuggaaaugucaguugaaggaagauccaggacagacaagcauaagaucaucuguuccaucauaggcaagggaugcucaauuuagcaggcaagucugcucaacacaucacuccucacaggacuggaccaagacuccgucacuuucuggauauuugcuagccacuauuuccagcuuccacaggauuguguugagcacaaauucaguggcacacaccuucaucacucagggaggccuugcuaguagugucucccaugggccauagcagcccaucauuuaacuacuggccucucaggacaugauuccuacuugauggguagcccauucuucagacugcaguugccccaagagcacccagccaaggacaacugaagaaggcuguccucugaguauaacagccauuagcaucuuagucacagcggcuaggguuacucacaagagacccucacgauagagccuguggggccacggagaugagugaaggugcuugccccaagucugacuccuuagucccacauggaggaaggacaggacugaguccuucaaucuagccucuaaucucugugugugucccuuuguacccauucaccuccuuaccaccccacuaaguaaaugaauaaauaaauguaauaaaaaugucuguuauuguagggcuuguugcuaguuccuuauuauagagggaagagggcaugaggaggguucucggccccucacaugggacucuagcugauuccgcacaccuucccuccaaguuuaagugacuaguuuggaagguaaacugagaaacuccaucuauguagcuauggggacagacuguuggugauaaagcuguuuuggggucaucuuugcuccuaagcccaauaaaugaaucaguuuggaauucuuacuuaaggcuuuuguugacacccuaagaagacacuuguucauauuuuuuuccaggaaaagucauacaacaucgacucagcagugguaagaacuuccccuugcugauaucauaggcagccaguaggcuuucagcuucaagcaggcaacaugcauagaaaacagagacccucugauccaguggaggaugcuccugagugcaucugggacucuuauggagggccaggucagcucaccucauugcuuaccaccacguggaugccagcgggacccugucgauagacgcgguguauaugcuguggggggaugcuguacaggcuggcgaucuucucagucagcuccaggguagucagcucuuccaggaagauagcaugguauacugcagggagaggagcaagugccuucuuuuaaggggccauuaaauuaacaagaaccuggcaauguguuucuaccccauccugagaaggcaacagcuuacauggaaggaugcuccugccccaagccauggaugccugucaagcuaagaaggcugguaaagcaugcugacagguaaacacaggugagcuguuuuccucucucuucgucacauagguugacuccugggcccaaacaggcacccagcuagggaaagaggaggacccugaggagcccugauucaucuguggugccugguaugcagccgguaggagggggaagcgccaagucaccuuucugcugguggcagaaagguauuuacagacaauugcaccaguauucauugcucucugcuuccucauguuggguucagugagcagcugccucgaacuccugcugccauggcuguccucccuccaugaacuaccugcugccauggcuguccucccuccaugaacuaccaccagacuaugaggaguaguaguaaggaaccuuccuuccuaaguugcugucgcacgugacagguauuuugucacagcgaugagaaaaguaacugaaacacugagaacagaaauugagcugcugcucaggagucagguugagguucuauuccacucaccacacaggcuguuauccccacugucauccugcuucuguggcaaggguaguugguuuugcuccagcuccugacagacauagauggucaucuuuggccucacauuccuugcagagagagacagagacacagagaggaugacuccuggauaugauggacuguuacucuagaguggaccuugcaguauaaagggcuuuagggagacgcagugguagggaugcagaacgcuuugcauggacuggcuucggggacagaguccaguccugacggaucuuuacagcuucacagaggacgcucuagaggagcugggguggaugacuucucccaaccugccaaucugaggcuuuucuguagaacagaaucucaagaucuggauuucaagagguggugugauggugugguggugugagauauagguuggugguagaacaugugcauaauguguguaucauaugugcagcccuggguuccauucccaucaagggagagaaaggagacagagaaagaacuggacagagagaguucuccacacaaggcucaucucccccauucuacauauaggaaaacugagguucagaggggcaauggcuucuuucucauuguacagcuccuaggacacaaaucugggauucauccugcuuuguguucucucacucuacaacagacuguguuguguccaguguccucagggcucaggagcagcucagugacaaagcaugugcuugggauacaaggcucugaguucuaaucucagcaucacaaaaacuggaaaguacaaaacuucaaaacugggucugacugugauguuaccucuagugccucaguacagggucccacauggccagggauuucuggauugacugucauagaauauuucauuuucauggugguggagagucuaucagacaacauagcccugaaacugcacugugguuuucaaggucaugcccagucccuggggagucagagcugucagccuggacucugcagguguccagagucugggcuagugacuaaaggccaagauccacaggcucugggcccaauggaggagagggagguugugaugguuaauauuaauugaugaucuagaaucaccuaggagacaaacuucugugaggaagggaguuucuagauggggucacugagugaaaaggcccaccauaaaugcaggcagggcuagcucaugaacuaggguuucagacugcauauggaguaauccagauccccagcauuccuucugcuuccugacuuaaagacacagcaagaccagacaccucccccugccauagccaugacuuccuugucauaaugagguacugugcagaguggaggaagcccugagggacauguguucgguggcuaugaccuggcuaugacaagggcccuagugucaaacccaugggaaauggcaaagccuugccccggagugaggcucagaguauguacuggcuaguuuuguguuucaauuugacacagguuggaguuaucacagagaaaggagacucccuugaggaaaugccuccaugagauccagcuguaaggcauuuucucaauuagugaucaagggugggagggccccuuguggguggugccauccaugggcugguaaucuuggguucuauaaggaaggaagcugagcaagacaggggaagcaagacaguaaguagcauuccuccauggccucugcaucagcuccugcuuccugaccuguuugaguuccaguccugaccuccuuuggugaugaauagcaauguggaaguguaaguugaauaaacccuuucauccccaacugcuucuuggucaugauguuuuguguaggaauagaaacccuaagacagagugcaugauuaaugauaguggguucugaaaaugugcaccauggcuccacccacccuagauauuuauggccuaaagacuguuccuacagagauuagcuaaaucugccuccuuguucagcuguauacuguaaacccucuuucuuauuuaccuguaugcacuaagccuuguucagcugcacgcaauaaccucacuucccuguacaacucuaauaaacacaccaagccccuggcaugcugagguuucuccaucagagagcccauucucucugaacccagcucuccuguacacgcaucugucuuuucuucauucccuagggggucccagucugguccaucccuugagaugucaagaugugugugacauuguaccuucaaaccaugagcccaaauaaaccuuucuuucauaaucugacuugggcguuuugucauggugaugagaaaaauaacuaaugcuaagauagcucaagcaagggcuacugcagucggauacuccacauggcacucauucaccgucccacccuccuggcacauccuccaguauuuaccuucauguugaaagaaggauuccuuccaucaccuagucccacaagcaggcuacaguuaaagaggcuauggugugacuucuugcuauacacaggcagccuacuggccacagucuuugguuggcaucucuaagaaaacugcaccuaccugccuuugauggcauugaagagccgaaucccaucugcagggccacagaccuggaccaaaucaucucuggacaucuucaggaggucagcaccuaagcagagacauguaccacucauuacaagcaaauaccugccaaucccacagcugggcuaggggacaaagaagggccagccucacccucaaugggcaccagacccuccacagagagaaauggcaugaagauaaacaauccuagcagaucacagccacacaauguuggaagcuaagagcuagagaagauaagucuacucccgccugacugcccacccccccccgucauuuucaucagcaauguucuaucugcaaagauuuuaucagcaugcugccaccaccaacauguguaugucugugcagaagcauacagaucacugaaaguugacaauacaaacacacccugggaaucagccagaacaaacuaagaggcaaaacaccagucucucaagagacagccauggacagaccuagcaccccauuugaaggggcagagggaggccaccagugugaaaucuuuaaagaucaagucccccagauccuagugcuccauccagaaccccucuacaaggggcucgacuccccucuucuccucuccuccucuucuucuucuccuccucuucuuucuucuucuucuucuucuucuucuucuucuucuucuucuucuucuucuucuucuucuucuucuuccuccuucuucuucuucuucuucuucuucuucuucucucucucucucucucucucucucucucucucucucucucucucucuccccaauuacuugucagaaguagcugcagacacaauggcucuccaaauccaauccccacuuuuucuuuucuuugagacaugguuucauguaacccaggguggucuuaaacuauacagccaagguaaccuaggacuucucacucuucuaccuaagugcacuauacccaguuugugaugugcuggggaauagaacagggggucuccuaaaugcuaagcaugcagucuacuaacugagcuacagcuuuaauccagaaugguugguauggccaauauccuucuaugguccugccagaauccagaucacugccccuagucauucugugacacccaccucaccucacugaggguuccccuggacacagccauaggcccaugagaucacgagcaagccaggaaucuacaauacucacucaccugagaagcuggcaaagagccagcagaauugugagaagcgguugcgaugcagccacugcugugcauccuggauagaggcugaugggagcaggugcugcaauuaauugagagaaagggaggguucaaaauggccacagagccagagggaccaccagcccaucaaucaacacccaugcauacuuacaucacugcccagggguaagggcuccaccgggugauuaggugagcuguuacuguaauggaaaagggacaguugaugagcaugagggaucccagggacacaaggaagguucuagaaccuaagugguaccuacauucauuccagcaggugugugacuugcuuuaaauauaaguccugcaagacuuccugaaucagucacaauuaguuagacccagucucucaugaugaaugucuucugcacucaacugucauugugcaacuucacagaagguuuagaugugccacacuguaccaagcaacaucaacaccucuaucuaugucgucuucagcaacaaccaagaagggcuuaucuguuucgucuggaucuugugcugcacgguggagccucacccuugugaugguccacuuugacuagacuuagagucaccauggaaacaaaccucugagcaugucugggagggaguuucuacaucaaauuaauuaaggugggaagacccacccuaacugugggcagcacugucccauacauaggcugggguccuacacugaauaaaaaggagacagugagcugagcaccagcauccaacucucugcuuccuaacuacagauacaacgugagcagcugcuucaagcuccaucgccaugacuucuucacagacuaucuccuuuaauugagagcugaaauaaguccucccuuaaguuauuucuugagaaguauuuuugguccagugaaagaaaauuacuaaauacccaccaaguuccagccuaagaaaaggacaagcugaccagagcacaggccacauuccuuccagcaauucagcaccuaggaaacugcagcugaaccaaaagcaucaaccuaguccuagccagauaggcauguaaggaccgcugcggugaauccacagguuggccuggguuuuccugauaggaauggacagggaugcuugccuugugagaauguuagauaccuaacacccauauaaaaaaaaaaaaaaaaaaacugguggugcaggacaugccucucccaguacuaggaugugagcuucacuagagagcacuagccagcaagucucaccaaaucagugagcuccagugagaggcccugucucagagaguaaggcagagagugacagagaugccugauaucaacuccuggcuuccaggugcauaugcaugcccacccauacauucuuauacacauacacauauacacauacacauacauacacacacacacacacacacacacacacacacacacacacacacacacgcacacacacgcacacacuagacgcuugcagagaugacccucaucccagcuguccauuguagcagcagccuuccacugcagcacaggcacauccuuccucaugcccuuuguugaacccccaagccccuucugcauccagcaaagcagggcuuagagaaguuaaggaaguuguuucccuaaagauagacauuaaagugcaggucugccugaucuaaacggcccuuuuguuauucuauacucaugagaagacauuucacaaugguaaaaucuuugacuugagcugaccuugaacuugcuauauaaccuugaacugcagauccucuuccucuaccuucagaaugcuggaauuacaggcaccaccacaccaggugcugaaggucaaacucagcauuuccucuacuaucacccaacucugauuucuuauuauagacugacugcagagcagaggcucaaaacagagguccugcacuggcuggcuggaguucuccucuacucacuaccaggaccaggauguuacugcagagccaccacagagauaucaaaagccucagucugcacacacagucauagucaucauaggcaguuaggaucugccuaugauguccuuccuaucccuguguccuuggggccacaagaccuaucugcagagucagccaagauucagcuuuggugcuacaacacugaaacccaggguggaggcuccuaccuggacagucccuucaggaaggguacacaagagguagacagcaaaccaaggagggccuuccagaugcuucagcuauccagcacagcacccaccucagcugaacacuggucuucaagguaaauuacaaaccuguugcuacuuauggaaguauauagaaaagagcaugcacgcaugcacacacacacacacacacacacacacacacagaugucaggugugauagcauacaccuauaaccccagcacucaagagguugaaaaaguaggauugcaaguucaaggccagcccgagcuaaccaaguucaaggccagucugggcuauauacaucccugccuuaaaaaacucaaagauaucugggccgugguggcauuugccuuuaaucccagaacucaggaaggcaaaagcaggcagaucucugauuuugaggcuagccuggucuacagaguucaaggacagucaagauuacagagaaacccucucucaaaacaaaauaaaaacaaaacaaaacccaacaaacccuaaaguuaaauauaagaguugaggguguagcucagugguagaguucuugccuagcaugcaccaggcccuggauuccacccucagcauggggagcuagagagaaauaaacauggcugugacugcuauaucaguuagccacacuaaaacccaagcagaugccaggccauggcaugaaggaagaccagaaaaggacuaguccacugcaugccaggagccccaaggaggggaagguuagacguacccuucacggaggccaaagcuguugggagagccauuguagcuuggggaugggguguuguucgccugguaggggacgucaggccauggagaacacuaugggaagagacacaacacaggcauguaacacaacggugauauaauaaccugaagagacaacccacgguccucgggcccuucugcggaagcaagcauucaugagcucugaugccuaagacccuguugugucagcauagaguccacagcgacuaagugcucaugaggagccguggccaaucagacauacugugacagaaaagaccucgaacucagaaagucauccuggauuaggcaaaccaugaaauguaccaaugccagucaaaccaaaggggaaagaagcaucaugugauacgaaagcccacaaccugacugucaaucaugcuuacguaugcaucacacagaggagaggugacuucuaaagaaagagaaaauaggaaaaugcagggcuaaaacccaugccauugggugagaaaacugcaggcagggagggccagagcaggcaggagggcuccuggaacucuccaagacuagauccucccagacaacuuuaucaguuacuccauuuuaguacccaucuaucugggcuccaaaagacagaaacacacaugacgugagccuuccucugcuggacauuccaaugcacaagcagaaaugaagaggcccaguuagggguguuggagagagaccaugacuuccagggaaagggagcccccaugccugccuuucuucccucccucuaaggcagugacucugcuuggagagggcuggucugaggcauuccuaaagacugacuaccccccaccaaaugccaggcugguaaauauuuaaccauugugagugugggcuggaauuuguugaugcuaaauccuaccaaggaaggaaaucugaugagccgauagaaggggugcacuggcaucucccaaggucauagucuggauucuucauaucagccaugcugauagagagaccgugcugagggccugcacaaccacagcacccucucuucuuucagaggagucaggguuggaacagagaaguuggggcucagccaggaucagaaacccagcacuagauggggguuuuccuggcagugucaucagucagacaugggccaggcaugggaugaaacuacaugaaaagcaguccuuguguuucucuguggcagagagcaagcagaagucuuccuguacugggcucccugcacacggucacccuuagaaaacauaaagugccacauuagcuucuuauacccugucuuaugcaaauguuccuccaugaguggcuuagcgcauguguauacaggcauacccacagcugagaccuggcuaccccuguuggauuucuguacccaagucucaccauuaacacagcccaaccuugcaugaccacccugggucauucauuccuaucuauauaucuauauauccauauaucugcauaucucucucucucucuuucucauauauauauauauauauauauauauauauauauauauauauauauauguuagaguaaauccaauuagucaaaaucacuaacacaaugaggaauagcuaccaaaaacaacaacaaacaacaaaaacccagggcugggcaguugugguacaagccuuuuaauccgagcacuuggaagguagaggcagcagaucucugugaauuugaggacagccagggcugcacagagaaaccccauguagggagggagggagggagggagggaaggagggagggagggagggaggaagggagaagaaaaagaaaggaagguaggucagaagggagggagggagagaacaggccaacaaaaggaaagacgcccagauggccagugacaggaagcaggagagcugcuaauagcauuugaggaguuuccugaaccugccucuuuugugucaggcuuaacaggaaggguauuucuguaucuguccaaacaagaccuagucagcgcugggaauagggucaagcucaguggguuccuggguuccagaucugacacagaaucuuaaauguacuuguauuauuugauuauauguuuacgaguuuauuuuuuauuauaugaguauauaugguguguguauguguguuuguguguguguguucacauacguguucugaugugcaugugaaauggcuuguguauggaggucagaggauaacacucagaaguaguucuuuccuuccacuuuggagcuggggaucaaacucaguugccaggcuuaggcagcaagcacuuuuacccgccaagcuaucucuuauuaaaaauccaugcuuuuaaucacagcacucaagaagcagagacagguagaucucugugaguuggaggccagccuggucuggucuacaggaaaaauuccaggacagccagggauacauagaggucccuaucucaacaaaacaaacacaaaacaaaagccagagcuuacaguacuggccagugaccuuaugcagagugaagcccugugcauaguccugcuguguucagucuacaagaggccuccaucagaacacugcacagcugaacaaggaacuagaaaguuguugaugugagaagacaggagccaugcccaaaaugagccacuagaugcaaaagacacagccagcgcagaagagcgagcgugcauuguugauaugcagacacaggcaugccuagagagagacgcugagaguggagaagagccaaggcauggaugggucagugguugcacuguuuuacauuuugaaccauaugacugaauguaucaccuguucauucacauuuucaaaagcaccaacauucaaaggccgcagggaguucugggcucucucucucucucucaacaaugcucccaccuaccuucccugauagcugaucuuccacuacucugugcaccuugcccacagcugcccacucucagcuucagcccuggcucacucaccucgguaaggauggugguuucauaggauggcugguauuucuccuucucuugagccguucuuuuuuccaucuuuucccggucagucuucuguuuccgaucagcucccuugggcugcaagcacagaacacaggguccauuuaggccagaaauaggccauuggcugggaaagaaggccaaggccugcacuucaacccggugccugaagaacaggcaggacuagcggcauguuuucuuuccaccccugugaucuuugagcucagcaggaaguacuuaggaagauugccaccaauggccacuugcuucuggaaggagccauggagaaccaagacaggauauaucagugcuggggcgacugauggagaccacagaaagguaggagaguggauucugacccacacugugccuuguucaacucugcucaggcccagcacacccagcccucaacaucgcagccccaaaggcauccgucucugcuguggcuaaaugaugaugcaacaggcugcagaaucuauuucuagucacagauagugccagcgagugccagccucagagccaccaucaucucucuucuucacaaacuagaggcucaggguuuguugggaggagagaccugaggguacagucccucccucacucacuccugugucaccuucauugugccucucauggcuccuauccuauccuauccugcuuggcaagcacagguagaagcgccagagcccuugauguguagauaggaacacuuaguucaggucuaguggccggccggccgcacaggacuugcaucccacugugcgucuuccucaagggaugccuuuugguucccagaucaagggcuuuuagggaaacccuuggggugacccagcccuagguaaagauaagcuuguaguaagccacacaggaacacuaauagcagguauggaauucuaugugagcaccaaggacuugucaggggaucagggcagacagccacaccuagcccccugcacuggaagccucucuuccuugccucagaagccauaggugagguaaguacagccagcucaugggcuagcaugcauguggguaaagcccuccaccucaaacccuucaaagaacuggcuagaacaggauggcuuugucuuucagaaauccaucaagaacccaaauuugaugccccugaaaccauguaaaaaggccagggccuggugacaaacacugggaauuccagagaugaggcagccaaccaguagauccuuuagccuaaugggcuaguucuaggugcagugagaggaccuaucucaaaaauaaggcaaaaaauaagaaccuaagauugaccucugaccuccacaugcuacacauguguacucacccucaaacacacaaauauaaaaccccauacauacagagagggaaaaaauaguuuguagguaacaugccugccauagacucaaaguggcaggccacaaagagugaaggcaggcuugcuuucagggacaucaagccaguuggggggagccucaaccgcuuagccucuaggucugugguuauaccugugaauauuuaguuccugucaaucacugcucaggaagaucaacacgacucuugcugucucucuaacacagcccugucugaaacugauguuuccaacagguuccaaauucaucuaggugugaagaaguguauuaagucuggucacacaaagugaccccugauaggagagggcucuacaaguggacagaaacagguuaaaccugcuggucaugggcuagccucaugcuguaagaauggcacaggccugcuccaccuuccuuuucccuaagggcauuagggauggugaguaagaagcuggcucccaccuucaggaaauaaucaauccagaugaggaguuaggaaccagcaaugagagacugcaggaugacucagggcaagaggaggcugggauagacuucugaagauguuccuuucuugaagaugacaugugacagaacucaggauauccuugaauauuagagccaauccccuaucacugagccacaugacagugcuucucaagagaaagcuagacuggggugggggacauuucucaauagcagagcuccugaagagugccugccugccaugcaagaaagagaccugaguuuggaaacaacccccacuuaaagagccaggugugacaacacaugucuuccauacugguccugaggaggcagagacaggaggaucccuggagcucaaugcucagucagucuuacugaauggaaaguuccagguucagugagaaaaaccuggcaagauuccucagcacacacacacacacacacacacacacacacacacacacacacacacacacagccaaccaaugcuaagaaaaauggcauugagcaagacuaccaacaggcuuccauucuuacaaaagcagagucuuguacugacaugggagacuccccuucccaacaccuuugaguaacaagagaaggcugggcagggacacaagccagaaucaagagagaggccccagcuaacaggaggccacauacccagcugggucugugaucuaagccaaggguccuuugaccagguuugaccaggguggcuguguuaagugcauccuaccuugaacaccuugaucuggcagcuggcagaguguagaugcuccgaguaguccccacucucauucugcuuaaacgugucaaucugcacccgaaaaggcacucccuucucacccccaugcuuccugggggugaauuccgugcugauacagugcaccugccaggggaauguggggccugaaauuggguagaugaggggacucuggaugccccuaaugucucccucuccccaaggagguaaccaagccugcuuccccuaacucuccacuuaccccaucaggccaaggccuucuuguccuuuagucacagaacauacagaggacauacauaucaucccaccucugucccuuuacucuggggcucugucugaucagcuaaauccucaccauugauccaggccacuagacacaguagacaucaccaccccauccagaaaccuuccccuucaucacaccaucaccccuccccacccuaaaucccagacuuguggggcaaauuagcacagcccuguuguucucugacaucauggucacugaacaacaccuggagucauggucagaaugccaaagucaucuccauauuuuuaagugcauacuauauaggagguaccagauaccuauguauuguucugauauugaaugauaaaauucaguauuacugcaauacaaaauguugcaacaagaauauuauuugcuuuuaaagauuguaucaguguguuccgugugugugugugugugugugugugugugugugugugugcauacaugaacauguauaccuagaagacagauuuugacauuugugucuuuuucaguuggccccacacacacacacaccaccucaacuuuuguuaaugcuguugcuuuguaguuauugguuuuguuaguuuuuuugauuuguuguuuuuauuauuguuguugugauagauagcccugggguccugagacuuacccugcagacuaggcugaucuuaaacucagagauccaccugccucuugaauggugagauuaaaggcaugggauaaaagcccaccaugacugauaaaagcccacuuaacuuuuuaaguccggguuucucacugaacucauagguuuggcuggccuugcugguagauaagccccagggauccuguugucuccaccccuuuagcacuggggucagguguaugcagaugugaccaaccagcuuuuacaagcugaggaucgagcucaaagccucauguauacacggcaagcauuuuacugucucuaguuuuucgagccauucucuuggacugggcauaugucuuaacuguuaaugggcuaauguuauaauccuagcacucaggaaauugaggcagauguguuuaaggucagcuugaagcuccauagaaagacccuaccugucucaaaaacaaacaaaaauggggaagaaauuuuauaaaacaacaacauacagccagugaaugaaaaggccaggcuagugaagaaccauaccaggccuuggccaugcccuuagccaucugaaccccagaugguauauaauucaagguaggagccacacaugugcaaauagaaugaacucagcaacagcaacuagauagagugggagaauguuccuuuccaauuauccagcaaauacuggcuuuaaaaacuuuguuauugcuaggcauggugucacacaccuuuucucucgcaccugggaggcagagaaaggagaaucucuguaaggaugaggccagccuggccuacauagaacaaugguucucaaccuuccuaacaccgugacccuuuaguucuucauguuguggugacccccagccauaaaauuauuuuccuugcuauuucauaacuguaauuuugcuacuauuaugaaucauaauguaaauaucugauaugcaggauaucuuggccuacaggcugagaaccacugaaacgcaguguuccaggauagcccagggcuacauagagacccugccuccaaaaaaaaacaauaacaaaaacaaaaccaccuuguuguuuuuuauuuacucugugugugugugugugugugugugcagcuaagugcaugccaggauaccagcggcccaaguggaggguuagagaggccuugaggaguuaguucaucuuucaccauuuagauucaggcaauuaaacucaagaucaucaagauuagugccaggagccuuuaccuccaaaauacugacuuuuuaaaaaugaagugguguguguguguguguguguguauacacauccauauagauguuagagauaaaucucgaguguuaucccucagauauggucuaccuuguuuucuuagcaagguaaggugucucacuggccugggaccaccgauuaagcuagacugacuggucaguaaaccccgggaucuacccccaucaccucccaaacacaguggucacugcuucaggcuuucuuauauggaggcgugaacucagguccucaugccuuuguaguggguauuucgcugacugagcuaucucccuagccuuggaaauaccaaaucuuucuuaaccucucagcauucugaaagcaaaaacccaaacauaaaacuccacaccauuccaaguccuugccucaauguuccugaccuggaccccaaguccucccgucuucuguccucccucagcuacuuucccuccaacuggagaccaucguaguuagcuggcaggccgcccuccaaagcgaucauguuugcuuaccugaaugaaugcagaugcucucuucgaugggucccacaaaaacuccacagcauucagcuggguugggcuggcccugggguccaagauaccaacagacaguggaauaucugugcacacacacacauacacaaaaguaaaaugguuagccucgccuaaauauugaggggaaggacccaauauguacccaaacuccuucacugugguuugaaacagcaccugaucuggaaaugaagcuuugcccaacuccgcuagcaggcagccuggcuggaauugcuauggaaugcuugcugucuuucuguuuucuuaugacaaguuucccuugauuucuauuugaaaagacuugaugacgugcugguguauauauacccuaucaucacccuagcuuuugaaucccaaagcacagcuaagggcugugggcagagugaggguagccaguaccugagcccucaaauucugugauacgcccacccuuccucuagccacuuaccaaaacccuugaaugaacagggcauggugacauacaaugcacucaggaggcaggggcagguggauuucugugaguuuugaauucaacauaaucuagucuaccuagugaguuuuauauauauauauauauacauauauauauauacacacacacauauauauuuauauuuacauuugcauucauauuuuuggaccauccuggccucaaccucaaugucuuucugccugugcaucuccaguacugggcuugcauguauaugccaccaugcugggcuuccugugaacauaaauccaaguggcacucacaaagaagucccauauggcccaagcguccaggguuggugcuggcugaggagacucaccaauguccaggaugcgguccccaggccgacuccaccgccaacccuccaacuguugguacucuguguacugcagccggcggucauggaaaacgacacggaugaugcucuguggaaggcaaauguuggagacagcuguguguagggacugcagggccacaagacgagcauguauaccuguccccagccagggaaaaccuucugccccucucuggucccuuuuccuaggacuuccugucuaucaucagaaucccaagaacacggacaaugguaagaagguggaugcuuccaugguuuccaguauuccgaacagcuucacauacaugucugauuacuaugcuguuaugugcaaguaagaaaggcucaauugagggcaaaauuaggccacagcuucuaucuaucuaacccagagcauacuucaccaauguaagccaccccacccugcuccacugccuacccaucuaaucuucacugggacaaugaacuccagaaacugggaugggacuagcucagggauuccuucccaccacccccagccccaggcauucagaccccacaggccccucuagcaugugaggagccagcccugagcuuacucaccuucacauauuucguguucagaucuuggaaguccccuagcuuccgauucuccagcagccggauuucauacgacugaccugagggaagaagguaauaccuuuuccauuucuuucuguaauuuuauucugagacaguaucucauguagcuaagguggaccuugaaccccugacccuccgguuuaugccuccuagccacacccaguuuauucaugggcucugggguucagaauucuggucuaaaugcuugcacaguaagcauuuuacacagaguaaaaaugguuuuuaaaaauugguuuaaaaauuaauuucucgaaauguaaaugagcuaaauaccuaauaaaaaauggaaaaaaaauuuaauuucucagggccagagagauggcuuaacaguuaggagcaacugaguaaucuucaauaggaccccaguucaauuccuagcucuuccuggccucugaaggcacgaggcacacaugugauguacagacauacaggcaaccagaacacacagacacauaauucuuaaaaauuaaaacucaaguauuucucuagaaccagacggccucagcgaugaacaacacagaaauggccgagguuaaggcucaggaccugcgcagcaaggaggaggaggagcuguugaaacaacugaaugaucugaagguggaauugccccagcuucgugucgccaaagugaccguugaugcugugucuaagcuccccaagaugugaguuguacacaaguucucacugccauuagucagacucaaaaagaaaaccucaggaaauucgacaagggcaagaagcacaagccccuggaccugcgacccaagaagacuagagccaugcaccgcuggcucaccaaacacaaggagaagcugcagaccaagaagcagcagaaguugcaagacaaccagggcuacacagugagaccuugccccagaauaaauaaacaaucuguuucucagagcuuuauuuuaacaugaacagcugcuaugagaugcuuaguauggacagacuuucccaaucuggcgucagaaacaaagaggagauauggcucuaaagucacauguauauaaaugugaaccuaaucccaaaacaaagcagccacagcaacuccuggauggcuucacacgcagcuaucagagccucagagaauggagaugcagccuagaaccccaguauagggaaaguuggcaguuuaaggcaagcauaggucauguggugagauucugucucaaaaaacaaagcaaagagcuggugaaaugguguaaggagagaagagacucccgaaaacugucauuuaaccgucaacccccccaacacacacacacacacacacacacacacacacacacacacacacacacagagcauugaacauauuaaacaaaagaagcaaccaguuagagaaaugccuccacccuccuuuugcacugagcugaaugggaauccaguccuguaaacagggaauguuuaacuagauagacagucucagacaaucagcccugagucuaacgacuugcacagugagacgcacagagaugacagacaacaaagacaggaugucagagguaaagaaaagauguggacacaagccaaagacugccuggagacaccagaaaguuaguggccgacagcagcaccuuccaugggugcccaagaaacagcccagcacugugacucuucucucccagccuucagagcugggagaacgagcugccguggaaacaagccugagugaggacaccggaacaggcagagcuagaaagaaauggaaccauuuggaccauguggcugagcagcaaucacaugcagagcacucugcaaacccuggggcccugagagucaguagaagggucccagccagcauguggaccacagagauuacugaccggaccccagaccggauauggccguacagagucauucacccuucucuauucaccacugugugcauguaggugggcgugucugugugcagaagcucuguuguauggguguguccaggagcgcaguauauacacauaaauuuggcagccagaggacaaccaacagcugcccuuccucaagcacuagccaacugaccuggggcugccaaguuuacuagccuggcuggccagagagccccagugaucuguuuuuaccucccucaccuuagcucuguuucugagccccugaaccaagagucuagcacuccuuaggccuggacauucuaagggccuuccacacccuaacugguucuuccaguauccuugccuuugcugaagaauauagaugguguuggcagaggcccaaguggucauuaugugaguguacaggcacuccagggggccaauuagcacuggccccagguucuacaagcugaccuccacucaggccaagcagaggcagcucuugccagauaaagaauuguuucuaagucugccccaagagacagcacuggcaucucacacuuaacgccuggguugugggccaggaucacauggugagcuucuucaucugaaugggaaucuaaucuauggaaccuuccucucaaacauacaugccuaggacgaucuccagccacccggccucucccaugucauccuguuccucuagaucagcugcccugcccaugugugccucaaggcuuacacauacuagguccagacugaccucccuaacccucacagaaucugcaaauuucugagauuaaaugaguuuguuaucaugccugguuuuccaccauacuuuuugagauaagaguucaccaguccagcuagacugauaagccagcaaaccccagggaccuagcagucuuuaccuucucuguacugggaauaccagagccaguucuuuuuucuuuuagauuuaauuuaaaauuuucaaaucuaugggugcaugugugcaugccugcagaggccaauagaggguguuagggccacuggaacuggagcuauaggcuguuguguggcucuuuuaugggugcuggguccucugaaagaguaucagucagcaaaagagggacaggaugaagcagaauuaauaauuccuuaguagacuaggagaugggaaggcuagguccacccugacaauggacagggcaucugaaacaggcuggcacaugcagguggcaugggagagaacucugaagaauagauagagugucuguggucaagggaaggaaggagugaccaugacagaaacuccaagcaaagugcagcaaggcccggggauuuccucuggagagcauuaacgagcagcuucacucaugggaacacaguggugcuggagacuacugggauauugauuugacaagcaaggucucucaacuagccaacagcagaacuagaaaccaggagccccacuggauuaagguggagacucacagagguucguuccccagacaaacucaaacacacaaagggugaaagggccaggcuguuaugugugauucuuuuucaccuuuucuaucuggaaggcuuguacuuaaggcuaucacaagaaucuuacaacaugucuguauuaagaucuuuucaacuaagcaauuauuugauaauggagaggagaaaaucauuacuggaaaugagaauuuuuauuucagagcuaugaaacaaaagugggguugcuuuguuucugacacaggguccucaccugauaaugaccuggagaaugaaugauccuccugcuccagcuccagggcauuugauuacaggucacagacaccaccgcccucaguuuaagggguuaugggauacugagggcaaaccccaggcuuuguucaggguaggugaacacucuaccaaccaacuugguagccacucgaggucucagccaaucaagucacuuuuuaaaccugaaccaauacuuuaaagcaugcauuacaucuucacaccguaaaucauaaucauauaccauaaaaagacaguggggaaccauugucuuuguggggucucccacccagguuugucucuugcaacucugacacucuaagacuuggaggggugacugccuagcaaggaaucuggugcagucugggagguccgaggaucccagccuggcagaaggaaguagauaagcaaagggcagucaggugacaccagaaaacagccucaaggaaauucccugggaagacuugcccgcccagcccucuacuucagauuguuaaaggccugccaaaggaaagccaggaaagagccccaggucacuuugugauguaaacuagcccuuggcuggugacucccagcccagcccagggagccaaggugaccugggaguggcuagaacagagucaggacucacaccacucucucaaacaaggguggcugagcccugcugaccccuuccuucuucaaucccagggcucuaaguacugucccgccaaggaggcguggggacucucuggaagaauuuaaguucagccugacuccauaccuccauccaugggaugacuggaaacaugccugcccaaaggggccuaaaccaccagaaggagaaaacaaaugucuagguucuauuggcuuugccugcuaucuuacaguggcagaagggguagugaaacacacacacacaccucauuuuucuucuuuuccuuaaaguaacccacacuauugguuguggcaguaucaaaguuccugugaaggcucagguagaaacuacaaucaguaacaagucccaguggcaaggacccugccauuagaauauggaagcaucucaguaccacgcaagcaggaaagagcacagcugaguuucaacaaaacauuuuacugguuccugguggcagucagaggguaaccugugggacaggguucucucccuauaccauguauguucugggauugaacucaggcaugaugaaaagcauguaaggggagguucuguugcuagggucuagcucuccaauugauucuugacuugucaauaaagaagagggugggcaauugcuggacagaagguacaguuggaacuuccagguccccagagaaaaaggaaaggcagggaaagggguggugggcuuuucugacaugcuuugacugagaagaaagcaguagucauguaaggucucagggcagcuugggcguguggccuccgcuaugggcaggagccaaggaauuuucaggcaggagguaucugugcccagcacuugugccuuuagaggcauauucuaaagguaacagagcuguguguguguguguguguguguguguguguguguguguguguguguguguguguguguguuuuauccacggaugcaagggucucaggagugggccgguaacacaacuccuccagugggaaagagaaaccaggucaguguuagcagcuggaucccagagcuaagccaggagaaacaagaaggagccaagaggggcugguagcagggucgcagcucuggggcaaaggcuguaguguguuuuuaaaacugcacaacacaagcgccuauaucuuuugaacuacccugcuggcccaaaauaugaauuuucauauaaucuuugauauuuugccaguaucccugaagguccuuccuacaucaaugguaaagccacaggucccaggaaaaacaccuaccuguucccccgaagagcuuucccaaguuucuugcucauagucgauuccaccauagcccccuaaggagccggcaaacugagaagagcaugaaucuuccuuauucccccggaaaugauuuaaaaauggugaguaaaaauaagagucugacucacaucagcuuagcaauaagugaacaaacucagcagacugcuaauaccccacacgacacggguaggaggaacagucauuaucuuacugggcaugcauccucucugacauuuugacaccccucagugugauggugaauacugaaugucaacuugacagaucuagaaccacccaggagacgaagucugagacaccagaguaccuucuagguuagucuaacuggggugggaagacccauccuugugggugucauccgaccauggucuggggucuaagagugaaugaaaaggaggaagugagcuagcugagcaccagcaucauuuguuuucuaggaggauguccagcugcuucacaguucugcugccauaccuucccugccauggugaacuguacccacaaacugugaccaaaacaacucauucuuuccagacauugcuuuugaguauuuugucacaguaacaagacaaguagcuaguggucuugauacccaaccuccagggugcuagcucauagggugaacaauggugcuuuagaauauuugugcaagggguuggguaaauggcucagaggguaaagugcuugucuacauaaaagccacgugaacuugugagagguggagacuauggaguaagcuaagcuggcuagccaaaaaagccaaaccucaaacucaugguucagagauagacugagccucauccuccaaggagcuucaaucaggccagaacccggcuacaaaggacacugccuagggcuggaggcguggcacugugagagaacacuuguuuugccugcucagaacccuagguuugauuccuggugugggggauggggagcaggcagauugggaauggcugcagaauagcacuaugcauucguggcauccuggaacucccuacauacaccacaaaggccucuaacucacaaagauccaccugucucugucuacugagugcugcaguuaaaaggugugcaacaccaugcaagggccuuaagagcacuguugagguauaugacaagugcugcuauuuuaucugugcuaaauuuucucaguuuggguauauaaaauaauauccuugaagacaccaagauggcuccgcugguaaagaugccugccacuaagccuaaacaccuaaguucaaucuugggacccauaugguagaaggcuagagccaacucccacagguugucugucuaucugucugucugucugucuuccugucugucucuugugugaacgugagcgcgcgcgcgcgcacacacacacacacacacacacacacacacacacacacacacacacggccaaucagccagguaggcauuugaggaagcggaaccaauuaagagucacaaaaccacaucaagcagacaggagguucuagcccaaggagcuaagacuccauggugcaggagcuggagauguugauguugguagagcacucgccuauuauguaguauguaugaggcccuggguuugcuacccagcacuacaaaaacagagcauagugguguacacuuguaauuccagaacucaggagagguaagacgacccgaaguuuaauaccaucuuaggggcuggagagauggcucagagguuaagagcacugacugcucuuccagagguccugaguuuaauucccagcacccacauaguggcucucaaccaucuguaaugggaucugguguccucuucuggccugcaggcauacauguccauuauguacucgggcagaauacugguacauaauaaauaaauaaaucuuuucuuuaaaaaaaaaaaagaucaucuuagacuauauagcacugagucagccuggguuccaugaaacccugucuugaaaaaaaaaaaaaaucaaagacuccacagugccauauaacuaugcuacuucaagaugaggaaugggguuccagggggauguuaacaugccccagaucaguaucaaaggcucagcagcugccugcugccuagaccuaaacaagaaaggaaaaggggccaggacagccaaggcuauacagagaaacccugucucaaaaaagaaaaagaaaaagaaaaagaaaaagaaaaagaaaaagaaaaagaaaaaagaaaaaaaaaggagaggagaggagaggagaggagaggagaggagaggagaggagaggagaggagagggaaaaggaaaagggagcuagggucagggcacccugagucuagacccuccaagguuuggucuguaugaccaagcaauuucuuuguuuggcgguuugcuuuuuugcugugauagaaccaugcauguuaggcaaguacucugccgcugggcugcacaaguugucauucaacuugugucaugggcaaguugugaaguuauaagaguuaguugugugcugcauauguguauagguuacugggaaggucggugugagggagggaggaagacagggaaagaggagagagagagagagagagagagagagagagagagagagagagagagagagagagagaauaugcugcaugcauauguauauguguguacugggguuccugggcauuacagagaggcuacaaaggacacugaauguccuguccugucauucugucuuauucccuugagacagggaauaaggagcuaggcuggcagccagcaaacccaauuauccucaugucucugccagcuacagugcugggguuguugguacagguguagucauacccauuguuuugugugcuggggaucugaacucauacugggaccucaugcuggcccaguauggccaucuccccagcuuccagagacaaguuuucaaccugccugugucucuuucucaauaccuacaaaauacugucuggagugccucuugugagcacucuucaugaccacauccuaacagcaagguaaggacagcacuuucuugacccgccccaccccuuugcuggccacucuaaacuacacaaauaaacucuccugcagccacaccacccaauaccccaaguaacccaguacuuaaggucacuuagccaggaggcaaucuagcagaaacccaucccugggacuuggacucaaguaccccuguacauaggcacacagcacauucucucucaggcaguccagucuuccagaaggcagcuccuguguccacagugcugcccagagcagccuaucccagcugaucuccaaugggcagaggcaaccaggugccuuugcaagaagggcagacaagccagaguaguucugcccagugggcagaacccagagcacggccuucugcccagaucacuguguucccaagaacaggaggcaauugccagggccagccaagauuuacagguuguuuacuuuccaacaguugcugguuuagguaaugaaugccacguaaaauauaauaagaggccauccucaccccagagaaaggagggcaacgugccaaaagcacuagaagaauagcagaggaggaaagcacggugcaguggccaugaagcccagcacgggcaauuugucucgucaccucaacguguaugguacuauucaaguacccgugacugugacagagugcacucagucagggagacagcacacuacagggacaaagccuuucuguccaggggccugagccuuuucccugaaggucaugaccuaugucuaagaagaccuuaaccuccuuucugcuaugaaugucaugaaugagguuaucaagccugguauauacucuagucagaauaggcaagacaguuaucuguggguacuccugaagaagaaaaccauggccugggcacuuagaaggggcugcugccaggacugccucagggcagcagaagaauaggaaacaccuugugguacaaccgggugaggaaaagcucaaggcacaagugacaggggagccaggcagaggcacucccuacagcaucagcaagacaacaggagcaaaggaauguauaccaaagaauucaguguuaaccucuaagugccgggaguacuuaccagggcaggaagcucuggaaaauaaugggaaaguaaauucuuucuuuuaagauucuuuaaauguguguauuuauggggcaaaggaaggcauacacauguggagcuacaaggaccacuacagggagucugcucucuccucuaacuaugugggucccagggacugaauucaggucaaacuugaaggcaagcaucuuuaccaguugagccauuucaccaacaaaggaaaucuuuaccucuugaugaugauggugauguguggaggccagaggucaaugucagggcuccuccucuaucccucuccacauuauuuuuugaggcagagucucucacugaaccuagaacucacugaugcagugauccuggcuagccagugagcuggagggauucacuugucuuuaucuuuccaacacugggguugaaagcaugcacuaccacgccgggauuuuuuuuuuuuccuuccuguggguguuggggaccaaacuugaguccucgggcuugcuugacaagcuuuucacugccugagcuauuuuaucuccccagcuagagaaaacuuacagauacauuucuaauacauguaggaagaggaaaacaaauaggaaaucacuaucagccaauuacagaaagggggucaagcuaucagcacagccuaaaugaccccucugcuaaaagacuucauuagcugcacaggaacacuuguaaauccaccacacagaagcccaacacagacacacaaugaccauuggcggucuuaauucagucuuuaggcuaacaucacuagcacuaagaaacucgaggcaucgugauucccagugggacacccugucaaggagccuuuuacuucagcagcacucaggccaagagauguagaaucuauaugucaaauacaaaacuucugagaggggcucaggagccagcccagugagugaaguaccuggugugcaagcauaaaggccagaguucaaugccuagaagcagugcuuuuuuguuguuaaaaauaaacaaauaaauaaagccaugcuggccaggccugguaguuagcacaccuugaaagccaguaguaaggagcuagaggcaggcagcccucugaguuccaggagccaggacuauauaaagggacuagaaagccauaacaaaaugagacauggagucccuggugcuugcugcccagccaaccuagcuuaacaugugaguucuaggccaguuuuagacccuaagucagaaggcaaauggaaggugcuugggggaaggacaucacagguauucucuggccuacacauacagauacacacauacaaauaaauauacauagaauaggcuagagagauggcucagcaguuaagagcacugacugcucuuccagagguccugaguucaauucccagcaaccacaugguggcucacaaccauucauaaugagaccugaugcccucuucuggugugucugaagacagcuacaguguacuuauauauauuaaauaaauaaaucuuuaaaaacaaaaaacuccacaaauauacuuagaagaccuuagaggaugcugcaggaucagagguagaugugcauaauaugcucagcgcacuagguggaaucccuaacaguaucacuccccacaagaaguacaucagagggaggagagagguuggaugguuggacacuggguaccaaaacaaguuggaaaggaagagcagguuccagugcuccacagcacugcaggauaacugugguuuagagcuucuuauuggaagcuccuccagcaaucaggaggcugaggcaggauucacaagguuugaggccagccuaggcuacauagagagauccuaucccaagaaaauaaaaugacaaaagaauaaggagggaguucaaagguucccaacacaacagacacacacacacaccaccaccaccaccaccaccaccaccaccacaaacaacaacaacacugauuaauauucagagauggaaaugcuuaucaccugaugugaucauuaugcccuauauacacacaacaccacaaacauauacuauuuuaaaaauuaaagacugcaauuggacaugauggugcaugucuuuaauccccgcacucaggagguagagguggcgggguggaaggaagggucucugaaacccacaccguggaggaacaggcucaaugcccaguguccucugaccuccacaugaacaaaugccauggcaugugcacacauguaaauagacauaaucauauaaauauaaucuuaaaauauuuuuuaagggcugaagagauggcucagcaguuaagagcacugacugcucuuucagagguccugaguucaaaucccagcaaccacauggcggcucacaaccauccguaaugagaucugacacauacacauaugcccaugcuagugugaccaagacaagagaagaagacaagagacuaugggacauuauuucuagagugggcaugucucccugcucaguaaacaccuuucagaauaaagagagagaaugcauuuuuuguuuguuuguuuuuagguaauguacaccaaggucauuugucuucuguagcuuauauauccaaacuugaggcuaaaaauuaaacugaaaaagaaaaccuagcugaggaagaaagagagcagagagguuaaucccaccccuuucuuuaaauucagucacuuagaaaccuagaagaaggaaaaauguaaccagacauucguggaccacuuaauucuccaggcaacagccccaacgggaggcuguccuggugagaacagccaggaacccagagauucaaggacugcccuggaccagaggcuggaaaacaucugaacuaccaggagauaggaccugcacagcccugagcagaccaugaaaaagacuguagaaagugcaggggcuagaucuacuaaaaacaaaacccuaguuugccagugucuucuccccuuccugcgggacccucuauagccccaucauucuccagaccccugucugaucaggugaggagaauagagaauuaagacaccugucaggcugucaccugaaaaaauaaaggcaauguauuuuaagguuuaccuaggaaagacuaucagggcaggaauaagacucgggguuagcucaggcucugagccugauccucagucagguagagggaagagggauuagaaagugcuuuucugauggaccuagagggcaugugcucuuaucacagucauugauuauaaaugcucuuagggacuggggauaugguggagugcuugcuugcuaugcgcccaaaaccaggguuagaccaccagcccagcacuacauaaacccguucaggcaauccaagcucuuaggaggaucagaaguguacaaucauucccagcuacacaaugagucugaggccagcgugggguuuguaagauugucuccaaaaagaaagagaaagaaagaaagaaagaaagagagagagagagagagagagagagagagagagagagagagagagagagagaaagagaaaggaaaaggaaaggaagaaagaaaacaaaaacuaauucuaaagugcuggagucucagaucagucagguacacacacacacacacacacacacacacacacacacacacacacacaaaacuaguguacccuaucuuguuuaaucuuagaagcaugaaaauaaauaaauagauguacugaagaaaaguuaagcugugugugugaagaccagcaaagcuugcuuucuccuuggcgagcacucaggaaagcuucccaucuccaaggcagaagggccugggcuucuuucucuccaccuccucccuucccucaggcuccaaugucaggaaagcuggguccaccaggaccuuugaccccagcggggaacuugcaagccuucauucuggucuacagcuguuuucuuuagaagacuuuucucagaagauauauuggcuuuucaagccauuuuccccacuucuaaaaccagccaccagguuuggugaccaggacagcccuguguggcaugacauaccugugacacuuuuuaccugagucuuccuacugcugagacacucuuuggacacugcccaggaaauggugguccagggguucaguaagagaauuugauuuauagauaaggaucaacauaauaaauauaaauaacuuaagcgaaaaaucuuucaauaaauuaaaaaggucuugaaugggauguuguuaauuuuuaaaacugugaucuuaauauauagcccaggcuagccuccaacucauaauccuucugccucggcucagugcugagaucacaggugcaaaaauuagaucaaaaucuauaauaugaaaaaaaucuauaauaugacuugaaggauauuaauucugcagccauaccacccugaaggcacccaauauuaucuaaucucaaaaguuaauaaagguagguccugguuagugguuggguagagguaggcugagaagacaccugguagaguaucauuaauaaaggugaaagaaaaaagauauaacauuuuccaaguaauuauugcuuacaugccauaaggcacccaacaucaugcuuaaacugcaaggucaaaaggaaaaacaaaggcacaggcaggcgagaguagccugaugaacucaccugacccugggaucccagaacccauagagugaaggacagaacucucacaaguucuccacugaucucuuauguaugcauugcuuguacacauucacacaaauaaauaaauguaauaauaaaauguaaucaugggccugggaguguaggccuagugguagcauguaugguuagcaugcucagggcucucaaaucuuacaugcuauaugccaugaauauaaauaccacgaaauauagcuaaaaugugugacagaggaaagauaguacaauauauggccacuaaaugguucauaaaucaugucucuuccaguggauaggacaaauaucucaaagagaaauauacagcagacauaguaauaaaauuacaaagacauucuagaagaccaaccaacauuuuagguauuucaucacgucagucaucauuauggagcacagaagguuuaaccaagcuaauggucaccuauaauucuagcacucuggaaggcugacaccggagguucacaaguuugaggccacacuaggcuccauaaagcuugggaccacaccuuaaaaaaaaaaaacaaaaagaaaaaaaaucaaaucaaguuuugaggauugaagacaaagcagcuuagagguaaagaacacauacugcucuugcagaggccccacauucaguucccagcacccacucaugucaggcagcucucagccaccuaugacaccaucaccuccuggauaccagaugccgccgaccuccucggguacuguacuugcucuuacaaccugacuccacacaccauaaaaaaguggauuaaaagugguuaaaagugauuuaaaaaaaaaaaaacuuuucaaaaaagcaaauuccagaguugagaagauggcucagugaguaaugcaagcagaaggaccuggguuuggaucgucauaacccacauaaagcuagcuagccaucaguagcaucuauaacaauucuccuauggugcaaugguaaauagagacaggagaauccuacaagcuuaugguaaauaacuaagacuccaucucaagcaaggaagauggugaagucagacacccaguguugucaucugacauguaucuauauguguaugcauacaugcgaugguuugaauaaaaaugacccccauaggcucacacauuugaaugcuuagucaccaucugaaagaauuagaaggauuagaaggcaugcaaggccuuguuagaggaagugcaucacuggggugggcuuuggguuucagaagccaagcauacugccucuuuaccucucugccugcagaucaggauguagcucucagcugcuucuccagcaccaucacuaccaugcuucccaccaaaccucugaaacuguaggcuguccacaacuaaaugcauucuuucauaagaguuguuuugguaauggugucucuucccagcaauaggauagugucuaagauacuacacaaagauuuuuauuauuacuauuaaaaaaaaaucaagucucauguuuuacuaauugugaaaacugggaaaaccugacuuugagagagacccugagaugcagagggcuggcuggcaugagauacucugccaagaagauaauguguagcauuucaacacuguaguucuaugugagguauaacucaaaaccaaucaagcucuacauggaagaaugcuugucaggguuuaaguucuagacagacacugagcuauuacuauuauauuccuaguccuccaaguuuaauuuuuuuuuuaauuucauuuauuuguaugugugugcacaugcccaagccauggcacguaugcagaggucagaggucagcuuuuggaaaucaguucucuccuuccaccauguggaucuugggaauugaacacagguuaucgggcuucccuguugagucaucucauugaccuuuaauguguaauuucuaacaacaaaaaaugacugcccacaauauaaaacacuggaguaacagacuuuaugguaugguacuauaugaucccaauuuuaaaacaugcacauguagacagucaguggcgaggcuggcaagaugacuacugguaaaggcacuugcugccaagccugacaacucccacugccaggacccaugugauggaaggagagaacugaguucugagaguuguccuccgaccuuugcaugugugucacagcaagaguuaccacaacaccaaaugaaugaaauuacacacacacacacacauaugauauuagagggaauuuaaauuugauuuuucuuuuaauuuucugccuuuugcucuucuauuuuaagcuuucuuucuuucuuucuuucuuucuuucuuuuuuuuuuuuuuuuuuuuuuuuuugguuuuuuuuugagacaggguuucucuguauaacccugcuggcuguccuggaacucaauuuguagaccaggcuggccucaaacucagaaauccaccugccucuaccucccgagugcuaggauuagagguguacgcugccacacccgguuuguuuuaagcuuucuugaguuucaauuggauuuuuaaaaaaaauuuggcagaaacaugcaaauuagcaacaauuaauauauuuagcauauugacuggcuacagucacacaguaguuaccacagagaggaaagcauugaauguaaguaguaacuuuuuuaaagacaggguuuuuauguaacgauggcugucacaauguagaauucacaguguagacccaaucucaaacucauagaaauuccccugucuguuuccugagugcugggauuaaagguguauggcuaaauaacucauaauaauccugauagcuagcuagcuagcuugcuagcuugcuugcuugcuugcuuucucucucucucucucucucucucucucucucucucucucucucuuucuucacagcccuucaguuuuuugagacaggauuucucuguguaacccuggcuguccuggaacucacucuauagacaagguuagccucaaacucauagagaucugccugugucuaccucccaagugcugggauuaaagauguacaccauccagcuugaaagacucucuucuuucuuucucuuuucucuuucuuucuuucuuucuuucuuucuuucuuucuuucuuucuuucuuucuuucuuucuuucuuucuuuccucccucccucccucccucccuccuucccucccuccccaaagacaggggucucaagcaucucaggcuauccucacucucuauguaggugaggauaaccuugaacuccuaauccuccugccucucagagagcugggauuacaaguguguaccaccacacuugguucauaagguacuaucaaucaaaucacccagggcuuccuucaugcuacauaaguacucugacaacugaccuaucuccagcccuucuaaacaaugucaaagcaaucuauauuuucuguaauaagcaucuaucacuuuacuagucagucaagccuagucagccauuuguaaaaccucauaaaaaacaaucugggguguccacaagaucucuggaaucagagauacuuugucucaaaauaucaaaaaacaagaaugcauaaccaaaaauaucuagggguggagggaguguaguucugugauagaccacuauuuugcaaggcuucucugagcaaggguucaacuucuauuguaaaauaauaaaucuauaaauauccaaagggaauauacuaaguuaagacaagcagauggauggaaccucagagugggcccuuuucucucuuuuaacauuuaugauggagaagaggauguucuuaugauggaaaagaggauguucuuuuaaacguguuaguaagaccucauaugcuaguaaacaccuucuaacacuggcuaaaucacagcggaggggcauggcaaacacaaccaaagaaagccuuaagauggggaaggggacagacacagugucccuguucagcaacaacaccucacagugcucacguggaacauggccccaaacaaaacccacaucaguucaguggucucauuucuucccucucaauauuaagcaagaaucgggaaggggcuaggggaagagugauggaaugaugaggggaccggcaaggagagagacugcucagagcauuuaaccuucaacaaguaagaaagcacaacgacagaagccacugugcaaacacaagggacugcuuccaguuggcuugucaccugcugccaucaauggccaccaagcuacuacaggaguaguaagugugcagcccacauaggugagcagugccuuccucagggacaggauagcaaggacggauuccacacagagguagaucagccacuuccauuuuuuaugaguucuggacaugggcaaggucaaaucuaacaggcaauucuacagaaaggaggcugccccucccagauuccaaccccuagcagagcaaccaguggcacuggcuggauuaugcggcaguccaggagacagugcuaaauacagucucaucaucagaacagacaccaacaaagcucuauccaccaggguaccgcuggggugucugacaaaugaaacauucaaaaaggggaacaugggguggugagaugguuggcugggcagagacaccugcugccaaccaagucggugaccugaauucuacauagugaaagaaagagaacaaguuccucugacuucaagugcacauuuauacacacacacacacaaacacaaacacacacacacaccauauauaaguguaaucacacacacauacaauuauagguauacauaauguaaucacacguauacaaacauccacacauacauacauacauaaacauaauaaaaagacuuucaaagaaguauuaaaagcuagacagaguacaagacagagucucagcacuuaggaaguugaaggaucuugaguuccaugcuaaccugggcuacauagcaagacuccaacucaaaacacaacaaagacuggaaggacugaugguugcacaacugucaucaugccaugcagguuacuuaccuucaccucuuuaaacaaccccccaaaaucagacuuucuccuuuuacacaagaaaucccugaggcaccgagaauaaugcaggucaccgugcuagagccagcaagggcagcugcucuccggcagguggaaggcugacucugagcuagggaggauguggaccagcuguuacucuauaaaggacagcagaccaggucccaaaggcaccaaacaguaauagcaaccaccugaggaccacugaguucugaaggcacaugaggacuguuccgaggugccccucuccugccuuuuccucccuucuucucuucccccuucucgagucuuauucuguaguccaggcugccuuaguguauggaguaggaauccaggcucacaucaccacuccugguucaguuuuuuuuuuuaaagauuuuauuuauuauauauaaguacauugcagcugucuuuagacaccagaagagggugucauaucucacuacggaugguugugagccaccaugugguugcugggauuugaacucgggaccuuuggaagagcagucagugugcucuuacccgcugagccaucucaccagcccccugguucaguuuuuaauauuuccauuuacccagugaagucauguagguccugggaagccacacaagcuaagccacagaaucugacccugcgcccgacuccuagucccaaguuacagguaaagaggcccaacagggucuugcacaucaucugcuaacuaucccacuuguccccugcacccggguuacaacucuauggaggccucuaccuugauugagguauguuaaggucucuucauguagcuucaccgcuggagagguggcggcacacaacacauacuguaggggcggcaagcgggccccauucucaggagauagcugcggcucuuccugcuugaagaugggcagagccagcacaucacugcaaaacacaggaaucaguggucaggaacauagagcaauauuggguggaauagaugcaggccaugguagcaaagacaacuuuagaguccagcaugacuugcuggcuggccuagcuccucauccacauggcccaaaucccagaugcaaccauuacuguaugauccuagcuucauccacuggcuuucaugaucuguucacccaaggccuggaaauguggagguguaaaguuguugccuaccuccccaaaccuaagugacauuauucuuucuuccuuuccuuuuuuuccccuccuuucuuucugggggaaggauacagugcucagggacugaaccagaacuguguccaugccagacaagugcauuaccacugagcuauaccccuagccauggguaccucauuucuguccguaagcacucacacaaaaaaaaacuucuuccaggacaaacaucugaacuauauuauuccuuuuuuacauuaucuaucuaucuaucuaucuaucuaucuaucuaucuaucuaucuaucuaucuagugggcgaguggguguguguauguguagaggucacagaacaacuugcaaaauucaguucugcccugguaugugggugccagagacugaagcuaggucaaauuuggcaccuuuacauaccuccccagccucaacuuuuauucuugaaucaacccuucuaugucucaacaguuggcaguacuccauaacuguaaacucacaacugaagagcuguuagcuuccucacccagauggaugcacaccuucaucucuuccaaaacggggauuuuuaacauguauguauuuaguuaguuauuugugugaccaggcacaugugcauaugaacaagugcacacucagcaugugcacacacaucaauaucaagggacaacuuuuggaagccgguucucuccugcuaccauguggauuccuaggauuggauuagggucuuuaggcuucgcagcaagcaccuuuuacaugcugagccauacugcaggcccauagcuccccuuuuuaaagcucuuuuuuaaaaaaacucuccaaaauacuaugaagauagaaaaccuugauuucaguuuucuuacccaagugacaaaucuaaaaguauucaaaaagcuguuuccuucaucucuaaguaaugcucccuacaccaaaacauuagcccuggacuggggagacagccuguaaagcacuugcuuuacagugaggaccuaguuucaaucccagagggcacggccugcaaaagcugagugugguuagugugugcuaacuacacaucucccagugcugggaagaugcgacaggaugaccccccugaggcucacuggcuaggcaguuaaucugcuuaacaaguuccagacagguaggagcuccaaccucaaaacacagugugugguagcugaggaacauuauuaaagacuagucuuuauaagcagguggcucucugugaguuccagaccaagcugagugagucccaggacagcuagggcuacauaaugagacccugucugggaaacacacacacacacacacacacacacacacacaucauacauacauguacaccucagccuccaaucacccugugacagaggaacuuguuuuuaaacuucuucaagaaguuaucaguacauugcccaggcuagcuuugaacucccagacucacagagcuguucagacucacggagcuguccugcuggcugaguugcugggacuucagauagguguccuugcuaggaacaauaaaaucccugaggagcagaaugaccuacaggcaggugagacuuccuuaaagauucuaaacuauguugccacagaaacaacuaccaaaagaugccccgcccgaucuugaugacccuccucccaucuccaugaaucagaucagcugaccccgcuucacugcacugucaccaguacgauguguucccuguacagcaucauaaaugaguguccaugaaauauaacccagcacacaccccaacaguaccuaacagguucucagaaagcuugccuuugggcacaccugggagacauucccuguguguauuuuuuuuuuccugcuauuccugucuguugcccagaguaguauuaucagggcuggccaguuucaccuccaccggaagcaaaucuuuccucuuuuccagccugggcaguuauuaaggaacacagaaagaaguaucauccugcuacccugagaauugcauaauuucauguuugcccagaccauguaaguuaauaacccaggcacaguuacuuuuaaauuagagagagagagagagagagagagagagagagagagagagaauuaguuaagagccaucauucaacaguaacuuguuucuggccugcuguccuuauuugccaaggaauaaaagucaccagaacaucaaacagaaaggagagggagggcuuaaaggccacccacuauucauugaaaucagauggcuuguagaauuucuagcagaacaaaaacugauaauaaaaaaggagggccagaaguuaucaaaauggaagaacaagcguaaggcccaagguucaucccagcacuacaaaaaaauaaacaaacaaaaaaacaauaaaaauuaaaaaauaauaauaugaaauuaaaauuuuaaauucugaaaaagaaaaacaaggaaagcaaagaaaaauauucuugcacuaacacagauacacagggcgcaaggaagucaaacuacuugaagguaaaaaacaaaaacaacaccagcuuccaguggggaguaugguuggucuuuacccauugcuuccucaaagcacccaaagaaacagugcugcuuuguaguggcucucaggcucucaaccucaacguuugccuuccuccuuucaugcuaagucaaaaucuuaaaaguaucugaguuggcucacaaaacuuccaucucaggcacagauacauaaaccacaccacgccucaaacaaggauaauguuuuaugcaacuagauuucaaauacuuccgcucaaggucaccuucaacuucauuuuuaagauaggaugagauuaaauaccuaauggcuacucacaacaauccaaaagaaaccacagguaacccuauagaguguaauacaguuagcauauauuuauucuauagcaauuuuaacugugggcucaacaccaccaccgggaucugcagucucaugucccuaguuugauuaccauuuucaaugguuuggaguuauuuuuuaaaagaaaaaaaaaaaaaaacugaagauacaccagugaaaccuggccaacccucggcuuucuaagaaggggcaugucuuccuagaggaguucugaacauacaugaaucagaagccaggaaguacaaauaacaaagaaauccaaaagaggagacuugggggggggguccaaagaagcacuuaagggucuguaguuagggcugacagccccugggaugucuucuugagcccacaucaaacacacuuuggguuaaguacggcacauauaauaaacugugacuaggauggaaauaaagacagguugaagcugguucuggcgaguucagaaaaagaaaugccugccuauuagcccugcagccagcugcaccauagcgagggggauaaaaaaaucaaagaaucccggagucaccaaagcaauuuggggaggugaggaaguucuauuuccuaaaagagggaguucagagaacuuugcaaaaucccgcgggacccucuucccuuaaagugcgcuagcgaaauccccacagaagaggagauuucuaggggccauaccaaguugaccccgagcaagggcagccacccccugaagcccgagcccucagggcugcagcgcagaccugcucccgcuauccaccugugggcccaagggccgagaagagcaaagagcgggcggggccuggcuucccgggacacuccagcuccugauagaugaggcaaguuuauuucuccuauuggaguggggaagggagaggaaaggcgacgaaacccggcuggggacacagcgaguggcaaggaaaccucgaagaagcagcccgcgggcaucagugcgccucuuccccgaccauucccuaggggccucccggagggcccuucucuggaggccugagguuagucagcgcucggaccccgaucguaggcagguguugccacgucuuaccgcaaguagcugccagaguugugcugguuguaguguucgggcugcgugugccagaacagcauggcugaggcuuccgcagcaccggccggggcguggcaccgagcuggacgcggcaacccuggccgccguccaccuuuaagcagcacccacucgaaccug

SEQ ID NO: 328 - RNA, 762 nt, Mus musculus
ucuuucuuucuuucuuuuuuuuuuuuuccuccccuuacucuugguggcgaagcacuuccuagccuggccagcuucggcugagaugcuguggcggucuuggagugucucucauccguuuaccggaaucgagaucgugacacugauuuuaggggggccggcuaaagaaggcaacccugauuagugcccugguccagcagcggcagggcuuaaggaggaucuuggggaucagaacucguggccggggucgauuuuauuaccacagcccuccacuugaggggaagugcuucuuguucuuggguugcucggguaggccggucuuugaccggugguaccgcuuggagccuggaacuguuugggggcgacgugggggcuggggugcgccgaagcucccuuagaugggcagcugggagcgcgccugugggacugugcggugugcugcaaccgccgccggccacuuggaaacuugcaacucuacuucuccgcgcugcgaguccgcguccaggagccagucuuuucuuucuuccuucuuucccucucguugaacccuguugccccuucccuccgccgccagucucuggaccucgguucuggcuuccuuaccuuucucucuuauccuaggucuccagauccccuugacuuccagaauggauccacgcguaauccuucgccgagggaucgguucccccuacuccucgcuuucauccuagcccccacuuaacaccccccaagcaaucucucaacaaguauauuugcugaggaauu

SEQ ID NO: 329 - RNA, 1868 nt, Mus musculus
uaaagacagggucucauuguaugacccuggcuggucuggaacuggcaguguagaccaggcuagcuucucacccucagaggucugucugccucuggagucuuaggaccgaaggcacuugccuaacuuagguuuccucugagauugaaagagaguccacccuacagggaaacucuuugaacaggaagguaaacaacucaaaauagcuucaggaaggcccuggaacuuaccagaaucacuaggccccucccugccagcauaaauaauaaaaguugagagucucccucacaugaagaaauugggcugccaaggagacgcucagacaagccaaaggggcaaagucuggacaccagagcagcagccugaaagaagcagacagcggcugguugucuggaagagguuuagccccacugaggcauggagagcacaggacacucuccagucuguugagccgccuggugcacagguucccagcuugguaagcuguccccacacuggggugggcuucagugugcagcuggucuuugagucauuuccguuccuguaaguaacuccucauccacagccuguaagacacaaaccucauggguucaccaagucagacugcagugguauccacacuuuggacuauuguggguuccucccugggugugaggggcagagaaguagacacaagcugcaucuucucagaaaaacguccugucacaccccaccauguaucgccacaccagaaaguuuuccauuugaacaccuugucaccuccccacccccacucccccugacuuccaaccugggaagaugacuuuggggaagacaaaguuagcaucaaauccuuguagcaucucugcccuuccccgcucuagaucaagaaggaagguaacaagaaaggaagaaugggacacagcacuuccccuucuguuaaaaaguaagucaaggucaguaaaagacuaggccagcaaaggugcuugcugcgagccugggugggguccucagcacccacaugacagaaggagagaaacagcccccucugcccuguccucugacugcugccagaggacugugaccucacacccugucccacaaaaucaauauguggaauauaaacuuuaaauguaaaacucagggucuuggaaguggaccucggaaggagaguauccauagcauuuggaaugccuugggcuauuucauaaaauagauacugacuugcagaaacaaauaaagcuaagggagagcccacgguguaaacugugccguccaccaacagugauccaaucagugaguaacaugggcugagaaggagcuuucucuaaggcaggguggaauuggucuggaggcuugguucucuugcuuugagaaggaggggcucgaaagagaugugaccaacauucucaacaggacaccucuauuuaaauggaccgaccuuagauuauugugggcaaguuucuaagcguccucaggcaucagucacuccaccuuuaaaaggaggauacccuauggcaggcuaagcaauacaaaggaacuagaccucaggaagaaauauaaagaagucccgcgggcagcuuucuaagagcagagcccaggagaggaagcugagucccauggcuugggagggcacggccauuugcugccugcuugcuucuuggaguggacaguucuggacuguauggaaagccggggcuacuuaagcaaaugcuuucaugaacagccucaucuacacuuuggccugcaacuucggugagccuaauucuuccuucucccucugauuacuuccaucuggcugcagcagcuucaauggagucuccgggauuaaaaaaaaaagagaaaaaaaagaaaaagaaaaagaaaaagaaagaaagaaagaaagaaagaaa

SEQ ID NO: 330 - RNA, 34492 nt, Mus musculus
cggagaacggaagggagggcugccucuggagaggacaggguugccgggcggacagcgggaacgcgcuccgggggguggggacgcgcgagcucaccacuccucaaugacaaaucgacuggggacagcugggguccggccccaggacggggcggggcgcucgugagagcggcgauucugguugugcgcauagccagagcggcggugggacggcucccccagguaaggaugcugugccccgcaggggaccgcagacgaggggugcgcccuaggauagggaagugaguacgcucuccgcgcgauugcaggccuccuaguuccacguugggagggagggacacgucucaugaaggacaacgccccggacugcgccccgcuuggcuugaaaggugucuuuugggaaagccggagagacucccagccggaucugggggugcugaggacaugggggaggcgccccaguuucucuucccuugcugccuguccuucccuuuuuccacaaauggccacuuccugccuuuucgggccucccuccugaguugguccacuuccuccgucccuuucagauccauaaaauguugcccaaacuucuuucuuaaagguaggaacuuguacuuugggugaccugggagcuggguucaagaaguuuguagggauuuguugguugugaauuacuuuuugauucugucuuccaguugccuuucagagugugacuagcaucaaaggugguuuuuagaagcaccguggcuugaaggguuuuccugacccgguucucugagccaagucagcucguggcucagacuugcuuguggcccagacuugaguguccccagagggcgcggcacccacagcaggguccuuuuuccuagaguucauuuccaagugaauccuggaaucuagggauugguguuaccaggguguucuggaagagggucuggaauggacugauaguucuuacccucacuugccuucaaucccugaagaacagagauccucucgcucuggcucugcuuucauuuccuaaccaccuuucuuaaguuuggguuuauugaaugaucaaggcuuauccucagaggggcagggagugugcuuuggaugugccaagugaagauaguuuuaaucagagcaagaaucuuacauguuaagucucagaacaugucaaaguggcgccgcuuaagccuggauugagguggugaaauugugagagccauaaagggaggugcugaauauugagaaggaggugugagccaagguugauccugguuuuggaacuuuguguguaugagacaugaucuuuuguagcgcaggcuggccuggaacuugauagauagcuagagugaccuugaacaugugacguuccugccucuaccccuugaguguugugauaacuguauucuaccaugccugguccaugcagugguggggcuggaacucugggcuuccuauaugcccaagaacucuaccagcagagccaaauccccagccugguucuggaauuuucuuagugccguggucuagaggaggcccuuugucuucucugagcucugaaagaguuggcugcccacccccacugucagcuuccaauccaguaggcaguguuuaaggugugggagugggcaugguucuaggauuccaugaaaugccccccugcugaagcugugaugugugugugugugugcaugaguguaugaguauauauguguauguguaugcauucuuguaauuuuauuuacaugugacuaugcaaauaucuguauauauguuuguauuuuuuagauuuauuuuuaugugugcauaugugugggacaggaacccuuggaagccagaagagggcguggcugggauucccuggagcuggaguuacaaacuguugugagcugcccugcaugggcccugggaaccaagcaggccucuggaggaguagcagaugcuccuaauugcugagccgucuccccagcccccaccagguuacuuauggugugugugugugugugugugugugugugugugugugugugugcgcgcgugcgcgcgcgcacgcacgcaugcuaugcacacauguggcagacagaggaugcuuuguagaguuuuucuuuuccuuccucuuuuaauuuucagaaccaaacugguugucaggcuuguguggcaagccccucucuccacuaagcacucucuuggcgugggagcuuuucucuuucuuuuuaaguggggucuuaagucugucccacucacaggaaacuaacguuaggggaaaccagcugcggugugggcccuguaggugcucuguugauucugaccuccucagagucuuuuuauuuuauuuuuuuaagauuuauuuauuuauuucauguauaugaacauauuauagcugucuucagacacaucagaagagggcaucggaucccauuacagaugguuaugagccaccaugugguugcugggaauugaacucaggaccucuggaagagcaaucagugcucuuaaccacugagccaucucucuagcccccuccucagaauuuuuauuuuugugcgcaauguguauguacacaccacacacacacacacacacacacacacacaaacacacuacaauguucuaggaguuggacagugccuugugcacgacuaagcagcccccauccccaggguugcuccccagcuccuccccuuccuuuccaguuacuucccacuggaaacagcacggcugcucuuaucugagaucccagcgagguuuuacugugcccgaggagauguuguuccaggaaagugugggugugaguuacuagauagcuuuuggaaaauaggaccuagacacguaaagauagaaacaugagaauuggaaccuuaaauggagucuggagaguuucucgugaauguuuaaugguggaggaauuagagguguacucggggcugguucuugauguuuugucuguuugguugcuuuggugcuggggauggagauuuuuuaauucuuaggccacggagauggcucugugcuuaaagcaguugccuuacaaguguaaggaaggacuggagcuuggauccccagagcccaaauaaaugccuggugggauggcagccugucuguaacuccagcacacaaagguggagacgggaucucuggagaaagugggcuagcucucgagucuugccauaccagugagccacggguuuucuuaaggaugauucuugacaucagcuucagccucaccgugcaugugcacacgugugcagagcacccacggcacaaacagaugugcaugcacgccugugucgacucagacacaaagaguggaagagaaauaucgucacuguugccuugaaguucuuaggaacuugaaggccuugggaacaaugacuuaaggcuccauaacaaguuugaaccccgggaguuugugcuguguuguuccaucauggcaaaccucucuggagucugugaccaaacuuccccauucaucucauuucugaacgugggaaccauuggagaccuugucugaagcugcaguuggaaacguaauaacaagcagagcuauuccauuggaacuuugugaacugggaaggucuccaguaagacaaaauaaacacaagaacccaugcccuauauuucucacuagcacaggagucccuugugugugugugugugugagagagagagagagagagagagagagagaauuauguguugacaauuacuucuaaucuacugcuguuagaugggcaagaaauuuucuuuuuuugaaauuuaauucuacauguauuuuuauguguauguaugugccugugucuguuuaugugucccaugugugcaggagucagaagaggucagaacccuugcuugagguucccuccaguucccuugaggugagagagguggauuugagucacuguaugggugcugggaaccgaacccaaguccucuggaagagcaaccagcucucuuaccacuaauccauugcucccugcacuccugugagcuucugguccuccuuccucuacgcacucagugcugggauaacaagcgcacaccucuauacgugguuuaggcagugcugaggauugaaccgggacuucaugcgugcuagccucacauuccacaacugagucacauccagacugccacaggccuucuccaagacuagcuuccaacuuuuuuuuuucuuuuaaaagguuuucuguuuguguguuuuuguuuugagaaaggucucucauguagcccuggcuauccugggaacucacuauguagaccaggcugaccucugaguuacagagauccaccugccucugccuuuuaagcauaggauuaacggcguauaccaccuuaccuagcuucuuuauaagcacucuuuagacuagacacuauugaggugguuuuuguuggggugccuuccaaagcauguggguacuguagaggauaaagacacaucuuggguuccugcuguucuagaaacuuccaugguauacuugaaauuucauguucuuucuucugguucuuugucguuagacacuagaauuaaucagccaaauaugcagucgcuuuagaaauuagaaauuuaaaucuuacuguuccccaaaccaaauagaacacagagauucuuuuagaucaacucuaaaacaaguuggugggcaaaaaaaaaaaaaauguugauaaagugaucuuugaucuccauggugagcagcugaaaaugauuaucaguucguguguguggagauuguaugcacacauguguggagcucagaggacaacauggacucucucucuccaaccaugugguucccagagauagaaccugggcugccaggcuuggcgguuucaccuuccucugcugagccgucucaccuguucuuccgccuaauuacuuuuuaaauuuuaauucuauuuuauuuuauuuuauagucuacggaggcuuuucuguuugagcuuugcaccucuagagaaaggaccccaggggucucccuccuguguguuuuggucucgcuucuuuguggucccugaugcuagcugggguugucagcacaaggaaaccaaacugacagcguggacacagauuguucugccauuucucuagguguuugaguugcagaucaaaccuagggcugaucgcgcuacacuugcucaaccugcccgugaggguucacauugauuuucccagcucugugaucaucagugaugcaaacucaccaugugaccgugcuucaucaucacaguuaggaaccgaacgauggcuuugacacauggccugaugaggacccggcguuugccucucuucucagcauuuuuggugcucuugagagcaccugccaggacauucauggugaugaggagucuuuaauuuuauuuuugagacagggucucacuguguaauccccaaucugagguagugcaaacagaggcaucauuauauagagcaggcuggccugccgcucucagagguccuccugccuccgccucucagauacuggauuaaagauguuaaacgcuaugcccggccaccuuccgauuugagauguggucuccaauugaagcugaggcuugcccauucuguuagacaggcuggccagugagucccaaggauuguccugucucugccucuucuguugggauuauagagagaucacuacacuguuuccauggguccuggggaucugaagccagagcuucacaccgcacggccugugcuuuauccacuguaguaucuucccagcccccuucuucuggucuuaccucacacaggcuccgccucucucuacugcaugacuacaaagucagucugcuacuucuguucuuugagacugggugucauguagcuaagacuguccuugaacucuguguguaguugaagacagccuucaaucccugauucucuuguauccccgucccacgggugcgauuacagagguguacguaccaaaccagcuuugugugguucggggaacaaaacccaaggcuuuaagcacacgaggcaagcacucagcuagcuugaccauauuugcagcccugucugcagagucuugacuggaccuugcuuccuuuugcuucaggacuuccuuccucccugcagagagaggcaguagguaggaagugcugagcauagcagcugagagaggcagggccacugggcaaagguuuaugggccuguucagaaaaggggcuagaugguaucagugguaagccauugggcugcuacauuuacugauguagaaaguucacauggacuggggagauggcucaauuggugaggucuuggaaugcaagcacaagugcccaggcuuguucccccggacccaugcuaacacaaagcaaaacagaacuguggcagcuugaguuuguaaucucagugcuggagaggugcacacaggcgcuuccccuggggcuugcucagccgaucuagccugagcagugaacuccaggccagugggagacccugugccugccuagagugccugaagcccugggcuccguccacagcaucacagaaaaucaguuaugaagaugcauacucauaaccccaaaucugagguagagccaaaaggagcaucaggagcugacaguuguccuuagcuguagagagaguucaaggguagccugggcuccaugauacccugucucaggaaaaaauauaaaaggcagaauauaauugaggaauauaacuuauguugaccucuggccuccauguguacacacacacacacacacacacacacacacacacacacacacacacacauacaaacagagugaacaguggcuugaaguggcugaggugccacaaggggucuggcagcuguggcugguuguucuaaccugguuguggcagagaaaauggaagauggguagagggaaaagguccauuagagauaagagccaggagaaagagugaguagagcuggggagaaacaaggggaucugggaugaucaccuggucuggcuugacuagugaugucugcacuccuaggggcuuguguugcuauuguggggguggggcagguagauuaggagugcguucauucugauuucuuuccauuguugugauaaaacaccuagaccacaguagcuuggggaagaaaggguuuguuuagcuuugagggaagcaagggcagggacucuagaaugaacuggaaggcuggcuggcuugccauucugucuuuaagcaaagaaugcacucacugacaaggaaguacagcagaaaccguggagcacacugcuuggugaucacccagggccaacugcacugggaauggagccguccacagugggcuggguccuccuacaucaaauaacaaugcagacaguccucuacagacuuguccgcaggccaaagcccucaauggagacucccuucggagcuguguuaaauugguaguuaaagcuaacuaggauacuacuuauguauuugcuugucuguuugacuuguguguguuugugaguacacacuugcacacucacaggacagcuuucacaaguaggagcuguccuuccuccaugcgcuucccaggaugucaggcuuggcaacaaggaucagacuuuaggguagagggacgaagaguggagagaucuauuuggggacuguugaauuugaaaucccugcaagacagccaguggggugaggaagacagaggggccuggccucuguccuccaguuugaggagacacaggaagccacuuggauagaugugcucagcccagggagacuguggaggagugagaaacgugacagccugagccucagccgggagaaaaccuuagagaagagauaggcccuggggaacaugagcucugcagucuagaaggaugggcauugucaagugggagcagcagggcagcggagccucggaggggagcgauugaugauccugguucgugguuuuaaaugccacaugagacugguuaugugauuuuccuuucucuugaauuccuucuccagccagaaugcuaguacagguaguuggggugagggguagaguuggucuuugcaggaggaacuggcaagaugucaucuaagcgggagugucagaggagaucagaaaaaaugugcugagaucggugcuuaauagguguuugagcgagugauuggaacaauuacagguuugaggcuguggugucugaauauugugcccccccccauagcuguauuugaacaacuguuccugguugguggugcuguuuggggaggucuaagggguacagucuuguuggaggaaguaugucacuggaggagagcuuugcaacccguuugaguuaccaaacacuuaccuauuuacaguuugcucucuuagcuuugugcuuguaguucaagcugugagcuuucagucgcugcugccgucaccaugccuacgauugcugccaugcauaacccccgccacggacucuaaccccuggcaccaugacccuggauaaacucuuccauaaguugccuuaaugccacagauggacagaccagaggcaucauaucaggacccuugggugagaucagguccccauggcagagcgaaggucccuuuuuacacauuuagaggaaggaggcgguucuauaccaugugauugguaguuauagugcaugcuugcugccaggccgucucugauuccuguuaaccuggggucuuauauacagagucagcuguaagggugcaggaagcgccgggcaugguggugcacgccuuuaaucccagcacucaagaggcagaggcaggcggauuucugaguucgaggccagccuggucuacagagugaguuccaggauagccagggcuauacagagaaacccugucucgaaacaaaacaaaacaaaacaaacaaacaaacaaaacaaaacaaaacaaaaaagaauccaaggaagcagguuaaugggagagcuuuacaaaaugcgcuggcccuggcuaacaugagcucaaaggauagagguaggguggagaaccaggaucaggcgagguucaugguauggugggccugaaacuuagugcucuaggaacugcuagagucagagccggggcugaacaggacagugaaacagaccaguuguagugaaacgcagacagagauuuaccuaacagcacuacacugggaagagcaagcaaagaggucugaugacccuuaaagcccgucagggucccggcauaaggcucagguauaaacagaaggcgagagcugugcauagccaagcgguccuggucaaggugugcucuugcccaucacugacccagccuugucucagugccagcucuccugcagggggucuuggcaggcugucagcacugugugaagucucuuccugagaaaggagcuccucucugccuggcaccaaggcuccugucuccuuuucucaguaugauauucccagggaaaggccaguuucauggauccauuguacacaagaaucccuucuggaauauucucauucucgccugggcaguuacaguggggaggauccgcaccugcucgaacagggugguuucugaggacagugaagucggaagcagaauuuguguccucuguccauaaggaaagugaccagggagaucuggcagugacagagcauggcccugggaggcgaggccuuagccaaaugggaauuuugaaacagugaggugagugacuaagaagagcagacaggaagugaccaugaggacagagaaaggacacaagucuggccuggucaccacaggccugcggaggccaacacuguaugcuuaaaauaugaggucuuuuaaggacaagcauagaggaacauucugagaauagaagaaugcuaugguaucccuagugguuggggacggugggucagucucugcggagguggaugaaguguugagcugagagacccaggcaugggcgaguguggagcauccuccugccugucccaggaggagaggcagagcuaugcucagggugugcuggccuggcagagccuguucuagcacugccugccccaggccuugacagaggaagccacucacucuugcuguguauaccgccuuggcagggagagaaaagacauggccauuauagcagucagagcugaccugaaaccaggaccaacccacaugcccauugcuuguuuggagaguaauguucucaguguuaaacacacacacacacacacacacacacacacacacacacacacacacacacacacacacacacaagugaaaguaaccggcaaggaauuucuuuauguuuuaaaaucuugcucauuauuuauuucuauguuuaugguuguuuugccuagguguaugucuauguaccaugugcaugcagugucugcaggagccacaagagggcaugggauccuccuguuacagacaguuguuagcuaccauauggaugaugggaauugaaccuggguccucugaaagagcagucaaugcucuuaacuacugagccccaggcaaugucuguuuuguaaaaaguguguguuaccacccaaaccaggauagcaagccaaauccaaggccaagauggccccugucuuuuaccccuauggaagacaggguggggaguggcuguucuuuuuuggcugagguugaaccucacaguucacucccagggggcuaauguggaaggcagccagcagcaagaaaacgaaggaaagaggucuugagccagcuguucugggccaucacagucugggaaugcagaggguugugggagcugggaggcucuggguaaaguacaaggugggagaugaaaagauuugaauuccuuugcauaaaauuguaggagguagagagauuuaugaauucuuuuguucuuagcaacuagucaccuuugauaggaaaacuaaaacccauuuuucacaagcugaguguggaggugcgcaucugggacucagaaggcugaagugugugugugucaauggcccacugguguuuucuuaugaauucuccuggguggcucaaaacacauccauuuuauauucccuuccuuuaaaacaaaaaagagcucacuuuuaguuuuuaauuagugugugucuguguguguaucugugucuccguguccguauuugucagcguauggguauguagaugugacuacaggugccaaugggguagggagaauggcuuuggaucuccugcaaccggagauacaggcaaccacccaacaugggugcugggaacugagcucucgggcauguguucuuaacugaugagccaccucccuagccagccaacccgcuuuuccuucccccacucuccuucauuacuuugucuuuuccuuuuuguuuggcacaggguccugucauuuccaaggcuagccuggaaccaccgaucucuuugccaccuuaugaguaccacguuuuuaaaauaaugaguuguuuccuucaaggcgauggaugaggucccuuuuaaguuuuauauuuuuacagguaucuaccgugugugugcuuauggugugugucugcgggcgugcaugccugugcaugcgcuugugggggccagaggucagucagcugucuucugucaugcuucaguuuuuugagucagggucucucccugaagcuagcgcucuaaguuuugcuagguuggcucuggggaucugccucugcacccucccagugcagggggcgguggggggauacagauguguguuguuggggcggaguuggcuggggaucugaguucaggaugcuauccauggcaagcacuccuccccagccgcugaauuuuacauuaguuaugcaguauuuucaaacccggggauccaagugcuaguucguauuggagcuguuggaggagagagggacucauuccaggugagagcuucauaauuugguuuuagcaagaaguaguccaauaaacuuuuaaauuugucuuaguuagaguuaacuauuguugugaugaaaauccacggccaaaagcagcuuggggaggaaaggguugugccugugugguuuguacugacugagcuggcucucuucaggccccacauacguacuuuaaaaaauaggcuuauuuuuuuauuuugauguguauguguuugucuguguggggcaguggaccaugccagaaaacuggauaagguugaguggauucagaaaucucccuccucuuacaccugagaacuauggguguuuaaucugcucccaaccagguuccuguccuguaacacaugaccauggcaccccauggagaggacugugacaaucagucaccuagaggcagcaccccagcccuccacaugcagaugaggcaucccuaacaucucagaccaagacaauaggaagcauuuacugucagaccccaacccaccccaaaauguauaaaagacccuauccacaaggaauaaagcaggaguuauuucacuaaggaucgucugagagugucugucauaaagagcuguaacacuuggaggaagagaaguucucucccggagaagcuuucucuacuggaagcuggucaagccuacggaggucacuuccuguuccguggccgcgaccuuggcuccuagccaaugugcugcaccaacucuggagcagagguagcucugcaguagagaccuggcaccuugccuaccugcucgcacuggcccuccacagagcagagcagcacagcauuggccugggacgaucaaccccccacccccaccccuucagagagugcaacccuggcugcuccagcugggccagagcucugcagaucucugcagauaacauccgguacacagcauguaugugugugcguguguguccaggugcccacggaggcccagaagaggguguuggauccccuggaacuagaguuauaaguuggugguggguuccagggaccaagcuccaguccugugaagagcagcaagcacuuuuagcugcuaagccauuucuccagcucugggauuuuuuuuuccuaaaaaacaaacgacaucauaguuuauauuuucugcagcuugauucccacccccaccucuccuuuaguggcaccuccuagacauuuccuaggacaggagauggggcuccucucucucuuuaauagccauauaaucuaaacauuggcucauucauaauuuacaaaacuauuucuaguuaguguauuuuuccagguuauugcauugcauguaaacaccaagaaaaaaauccuugcacacuuacagucucagcauauaggaucuauaucuuugcccacaauauccauuuccccauaccuuugugugugugguacuugcaugugugucagcacacguuuguauacagguucgcauguacccgugugccccugcaugccaagguccuaggucaacuuuggguuucccuccaucauucuuuacauuauucauggaaacagggacucucaggugaacccggagcucgaugauugggcuacuccggcaaacgagcuugcucuaggggaugccuugucucugccuucugaugccuagauuuucagacaggcugccuggcauauauguggauucuggggaucugaacuccuggccucacauuuauaaggcaagugcuuuauaucaacugagccaucucgacagccccuucccacucucuuccuacacucuuuuuaguuuuaugcaagcugguguuuuguuugcauuuucuuaaguagccucgaaguuagguguggcuccauauauuuaguaaccauauuuaccucccucccggugaauuacuucauauucugcuuauuuuagaagguucauguggaagguggaggaucagaaagaaguucaaggucauuguuauagcagguuugagguauuugaaauccugucucaaaaagcuccaaauggggaaaaaaaaaaaaaaggaaaauaaauagaguuuaaaauugaguuguuggccucccgggcaggaccuucauacauuccagaugucauuucgcagaaugcugcacucuuccugagcguggcagucuuccgaaaucccugcccuccguucugccuucacagcuucuccagcugcgcaaguucaguugaccguucuuuccauguuugauuuucugauuuuuccccauuauugcuuucugcugggaacuccugugugaaguagucuggaaguuuaaauggucaucuuccucuuugagcuucagcuuucuauguggaucuggguuuuccuugucaacccugcucuuuaauggccaaguccacagccugcucuaguccuaguccuccaaacagcgcuugcaagauggugcugagcugcaggugacugguaguucgugugugugugugugugugugugugugugugugugugugugugugugcucucaugcccccucccuucaagugggcaaaugccaugguguaugaggagaacauacaaguaucuuuuauuuuuaaauguuauuuacuaauuauucguuuaaaggacuuuauuuacaccugugugaguguaugucccaugugaacagguguccugagaggccagaagaggaugcuggguucccaggagcuggaguuaaaggcagcugugaguugccugaugugagugcugggaacuguucucuggagacagcaaaugcuuuccucuccagccccacgggugucauuuuccuuuucuuccagauccucucuguaggucuagcagccaacaaugccgagucuuaccugaacuagucuuuuuauuuuuuauuuuuuacauuucuuuauuaucaaugcgugugcgugugcaugcaugcuguguaugcugugugugugugcucuaugugugugucuauaugugugugugugugugauugagugcacagugccaggugugaguauguggagaacaacuugcagguauuggcucuguccuuccucuguugcaucuggggcuggaacucagguugucagcuuggguggccagugccuguccccacugagccgucucacccgccucugcaucagucuuuuuaguggugguuguaaacacuggcuuaguaacucaugugcacacugugcguuuaccagcccgccuuggcuuucuguggucgagagcccucccuucucccucuuucuuuaguacuuaccauagguauggcucuauggguuccugaucuccuuugcuauguagaggucaugggugcuguuacucagguaucuguguggagacaggcucucucggaaccaggaacuugucauguagacuggacuagcuggccacugaggccgagcuccaccagucugccucucuaagcccugagauucacaagcaugcaccccccaccccaacuggcuuucuccuuucaaauucagguccuccagcuuacagggcaagcacuuuccugccucagcccccgguucugaauuuugcaaugauguguuuuaaugagcuuuucuuuguuguaacaaaguauuuggcaaaaaucaaacauaaagagggaaggugcagcagccugaggccagccucgaagugaguuccaggauggucagggcuacacagggaaacccuucucuaaaacagcaacaacaacaacaacaauaaacaaacaaacaaacaacaaagaaggaggaggaagaggaggaaagauuaguuuggaucauggacccagaagcucaugguugcuuaggccuuugcuuugagucugaggugagaggcuggacgacauggaggagagugggaagcaagcagagagguccagugccugucagcagggaagcugucucucugucucucucugucucucucucucugacucucucugucucucucucucugacucucucugucucucucucucugacucucucugucucucucucucugacucucucugucucucucucucugacucucucugucucucucucucucugacucucucugucucucucucugacucucucugucucucucucugugucucugucucuuucucucugucucugucucucuaucucuccgucucuuucucucuuucucucucugucucucucucugacucucucugucucucucucucugacucucucugucucucucucugacucucucugucucucucucucucugacucucucugucucucucucugacucucucugucucucucucugacucucucugucucucucucugucucucucugucucugucucuuucucucugucucugucucucuaucucuccgucucuuucucucucugucucucucucucugugcacacgugugcauuccuguguguaugugugugugcacuuuugcaugucuuguuucugucugucuguguucucauuuagauacauucuaagguucucacauucuccagucauuuccuggcucuuuuguacagucagauaauagggugggguguuuucuguuuguuuguuuguuuuguuuuuuguuuguuuguuuguuuuaaggcaaaggcugugucucuggaaugguuaccugcaaaagaaaaagcaaaaugagccacaguaaauggucugugugugacccaaacagggaucagauuucaucuuucgggccagcccagggguggguaugucuggagugacugagugacaguuggcugucuuagguccuucccuaauccuagcaggucagcugcagcuauggccuaagugggaacaucaacuuuccuuacuucugauuugcacuuaaacaacagcaacaacaacuagaucucaugucuggagagaagacagagagguuacauagcauggacucuccgcaccuguauugggggcucccaacugccuguaacuccagcugcaggggaucagaugcacugcgccugugcgcacgcgcgaacacacacacacacacacacacacacacacacacacacacacucccgcguaauuuaaagggggcuggggguggggguaggggaaggccgggucucaugcuucuauuucuggccucaagcucccuaugcagcugaggaaacuucugguuuuacauuugccuccacacaagguuuaugugauggugcaggggaucaaaccuagaaugccgggcuggcgcuguauggacugagccacaucguagucccuguuauuuuugaacuugaaacaaaacaaagguuuuguucuucagugguuaucauuggcaaggaaaucgacuuuauuuaaaaugaaaacagacaaacaacagcaguaaaugguccuaggcuuauucgguaaaugucugccuuacaggcaugaggagcugagcgcagaucuccggaauucaugaaaagccagggagggcugugugcaccugggaccccagcacuagggaaugcagacacaggcagaauucugacguucauuccagguuccucaggaaacccugccucaaaaaaauaaagggggcuccggggagauggcuuccugcugagacuguaccagaguuugauucugcaacccauguggucgaaagagagaaccaucuccuacaggcugcucucucauuuccacacaugugcuaugacauggauguucacacaugcgcacgcgcgcauacacacacacacacacacacacacaggauguaaguuauuggaauuaaaauaaauuaaaaguaaagguggcaaaugacugaggaaagagagccagaguuuacuccuucauggaugugugugugugucugugcgcauccuacacuauaagguacauacagcacaugcacauacaugccaaacgugcauacuaaaaccauauaucuguguagugcauaauuugguugucugcauguguuugaaaggacccugcccccagccuggacaaauguugguuuauuuacaucaaguucacagaaacaggguuggcggugagaaauugugggccuuugugugguguggguuccaaccgcauuccccagccccaucucugcaggaaacaguuagugguuguaaacgaggccaaagguauuuucaaguuccugaaucacagccuuguggggcuccuguaccccccauuccuucuauuucuauccccacuuagaugugcuuaauuaucuaguuaauugcuuagcucacucauuaaaaagcacauaauuagcauagggggaguaggucggauggauggauggaugccuggugugggcagguaccugaggaagugcagggaaggcagaucugugaccuugacuugagcagcccaaggccaugccuggagcucacaccaaugcuaaggggucccaaaucaucaagcaaacgacaaauuauguccagucugccugacugcaaaaacagauaaagugcaugagaaauaguuugcaaaacaaccuaugcccucaaaggauuuaaauacaagaaugucuaagucuaagacacuaagcagagacacacaguuagacacacaguuaacagugaaugcuaggccagguauggcagugcaugcuuguaucccagcacucaggaggcugggaugguaggggagaguccugaguuccaggccagccugggugacacagugaaaccuugucacaaaagaaaacaaaacccaaacauugcuccaaccgaacaaaucaguccccauaaagaaggcagcuagggaguuagcuucaucagucgggaucuccgugcaagggugaagaccagaucucagauccccagaacccaggagaaaagcuaggcguggacuccacaucucugacucuaaugcuugggugacaaagacaggaggcucccugaacuuucuggucagccagcccagcugaaacagugagagacccuaccucaaaagacaaggugggaagccaggugaggggcacaagccuuuaauccuagcacugugggggcaggggcugugauggugugaaugagauguggcuccguugcuugggcauuuaaaugcuuaggauguuguuuggagaggcuuaggagguguguccuugcuggaggacccaaccucugccugcagcugugcuucccugcugaaggacucuccucccccugaaaccugaggcagauaaacccuuccuccuauaagcugccuugcuugcuuucgguguuuuaucacagccauaaaaaaguaacuaagauggaaguacaggcauguggaucucugugaguccaaggcuagucagggcuucagagugagucccugucucagaaauuuuaaaauaauuuuuuaaaagguugaggagccagcgagauggcucggcagguaagagcacucccagggaacccguucaguuaccaguacccauguggggggagcggcaacuucagcucuaggggcucucuuuugaccucugagggcacccacacauuuaugauaugcacaacauagacacacacacauacacauaauuagaaaaaauacaauaguuagugacaaaaauaccugacaucacccucuggccaccacauauguacuauacacacacgcuauacacauacauacagagacaugcuguacauacacuauaacacucacagacacacuauacacauacuaucucucugucuauacauauacauauacacauacuacacauacaugcauacacaugcuauauacacacaaacaugcaaauauacauacacacuauauguacuauauauacacacacccauacaauauacauacacacauauacauacauuuguacucaaacacauauacacauaggcacacacacacuauacauauauauuuuuauacacacacauacuauacacauaugcacacacauacauaugcacauacacacauguucacauauacacuauacauacauauauacacacauagacucacacauacacccaugcacacacucuauacacagacauacacacucuacacacaugcauacuauguauacacacauauacacauauauacagacuauauacauguacacacuguacacacagacauacacuuacacucuagacaugcauguacaguguuuuaggcauucugagugauuuuuuuucgaguccaccugacuuuaauuuuuuuuuuuguaaguuugagacagggucuuuucuauuuaucccaggcuaaccuugaaggcuauauauagcugaagauggcccugaacuuacggucauuuuuccucugcuuucuuuagugcugggaauaaaggucacuucucuugcuucguccauccggucuuucgauaaugucauuuuuucccccagauguuauuuuugccccuguuaaaguugaucaagcccuuucuaacaccagccugcaauguccuuuagggguguguguugacuucuguuccaguuuguauuggaggcugggauggugggugugugcugcccccagugguuagccuuugccuacaucucagagagguuuugugguucucugugucucaggcuggagcuugcuuugccugcuaauugccugacuguggagagaugcuguggcuacagcuuuuuaggggaaacuccccugcuucagggucucugaugaucaaggagccucuugguuguuguuagaauguuuguuccucuaacacauucaaaacaauuuuaaguuguuuuuugcguauggauguuuuugucugcuuacacaccuguguaccacacgcacgccugguaccuguggagcccagggaguguaucagauucccugggacuggaguuacaggcaguucugagccccuacguggguguggggaaucaaacccggguccucugggagagcagccagugcuuuuaauugcugacccaucucuccaguucauuccugucccguguccccaucccgacuccucuaucaucccccccccccccacuuugggagacagacucuggauggccuggaauucacuuugugaggcaucucuggcuugggcuguguugacuuuuauaaugugaccggcuccuugcccccaucccuagcagugcugacuuggaauucugcaacucccauuucugcuucucagcuuuguccuauccugguuccucuugggugacuucagaguugccagacugucaaggcucuuucucuuccagcccuucucucuuugaaugaguuaaguguuucuaaggugcaggggagggcuggagaaagggcuuggugcuaagaugaccacccccaacuccagccccaggggaucugacauccucuucuggccucugaggucaccgcauucaugugcguccacacaugcacacccagccacccccuccacacacacacacaauuuaaaaugaaaaucaaacauuuaaaguauagggaugucugucauaugucauuugcuuucaacuggauaggacacacaccaucuccaagcucuuguuucugucaucugcagcuccucaccugggccaccuguccgugugucaccaccuccgaccagcaggauggcugccaacaagggcaagagccagggcucccugguacuucacaaggucaucaugguuggcaguggaggggucggcaaaucagcccugacgcuucaguucauguaugaugagguaagagaugccagcacagccugcgccugcugugauguugagugugucugcuccagauguguucuaugucccuuuccccgugggguguuugaaaagcugcagggauaggggcucucagcagaagauucugguugccgacacagugguggguuuaguggucacagaaauggagggaguuucucugcacacuguauuuccagcguuauguguccuuucuuugagacaggagcaagggaagagagacaccucuguauaugugcuaauuuuuuauuuuaaauuaugugcaagcugaaaaauguguguguggguggggggggaggggugauauuuagaaaagugcaguugccuucagaggccagaagagggcauugaaugcccuggaguugaacgcaguuggaguugcccaaugugugcucuggggaccaaacuccuagucuccaggagcagcagguacuugucaccacugggccgucucuccaacuccaacauuuuuuuuuuaaagauagaaucuccuguagcucaggcuggccuggaacgcacuauguagccuaggaugaccuugaacuucuaaucuucccaugccuccccuugcugggauuauaggugcaagcuaccuugccuaguuuaugaggcucugaggauggggcuugggccuucacaggaaagaggugugcacucaaccaacugagcuacuccccagcacccggucuugagugucucugaaaggguugaauguuaaagaacagacccucagccuacagcaccuugggaaguugagcucagcaagagagguuaggucaccggaaguguguccuuaaaagagauauuagagucccacucccuuccggccuuccucugcuucuugguugccgggacgugagaaaccguuucugcuguuccucgcaccaccucaccuccucugccucaccucaggcccugaggaccauggagugaaguucugaagcuaucagucaaaaauaaaccuuuucucuuuauuaauuuuggggugcgugucuguguaucuguguauguguguuugugugugugaaugcauguugcaccacacuggaggucagacgacaacagggacaagucaguucucucucucauggacugcacguggguccuggauucgaaugccaacuuuucacgcuuggagacacucacuaagcuuucuugcuaaccccaaaauucacucuuucgucauguacauucuaagcaggugugaucauguauaccuguaaucccaacacuccggaggcugaggcaggaggaucaugaauuagaggccagccugggcuuuguagcuaagcccagugucacaaaaagaaaauauaaaauaaggaauuguugucuuggugggcacuuuccgguugcugugauauuaaaccuugaugaaagcaacucacaggaacaggguuccuggggauaccgucuguuauuggugaaggcauggcugcaggagcagguggcuggcuggucacacuguauccacacucaggaagccaagagugaacaggaaguggggcaggcuauucaacuccaaggccaccuucagugacccacuucuucccagaaggcuccauuuccuaaaaucuccacaaccuucccaaacggugccaccuuuucuaauauugcccuuugauuugucaaaguuuuacaguuucaaaaauguaauuaauuuguuuuauguguauuuguguuaugccuguguggaugccugugcaccacacguguguaguacccacagaggccagaagagggcaucagauucccuggaacuggaguuguauacagaaaguuaagcugccauguggaugcugggaauugaacucaguucuucuggaagagcucaauugcugagccaccuguccagcccugaaagcauuaaguuuuacugaaguccgguuuagaguggugugugugugugugugugugugugugugugugugugugugagacacgugaggugcacaugaagaggucaguggaaacuugcaugacucaguuuucucuuccacugugagccccgggguggaauucaugucagguuuaguggaaagcaccuuuacccccugagccaucccccuggcccccagcucauuucuucuuugcuacuuggacuuuggucucauuccuaagacuuuaugucugguucaggcucacuggugguuguucuguguuuccuucugaguuucugucuuaguucuuaugucuauacuggcgcuguuuucaguuagucacuauguuuuaugugcccugcauaagaaguccaauuuuuuuacgcuuuuuaaaaaaauguauuuacauguguguuccuguguuugaguguguggcaugaaaaaccuugucucaaaaaucaaaaaacaaaacaaaacaaaaaaaacaaaaaaauauccaccuguccuugccgccaaagccuggcaggaaaggcguguuucuccaugcccaccuuccaucccucauuuuuucaaaaguaaauuucaaauuuauccugugacgguuucacgcaugcauauacucuauguggauggcauucauucuccauccuccagccugcccacuucccgcucucacuuccucguccuacagacgcccaucugucuucaugucuguucugugggacccacugaguuccccucagguguucacguggccaucacggagcugguguacuuugaggcacaguauuauuagauugcucaggcuagccccagaucuagccuugccaguguuaggcucagcugagauaguucaguggguaagacaaccaccaugcaugcauggggaccugaaccccuagagcccauguaaaaccugaacguaguagcuagugccuguaacugcaguacuucugugggaggaucagaggugcagcagcagacuccccagaagccagcccagcacaugcauggugucaagggaaaggaagagaccugccucacaagcaagcugggggaugaggggugaugccugagguuauccugugaccuccacguauguacagcacagucucucccacacuccuacccacagacaucacaaacacacauaugcgcgcgcacauacauacauacacacacacguacacauacucacuuauacacaaacacacacuacauacacaaacacauauauacacacaaacacacauaaacacauaaacccacauauacacacacacauacacaaacacauauauacacacauauacacaugcacacauauacacacacucauacacacacaaccacacacacaagcuaaauaaauguaauuaaaaauguuaaaagggauugcauuuuaucaagaguuuacuaaagucucauaaauuaguuaauuuuuaugugugugucuuuauuacaaaaaaaaacauucggggaggcuaauuuacuucuuuuuuuggcaguuuuugaauuuguuuugucuuugaggggagacuacauccuucuauacauagguaauaaucucuacucuacuggcgaccugcugcagaaugacacacuguuauucuagaguugucuacaugcccguauagaguuuccuuccuccuuuuuguguaacagcgaagcacucaguuguauagccaaccuuagcugggcauuuggguggaccuucaucuuuugugaugcccuuuggugccaacagugaccuugauuuuugagccagcguuucuggagauuagauuccuagaagcuagauguggggagagucagaggauaaaguacuucucauuuuaucagauguugacaaaucucuccaugggaugguccuguccccugccccacagggagcaacaggucuuuccccaaagcccaugucucagggcagcucuuccuccucucuccugauugcuuuucucucccucccucucucccuucucccuccucccucucucccuucucccuccuuccuuucuuucgcacuagugaggagagcaugucuccaugcuggcuuuggaugcucccaucagugcguguuaaagaggagugcucaaugcacugugugcagcucagaguucuggcuagcgcuugcaucgugcugcgcugugcugggcuggguugggcugugcugugccucuguuguuuuuucauucuugggaaaucuaacaucaauuuuuuuuacauggcuucuggacuuugagucauaguuuaaaaagcccuucucuacuucaagguaauaaggugcuaccaugucuacuuucagugcuugacuggauuuauuuauuaauuuacaugugugugugcgcauguucauguaugcagaugcauguguggggggugugcaccuacaugugcaugcacaugcuugugugccuauggaggccagagagcauccccaggcaaugguccucagauaugguccaccuuguuucugagacaaggucuuucauuagccuggggcucucugcguaggcuggccuuagcuggucuuagguggucuuaacuggccuuagcuggcaaugucaccuguccucaugucccuggacuaggauuauaagcaugcacuauuaccaugucucacucuuuuuuuagauuauuuuauuauuuuuaguuacauauaccgguguguaaaugugggugugugcguacgagugcaggugcucaugcaugcuggacgcacuggauccccuggagccaccaaggggacuguggucugaacuuagguccccuaggagggccauagauacucuuaacugcugagcccucuccccagccucuggcuuuuguuguuguuguuuguuuguuuguuuguuuguuuguuucuaagagggauguggggggucacacucagcucuucauguuugaugaccagcacuuuguccacucauccaucuccccgacucuccgcuuguuuuacucuacacucugauuccucuugccagauucccuugggaugauuuuuauaguucugcucauuauuaauacaggcucccgagccucaccuuuuccauuguuuguauuauaauuuuaugcucuauugacaaugauaucaucaagaauucuucuuaguguuggccuuucuuaucuguaaaauggggcuaucugccccuguuguugaaagcuuuaaaaaaaagaaauugaacucagagcuauuaaggcaggaaguguucccaagcaugaugggacaugcuugcaauuccaacauuuggaaaguagagacaggagguucaagaccagccugagccacaucgugugacccuguugaaggaaggaaggaaggaguggguuguuugcauucuucagugucuucucuggguguaauagcucuagacucuuagugaauacaaagcugauugcaaagcauucagacguagugauguagucggggugccgacuguacuccuuaauucugacugcuuccccccaguuuguagaagacuaugagcccaccaaagcugacaguuacagaaagaaggugguucucgacggagaagagguccagauagacauccuggacaccgcuggccaggaggacuaugcggccauccgugacaacuacuuccgaagcggagaaggcuuucugcugguguucuccaucacagagcacgagucuuucacagccacagccgaguucaggugugcuugacuggggagagccuggcccugacccuccugcccggcggcugagggcgagggauccggggucgaguggccuagugauggccgggcucugaugaggaagaacucugccguaggguucucugaaucuuguuacacuuuggucuacuauuguuucuguuucuuugggcauccauguuuuaggauuucugcacauaccuuuuuuaaaagguggacuuauuuuuauuuauguguacugguguuuugccuacuguaugucuguguaccaagugugugcaguacauacaagggccaaagaguucugagcgugccaauagaccccaaaguugucugcaagagcagccaguguucccaacuccaaauucuguuauaaagaaauagugagcauugggggguacuucuucuguagcugguucuucaccacaccacacaagcuuucccacuuucuuauauaauugcaaauuuuuucaucgacuccccuuaaggacagaauacccuaguuaguccgcuuaucagaaaagaaguuacugugguuugugguuucugaggcuaccaaccacgaucauguggccuguugcucugggcccagggguagggggcaugcagcaugguggggguuauguuacugaaggcuugugugguacacggcagcuggggugcaaaagagggagucuagagucccagugucccuucccagggcacaccccagagaccuaucuucuucccaccaggcccugccuccuaaaggucucuaaagagcugaagguucuggcuugcuuucugcagcugcgguguguguauggaggagacgcacagcagagaacucagcgugagcucuugcggcugcagauuuuuuuugagcauucaggaaguuucuauguggguaacacuuuugugaucacaacuguguuuccucuucauaaucugauuuugaggccaucccggagauaaaacaggaugucuguacacacugcuuucuucucucccuugugccuguauuggaauuacuaagcauuuuugugagcuguugcuuuggguuugauuggauuuuuuuguuuuguuuguuguuuuaaguagugucucaugaagccuuaaacuuacuauguagcuaagaugaccaugaacuucuggucuuccugucuccuggguuuacaggcguguagcaccaugccugccuguagagugcugagaaggaaccaggggugggggguggggaggggcucuguguauacagugggagcacccugccaucugggccauguccccgagauucacagaggguuucuuccugacuucccucucccuuucucuuugaccccauaaauugggggacuccguugagaugcagacuccugacuuccuaugcagacaucucuuuuguaggaguauggggcagagaaauccguaccugggagagaccagaugaucauaauggacgaaagcuaagggccagccuggaaaagccccugcuaguagacacccauuuugaaaucucccgauggaaugauuucucuuguucuuuaccgagggcuuuagaugcucuguaaaccccgaggcaccuggcagcuacuuguaaagcugacuucauaugccagcuuuuaaacaaaacaaagcaacuuuauuuauuugugcgcugugcgugcaccggcauacauaccauaguucacguggaggaaggaggacaaccugcaggaaccaguuaucaccacucacaguguagaucaaacccagguccucagacugccuuggaggcaagcacucagccgcugagccguccuggugccucucccgccaguuuuggcuuucuuaaccacacuguucuugccgcaccgucccuagggaacagauucuccgagucaagucagaggaggacaagaucccacugcuggucgugggcaacaaguccgaccuggaggagcggaggcaggugccuguggacgaggcccgaggcaaagcggaggaguggggugugcaguacguggagacaucugcaaagacccgcgccaauguggacaagguaggacgaguucuggaggcuucucagaaucuggcuuuugcugucucaagacacagccaucucguuugcuuggcuuuuaauuuuauuucaacucugugugugugugugugucuaucuauguagggguaugugaauguaggugcuuauagaaguaagaaaaauccccuggaauugaaguugcagguagcugugaacugucugauguggguaccgggaacugaauucaggcucucugcaugaguggcacucucuccugaccacucagccacuguggcugcugccucugcuaccacugcccccuucuucuuccuccucuucuccuccuuuuccuccuuucuuccuccucuucuuccuccuucucuuucuuuuuucuccucuuccuucuccuccuccucuuucuccuccaccuuuuuucuuuugacagggucucguaccacccgcagucugaccucaagcuugguuauguaggcagugucacaccugcagucugaccucaagcuugguuauguaggcagugucacacccgcagucugaccucaagcuugguuauguuggcagugucacacccgcagucugaccucaagcuugguuauguaggcagugaugacuuucuaguccuucugccuccaucucccaagugcuagcauucaagcuuugugccaucacaguugacuugucauuuuucuguuuuccuuuuucuuuuuucauccuuuuuuuuuuuguuuuguuugaaagucucacacaggcuagccuagagcuccguaaguagcugaagagacccuugaacuugugaucuuccagccuccagcccucuaccuuccagcacuggaaugacaggcgggcaucauagcacccgguuuaugcagugcugggaauggaacccagggcucuacacaaucacaugaccgcccugugguuuuucuuuuacaucagaguucagaguguuagcacacaguugaaguaggugccuuacagcugaacuucacgccguuuucccaugcugugcugugggcucuuacuucacauccugggcuugugaaaucagugcagagccagggcaggcagaacagaagggcuaugucugcacccaguuaugcucggccacagaucugucuaccucuucuuguucucaguucacacuguagcccaggcuagcgcugugggaugucacucccucucuuuguacccuaccaaggagagcuguuugacuagcugguucuagaagagggcugaguacucucaagggacauucggaggaccuggcuuuaagagcuuggugcucucuguagccuggggcacagugaguuguguuccaucgucagcuagauuuugguuaucaugugggccccagggaauugaguucacguugccagguucuuauccuccaccgcaccaugucccugguucugucugucugccugucuucugucuauguguguaugugugugucuaucuaucuaucuaucuaucuaucuagacagggucucauaugcucuagacugaccuguagaucucguguguguguaaggagugcuagaaacacagguguggaccguugcaccugguuugugggugucaggguggaccccagugcuuggcaagcccucucccagcugccguaucccagcaucuuuguuuucuuuacauuguuaucugaacucucacguugcuucuuaugaugcucagacuucuguuccuagcugagggaaauacagagggcauccagguauagccuuagucuucucuggagaggaggagggugcauguuugagacaagguguagugcuaguuguccucugccucccacacccggacuaaggcuuuauguuuuaaaaccaagaaggcugucuggucaugguagcacaugccuuugaucccgcuacucagaaggcaggagcuggcagaucucugugaguucaaggccagcauagucuacuuaaggagaccuugucuaaacaacaacaaugaaacaaaacacagacuuuuucaguaugaaaaugcugacguuuuugagaaggcuggagucagugcucugggaucucauucuggggcggggugcacaacaucaugucccccuccucucccuggacaaccuuugaccugcaggaaaaacccagcaggaacuuguaacagguaauaaguuuuuuucaguaaacacuucccuucagaaaggccgcggagauagaugcccagcccaggaucagugugggccgcuuuugguugaaugcuccacaggccucccugccuuuuaucacaggaugaaaccaaagucugugguuuggacccagggcugugcuagcaaaacgggguguagacaucagccugagacacuuaggguucccuucccuggggcugggguucauguaagcucacaugagaggcauaacaggaaagcagucuuguuuugcuucauuucugaaacaguaauuuauaugcccagacuaguuucaaauuucaaauuuguuguauagucaaguugaccuugaacuuugaaccuuucuagaccugugacaucacacaugacuucucucucucucucucucucucucucucucucucucucucucucuuucucucuguuaguuuuauuuuuuuuuucuuuauugaaaauaaugacagggucucuucuccgccaggcuaaccucuagcucaguauguagcugaggaggacuugaacucccgaucuuccuaucucugccuccuguguucuaggauuacaggugugcaugccugguuugugcagugcuggggaucccauccaggggcuuguguaugccaggcagcugcucugccaccucagccccagccccagccccagccccagcuuuugcuugcuuuucccuuugguucgucucugagaaucagcgcagagauggcggagauggaaaagcuaguguucuuuguccugcuuccaguucugugggaaaucuccagugugucuuugcagggagcguauuuugucugccaggguuuaaucagucccuuggcaauugcuggucgcagagggugaaacccaaaccucacugacacaugauaacgcccgucuagauaauucgcaguggcucgucuuucuugauaacauucuucuuggcagugggggguggaaauggggguguggggcugagguacgggaggaggaacgcugugauaagacuucacuuucuucuuucucccagcucuccaguucaggaaccugccuuccucacuccugcccccuugcuuuccuagauuugcccuugguggcuuucaaaguaggauuuggggaggggcaaaucauuuauaaugccauuccagccuuuguaguucaacaagguauggugacgugggacaaagcagagauucacccuuuauuucuucucucucucucucucucucucucucucucucucucucucucuguguguguguguguguguguguguguguguguguguguguguguguguguauacacauguucauaccaucaggucauugugcucaguggcaggggacucugccugaugaggcugcccuucaccuuucuuggaaauaggaggcagacacucacaggccauaucccuucaaauguuugaauuucgcacaccauuucaaaaaccaugcuugccaaagcacauuucacccuuaguauauaauuaagaagagauccggcgacggugacaggcucuuccuguccaugacagcuguguggaaaggcagggcucuucugcugggagagaggaggcucucauuaaagcggauucuuacugcugucugucgacgccuugcuguuuauucgugaugcuuuguuuguaacgaaacaggcucauaagcauaagcuugggggcuggagauggacuuauugauagaacucuugccugggaccaucaucagugucacgugaccuagcccugggaugcguaggaaagccaggaugcauggccaugcacagccaguugaggccagcuugggcuacaggagagccugucugaaugaauaaacgaaugaaagaacgaacauuuggacccuguacauaagaguugagugcaccccaccuccuuauucuuuucucucuuccucucacuucuagguauucuuugaucugaugagagaaauccgggcaaaaaagaugucagaaaacaaggacaagaacggcaggaaaagcagcaagagcaagaaaaguuucaaagagcgaugcugcuugcugugagcgggcugcagacugacgcagcagagugggccacacugcagcgcagcgagccggagguggccucccagcuggcuccccauucgcucuccacaacugcauucacuaucacuucuugagaugggacagauauccgugcgucaguggcuggcagaagaaagacgccuuugucuguguaaugccucuguuaacuuugccaggagcuuugagagucugcccucucccacccuuccugaaccaugaccaccaccagcucuagggucguaauguuggagaucaggaauauugguugugaugacaagaaagagcccacuuacuccuccucguucuaggacacggucaucuuuccuuaggaaauuaaaaugcuucauauuaucugggcaugguggugcaccccuguagucucagaacucuagaagguaaggcagggaggguagccugagcccaaggccagccugggcuaccuaacaagacccugucucuaaaagaaaaaagaauuaacaucuuauuuucuuagauuuuaagagagagucucuggcaagaccccccucaucaguucuaaucauuuuagaaguagacagaaaaaaauaucuaagcucagguaauacugaaaaagccaaaauguuuuguuucguuucuuuuuuuuuuuuuuuuuuaaagauaaacuuguguaguuuggaagcagauuuagaaagaugaacuucacuugggccagauaggcugaaccaagcuuccuggcguuuguagagaaagugggacgcuguucucuucauauuuaaaugccagccaggugcuggcugugggcuuucccuccucaacacccuuauuuagaaaggaaacuguguggggggagaugcaggccugagccccauagcgagcuugccuuuucugacugggucuucugguccccccuacaccagccauaggccuguucuuuuucuuccuucugaaaacugugaccaguucaaauuaugacucagaacguagggccagcaccagcuaccucugcagacucccagugacucucucuucacaagcagaugaagggaaggcucagaagggcaucuccuguagcuccuggcagcugguucugguggcacugagaugagugccaccagaggcucacacucacucucuguugagcuucuucccagggaaggggauucugggacagggggcugccacuaagcacacacacuccuccuauuuuccagaagugaacauuucauguuuaggugccgaaugugaaucuggguggggagagcgggagcccuucgaauggauuuuuuuuuucuuuuuuuacagagguuaugggaacuaaggucugaucccuggaaacugaucuugugucacuuccaaagaaucaugggcuuuuucgaauaaaaaaauuuacacuuuucaggau

SEQ ID NO: 331 - RNA, 6688 nt, Mus musculus
ccucauggugugcuuuuaagaauaaaaaccauguuguggguugacacacuucaguuaacaagaagaguuagccagaagcagaaguacagaagccauagagcaagguugguacauuuagagacuuuggcggguggugcucuguguguguugagauuuacagacugaguggcaccuuugucaugcagccagcugugcuaaggucuggugccuguuacagauaugccuuaauucuuuuaccuccuccucugccuaucagucuuuggugccuuuuaaauuaucauguacacaugugugggcuugagguguaugcacaaggacaagacucccagaccuccaccugauguuuggcugugggucucugcaucuguuuccauccacugcuggauuaagccucucugaugacagguaugcuaggcuccugucuucaagcauaacaguaucaauuauaguaucagggguugacucuccuacaugggauggguuuuaagauggacuagucuuugguugaccguucccucaaucucugccccaucguuaucccuguucaucuuauaggugggacagauuuugggacgaagcuuuuguggauggguugaugucccccucccuccucugaaaguccuaccuggcuacaaguggugggcacuucagucuccauaucccccacugguaggagucucagcuaggcucacccccagcccugguauccucccaggacccucccgcaucccaggucucuggcuagucccaaagaugugcguccacacgcacacacacacacacacacacacacacacacacacacuucccuucucccagcucucucuccugcccacuccccacaccucauccccaucccugccacacccucucuaaguugccucccuccauccaccuucaaagauuauuuuguuuccccuucugagugaaauuccucccuugggcccuccuuguuacuuaauuuuuuuugggucuguggacuguagcgugguuauucuguacuuugaggccaauguccacugauaagugaggacacaccauguguguguuucuggcccuggguuaccucacucaggauauuuucuugccggcaaguuucaugaugccauggaguuucuuaauuaaccuuuuuuauaucauauagcaucuccgggucacugacaugggagggacugaagaacacucucaggugaggauuuuccuuuauuaauuaagguguguuaauaguuuauaaccauuaccauggaucugugucuuagucugcuuuucucuugcugugauagacacugaccaaaggcagcuuggugaggaaagaguuuauuucgacuuauaguuuguaauccaucuuuuaaggaagcugaggccagaaucuggaggcaggagcugaagcagaggccauggaggagugcugcuugcuggcuugcuccauggcuucuuaaccuguuuucuuauccacuccaggcucaccuacugggggaugggcagaaccacccaccguggggugggcucucacgcaucaauccuuagucaagcaaaagcaguacagacuugccaacgcgcaagugugauggagguauuucucaauugaaguuccucuuccaaaugacucuagcuugugucauguuaaccacaacagaaucugaccggcagcacauccuagcuaggccaucaugguauaaccaagaugacaucuucuuaugggcagaggagaaauuacuaaccauagacacaccaaaaauagcucaagauuuucccaguaacucacuaauccacaccuuauugucacauuuuuuaaucuugaaauguuauuuugugcauaugaguguuuugccugcaugugagucuccauaccacauguguaccuggugccccaggagaccaggagagggcgucauauucccuagaacuggaauuauagaccguuguaagcugccaugugggcgcugagagucgaauccggguucccuagaagagcagccagugcuuuaauggcugagccaucucucuggcccccauccuugccacacucucaguguacuuaccaacagcuagcuagucucaguacagggagaguuggaccaagguuguguguuguuuaucaugucugaagcagacucucaggcagcccagguuucccucagccucacugaguagcagauguccucaacugucugaucuuccugucucccuuccugaauguucagaucgcaggcguguaccaccacaccugguuuaugcaguucuggugauggaagccaagggcugggcaugccaggcagucucucugccccuugagcuacacucccagacuggacgugggguuucuaacccagccggugcuuucauuaacaaagcuuauuuaauucugggagggugguggggaggggcagugaugcugacugccagaggucagcucuucuggagagagacaaacgcugucuacacucagccagaccgagucacagcacacugagaccgggaaguguggucccguuagaauggcggcggaggucuucaagcuugccaugcacaguacguucagcaacaaaggaggcacugucuauguggcucacuggcagagcgccagccuggcguguacagagcccugggcuccaaccccagcaccacagaagcugagugugcuguguacgccugcguccucgaacucaggagguggaugcagaaggaucugaagucuaaggucuagcuacagucggcucaaggccagccugggcuaugcgaugcccugucucaaaagaccaaggggauggaggguuguaaagaagaggaggcagaaagaaagccagcagaauguugcaggcuagggcaguguguguggccugugguugugccaagaaacaacuuacaagagaaaggggacguucuggcgggugggaaagagggaaguggcugagaaugaucaccuccgcagucagggggaggaggcguggaaugaggcuacacauuucuucagggacccuggcccauagaaggaugccaaccauauuaaccuaaucaagugugccuccuaguugauccuaacuccucugaaggugacacuaagcauaacaggcucuacauagggucuuuuuguauuuuccccaacuccuguuggucaaguaagacuucucacauaggacugacuugcucuuccuugcaggagggcguggucagccagccccuccaguugcagagggagggggacuuggaggaccucaggacuuucugcccaggcuuguuuacuaggguacacaccuuuguuaaaauguucaagccaccaugcuccugugccuuugaccugagacuccaccaggcaugugaccaucccaccagaguugccucugaaacagagagagguagcaaggaaggaggggguaccuagauuugagccacuugccuacacugagauccgggcauguccccaugcugcugacaugggccuaguggcgcuguugggguggaagggacaauggaaagaggacuuacuaagacauagauggugccagccggugucugcugugauagcguggaaggagccccaggcaugagggacaaccuaacuaggccuuggcacgaggugcugugcccuccuauggaagcacucuguuccucuggaaggcaggugauggucuaggcuaaccaagagggcacuggacauugguuccaugaccggaccaaguuccagugucacauuggccccugagaugugaacacagugacacccucccuggagugggggggggggggcagggucacccacccagcacagcucugggcgcucucugucagcacugccaucaaugagguccaugcuguguuaacacacgugugaccacucugcaggaccguggucugcuuggccauugcugguuugaucauggcuugagcacucuguccucccacagcaaugcccaaguagugcccuguacaaucggaagcccaguccuucugccacaggccuccugaccgcuacucacccucuguugucauauauucuacuauauauuaugaaauauaauaauguauauuauauauauaauguguguauacacauauauacgugugugugcacauaugugccagcuauacugaacaugaacauguggcugucagaggacgaccugugggaaucaggucacaugggucccaggguucugacucagguugucaggcucauugacagugccuuugccuagagccauccugccauaccccacccccaucuuggguuuguuuguuuuuuuuuuaauuuuuaaaauucauuauuuauuuuaaaacagacucucucuauguagccacaaaugaccugaaacuauguagaccaaaguggccucaaauucagaaaucuuccugucucugccuccugaguaccuggauuuuuguuguggaugguugugagccaccaugugguugcugggauuugaacucaggaccuuugaaagagcagucagugcucuuaaccacugagccaucucaccagcccuuaaaauauuuuuauuuugauuuuuguuucugagacaaaaucucauccaaggcuggccuuaaacugaucuuguuucugccugagcagaguugacacugguucucgcauaaugcaguccugaagagcugcugccauuucuaaaugccacugcucacaaggggaucugaacauaggcucuucccaucucucaucggaucccaguggguuccuucccauggcaacggcuuuugaaaacuacagaacauuuguaaaagaagaaaaucauucgugaucuacaaauuuuggucccuuucaaaccaccuguagcacucugaguucauggacugauagcuaccuguguaaacugccuuggacacacgcugccuccccuggcaggcucgaccaugugcucgggccacuggaauugaguugacugaccggacaucuaucaccugggagcaggaacguuggugcuugcagacuuuggcuuggccuccuuacuucugccauaaaggucaaaguccaagauugccgcuccuucgauccagcaucuugaagaggacgaaucaagaaggccuggcauagcucccaggccugagcauauuccucagccaacuugcagcuccagggaggaaucuguaguuaugucuguuuauauuacugucugugugaguauacgcguguaugugcacuaccgcauucuugugaaaagccaagaacuuucagacauauacucgcucuuuccuccgugagacccaaggauccaacagcucaccagcuuugugcauugcuuuuuccugccaagccaucuuacugggcuuuaaaaaauguauuuggaccuuagggguuuuuuguuuuagauagucucccauuggcauagaccucaacaauguggcuaucuggcucacaagcccaggggagccucacuuugcguucucuacacugggaauauaagcucauacacuacagcuggcuuuugugggguucugaggcucacacagccacacauuuacugagccaguugcccagcccagcuacuaaguucuuggaaguugugaagaagcugagacaucccuuuguagaaguugugacaaacagaccugcacgcuaguguggagucaccgugcuguguggccaucagucaacaaccgaccacaguccuccacugacacucaccuaagacugaauggaacugagaccugacuggggacagagacuuagggaugucuguagcaugugucuugacaguggcucgccaacacuccucccauugcugggagaauacaacugagcacugcagacccuccugaccaacccuuccguugcuucagaaauaccugcucuuccaucccuaaauguuuuaaaauuauuuugugcauauagguauuuuuuuaauauggaagguuucacggauuugcauagcauccuugggcagggauucuaaucuucugugcauuauuccaauuuugguauaugugcugcugaagcaagcauacauauggguauuuugcuugcaaggaugucuguguaccacauaugugccugcagagcccagaagagggaguuggaucgccuagaacuggaauuagaugguugugagccaccacccgaaugcuaagaauugaccccagguccucuggaagagcagcugaugcucugaccguugagccaucucuccaagccccaucuuuaugucuuacuagggugagaagcuguuaucagauacuuuguggggauggaggagagguaggggugcggugagcagggagguagagaggaaguagguaguaagguagcacugagauaggguggcugccugaagcucaggugcaguucacccagaagccagcagcauuccuucaugcuucucagcuuccucucuagcacagggaucacuaugaggagcaccuccuuggugucccuaggagcccugagguuuuauugagaagugaaucagcaaugcccuguguagaaagcacccccuccacugcugcucaguacugccgcacagucugcugguugguccaaaccaccuauguugcaaguacaaagaaccccugguagcuuugcauguuguuccuuagcauguaaacaggcauuauuuucacaugguuuugaaugaugcuaaaauacucaauucaucuuguuugugcauaugcuuaaaccagaggggaacauuaggcggcuuccuuuauuguucuccaccuuuauaaagaaaacuagcuu

SEQ ID NO: 332 - RNA, 101520 nt, Mus musculus
gggggcggaccuuggauggggcuuuaaggggcgugcccucgggcggccgggguccuccggggauuagcgcagggugggcucgcgccuugcgccgccauuucucggugucucuggagacccguccucuccucuagccggcugggcaucucucuccgagggucgcgcgucccagucgcaguggucuccgucgcuucacgguguucacccccgaguacagguaagaguuuggccucggguguccaguuggcccugcucacugagccgaggcucucgaccgugccgggugggcggcccggcuccccgggcgacgccgcgggcugggaggggaguggcggcgacggccaauggggcugggcgcugaguuucgggcgauaccgcgcgguggccgcugagggccgggcgcgucgccggggucucgcgcguuguuggggggaaacucuggucaccccugaccuccccguagcugugggauuaggggaaggucgccucgagugucacuucgccgggauugugggcagacaucggugagacaggacgugccagcuagcucccggucgagugaaacuugggaagcguacgaggcaggugcguucccgggaaccgccaaggccgagggcgcuccccgcccccacgcguggcgcgcguccgguaaugauggguucuccuguggguagaagauaauuguguccaucucugguuacuguagucucccggguucugcuuuaagagcgagaaggcuccaggcuccgaaguuguuuagcaauaguucaaaauuacuaguaaugguuuuuuuuuuuucccuuaagaauuggagauaagcccaccaagaaauuaugaauguaauucacaacuccgcucaccccagaugcacugagcugaggcacugagcacugcuaacugcaguggguaacuuguaugugucuaaaugaacacuuugggaucauuauuuucuuuuucuucccaacccccacuucguucuucuucuaauucuuuuucucucuuucuuccuuuccuuuccuucuuuucuuuucuuuucuuuucuuucgauacugggaaccaaacccggguucuggaacgcuaggcugaacuaaaucuaaaugcucacaccuguuuuuuucuuuucuuguuguuguuguucuuguuaggauaacuuguuugggcagcgaugugcgcaauguuccuguguuuaguuucuuaguuacaguuucuuuugcgggaguaacugggaugaaagauacugauaacuuuaggacauuuucuauaguuuucaauauuacuguuuuuuuuuuuuuuuaaaaaaucacuagcuuggcuguagauacccuaugguguaaagcauggauacccaggguucaauccccagcacugcaacaggaagagccaaaagggaggcgcaguugacacuugcaauuggcaagucaguauguaugaacuuggagugguggaaaaguggcucuuggcuaaauaggaaauguaucacuucaguuugcauuucugugauugaaaagaaaacuuacucguugaaaacucagaaauuaaaguuauuagaagacuuguaacuccaaaccccauauuuccaguugcuuuuagagacccugucuccccaugcagcccaagcuagcuuggaauuugagauagauagauagauagauagacccugucuccccaugcagcccaagcuagcuuggaacuugagauaaauauauauacauauauauauauauagagagaggggggggagagagagaggagagagagagggagagagagagagaauaugagagagagagagcacgcucucucucucucccucuccuagauuagcuuggaaccaauucugcuucugccuuccaggggcuggagcuguuuugugagucucuuuuauuaucgucuuuuagaauuugugcauagauaucuauauacauauagauaccuagaucucucuauauagauaucuagauaucgaucucuauauauauuccauuuucuaauguaucauuuugcucuaucacauuaguuuucuuauugaucgucuaauauguaauauguaucauagcaacuuugccaugauagcuguuuggucaguaaacaagucagacuugguuccugucugugggaguggaagggaugauagucaguaaaaaggaagaaagaagucaauuaaauauuuaauuacaguuucuuuucauguuauaaagaaaagucugccugcuaacagggccaucuaauccggccacagaaucugagaguacuuuucugaggaaauaaaauuucauguguaaauauagcgcucucuuagaaaaaagaaugggagauggagugcacagagauuuucuuaggaagaucgaccauugauaagaaaguucuggaauuagacauuugagcugagcaaagcacuggagcugagagcagagggcuagcaggcccaggaggaggaggagccagggcuguuaaagauuuaaaagggaauuagcuuuguggaggcugauaauccaccaguccaccagcugcagcacugcccaggauugggggcaggugggaugggggaacaaaauauggggacaccuuuucauuguguaacccucaaguuuuacuuuuuauauuuaagaacuuaagcaauacaugcucuuaugaccucuggauuaacucuacagagagaaacucccuuaaaucaucugcauuuguaguuucuauauguguguaugguauaauauaauaugguauaauccacauccauuauaucucaaaguagacuaauauuuuuacuuuucuauuaauuuaauuuucacuuauuuuucuauauaaguuuaauuuucacuccaagacagauuguuuuaagacaagguaucacuauguaaccuuggcuggccuggaacuauauguacaccaggcugacuuccaauucaagagaucuaccugccucugucucuuaacugcuggaaucaaaagaacaacuguauugaacagauguauacaaccauuguguguaucauaacucccuuaauucguugcauugugcugaauacguuuuugauguuugguugguuggguuucuuugagacaggguuucucuguguggccuuggcuguccuagaacccccucuguagaccaggcuggccucauacucagaguuccaccugccucugccuccugagugcugggauacaggccuaugccaucuacacccagcuuauuugugagucucuuaagucaguuaggccaagaaaaguuuuuguuccugcaacuuagaaguagaauugcuacaugaagucuaugcaauuuaauaacuugcucaaauaggacaguauaugaaaauguauguaagcauucccccuccauuucccugcuacauagagauccaaccaaggaccucagccaugacagucuuuccucugugugugugcgugugugugugugugugugugugugugagugagagagagagagagagacagacagacagacagacacagacagagacacagagagaggcagacagacagagacacacagagagugaauaugcauguggauuucagagacaaccuacaggagcugguucuccugccacauaaagggacaggcuacuuuucugauuauguuugugcagugcuagaugucuaauaucuaauccuucaaaucuguuaggugcauccuucuuuuuuuggggggggggguguuuuguuuuguuuuguuuuguuuuguuuuucgagacaggguuucucuguguagcccuggcuguccuggaacucacucuguagaccaggcuggccucgaacucagaaauucgccugccucugccucccaagugcugggauuaaaggcaugugccaccaugcccggcgcauccuucuuuuuaacuuucucuuuuuacucuuuugcuuuuuaguuuguuugugaaagugucucauguugccugacuuggccuagaacuugcuaugugaccagggaucauuuugaucuuccugccuccuccuccccagugcugggauuacaggaugugcuaccaagccuggcuucuaucucauuuucaguucagauuuuccugucugcuguugggaucuuuuucaucauggugcacuugaauguccauugcagaguuguggggucgguacacuugcauguccguugcagaguugcuucucuauuuccaggcuuuaccucaagcaucucuacucacugagcaguauuaucaaccauauuuuuuucucuuuuuuaauguagcucaagcuaaccuggaauuugcauguauauagaccuauagguuacccgagaagucagcaugcuccuauuuuggcuuuucaagugcuagaauuacuuuauuaggcaaccacgcucucauuuggaauguccuguuugaugucacccauuuucuucuguuggguuguuuaccuagguaauaugcuucuguguucuggguaucuuauguagagccauguguauagcaggcacgcauucuaucaccaagcuauaucucuguagaaacaggugauuuguaauaacuguuuguuaaacuacaguguuauccuucaaaauaucuuuucagaaauuguuuaaaaacuccuuugcccuauuauucuauguucuucaaguacuuucucaguuuuuucuugaaaccuauauuuuauuucaugcuaucaugcauuugugaaaagaaguugguauucuucgagauauuggguuuuaauguucaaacuaacaguaauuaaaagauguuuuucuuuagaaaacagaguaguuguuuuuuacaggacaggauaagaugacaguaagaaaagcaauuugguuguuucuuaggaaaugugaaguuauagugcauuuugaauacuguuuucuuuuaaaagaccacugugauaaaauuaagcauuuauaaaaaucaaaaggaagauaaggauuauguucucaagguacuuauaauaaagaguaaaagaauaaugaucagauuauaagaaaagguucaguagacgugcaguuauaaugacuaacagauaucaggauguuuuucuguggguaugauggaacuaaguuaaaaggaagaaguaggaauuaauuaaaauagaacauuagaagacuggaguccacagagaaaggaggcugagcaccuauuuaaaagcuaccuggagagagcugcacaccuggugauuguggcaccuuguagacuaaccagucuggaugcccagacuuuaguuauuuccuggggcuaaaaucuguaguauauauuguaaaaauacuauuauaaaauauauuccguaguuuuucaguucauggauaguuaaauuuuaauauagcaauaugcucuuaaaauuaccccuuugaaaagagcagaucaauagccacaucuaguugaaauaauaacuuaauuuguaugcuuaaaaaaaaaaaucagcguugccuggaauuuugcugccuccuccuuucccaagcaucugcuuuccuguguuccuguugcuccuuucugacuugaaaauugaagcugucuggugccuugagaacagcucuucccacuguaugcccugccacugggagcaccucccuggcggugguuacuguagcauugugcuggaggauccugacaacgugggcugucgucggcucuggcucuuuccccuuuccuacacuuauuuuuccuggagugaauaauugucuuuauguguacuuaguuaguguuuacuuuucucagccucuuaguuguaaaacuaaaagcacuagguuuaugaaggaacuguguaugguguugcauucuauauguuuccuuccaaucuugaaguuaguguuuucaauuauaaugugcaauauuuuuauauaacuaguagcuacuuuaacuguuuauuuaacuuuaauaauauucuuaguagaacauuaagcaauaaaacuuaguuuaaauuuauuugaacuuugcuaaaauagauaacuauuuguauuuugaaugcucaguuuaaaagcaacaacaacaacaacaaaagucugucccaucagugucuggcacuguuguguaaucuucaccuacguuagguaccacuuacugaucccagacgcuugauggacaucaugaaugacugcuuucuccugcuagagcagcuccuuauaaaaugagacacuaaguuuaaaaagcuacacgcguugcucuaucuuaaaaaguauuuuaaaacuuuauguuaaaaucuagcuuuaaaaguuauuuuugaaaugaaaauuaaauguauuuaacauuuugaaauauauauaaaaaguaguguuucagcuuuuucaaauuaacaccuauagccuuuacuaaacagcauuguuaguuugacacucagucuuuguucuuccugcugucacucacugguuuuguacuggcagaaaugcugagcuuccugagacgaacgcuuggccgcaggucuaugcgcaagcaugcugaaaaggagcggcuccgagaggcacagcgugcggccacacacauuccugccgcuggggaugccaaguccaucaucacaugcagggugucccuucuggacgguacagaugucaguguggacuugccgguaaguaggacuuugcuagcugccaguugugugugaggucacuacugccuguucuuccugggggcuaggugagauagagugaguguggaucaggcacgggagcagucauggacaugcacaaggaaguguaggcccagaggaccuggagucagugucaguugcagaaaacauugacugauaggguaguuauugaugugaauuaacucuguucgugucugcaugaacacacacacacacucacacacucacacacacgugcccgugcucauguuuauagacaguauccuucacaguauguacucagauuggccuuggauuugugauccuccugccucagcugccaaugugggaguacaguugugugugcugccgugcuggguuuaaguuucaaaacuguuuagagauacuaaaucucuguucuguuuucaaagaacaaagucuuuguucuguuucaaagacuuaacaaaacuauaaauuaugugauuuugauaugaguuucauugaauauuuccugaugucugcuauuuuacuaaaauucaguuugaacaguccguuuggaaaauugaugacucugugucuuugauauguaauuuaauaaauccugaaaggccuaaaauacagaaguugaaaaugaagaauuggagaguuugcucagguucaggcuuucuuuguuuuuuguugguggugguuagauugauugauugauugauugauugauugauugauugauuuaugagaccaggucucaguaugcaucccuggcuuuuaggaaacuuaugaaccugcugccucagccuccugaguccuggcucacaggucugcccaacacagcucuagcaguguugcaaguccucauugugugugcuuguuaucugcauggacauuggauugugcauucuuagaguguuugaaucuguaaacuuuaaggcaucuagauuuucuuccuguaagggcugguugagggcuuaugagcuauuccaacaucagauacuuaguaaggauaguuuuuauauuuauuuuuuuauuugauaagaaucuugaagaguuuuuuugugucuuaguccauuaaaauaucauuaaauauuuaguggaaagccugagauugcuguaugagagccuggaaaaaaauguauuaccuaauguuugaacuaugaagccuuggguuguugaaggguaggcugugcuaagagaaccuguagagaagccuuuugaaagggcagugugguguagggaggaagguggucaggcuccaggagaagcagagcagcagcuguuuccugacuacagagagugcuaaucccuugaucagguccuagacaggacaagaaacaacugcagcaacacaggcaguuuuagauuugacaucucucagagcaaaaccauggccuuuaacaaguuuuuaaagauuuauuuauuuuuaugugcuugaguguuuugcauacauuugugaucaguugaguuaugauaaggauacuaauagugcucaacaggaaauugcuuuuucuucaacaaaugguuuauaucuacaugcaaaagaauaaaguugaacccuuuucucauacuacauaaaaaaauugaaauaaggggcuggugagauggcucaguggguaagagcacccgaagguccggaguucaaaucccagcaaccacaugguggcucacaaccauccguaaagagaucugacucccucuucuggagugucuaaagacagcuacaguguacuuacauauaauaaauaaauaaaucuuuuaaaaaaauugaaaugaaucaaagacagaaacauaagaaauaaaacugaaauuuuuagaagaaaauguagaaauauuuauuuucuuagauaaugacaucaagauaauaaguagcaaaaaagaagauauuaggcaaauuggacuuaaucagaauuagaaguguauucccuucaaagggcuccacuuagguaaaagauuguacaacauaauaacagaaauuacuucaaaauuaaauaucagauaaagaacuuguaucuagaauacauaaaaaaauuguugcaaaccaauaaaagacaacccaauuuaaaaauaagcaaaagaucuaaguagaaaucguuuaguuaggacauaacaugagaacaaauauaagagcauucagagucaggugggucauaguucaguggccaaguaugugccgggaagcaugaggcccuggcucagcaccaaaacccagaagacaaaccacaguaaauucuuuuucacacugaaguuagaaggucaaaagucagaaauagcaaguacuggagagaauguagaaaaaucaggaucuucuaacaccaagauugagaaauggaaagcagcugcuuugaaaaacaguccccuagcuauuuacaugacauaacauuguuaccuugugacuaagaguuuccacuuuucaagaccuauccaagagaauuaaaaacugugcuugcacaaaaauguguagauguuagcagcauugugucuaacagggggaaaguaggaaugaaucaggauguauaggucaagucacucccuguagaagaaaugaaauacuaauauuugaacaacguggaugaugucgaauaugcuagugaaagaauccagucacgggcuggagagauggcucaagcgauuaggagcgcuggcugcucuuccauaggacccaggauucaccucggagagcacacacacgguggcucacaacugucuguaacuccacuucuaggggaccugacacccucacacagacauacauggaggcaauaaaaccaaugcagacuuaaauggaaaaagaaaccagucacaaccucacaauuugguuuuguuuuacaaaagucuagaacagggaaagcuauagaaaugaaaagguagauuagugguugcuuggggcagguaccugggaacuagcagagaggugauagaaaguaguagcuaugggaaggacucucuucuagagguaaugacaauguguacuaaaauccauugacuuacauacuucuguugguuuugagacggugucucacuaugcaguccuaacuggccuggaacucacuauauguagacuagccucaccucaaacucagacguugccugacugccucucaagugcugagauuaaaagucugugacuccagaccuaacauaaauuacauccuuuuaaugggugaaugggauaugaguuauauuucaauuaaacuuuuuuuuucuuuuaacuucuaccccucaaaacaaaaacaaaaaaaaaaaaaacacacauuuuuuguguauaugucucuuuggguguuguguuugguuuuugguuuuuugguuuuuguuucuuuuuuuuuuuuuuuuuuugagacaggguuucucuguauagcucaggcuguccuggaacucaauuuguagaccaggcuggccucaaacucagaaauccgccugccucugccucccgagugcugggacuaaaggcgugcgccaccacccggcuuaggguguuguguuuuuguuauguuuuguuguuuugaagccauggaauaugcaugaaaugacauuuuauuguaaguauagaugggagacuugauuuagaacagggggagaagcuagaaacuacuaaagcauugcagguaggaggagauguggcauugcagagaaaggaauguuuauuuagcacacgaagaugcugagggaaggaaggaggaugagcacuguuggaccaggucauaaucaugguguggaaaguccugagagaagagucagcugucacagagcgggggaacagugcgaguggagaaaaggacugugguaggcaaguguguuugcuagucagguuuuagaaaguaaaaggaauuaucaguaguaguuguguuguuuggaauuuucuacacuccuuuggacuuaguagcugcuuuuaacacauuaguuguuugugcagguacauggagggaaaugaaagguuaccagcuagaaaauggcugaguagugaaacucuugaguuguuucuaaggauaggagaauuguuccuugggaauuggcuuuguauaugcagacagaggaaaaauauacuggcagaaauaaauaccuucugagggaaagaaaggcuuauaagccuucagggcagaagagauggcucagcaguuaagagcacuggcaguucuuacagaagguccuauguucaauucccaacaacuauaugggaauucucacaaccaucuguaaugggaucagaugcccucuucugguaugucugaaaacagcuagaguguacucauauaagaaaaaaaauaaauauaaauaaauaaauaguaaugcuucaacccuucuccaccugccagaguucucuggauucaugaauggaacacacacacauacacguacaugcagccuuuauauuucaauaugccuaacuagcuuaacagcugggcuucucccuaacuccucguggcuaacccacuuucccuucugauauuccugaguuauacuugcuaaaucugcauuuuaucucugcuauccuagacccagucagguaguggaccauguaagcacaaauccaaucccccacauuaauguuccuggaguagaaaguaaagggaggaggacugggcugacugagcuagaggccuggagucauuuguuggagagaaagaagcuaagagugcgucuaggacagaggcagcagucgugggguuuguaguggccuaggacucugcaggucuguguuucccacccugucuacuugguguuaucuuagguuuucuauugcuguaauaaagcgucaugaccaaaagcaacuugggaggaaaguaauuauuugacauacaauuuuacaguccuucaucaaggaaacucaaagcaggaaccuggaggcagaaccugaagcagaggccugcuuccugacuugcuccucuuggcuuuuuuaacuugcuuucuuauacaaagagaauccagcaccaccuccccacaguggacugggccucacaauauuaaucauuaaucuagaggauccgugccuuggucaaaccucaucagcuuuuuuuuuuuuuuuuuuuuuuuuuuuuuuuuggcaguagguagaaauuaacagagagaaccacaacuggacacugugcagagaggaagacuucuaaauaagacaucuucaccaggcgccuccccucacagcucagggaucugugcaugaaagaggaggauuuggaaagcgguaguggaugacaucaagcaacaguauauucuagaacaacuggacugaugagggauacacauaugaacucauagagacuggcaucaugcauaagaccuguaaugguucaagccagucaggucccagcacugagaggggggcgugggcaugaggucccaccccugacuagaaggcuauuuguaacugaagacagcugaaaaagagaaaaucauuuuuuccagugguuugccucugggcauagcaacuacacugcagagcagacccaccuccaggaguagugagccaacaaaacaaacaccaugggguuuugcuacaucuuggcauuuuugucucacuuuguuguuguuaccuuugauuuuguuuuuaguguuuuggaaagagagaacaaaguuggguggggaaggucugggaggaaguuggggagaggaaacauuuuauaucuccugccuaccugugccucuugcuagucuucugucuguuucuuuucuucaugccaccagagacucaggaccccuuucuaucuuuauuuuguuugcaccaagaguggcaaagcugcauuuauucuuucuggcucauuuugaaacauaaagccccugaagcuauugguacuuugaggcagaucuaucaaacuacagucauuccuuuauugcaaaaauagcacuugagcauguuuguuuuguuuaaacuaguguucuugacuaauaagccuuuaguuacucugacauuguuaugaacuagguuuuucuuguagacaggauuaugaaugaaaauuuuuagaauagccaugcuauuccagcaaccagaauuuuuuuaagaaauucuguuuuugauguagagauuuguuuuagauugggcauggcuaacuugaggacuuugaaaaucaugcccaugucuucacuauuggauggcucagauuggcuucucauuaaagaagguaaaauacaugaccuugaaaaggcucuuguucucuccgucuuguagaagcccauucucuccccuagaacacagcuaccauauuucagaaggcugggaaugauacuuggacaggaggagaucaaauaccauuuuaaagaagugguggugguguuucuggaacaaauacagaaugugaaauuaaaucuggaaguguacuuccaauugauacaauggaaguuggacacuuuguugcauugggagguaggggaucaagaguuuaaaaauauuuugaaaaaaaaacacuuuauuaauauuuuuaaaagaauauuuugggcucccuuuuuugaugauggcacuuuauaaaauaagcauaauuuuauaauauaaaauuuuaauauuaugaacucaggaccuuccagagguccugaguucaguucccagcaaccacaugauggcucacaaccaucuauaauugggucugaugcccccuucuggugugucagagacaggguguucauauauauaaaacaaauaauuaaaaaaaaagcaucugacacaucugucauccguccugugguucacugugcuggacuuguuccugauggcuuuaaguccuaccacuggaaggacuuuguauuucuguagggaauugcuuccuauacucauaguucacugaauuuuuucuugcuuaaaggagucuucuuauuugaauacugucucccauuuauucuucgucuuguuccuuauaaccuuuaacaacauuauaauuauuuuuuaaaauauaagccucuugaaguagccucuuguuuuguuuuucuguguaguagagcagcaccuggcacauuguaagugcucuauugauauuuguuaaaccagucaaagaaaugaacaauauuugaaauggaucuuuaauauagaauagauugauccccaaugaaguuaaaaucauccucaaacccaaguuccuuauugagacauuuggcucuauugggacaagaaaugaauuucugauuuccugcuuaagacuagccuaugaaggaauguucauaaaaccuaggaaauaaauuuuaaaaauuagcaagaguucugguucacacccccuacuaucucuucccucucuccuuugucuuucuucccuacuucuuucugucccaugugugugugugugugugugugugugugugugugugugugucugucugucugucugucugucugucugucugucucuugucuaguauaggcaugggguuaucuuggcuacagauuggagugucccuggaaaggaagauaauugaaaaaaacaaauuuugucucucucucucccaugaccauuguggucuugagugcccuuugagugguuugguuucaaaagaaacuugggacaaauggcugucugugguaucuauuagcauaccaaaaggggugcuggccuccuggcuguucuccgcacuucucacccugccccacucuaggccucagcucccagggcuucccuucccucagcuucccauccccuuacagccacugcucaggcugucuguucuuuuggucuccuuugccugcacucuuggccuuccucucuccucuucucguggccaagucuuagucuguugaccauguuuauucuacuaaucuuucggcucuggacucuuccagauuugucugccuguauucucccuuacauauucuacuuuaccauaccuuggaguggucaugccauucauuuauauauccucugccucuaaaauuccucauuccuagaaccccuaaccuggacagauucccuucucuacugaacugcacccaguuacaauuaaaggagugggagugaauugcuguccuuaauguugugauggaugaaaugcagcagguagaaugcugcgggagggagggagcaccucagccuugcuuccccugcaaccuaauauggagaagguuuauuggcagaaagggaaggugaccuggaaaaggaguggaggcagagaaaggaguuguuuguugaaagugauuagcugugguuuugugguucuuggggcucucuucucuaggauccuaccuagccugcaacgagcuaaaugaagcagucauagacuuuagaguuagauugguuuuucuuguuauauuuaauacggagaggguaacuuauauuccuaaaauacagagacaaguauauagaaguaccuaagaagucaaagacaacaaaaacuauauuacagaaaauauuuaggcaaaggcagauauaaaguccggaagguuagcaaugugaaauaaguugguuugaaaagggcccaaauggaaauauuagaugggggaaaucacaauuaaauaaaaaaauacagugaaugaaauugggaucacuuaacaucaagaagaaauuggugggcuggagagauggcucagugguuaagagcacugacugcucuuccaaaggcccugaguucaaaucccagcaaccacaugguggcucacaaccaucugucaugugauucaaugccgucuucuggugugucugaagagagcaacaguauacucucauaaaauaaauaaaucuccuuuuuuuaaaaaaaggaagaaauuggugagguuauuugggaaucuucuauuggaagaaaagaagcauuaaagaaaauuuagaaaugaguggaagacuaaaaaaaguauuuuuuuuuucucuaagaucagaaauagggcagugacccuacugaaaccucuuauuaauuuaucuucuugcuguuucagaaaaaagccaaaggacaggagcuguuugaccaaaucauguaucaccuggacuugauugaaagugacuauuuugguuugagauucauggauucagcccaaguagccgugaguaucuuuuggaaguucgauuaugacugcagaaguggcaaauuucagaucauggacuaagugcuuaaaagcuaaaauacacucaaugguuucuuuauuuugugucauuuccuauagccugaaacauaaucuuuaucuuauuucacuuguuguugguuaaaauauggucuugcucugcagccugggcugggcuagagcuggcacucuuaucuuaccuacaccuuaggauuauaguuggguaccacuauacuuuguuauuccuuucuuuacagucaccuaaaauaccuuuuuacaaacaaaucugucccuaaucugaauuaugaaagcgacauuuuuaaagcugggguuuggaaaucuaucuaggguaucauaaaccacuguguaacagaaaggaugguaauacuggaguuuuaugugcucuuagacacucaauguuaauuucucgcuuauaaagucagcaggcaaucaucucuuaagguuucuuucagaucuaugauucuuggucuguaaaaacuuuuuaugcuuuucagaugagcgaacagaguauguaacagaguaggaaguuggaaacuauucaaacugaguacuacacugugauuucacugaggugugcuugaaagaaauagaugguaggguugagagggauuaguaguuauccuuaaaauugacuaucaaaauuguuaaguaagcuggguguuguggcgcacgccuuuaaucccagcagaggcagguggauuucugaguucgaggccagccugcucuacaaagugagguccagaacagccagggcuacacagagaaacccugucuugaaacagcccccccccccccaauaaaaaaauuguuaaguaauaguugcaauauuuauucuuuaauaauuggaauuggaucuuuugcaagcagauuauuuuuuguuucagaaaguuauuuaaauauuauauuauuuuuacuuugggggcauguuuuucuacacauaugucugaaaucagaagauggcaucugauccucuggaacuggaguuacagaugguugugagucaccauguaagugcugggaaucaaacccugguccuccacaggaguauccagugcucuuaacucucuagcucuuguuucagaaaguuuuauguagauaaaauuguauaggauuauuuagaguaagauagacugaagucagaagaguuacuaguggcuggagacgugcucagcaguuaagagcacuggcuggcugcucuucaguggacccauguucaguuccugguccccacaugccuauaacuccagucccagagaguuuaacaucuucuucugaccucucugagcacugcacacacuugguuuacggacauacauucaggcaaacaccaauacauaaaaauaaguaaaaucucaaaaaaaaacccaaguuauuguagcacuuugguagaagugaugauaauaauaauaauuggcagagaaagcagaaagaauaaggacauuaagauauuaagcucacuggcauacacaugagcacauacauauaugcauauaugcaccccagaacacugagacuaugggaaaucucuucauauauacauauauccagauuuuccaaaaaacagaaaaauuaugcuuaacucuagauaaauacuuuaaagcuuaaauuguaacucauuugauuuuauagcauaguaaguauaagaaccccuuucaguuacuugcugcauagccacauuuagucccaggauaaaauaaauggguauugagugaacaguucaucuuauuacuauauacaauaagcuugauagaucaagggcaguuuuuuugguuuuuugguuugguuugguuugguuuuuguuuuuugggguuuuuuuuuuuuuuuuuuuuuuuuuuugcuaaagcauaauauaagccaaguuaccuaaugaccuugugauauauacuuuauugauauaccagaaucuaaagugggcagcaaaauauaaggauccaaaguauuaauguaauauaguuuagucuuaaucauguggcaucuaaaauuaauguaccacauuuuaauucaagcaguccaacauguguauggugccuacugaauuauggagucaucauggagauaaccaaaauuaauaaauagaugaauuaaauuuuauuuuucuguauguauguauagauaauaguuugauacuauuuuuuuaagacagcaaaagcaucucaccuuuuauuccuagcugacuuggaauucucuauguagaccagguuggccuugaauucagagagagcugucugccuuugccuccaauauaccaagauuaaaggcuuaauauaccuuauuaaaggcuuuauuucauucagucauuuuauaguugcauacacauaguugaaaaagaucucauauccacagaacagucauaagaaugguacaaauaccauuugaaggcuaggggguaagaugucccauuauccuuaaauucuuucauguaugcuuuuuguaaacaugcaugguuuaugguuuuauauaaccaucaaacccagcaauugagaaauccucaccaucuaaucuuuauuuuggcccaacagaguugucucuagaaugcccucgauagccaccaagguccacuucagaauccugcucugcuuaguugucgugucucuuuaguugccuuuaaucugaggcauugugguucugcaguguuuuuauuuuuaugacuuugaaauuuuugaagauagaagcugguuacuuuguuugcugucccuuuguggauuuguuguuaccugcugaaguagguucauuuuagaagguaauccuguguucuguguuccauuaaaaaaaaaaaaaaaaagcauguaucuauugaauauaucauucugagagaucucuaauugcuuccucagcagucauagcugggcgcugaaguuaaugacagagucuuuguuguucaucacaugauaagcaguccuggaaccugugacccacugccacugucucuuaucacaaaagauaaugcuacuuguagucuggaaaaagauaaaaaaaauagaacaauuucuguuaaauguguguugcuuccacacaccuaaaaaauuauggaaguauaagcaaaccugaugagucacuccauugcuacuaugcaaaugcugacuauauuuaagccgcugaauuauuccuggacuauuuuauuggaguggaaguagggcuuaugaacuguaguauccacuuaucuuacuuuguguagcacggucauuaacuccuuugaaguugucuccucuggagauacagcuugacaaggaagacuacagagcaaagacaugugugaggaaaacaguuuuagcuaggagaaccauaguguuuuuaugucaaaaugaggccacuuugaaaaaucaagguacauuuuucauacuauaaaauuugccgcuuuagauuuuaccauuuguuuuuagcacauucagaauugugcagcuauuaucacugauuucaaaacacuccauuauuccuuaaagaaaaccuggauauauuaccacuugauucuuauuaacccucucuaacacuauacuuuaacaagcacuauauuucuguccauauugaucuacuuauuuugaaauuuuuacauaaaugaucaucuaguuucaaccuuucuugucagaguacuuucaaaguuaauguuuguuguacauacauuuuuucaguauuugauuccuuccuguggcugaauaacuuaugacuauaccugcuuauucaguaauugaugugcauuuuguuugguucgauuugacugcuauggaugcugcccugaccaucaaauuucaguucucgagguuaugcaucgaacagugcguagaaagggaauggauuaaucugguagcugaugaaauuuuuguagcaugcuccacuguccuauagcagaggcaucauuuuacauccccacuaacaauacaugagauugcagugcuacauagugguucacuggcucacuuucccacaacaagguagaaggggcccccucccccugcuuugguaauagcuauuuuggcugggcugagacaggaucucaauuguagcucugauuugucuuuuccuaaugagccuaaggagguugacuuuucaauuacuuacuggccagcuguacuuuucauuugaaaagugcauuuucauuucauuugcccauuuacugugaagucuguguucuuagguguuuugcucuuuuaugauacugauccucuuggagaugaauagcuggcaagauuuccaccauucauugaauagacugucucucaacucuggugauuguuucuuuugcauuacaggaacuuuuaauuuuacaguuuuuggcuuugggguauguguguguauauagucauacacaugacuuggagcauguuuagaguucaaaggacaauuuagggaguuggcuuuuaucuuccaccuugucagguggcaucucuuuuguuucugccacugcagacauacuuaggacuaguugacuuuugaguuuccagccgacucucuuuccucccacacccaccacccaauuccccauagaagugcuaguacuacagaugcacaccccugcauuguguuuuguggguuguuugguuuugguuuuuuaaucugggauacaggauuggaaccgcagaucaucagauuuguauagcaagcgcuucucuacccacugagcccucuaucuccccaggcccaagagugaucuuuaacauguuguuagauucuaaguugcaaguauggagagguuuugcagccauguucaucaaggaacucuuccauggguuuuugguucuuuugucuguugaauccuucccugguuuuauuaccauggcaaugcuggcuuuagaguagagagcugggaagcauccccccuucuauuauguguaguacucuagagaacauugauuugguuacuuuuagagguagaguaagcagugagugugucuggcccuggccuuuguccuaguugggaacuuuuauuaccauaucuuaaauaugguuuuuaagauuuauuuguauuugcuaucuguaauuguuuuucuugaauauagguuuguguacuauaugugugcauugccuacaaaggccaggaggcauuagauccuuuguaacuaauuauagagagaucuuggccgucauggcagugcuggcaauuaaauaugggaccucuggaagaguacuucgugcucuuaaccugagccaucucuccagccuuucaguauuacucuuguccagugucuuggcuuaauuuugguaggucauuugucuaggaguuuauucuuuuuuuuuucuuuaacuuauaaguuuucauaauggucccucuuaaucauguggacgucuguacuacuucuuguaaucugucucagguauuauaaauauaaccuguaauuaguaguaauaguaguuuacccugugguucaccaauacuguuuauccuuuuaaagagccaucucuuuguuauguugguauuuuauauugcucuuuugauuacuguuucauuaaucucagcucuuauugaguuuagguuuggcuuucuuguucuugguuuuuuuuuuuaagaccuugagguguaccauuaggucauugaucucucugguuucuuaauguuuaaaagauuuuauuuucaauuuauguacaugagugccugcauaaugccuggggcuccucugguuaccuucuggagguucugggaacugaagaacugugaaugagcaggaaccugaccuaacaccugaaccaugucucuagcuccaguguugcugugaugaauuaccuuagaaaagcaccuuauagaaaauaaguauccucuccuggccuccguagguacaagcaugcauguggugcacauccauauaugcaagacaaaaaugcaaaaggaauaagcguauuggguuuuuuaaagaugauuuacauacuuaggucaccuacauuucagccaugaauuugacauuuuacaaauuuuaccaaagauaccuugaaaauauuuuguaauggcuggucuaagucuuuugaaaugauuuaugacaaacuguuaauuccaaggaaagcaguuacuuaggaaguguuucuuagcaucuagacuaaacagaaauguuuuuauuugauuacaaacccaguuuucuuuguguguguguugauguuaggucauucuuugguuaguuaaaagccuguuauguuugugauuauauauuauugucuuuuaauauacaugaguaaguuguucuuccauaaccagcugcuuagagugaaaggaaauacaguuucuagauuauuuuuaacaucuuuaguuuuuaguaucaacuaaacuuuaaaaauaggaagucggagggaauucuuuucuuuuuaagguauaaacuguuucaguuuuacacccaagaaucuguaucugcaggcuuuccaucuuuaucuucuuagcaauuuaaacauaacucuuagagccccugguucuagggaaguacaucagcgccugacucugagcucugaacuuuccagucccuggccauggaaugcggaggagaugaaagaaaacagacuugagaauccgcaaacaugagcucagaccuuccucauaagaauggugaccaggacucccccagcuccuaaguugcucuuuaaauguguuuguuugacuugucuuacuggagaggagcuacaggaauccauagcgaacacugaaauuacuguuuuguauacaucuccaauccuuucuuuacuggcauaauuuuguauuuaaugguagggcauugguaagaguagaaaaauguaaucaugaaaauagucuuuugguuuauguuuguuuuuaauacuuuguguucaagggugugccuacaugugauacacauagggaagucaggggcagaagagagcauucauugacucucuagagcuggaguuaagaggugagccaccugacauggguucugggaacugaacucagggucucugaaagagaagcaagugcucacaacugcugagauaacugcauauaaauacuuuuuguuggcuggagagauggcucagcuguuaauagcucugacugcucuuccagagguccggaguucaguucccagcaaccacaugguaccucacaaccaucuguaaaggaaucugaggcccucuucuggugugucugaagagagcaacaguguacucacauagauaaaucuuuuuuaaaaauacuuuuugcaguuuuauuuuucuuugguguaugaccugcguagaugucugugcaccacauguucacagugccuuuaaaggccagaagagaaagucauauccucuaaaacuggaauugcauaaggcugugagccacuuuauggaugcuugggaguugaauccuggucuuuuggaagagcagcaguuagugcucuuaaccacagagccaucucuccagccccucaccaguaaucucauuuacuacuuuauuguuagcucaauguaaauguguauacauuuguacauuuugauaaaagaauuuguaauacuuuacaguauguccuuuagaauacagcuguguggccaggcaugguggcacauaucuuuaaucucagaaggaaaaggcagaaguucaaggccagccuggucuacagaauuccaggacauccagggcuacauagacccagggguucaggcaucccucccuauaugcccugaaaauacaaguaucuguuuuagaucuuuuaacuauuugcuuucauuuuuuaauugcuauauuaugcuucugucauauuuaaauguuuuguccagucuguuauuagauuguucucuuggauuuuucuuauggaauuccuugcaggaaaaucuuuguacauuuauuucugaauuagacaugauguguccccccccccauuuauuuauuuuuauguaugugaguacacuguagcugucuucagacacaccagaaaaggacaacagaucccuuuucagaugguugugagccaccaugugauugcugggaauugaacucaggaccucuggaagggcaaucaguguucuuaaccucugagccaucucuccagcccuauacaugaguucuugaggcauuagcugcugucuauuaacaaagauuccuaccuggagagaugugcucauuugugcaugcacagcagggcucccugagacaauacccacaugaccagccaugaauaggguuuuggguuuguuuuuuguugccaccccccccccccaacuacaguaagaggaauaagacuugaacaagguccaaacauuuuuggagggccuugagugguucagagagcaaacauucuagacacagaaacuguuuuuauuucaugcucaggguguaauagcauuaggcuaucccaagucuaaaauaauugaauauuggguucugggccaaaaugaaagcacuauuugcuguuccggguugaagucauucucaauaaaucaaacuuuucugccugucaguaagauuuguacaauugaauauuuuccaugcugaaagauguuuagaagugggcccuccaaaaauuuguucaaugaaaaauggcuaaguagcauacacaacuugaaauccagaagaaacauuaacauaggacugucaugugacucagcugcaggacucuugucuaggauguuugaugcccuggguucaaucucccccagaaccaaggcagaaagcauuguccaguugcugccuaaaauguuuacaagagcaucuuauuaaaggguagaagugcacacugcuggaaacuguuuuguuuccguacuuuggaauagaaaagagagaagaagccagacagauaauuaguaaggagaguccugguaacagugaggccuuauuuauucuuuguuuaacaggauuguugaaacuguauccuuggcucuguggacuaguuagcacaggagcccucccuucuuuuggugcuuggaauugaaagcaugcuaaggagagcucacccuuguguaugguaguucugccuguuguuguaagaggccaaugggaggggucuguaaugagaacugagcuggcagugcuuugucagugcucgcauuagggauugacucaggcuuguuuauguugugaacauuucccagugaagaggcuauagaaauuaaaaggcugauaacuguugaaagcagaacucugcuucucaaguagaaacauuuuuauuugugaagcaggacaaugccugcuucauuugauagacgucauaauuuugagggaagcccuucuggcucuuuaaaugagugcuaaauaguuggucaguuuugcaguguucagaaagcaguugagaaaacagaaaaucaguuggcagcucaguguuagggucugcuugugaaucuuauaaaggaauggccaggccuugauauuuuucuaaauuugauuuauguacaugcuuguagugauagcugaguuguagcuacagccuucuuuucauuaacaaucucaagagagcuguuuauuugggaacuggguauaaucuaaacuguaagagccaccuuuuucaaauucagucccuuugugaaauauugcuuugugguugucaacaaaguugcaguaagcaauagcucuucauuaaauguuaaaguccuaccaguccgauaaguacucaacuuuuguuuuucuguuuacagcauugguuggaugguacaaaaagcaucaaaaagcaaguaaaaaguaaguauugggaaaucauuugaaaauagugcaaaugaaacaucagagacacugauuuuuaguaauaaggacauuucaaaaauuauguuuccuaugcguguuuuuacuaucugcuuuuugggaggaaaugucagccaagacucaaguuguagccuaggcuggccccaugcucagaagccuucucuagccuccucaguauugcuaggaauuuugguguauucugcugugccuugcuuucuaaacuuucauuguaauauacacccacucagugccugguuuauauggguuuaaccuuaaccuagguuaagaggcuuauaauucgaguuuauagaagaaacauuugcagcuuacaaauuagauugaauuuuuaugaaauauuuaacuugucuuuagguaauuacuuguguugaaguuuuuugauugauugguuguuuuggggggguuuuugcuguugguuuuugcauuuguuuuuuuuuuuguuuuuguuuuuguuuuuguuuuccaagacaggguuucucuguagcccugacugucucaaccagacucgccucaaaaauagagauccaucugccucugccucuaccucucuaccucugaaugcugggauuaaagguguguguuaccaccacccaguuguguugaaauguuuuggguuuuauauuuuuaugggggcggggguauuguuuauuuguuuguuuguugaggauucuaccuggcucuaggaaacauuucgagaccuuaaggcuauaauaauuuucucccuuugucuuuccggagacucaugauacagaucaggcauagugggcuacuaagagauacuugguagauuuacuaucuccucugacuuuguguagucagcaaacaccaaagaccuguuagucuuuuuaaaaguuuuacuuaaauuuauuuuuauuagauauaugagugcccugucugcaugcauacaugugaaccaugugugugccuagugcccuggcuguucagaagauuccuggaaacaggaguuauggaugauugugaaccaaauaggugcuagcaaucaaagccagguucuuugcaagagcaacaacugcucuuaagcagugagccaucgcuucagccuuuacuuguauuucuuuuuaaagaaaauaaugaaacagugcugggaagauggcucggcagugaagaacacaaucuggucuugaagacccacauucaguuccccacaccugcagcaguggcucacacaacugcuucuaacucccaacuccaggggaucuagcauuuucuucuguacucuguggauaccugcaugagcuaccuuaccuggcuagaguccagcacaugcacacagcccccccccugccccccacacacaauuaaaaguaagucuuaagaauaauguauuauaauauauguauaauaauguauuauaauaauucauauaaaauguaguuaaguuggcagaacuugagaaaauaccagugucugguucccacagucuggcuuaucccugcagugucgaauuucaggguagguuaacugccuuuuugaaauacaaacuuuauaaaauauaaacuuuguaaaauauuggggcagagcugcugggaacauagcaguuagugaguccacuggacuggauuugaaagugugggaugcuuggccuugagcuauuucauguuggcgauacucagugcucacuagaaggacagucagccgguuuuccaggcuguuugauuguuccacuaagauggcccugaaguguuagaauuaauguuugacagacgaaugagauauugcugugcugugcuugguauacuuuaaaacuuuuguugucaaauguuagcuuauguuguacuuugaaguagugguacaauaaucuguucuuuccuuuuauacuuaguaacuuucagcaaacugucugacugaagauuacuaguaaauuaauaaaaauuaaagcucuuuucuuuuuuuaauggcaguugguucacccuauugucuucaucuucgaguuaaguuuuauuccucggaaccaaauaaucuucgugaggagcuaacccgguaagacagaggugugucaggaguguucagaggugugucaggagugcuaagaccuugagaagaccgauuuuaguauucucuaaccuuaucaauaaaagugucagacgaauuuuaauucuacaacaagauguuuuaagauguugcauuccagccacauagcucaugccuauaaucccaacacucaggaaacuagggcaggaggauuacugugaauucaaggcuaaucugagucccaaagugaauuucaggcuaguccaagcuacagugugagaccuugucuuaaaauauuaaaaauaauuaaaguguuugauucuuuuauuuguuguaaaacaugaagugcugauuuucaugcauuuguuggggguggccagugagucaguugauaagguuuuaaacagaauugauaacguguuaacaauuucauucuuagguuuauugacauucacuauaaucugucuucuguuaguauguaugccuuucuuuauuuuacacugccucuuuauugcauauguauuccuucuuggugaagaagcugaguuguuaagaauaccuuuugagggauuugcuuuuguauucccugcuguuauccuuacagcccucauauagaagguauaugaggauuaucagguccacuuccccgacauccuucuggcauuuucucugaaguugcucugcucuacucagcccucuguccugacucuuacuucagacuugcuuacucccucccuccuuuuuccuguuuuguuuuuccccuuacacauuuuucugcagugaaauucuguaauuaaggauguucucuuagccaggcaguaguggcucaugccuuuaaucccagcacccagaaggcagaggcaagcagaucucugaguuggaggccagucuggucuacagcgugagcuccaggauagccagggcuacacagagacccugacuugcaaaaccaaaccaaaauagaacauuuucccaggguauguuugugcacacccuuaaucuuagcagcugggggacagaggcaggaagaucucuugaguuccuagccauuuagggcugcauagcaaaauccuguuugaaaaaaagaaaaguauucucaaguuaaaauuauagaauuuuuuuuuccuagagugaauuguucuauuuagcuaauuugugccuuuuauuuuucuuagguauuuauuuguucuucagcuaaaacaagauauucucagugggaagugaguauuaaauuauuuaguacauaacugcaaaauucuugaguaguagaaaaauaauuuagaaaauaaauucaaauucaguucaggguuggagagaugaugacucagcaagcacagagucugcguuucaucccaucugcucauaugaaacccaggagcagugugggcaucuguggccccagugcuaagggcucacuggcuggccagcacuguagcuaaaacagugagcucgaaguccagugccaagcacugucuccagcagaguuauguggaaagaaacaaaggaagauacuugauauggcccuuuggucuccacauacacacacauggucaagugcacugcacacaagugaacacacauaaguucaaaguuguguaaaaacaaaugcuugaggugcuauucagcuuaaaauugagauuauaaauugacggaaaaauuuauauuuugaucucagguuagagugucccuuugauacagcaguucaguuggcagcuuauaaucugcaagguacgugauucuugugcuugauuaaggcugaaacauaauucuuuugugugauacuuguuuaagaaaaaaaauucagugacaaccuagggaaacuacagcacuguuucuaugugaaucuaccagcgucgggcuuuugaauucugcuugguuuuaaaggacuucuuuuaaaaguuguugucuucaggccuuucccucucaauucuuugcuauuuuuauuuuuucuuccuuuuuuuuaaaaguuauuuugcauuaaggguauagguauucugucugcaauuaugucuguacaccaugugugugccugguguccauggauggcagaugagggcauugauccccuagaacuagaguuacagacaguuguaaacugccauguagguguugaaaaucaagcccagguucucaagagagcagccacugcuucucacugaggagccccugcuccuuauccgucuguaguacaaugaaacaguuggcagccugccuccugguaauugaauagacguuaauauagaacccuagguugauugcuuuuccauaaguaacagaagaguaaacuagcaugguugaucaugguugcuacaugauccuuucuuuagucuucuuaaaaaugaguucauggagacucaggacauacuuagacaagauggggccaguacauauuuuaaagcuccaauuggucacucuaaaguauuccuuaguaaaugagguuaguggaaaacuuagccaaauguuuaaauugcuucuugcuaaacuuggggauuuucucuuaaaaguugacauuuuaaaggaaaacuauaauuugagucuaggaaacaguucucguguguguguguguguguguguguguguguguguguguguguguguauaaaaugaaugauauuguaauuagaguuaaugaugcucacaacuauguuuuugccuuaguaguuguacauucucaucauucuaagaucaguaguguuugucacuguguagauuauaaaacuacauuuguguguuuuaucagaccuaauguuuucacuuauuuuggauaucuauuauuaaagcauauuuuccuggugauaagaauuuuuaucuaauuuggcuuuuuucauuauugaaaucugucuccaaauuaaaacgugcuuucuaucuccauaaugaaggggagacauaaauuuaaaagcgguacuugugucuuuuugccccccuugacagcuaaaguacaugcauacaaauaagguuuaugugggauugauagaucacuuagugaggguucuuaaucuguggguagaaagauaccaguauguggccccauaucaauaucugccaaagucuccuagaauuuuggagcugagacaggcagauccaagaaccugauggccauccaaacuggacuuagaccauaagccagaaagcaguaggaggaaacaccugacauccuguuguggacucugcaugcacagacguagguuugugucuucaaacacuccaguguauauaccuccaguguauauaccaguguauauacuccaguguauauaccucacagagaauuauagaaaaggauuacagcaugcaucuugggugguggguuuuuuuguuuugauagcaggugacugucuuuuuuuuuuuaauuuauuuuuuuuaauuagguauucaggugauugucuuuuaagaauuaagguugggcuggagagaugguucagugguuaaauuucuagcaaccacaugguagcucacaaccaucuacccuaggaccugaugcccucuucuggcauguagguauacaugcagauagagcaauuauauacauuaaauaaguaaauaaaucuuuaaaacaugaauuaaaagucaaaguuuuuucucuauggaaauacagaaauuuauuuucaaaagcuaagcauuaauauaugucaauauauuaauaauaaauuagaaauguauauuuaaaagucaccaacaacaaaugugauuuauauugucuuacuuuguuauugccaugacaaaguaccaugaccaaagcaucuuaaaaaagagagcauuuaauuuggcacucaguuccagauguaagagucuaugaccauuauagcagggagcaugccaccaggcaaguaagcaugucacuaacaggaacugagugcacaucugcaaguaugaggcagagagagagcuaacugggaguggcauggaaguuuuagaccuaaggcgguucauuaacacacuuucuccaacaaguugccucugaaucucucccaaacaguucuaccagcuuuggaccaagcauuccugagccuguagggguucgucucaaaccacacugcauacguguacagaccaauucaagucuaaauuagauuuauuagagcggaauggucuaggcauuaugaauagcugguagcuuaagaaggagcuuuacugaucuuaaucuuuguuuacaaaauguuuuuuaaagcauuuucuuggugucacuaacaugacauaacuguguuaacuuguauuuguagcugaacuuggcgacuaugaucuugcugaacauaguccugaacuggucucugaguucagguuugugcccauccagacugaagagauggaacuggcuauuuuugagaaauggaaggaauacagguagcucguuauuucaucacauuuuaaauaucaccaacaucauuguucauuuuuuuuccgcucuuguuuaugaucuuauaauuacuauauuuaaauuuucagaggucagacaccagcacaagcagaaaccaauuaccugaauaaagccaaauggcuagaaauguaugguguugauaugcacguggucaagguaagccuuguguugugguaccuguuuuaaaauuuuauucuggagcuagcaggaugguucagcagauaugagcaagcaugugcuguucuuguagaaguccugaguucaguucucagcaccuguguugagauccacauaaaugccuguacuuccagcuccaggggaucugacaccucucuucuggacucaguagacacuuguacccaauguguauauacauauaauuuaacaauaacaaaauuaaaucauuuuuuaaaaauccauuuuaggauuaaaggcauagaaugugaaugcuacgguauuugggcaggcauagaguuucuauagaauaccucugaguauuuuggauguguaguaaggaaaaugguugaaauuagauaucgagagacuagaaucaccugggauugguagcacaaaccuuuaaucugggcauucaggaggcagaggcaaauggauuucuuuugaguucaaggccagccuguguagagacccuaacuuacaaaaacaaacaucagaacaaaacaaaagacuggagucuaaagaaagauugaucaugaaacaagagaaaacuaaaguucccagaauuaucuaaaauccuuguauaaaugugauuuuuacauugagaaaaaaaauuagguuacuuuuuauuuuuauuauuugugauaccaccaaugcucacuauugaggagacuuuacuaaaaaguaaagauugacacuuuauaaccugaaacggauuauuugucagagacaucuagauuauaauuuuagccuguauauaauuauauuuuauuuagugugaaaaaagauccacuuguaugaaaauaugaaaccugcuucauguguacaaacacuuuauuuucucuccuuacauuaggcuagagauggcaaugacuauaguuugggacugacuccaacaggaguccuuguuuuugaaggagagaccaaaauuggcuuguuuuucugguaagcagugucuuguuuuuaaugagucaauguaucuauaucauuagugaauaaaaagguguggaaacgaaugcugagagguuugcaagugaaggaggcuacuguuuccuguucuucccuuacucaucuguaaccucucuccccagaggcaaacuuaaguacucuaggucuguagcccauuaguuucaacgugugucagugcaugucuuaguauucuuaccucguguuguauacuuacgacauguuucuuacacgauucccgcccuccccccaccugcccuccuguggcucugucauucuuaguguuuuccauaggcucucuucccuucaugggaagggaggagaugggagugcuucuguuccuacuuuucaagcuuggcuccuccuuuuucccaauuuccaucuuccauacuuagaguuauuguacagauuucauagcccuacagcauagaauugggaagcuguuuacauuacuacauuuuuguuagaacuaagucagaguuuuggcauauguuauagauaagagcuaaaguuuuguaauaugccaagacuguugacuucaagacuuuccaccuaaacucaaauucauuuccagguguuaguggguaaaaacaguauuggaaaucauaaucagugagaguuucuuauaugcccuuuaaaaauacauauaaugacuuuuugcuauaacuaauuccuguguuguuuaaucuugaaacauuuuaccuaggguuacagaauuuauuaugccacauuagggguaugcaaaauacacuauauuucuuauuuccuuuauaauuuuaauaucugauagaugggagcaucauuuuguuaguugguugcuuuugaaauauguguuugccuuuccuuuagagacuuugacaggcggggcuggcuguguuuuccuuaccaguguugagaauuaagaugaagaaacguacuugauggagaagauuuccccuaaucuguugaucuuauauuauuacaggcccaagauaaccagauuggauuuuaagaagaauaaguuaacucuagugguuguggaagaugaugaucagguaggaacuuacuguauuacuugcuuaacaguuaugugguaaacagguggugguguaccucauuguauggagagccauaaaacaaaagcuuagcguugcauauaccuugaaguaaaauuccccauucaguucauuuuaugccacuaagcuuaaagauaauauaaaugcauguuuguuuuuguaguguacagugguuacauuuagaugacuaugcuuuuauuccuaaugaaauuuuuaagaaaauaagccaguugccuuuuaucccaauacucuguaggcuuguacucuuguacucuguacaaguggaucucugaguucaaagccagccugcucuacauaaugaauuucaggccauuuaauccuggccaguagugagacccugucucaaauaaacaaaagagauccaccuggugguauucuuuacgauaaaaugugauuuuauauuuuuguuaauuuucuuuuuuuacauaauuucagugugcucccauuuaaaaaugauauccucuuagcuuuuaucauauucggguauguuuucauguuuccauucagcuuauaagugaccuuuuguuuuuacuucuauaagaagugguaagcagaggcaacaguuauguuuuaacaauuuucugaaguuuggaagauaaaagauuuuagaaucauaguauuuuaaguuucacuucuuuuaauuguuaaagaccaggugaaaagucucuuguauugugauaagagccuacauuucucgguaguuaugaaggauauaugugaccugauuaaguauacuaacugcccaaaagagucugacuguauucugucuuucauacagacaggucacuugugauagaacgucucugaauauuugacauuaguaagauguggaauugacaugaaagaacuuuauaguacaguagugaguguuugugguaguuguauaucugggucuuuuaaaagagauuuuguauuugagaauuuccuaccugcauaugauauuuugucauccgguuaccccacacugccuccccgaugguccuuucccuuccccauuuuuuuauuugcuuuuuguuuuacaguacuucacacaggaaaaaguggguacauuucaaguuguugugucuuuuguugggggguuguuuuaauuuuggauaauuucauuuuuucccucuuguuuacauuucucuagauguguuucauaaaaccagggacaagucacaagaaaugcaaaguuuccaaguucuguuuuguuuguuuguaaugguauuuuagauuuguauuuuguuuaguuccuagaaauuuacagagcuaccuuuuuuaucuuggugaaguuugauuuuaaacuuucuuaccaaaaaucauacacuguaggacagugagauguucacuaugugaaggcgcuucuucucaagccuaaugacaugcgcuugauccuugggccauacaugacugaagacagaaaccaacacugauuguccucugaccaccgugcaugugucacguacacauguacauacacacaaacaacacaggcuuuuuuuuuuuuuuuuuguccuggcacuaacucuguagaccaggcuagccuccaacuuaaagaucugccugccucugccucuuacaauaucuccaucucaugcaauguuccccgagcuuuagacuguagggguuauaguaauugggggucuagcacccauggucauaguggguuuucaagguucccuggccucaccauccauaaguaguuggcugaguuuacaggacucagcauggauucccucuaguaagcagaccuuaaguucaaugaagugccugucgggucaugccaagauguaagugccacuauuguaccuuuaggaugguuuugcuaugcuggucauuguugugacuuguagacauuucaaguagccagcuagaccuacuucuuugcuuucucacuuggcagcuuuuacagcuccuucuaauacugagguagucaucaaggaggagccuuacaggucagauccggauugaguccuccaauccuggguccagaguauguugugucuuuagcaguacaaaaguaccuucuuuuccuggaaggcacuaaauauaauggcaauagccuauguuauuuugaggaggagagucucuugguuuuuccuaacuaacaacuuaaaaguagguuuuaaguaucuggcacuguuuucuuuguuagauaguaauugguuuuggagugggaaacauugucaccguaaguggccugagagagagagagagagauugauuuuaaauaagcauagaauaauuccugguagcuuuuucugacauccuugguguuauuugucccuccuccuugccucucuccucuuuauagcaacaguguccuacaguuccccuuuuuaaggcuccagccccccccccccauggucccuuuuuacucccgguuuccguaguuacuucaggcuguauaaucuaaagcuguaaagaucuaaagauuuguugcaaucugcaaauaugagaggacauggagcaugucuuucugggucuggauuacucaguauacuauuuaccuacaaguuauauuuuauauuucuuuacagcugagcuaguaucuaugugauacaaugugaaguccuuugaacaugggucaaaaaugcuguagcucauucauauauaacagucuuugucuuaguuuuuuuguucuguuuuuagaauuuuccaaacugguuuccagggugagugcaccagucugcauucuaccaacagugaauuggugauuccuguccucaaguccucaccaucguuuauugcuggguguuuucaccuuugccauccuuugcauuucccagguugcuaaagauguugaauacuuuuugagaugcuucuuagccauuuuaauuucuucuuuugagaccucuguuaagaucuuuaaucuacuuuuuaauuggguuguuuguucuuuuucuuuuuguuuuuuguuuguuuuuguuuuuuucuuacuguuuugaguucuuuauauauucugaauacuaauccucuguaguguguauagcuggaaaagaugucucccacuuuuugggcuucuuguaauuguugcuuuuauuuucucuaauggagggaugagaugagagccauacccaagaugugcgaugcgaauacaguguuucuuucucucuucuaacuaucccuaggucuaagccuagaugcuucuagccuccauacaaucuaaucuuccaagaauacugacucaauccagcuucucucagcuuugugugaguugcucuacuuggcuucauacuaacuuugguaauauguucuaaucuucuggcuccuucucaguucaaauaugacugcuuccuucuacaaacuggcauuaccuucaucguuagggauuaaagguguguacuaaagauuuaucuucauucuagccagaucauuauauaauccagcaugucuacauucuggccagaccauauauaccuagaaggucuuuggaugugaucccuugccaaaguagccagguugcuggucuauuucuucuauacauaauuguaugcuuccuuugcuguagauaagccuuugaguuuuaugagauacuacuugucaguuguugacuuaauuacucagcaaaugggguccagucuagaaaguacuuucccacaccuuuaucuuacaggucgaugaggugcuuucuuccaacauucuuguggcuucgguuuucccuucuucccuugggauguccagcacugcugcacaccaaguagggaaggauggaguggagccagguuccauggucucugucuucccuuagagugucugggcccugaugcgcacuguauaggaaaggaugaagcaaauucugaaaugggugggucaccaggauccccguccuggagugaauuggggugggggcggaguguuacagcucucuuagaugauagucagugaaacagcuugugugcauauacuuuauuaggggaaucaagggauauauacauauggaccccuaagaguggguagggguucuuagguaaaguuucauuggcugagguuuaaaguucuugggauacuucauuugcauggagaagcauuccaggaaguugcaccugucacuucuccaaggacuacauggcauuccuuagguagaagauuagaaucgggcuccccagagcaggcagagaagaggaagcccugcuaaggaaaggagucuccauuuuugcacccaggaagaucuaucuggacaugauagaccuuaguagccagguacaacauaaucuugaauuccucauuuuccugccucauccuucugaaugcuggcauuccaagcauauuccaucacacucagcuacaaucaaaagagcucuuuuaaauuuauguaauguguauggguauuuugucugcauguguguucauauaccacauggaucccagugccuauggaaacuagaaggggguuauaggagaagacgaggucuccuggaacuaaaguuacacuguuacugagccaccauauuguugcugggaauugaacccaggucaucuggaauugcugcuaguguuuguaacuaauuagucaccucagugguuccugaagagguccugacugaaaauaguuuguuacuaacacuucccucuuugugugaguauagauguugucuuaguuuaaauuuuauugcuauugccaugaucacagcaacucuuaaaaggacaauauuuaauuggggcuggcuuacagcuucagagguuugguccacuguugucaaggugggaagcauggugguaauggaggcagacguggugcuggaggagaugagaguucuacaucuugaucuaaacacaaaagaagauuguggucauaagaccacaaagccuccccacagugacacacuucuucagacaaggccacaccuacucuaauaagaucaaaucuuguaauagugucacucucuaugggccaagcguucaaucauaugagucuauggggccauuccuacucaaaccacugcagauaugacuagucuguuaugaaaacauaagauauaauuauguguuuagguauauguggucauacuuuaauugauaaccugauaacccuaguucuuugucgcauuuuggaguuguuugguuuuuuuuuuggcuuucacucuguaguccuggauaccuuggaacucaggacucaggacucaaacuugugaucccucugcccuaucuucuggaugcugggauuccaggcauggaacaccacaucuagcuuuagcaagucuuacuagcuuuagcaugguuuauuaaagcacauacugguguuuugguugguugguuugguuugguuuuuaauauuuggugacagggucaggauguccuggaucucucucucucuagaccagggcuagccucuaacucugccugccucugccuccuuaguguugggauuaaagauguccaugccagcagcuuagcacauaauucuguuuguuuguaucaugggcuuuucauguguguuauauguacuuguucguauggaauuguguauggagguacacauguguguaaauguccauguggccagauacuggauguuauuacucaccaccuuaccuguuugcaucagggucucuacugagccuggugcucaccuaucugacaagucuagauggcuggucccccaucccaccaaaaaguugccaagaacaaaguagagguuuuauugcuuuuuaagguuuauuucauuuuuaauuauguguacaaggugugggugggugcuuaguguagaggaccuuggaaagugucagguguagagcuguuaugaguugucugauaagagugcugagaaccaaucguguccugagguagcggugccuacacuuaacuauuaagccaucucuccagcaccuuuauuguuuccuuuucugucuagcuggccuggaguuuacuaugcaugcaguguuggccuuggccugguggcauuccuucuguguccucgacuuauaggcauguaccacaugcccagcugccuuugguguugguuugauuguguuuccauuacagcaauagaagacauggcuaagugacuuaauaaacaucgcuucgucuuucagggcaaagaacaagagcauaccuuugucuuuagauuggaucacccuaaagccugcaaacacuuauggaaaugugcuguggagcaccaugccuucuuccgccuccgaggaccuguccaaaagaguucccaucgaucaggauucauucgacuaggaucccgauuuagauacagguucaguuccccaaguuuucacaucacucuuaacucuugauuuuacugggguagaaaagaagacacgagaaauaaaguauguugccaaagauauccacuggccaaaauuuuuaaagaaguauuguuauuguuaauaauuucuugacuagaugggaaaucaguuauauuauuguuauuuauauuaauaaauuuuauauguaauaagccacaauuuaaauuuauguaacaagguaaauuuucaaucugacagguuuaucucauacagaaaauguaugggacauuaauaugaacaauacuguggcugaaggccaguuggcuuuuaccagcuccucugucaugaacuggaaaaugucuguuauauuugaguagcggucaguuugagucuucaguuaaagcagggaugacagugcccauaguguaacgagucagccacagagaguucugaagauaauuucuguucuaccaugucagaaaugcugagggauuuucuuagcuggcaaacaaacaaguacaaaauuguuuuuuuaaguguaucuagauacacuuuuguagaaauaaucacagaaaaaguaacuucaguugggccugaagauguagcccauugguagagggcuugccuagcauguguaaggccugaaguuuaauccacaggaccaucaaagaacuaaccggaaaucuuguuccggauuacacauuuuguauuaauuccuauggcuaggaaaggagaggugcuucccugauagcauggacauuuucuucuguuuuaauagguaauauauaagucuuuauacauauauauaggugauauauauacuuagaagaaauccuauguuauuaauguuauguauaauaccaaagccuggagaauaaaaaauauuuggauaaagagaaaaacaaaacuaucgauggcaguaguucccuucagcaugcuucagugcaggauaauauguaugcagacauuuuacucuucugcgucugguugccucauacugucuuccuguugacuugcuucacuuauuuuaguggaaaaacagaauaucagaccacaaaaacuaauaaagcaagaagaucaaccuccuuugaaagaaggccuagcaagcgguauucccgacggacgcugcaaaugaaaggugaagugcagcccugcuccacaggcuuguccuuccuuccuggacagucuucuuguccucacacuuccuguuugcuggagaggaagcugccugaguuuucucaagucuguuuuaguuaacuaaaaccaucuuugucugacuuuaauaagcugcguaauauugguccuguaauuggcugacauuaaacuugguaguaaucucagugcagauguucugggcagggucacacuuaguaugucuucaguagagugguauuuucucucuugugucuuucaaaucgcgugaugaaaugcaguuccuccccuuggauauuuuucuaauauuagcauguaaugaacauauuuaaauuuuuuuuauuuguaugugugugugcacaugcaaacaugcauguguggcauuuuaugcacccuauaaaggccaguacccuggcuuggaauguaggcaguugugagcugucugguuuggauacugagacuugaaacaagaccucuggaggagcagcaguuacucauaaccacugagccauugcuccgggcccaaagaagauuucaguaaagauuuuuccauauuaggcugguaaggugacuuacguguuaagugcacugugcugccaagccuaauggccugagucauuucccaagaccuacaaaauaaaaggaguucucuucugacauacacacaccaugacauauguguuucacacaaagacacagagaguaagacaauauaaaaugaguagaugaaagccagucaugaugguguaugucuuuaaucccagcacucaggaaauagaggcaggcagaucucugugaguuucaugccagccuugucucuacuacaaaguuacuuucaggacagccaggaccguuaaacagagaaaccauaucuugaaaaaccaaauaauaauaauaauaauaauaauaauaaauaaaaaguauaaauuauauuguuccauauuacaauuuacuguugagaaaucccacaaaauagaauauuuaucaaugucuguugugaauagauauuuacaacaucauaaauguuaucuggcauuuaaaauauuuuaacucuaaaagaagugcauaguuuucauuaaaagauaaauuuaagucaucuauaagauggaacacagggcccccaauggagaagcuagagaaagcacccaaggagcuaaaggggucugcagcccuauagguggaacaacaauaugaacuaaccaguacccccagagcugauaucucuagcugcauauguaucagaagauggccuagucggccaucaguggaaagagaguccccuugguauugcaaacuuuauaugcccaguacaggggaacgccagggccaagaagugggaguggguggguaggggagcagggccaggggaggguauagggaacuuucgggauagcauuugaaauuugaaauguauauaaagaaaauaucuaauaaaaaaaugugcuuuaaaaaaaaaaaagauaaagcuugguggugguggcgcacgccuuuaaucccagcacuugggaggcagaggcaggcgggauuucugaguucgaaaacagccuggucuacagaguaaguuccaggacagccagggcuacacagagaaacccugucucgaaaaaccaaaaaaaaaaaaaaaaaagauaaauuaaaacuuguguuuggauuucuacugaagcaugucuacugucagguuaucaucaccacuuaacaaaaaacugccacgcgcugacuguggcgguggguuuuuaaauuaauuuuucugacugaucuguacucaaguuuuugagugguuguaaauuuaaauauaugguuaugaguuaacauaauuaaaugauaguuuaaagccuuaauacuucauccuccuacugacagaauucagaguuaguugccuuagucuaugagacuuagagaaaguuacuuuaaaagacagaugugagcugacaguuuaguucaugagugaaguuucuugucacucagcuugaccugaguuugaucuguggggcccaggucauuucagaaagagagaauggacucccacacauuguucuuugaccuuauguaugcucugugacacugacauacacaugcagaaauacauuuuuuuaauggaauuuuaagacaaauagauguugggcuggagagaugauucaggaguuaaaagcagauacgcuccuccagaaguucuuagcaccucugugagacagaucacagucaccuguaacucaggcuccagggucaucucagaccucuugccuucacaggcucacugggugcuuauguacacacucacauacaugaauuuuuacauaagucuuuaaaaauagaguagggugcuagagagauggguggguggcagcucaguaguuacgagagcauacugcuuuuacagaagaucugaauuugguuccagcaacccacaaguggccugcaggugccaauaguaacuccagcuccaagggaucucaggcuuucuuuggagcuccggguacacugcacccacacacacggacucagguccacagaaauaaaaguaaacccuugaaaaagaaaggaauagacccucagagugacugcugcuguuggccuuccugcucugaccugcagcacagccgauggcugagaaguauguuuuauagagcagugaguugagcuuuuacuuugaauaguaaagcaauuuguuaugcaggguggacuaauaagauguucucucuucucuucucuucugucagccagcacaacacaaccugaagaucuuggguaaguacugccuuguaauguaggaacugagaagauuuauauaguugcaauuguuaauuaaacaaauauuuguugaaggccuugcaaaaugucaaauuuucacaggcauuaggauuauaagaaacaaaaacacaccagaugaauuaauauucagaaaaaugaagcuguuuacagaaguagaauaggguaggaacagcuauguuauuaauuucagagugucagaagaaagguggguuucuagguaaaagcaauuuauuguaggcuaaauacagucauuguauauacguaguuccuauuuucccauauuguuucuguaagaucaguacuguugugccugauuccuuucucauuuaagcugaucucuucuccuuucguucuuuggucagcugaagacucaguuuguuagccuuuaauugauguuugcucuaauauuuguuccuucucguuucuuacaauuuaguuugcucuggcugcuuccuccucuuccgggguacuucuucuguuacccagagccuagugugaccagaugggcaagugcucugccaccgcugccucagaccgcugcuguguuuuguuauuuucuguugguuuuuaaaacagagccucacuuugcagcccuagcuggccuggaacuuaguuguuugaagccagguuuuuuguuuuuuuuuaagauggcccacuggccuuaauuaugugguccuucugccuuagcuaacuaagugcugggcauuagaaugaugcagcacccacccagcuuccuuguccuuuugguguuaucuuaaagugggguuaagaugggcuauguagggcuggccagauggcucagugguuaagagcaccgacugcucuuccaaagguccugaguucaaaucccagcaaccacaugguggcucacaaccacucguaaugagaucugacgcccucuucuggugugucugaagacagcuacaguguacuuacauauaauaaauaaauaaaucuuuaaaaaaaaaaaaaaagauggucuauguacccuacacuaaauuucaacucuguccugguaauccuggugggauuacaggccugagccaaccauacccaggauaacgucuuuaaauacauaaauaacaauuucagcuguaagguuccccuugagcacuauuuaguugcauucuguaaaccuugguguguuuuguuugcauuuuugguuugucccacuuuauuuucaaaaacagccauguauuuggugucuuccagaugcuuauuaaacaguuagagucaaagcugggugugcuggcacacaagccuuuaaucccagcacuuaggagcccagaggcaggugggucuagauuuccaugagucugaugccaaccuguucauaaagcaagaucuugucucaggaaggauagcaauaacaguaguaguaguaauaauaauaauaaguggcaaugguaauaauaauaaugauaauacaaaucagauucagaccaauaccuauaaacauaacuuugugugggauguggcugaaugggucugucugucugugugucugacuuagaacucuucaaaagagguuuguuauuuucagauacugaguagucauuuuauauauacauauaaaaguuaaauauauauguguguguguguguguguguguguguauaaucuacccuuuuuuuaagaucuauuuauuguuauauguagguacauuguagcugucuucagacacaccagaagagggcaucggaucucauuguagaugguugugagccaccaugugguugcugggauuugaacucaggaacuuuggaagagcucuuacccucugagccaucucaccaacuccucuaccuuuuuuuuuuaucuuucccugaacuauuuagaaucugugcuuguaaggaaauugggaacuaauguugucucuguguuuuuaaaugguguuguuuucuuuaguaggucaugucuuacuuuccugaaacagccugggacauggcauuugaccuuaaagaguagcagaaaugggaacaaaauauuuaagcagugacaugaugugaaauaguuaaggauuuuauuugcaaaguaaaaaagccucuucuguaagguguucugaaguacuaacuuuuaauuacagcacagugagaauaagcauggucucuuuccuagaauugaaguuaauuucacuuuaguggauaaaugucauuuucucuucguuagugauacuuuugacucuagaagaccacagaaacaggcuacugguggcccuuuggagggaggaaagggaagggagucaugauauaauuauguuauaaucucaaaaauuauacaaaacaaaauugaguggcucacaacuucaggugaucugcguuggcuuccaaugacacagguguauguacucaugcauagacacaugcacauaaacgugugugcgcgcgcgcgcgcgcgugugugugugugugugugugugugcgugcgccagugugugugggcuuucagaaguuaaaugaugagagagugccaucccuccugaaguaaucucauauaguacucuggaaaaccugaguuuguguuggcauccaugcccuuugcccuugccguucuguuugcaugacugguuuugcuccaguggacuguggagaacagccauuuuuauaggguacaacuauuugaccuaagauguuucuugaccuuguacucugcucuugaauagaauauaccaguuugaguaacaguuuuguaagucugucuuuuuccuuguaauauuuccccuucuugugagcuugaacuaaaaguacacugagaaaaguuaguguuuuaaagcauaguugaugguuuuguuacaaauacgguuuccucccacuggagcuuccuucuccugagugaggagacugagcaagugccuuuguaccuggguuagagcagcgcugagacaggaaaggggaggagaguaaguaggugcuguucaugagcagaaaaugggucaguuguugcaugugggacucucccgaggcucuucucuaaggugcucggaauauacauuuagaaucagaaaccaaguuacuacuaagugucuugaauuaacuucaguugucucuuuaucacuauugcuugguuuguuugcuuguucuugucuuuguggaacuaagccucaaaaccaggucuccuggauguuagacgagcuuucuaccagugagcuacgucccaagcccuacuuuuuaauuauuaaguucagauucaaaacaggaaguugcgauuuaguuaauaugacuugauuuuuuuucucaaguuuaauuuuuuuuuuuuuuguuacuacugaaguuauuaagugcuauaagaaacguuucaaaguaagacgugaaccauagacucauugaggcuaacuuuugcuccaaacaaguucggugagauuuuacauauagacuaggaagucacuuuaaucaggauacuguagucugggaagagcaaccacagcuccauagcaaaaaagggcagagggagcugggacuggaugauagguguccuagacauuguucagcauccuuaauagugauacuguaacugagauucagugcugaagcaugguagcugcucuuccagaggacccaagcuucacucccuacuugcacauugggcugcucacgacuguguaacuccaguuccaagugauccaagccaccuuccugccuuuucaggcacccucauacaugugugcacauaagcauacacacacauacacacaacauacauguaaauaaaaauagaaugaaucuuuuuuaagugugagggauagaauuauuuuuaaaaauuaaccuauaauaaaugaaauauggggaaggaaaaccaaccaguuaggucaguaguucucaaccuguggguccuaaccccuuuaggguuacauacuugcuauuuacauuacgauucauaacaguagcaaagcuacagcuaugacguaucaacaaaauaacuuuauaguuaagggucagccacacgaggcacuguguuaaagggucacagcaucaagaagguuaugagccacugggugagauuauauagacuucuaaaaacuucagagaucuggaagagagaaacuugaagguuccaaguauagauaauacuaggaugggagugcuugguacccuguuuggccaauggcaccugaugagagcauguguugggagauugcuaguaauguaaggcacaauuguguauauggaaaauauaaauacccauagaaaagugauaguaaaugugacaguuguaguuugagaaaccaccaaaacaauuucacuggaacaaaacaugaacauuguuggugcugcuuugauaguguauauuucaucucagaaagucaagcugcuggaauggugcccucccuuaagcucagcacuccagaggcagugggcacgcuaguccacauagcaagugccagcucagccagcacuaugucaugagacccugccucaaaaaaaagaaagaaagaaagaauuuuauauguaggauuucuuuaacuuagaauguuuuaucuuauuaguaauaaaagaaaaaaaacaugcaucauuaaaaauaaaaguuaaugaaaaauuacagguaaacuuuguaugugcauauguacauaugucagacuuaucaaaagacuauacaguuaugcuuuuggaucuuauuuucucagucuuacaaugauuugguugcaaagcaugaauugauaccuuagaucuaagauaggugaacucauaaucacaagauguuacuguuuuggugucaugaaaaaaauuaaaguaugcuauaaaauagcacuuuaauaugcaaguuagauacauauuuuuaaacuuugaacuuaguuuauauucauuuugaggaaaucuuuuuuuaaucaauuuuguuccaguuugagucuguguucacauuuaucuuuuuacauuuuuauuguauuuuaauuacauuccacccuucccuuuccuuacuccuaaccuuuauuauauacguuuauuaguagguuuucuucucuucuuuacaguguucuuaaugcuuccgcucagaaaagugacucccaacagguaagauagcaguaaguuucuaaaguccuagagcacauagauaauuacagugacugacaugguauuaguuggauuuuuguaaugugugaucuuuuacaaguuuuguacauuuucuuaccccuaucacaucuccuauuuuacuaagacaaugcaaguagaacagaugauucauaaaacauuuucuauuccuauaaaucuggcacaucaguaagugugaauguucauuuauuaucuaaaauuaguguguaaaauuuaaauucaaacauuugacugccaggcugaguaucugccuccgugccugggguacccggagugcugguaggcaaaacacagucuguaaugagguuucucagucccuguuuuccuggguggaaacaucagggucugggaugauugcugugguucccauuuuccugcauaccuagaugccacuggcuuagugcugggaguuggaaaagggcuucccagucagagcugcccuuugggguguccacacagcaggcggaaggggaaggcacagcccagagagggaguaagagugagugcugagaguauggagggacuggaagagaggccuccuccaggagauuuagcugcucuuuaugaggaaggccuucccuccuugggcguccugaggagagaggguccuugcuuguugaaacugcuucauuuguuggcgaaugugaaugcauacaccuuauucagggugacccagggauuaaauaccuuuuaggggaauaaaugccuaggaagaggaaguuccuuggcugaacacuuggggaccuauuauuagcauggagaacuccaaguuuuaugcugggagaggugagggugaaagcuuagaaucccuccagacaaagucagagaaggagaaaaccugcugacaagggagucucccauuuugugcugagcucagagacuguccagucaugguagacuuugaucuuaauuagcagaguuuucccacauuugaccgcauuuauuuacuauauagauggcacuccauuuuaauauccuguuucuugauguuagugucuauuuguuaguauuugacuuuccuuauucuucuguccaaaggcuuggggugugaugucuccugugccugucacuucuuccucauccuguggcgcugugcagguggagauagagaaucucccacagaccucugcgacagagcagcacgacaggaaaugguuuguuaacuuccuaaaccaaaauauugcuugcguaauuguauucuaaaacuuaagcuguaaucuuaaaguacuuuaaguaugauugaaaacaaaguauucauauuugugagcugaaaaggagccuacugaguagucggagggguggugagccuaagauucugcagggacgagggaggaccguugucuacaggcaaacauaacccagcuggcuuuaguaaagucugggagugacuaauuuuucuuauaaaaauuccaguuuggggagcuggagaaauaauccagugaaaguaaagguauuuauauaaauggugaacacacaaauauggauauuuuguggcuuauuugcuauaaucaguuggguucaugcuuuccuagagagcaguguggcuuggugagggguacuuuagaaaugacuugggcugcguggucguguuggguaucgucuguuacucagugcacuuggaugauccaugagagucuucucuuuuucucuugcucuuagcuuguuaauaucugaaaucuaaugagauucgguggccaucucaaggguugggucggcuuuuugugcagccaguucuuccugcaugguggugggucagcagugguuggugauuguuuccagucuguccuauguacucuuucacugggauuggcuuaacuaacuauaggauacucugcuugcgaucguuggguauauuuuauuucaguuccagguaauuuugcaguuacaaucaaagaggauuucucuccuuguuugauccuuuuuaaacuuuccuuuccuuuuuguccuugugggaaucugucugauacaggguacuuuagguguauucacauacacauaccaaaggugaggucuacaaaugucaaguuauaguauuuauuuaagacuuuuuaaaaguuucaauuuugccgggcagugguggugcacgccuuuaaucccaggacuugggaggcagagacaagcggauuucugaguucaaggccagcguggucuacagagugaguuccaggacagccagggcuacacagagaaacccugccucgaaaaacuaaaaaaaaaaauaaguuucaauuucaugcugaagauaacagcccuggcaagcaguuauguuccauaaugugccacugaagcccauuaucacacaaaaauacugaugagucuucaacuguaaaagaacugucuuaauguaugcauaucuuaauugcaagugagaaucugauuaguuaacauccuguguuaugcugucuuuauuuaauuccauuuuaaugaguacauauuuaaaucuguuuaauuugauuugcuaggcacuaccaauuucuuugauguagacuuuaaagagaauauugaauuugagauucaagaaaaaugaaauaucuuggagcuguguguccucuccuuuuauaaugguucuacugagaccuccuuugcugaaauggaguagagauggcccuaaaaacugaugagccucagaguacguuagcagagcauggaacugaaccacagcugacaugucuuagagcuacugauucuuacccuuaauguagcgugcauucuaccucuuucuuuguuucugcaugcuuagauuucaaagaauauaaaacaguccuccuguagaaagugggaauaaaauuuggaaacugauuacugcauugagaagcacagaguacggaacaucucucuggcagauaauuuggagccaauuuaauugagccucauuuccuguuacagucuucagcuuuuuuuuccuggcauccuaaaugaaacugcucacuaggugaaugaugugauguguuaguaacuuagaaucuauacuucacaucacuuggaauccacaguguuuauuuacaacaagaagccagcagacaguggugugugcuugagaggcugaggccuggaacuugaguccagccugagcaaccuaaucuccaaacaaaauaaagccuguaaucccagggcgugggaagaaucaugcacuuggguggauugugauuccaggcccaacccuaucaaaagacaaaaagaaauagaacugagaaaaucuuguaucuguaaaccagaucauaugccuaauuuaauuucuaaauuguuagagacucuaaaucaaggguuaugaauuuggcuuguauuuggaaugaugguuuucccuuugugauuauguaacaugugcugcccuuguguuacuuuauaaguuuggcuuuugagcuagggcagguguuuucuuucuacuggaggacucuugucacucuguucaaaccugcauguugcauguggaugcaugucugcugucuacuucuccugugcuugugauucuuuuguuuguaugugugccuguugcacuucaguuugugcuccuaugaguuuugauugcagaaaguacagugauuuuuguuaauuuagucuaagccacccugaacaagcccagucuccugugauuguuguuugauuuggagcacugauagaaacuuguuugaugucugagggcaguuuuuuuaaugcuccuggauucuguuuccuggauuauaacuuuuuacaauuguguaauuuuagagaucauuuuuaaauucuucuuuuuccauaaguuuuuguucuucaguagaauauuuucaaauauuugaauaaagcucuacuuagacccccccccccccacacacacacacacacacuaaaucaaccaacauuuguaccuuggaguuccccagaaacaucaugaguagguaucaguguuuugccuucugugacuuuauuucauuaauucacuuaauucauacugcuuucauguguucccauuccauguacuucaugugacuauggauuuccuccucugcuguucuugaauguuaucaucucaguggugcaugcugaucacaucgccucucuccuuuacacaucguguucuuuauuccuauugacuaacuguacuccccacuccucaaccaucuaggcucucugcuaccagugaccgcugccaacgugguggaaaccaguggaacccaagggccuugcccccaccccagacugcauauagaaacuacacugacuuuguacaugagcauaaugugaagaaugcaggagcccaucaugacgcucaguuaucuggccgugcagccaugaccgagauaugaguuguuacaccuuuuaggccguggaacucuugucaucuaggucaauaauguauuuuguggcauuuauauagaggacugauuucauuagguguauuggaaagaauuuguuuccuacugagucacuaguuacacaaugcuaugauugacuucugucugcuguggaagggaagaggaucugaagaagccgugagcugucacucacauggcagauguugcuguguugaaagggugugcauagcacuguguccucgggaaggguuuucaauguuagcauuuaacacaucacucaaaacaucucucaggggauucauguuuaugacaaacugucaguugucauccacaugccaucuaaguaagacugaguuuuaaagguuaagacauaaaauguacacccaaaaggaaccauauucagucauggugccucagccuuuuguggugcuauaguaauacucuucucauaugcuacucucuaaaguggcccaugccuucauuucagcuaagagccugcgguuuaauaaaaauuauuauaauauuuuuuucuuaacaaacauuuuauuaccacagcuguagaaaaugcaauaacagcaugguucauguagagagauaugucugaaagguuucuuugggugguuaacuuagaguuaacgugaaugguuaccuuacuagcaggugguuauaccaaaugcaagguggaaagcuuuccuuguuacucuuuucucaaugaaguccuugacagaucauccgaguuuguaucacccucauaaucugacccauacaaccuuuaaaauaaaauucugaagucaaagucuuaccauuuuugagauggauuaccuguauaauucaggcucuuugguuuaauucacaaauuagcuggaaaaguacaugaugauugacacacuaggaagagagaaacaaaaacaguauuuccucuuuuacaauuauuuuuaauuuuagaaaaauuucugaacuuuaagcuguauaaggagaaaugagaaggguuauauucagaacuguuaaugcuuggaaauaauaaagcuuuguuauauuuaaccuguccugcuuaacucagagguuggcuucauccuauagguucucucuucagagggcuuugacagaagucugcuguuguagauacaguagggcuugucacuagaagacagguggcuaaccaaaaauauuuagagcaugaaauucauaggcaaaucuugaucugauuuuuuuauuauauaagagaaucauugcuuaaauauacuguagauguaagauggauauucaaaauuuuaguauauccuacagaaaagcagaugcauaucuuaaauaucuccaagacucaccaucuaguaugcucuaaagacaauacuaauguacaacgcucugaggguuuuuuguuuuguuuguagcucagauuauaacuaaguguugucuaugauguuuucuuuccuuuuuaucuuuaagacuuguuuauucuuguuuacuuuaugugaauggauguuugccugcauguauguauguauguccauuaguauguugccuccagaggccagaagaggguauuggagccccugaaacuagaguuguggaugguuguggcugacacauaaaugcagggaauugaaccugcauccuccagaagaggucauaaugcugaacuaucacuccagccuuuuuuuuuuuuuccuuaaaaguguuuauuuagaucauaacauuuuaaacacagaagcucugcuuugugccauaagaauauuuaguugauaugaauagcauuucuauaauacaacugagucagacugaauaaaagcuuuccuagucuuguggcuuagcuuuaucacauuaacuuuaaucugaaguuugaaaucgggccucccacuguguaucuuagcaaauguuaauuuuagguggcuuguaacugaguaaugcuaucuucaguuuguauugaaaaugaucauuuuuauuaggauuugaaauaaccaauuguguucaguuugaaugcuucagggucacaucauggguuauucuuucuuugaaaccuagugaugaaauaauucauucauaaaauuuuaaaaaggcaaaacuggguuggacguuagagacaguaaaggacagagagcaguagagucaugucuccuaaguguccugugugcuuuaagaugucauaucaauagguugagcaucccugucuaaaauccuaagccuccagauaauugauauaacaguuucacaccugaccucauuuguuucagguugcacuuaaaggcagcagcaagcaaacccaaaguauuagaucugcuuaacgaucaagccauguacauuaaaaacauacacgacucccaucccacaaauauuuaaucuuugugugugcuugcacuaauauuugaaaaucuaaacuaaaauggaaaacauuucugguuccaaguaauugugauaaggaguauccagccugaacuguaaauauuugcucuucugagugcuagucacaagauggccguacauuuuucuggagcagugauauauuuacaaguaguucagccucaauaaauauauugucuccgauauauuucuguucucaucuuacuauguccaaugaucagagcccuagacuugaaggcagagugagaugauucaguagguaaagucacuugccaccaaaccuggcauucugaguuugaucccuagagagauugaucccuggaaugcacguguuagaaaauaaggauuaccccaaguuguccuccagcagcugugugugcacaaauacaaagaaaguaaguuuuuaacauacacagauuuugaaguuaacaugcaccuagaaggcucucaagcuugggaguuuggagucaaccugagcaagacaguaagacucuugucucaaugaaaaaauaaauaaaucuagacuggagaaauaacuuccuuccauaaggacccuaauguggcacagaacuccauguuuauguacugugcaguguucuggcuacuuuuauugaauauaauuguaacaguuuaauuagauugguuguguucuguuggguuuuuauaaacaggaugguuagagagacagaaaauccagugaccuucagaaacaagcucugguaaucaucguuuuuaugguuaaaaacauuucugcugccuggguaguggugaugcacacuuuuaaucccagcacuugggaggcagaggcagguggaacucugaauucaaggacagccagggcuacacagaaacccugacuugaggggggggggggaaaucugguuggacauggcaguucaugccuggaagagagugagaaaggaagagugccaugagugguagacccucugaaaaacaaaagucgauauuuggguuuuuuuuuuuaaauaaccagucuuuaugaucuaauuuuucugaucuugaaaugguaaucacaugcacauuuuaauugaaguuacagaguaaaaaaaaaaaacuaucccauccuuugaagauuugaagauuauaaaagauugguuuguuguagaagaaauucaagaauacccaguucaauucuuucgugcaugcuacccacugcaagcaggaaucauugaaugcuuuacgucaugcagaaugucaaaagaaagaacacagagaggaaggguucuugggucuccuggagucagcacaaaggauuugaugaggucagagugcugucaggcaccagggcugcuagacauagaggauaaacugauaugcuuggguuuuauagcugcuaguguacaguuugaugucauagcagcuuaauuuaaauagugaauugagaguguuggcacaugccuguaaucccaguacuuaggaggcaggagcaaaagcauaaugccagcuuauuacauagcaaguuccaggccagacaaaauaaagccaaaagugucuuuuugcagggaagugaccugaagacauacaccucaacaugcacacauacaguaaaauuuuggguugcccacaaaaaaaguugaacuccugagugggguuaauugguaacauugccugggauauaaaaguuauuggguaaauauaccaggauauaaaaacaucuaucuagaacaugauauaaaguucuaagugaaagauuuuuuagggugaauauacaugcccacccccaaugcugguuguaguaccuugagccuugcauguaguaagugcuccaucacuuagccacaucccuagcuuauuugguuuuucugcauuacugcacauuugauugaugugguaacgguuuucauuuguuaacguugcuagauaacuuuuguauaacccuaaguaaauaauuucaucuuuccauuuuccaaaucaguagcugggggagauugagaagaugaauccugagucuugacuuccaaggguacuuacuguggaggaggccagcuuuccuagcaugggacccauccuucagcuuugguuucacuccugcucccuuugcguucacaagugugaaccaaagagguuggaaaugguuguucuguauuauccagcacugaugggcgaaaccauggauaagcgcagagggggccuucugaccuuuaagucaguaaacucuucuuuucuaaccuuacucccagcuauuuucaguuuguuagacauuagguuugaaaguaaugccacauuggauaaauucauuuuauuuuugagauuagaguuuagggauugcaaaaauaaaauguugguuccaguaccucuuagugucucuuacacuguaguuuuauuuaucauuguguauguacuccaugaccuguggaagucaguguacuuggagagucauuucucucuccuaccuuuaugugguuucuagauuaaccucagguuaccaggcuugcaaggcaaguuucuuugccuacugagacaucuugucagcccuucaugcauuuuaauaugaauuauuccacaauauuaauuauaucuucuauccagaacauuaugagcacucauauguaaaaugcuuugaccuaaaagaugaaacauuaagcuuuggaacauggaucuccacaauguagaaauuauggcaucguggccagaaaauaggcagguuaaacguucuugccaccagccuagugagcggaguuugaucccugggaccaacucauacagguuguccucugguaccacacacacauguacacagauuaauuuuaaaaaaaaaaaaacacgugaagcacaucacuuucuauguaaaauguauuaaacuucauuuuuuuccauucauucuugucuauuguuaauacuuguacaguuugggauaaugaaacagaacuuguaaagaggaauuuuuuuuuaagauugaaaaacauuauauagccgggcgugguggcgcacgccuuuaaucccagcacucgggaggcagaggcaggcggauuucugaguucgaggccagccuggucugaaaagugagcuccaggacagccagggcuacacagagaaacccugucucaaaaaaccaaaaaaaaaaaaaacauuauaugacuuuaguacugagaguuuagaacauauguuccuguucuucugaaggaauuguucucaugaacuuuuuuuuaacugauuaauuuccuaugguuguguucccaaagcgcugcuggcuauggccucaguuggaggugguagagguugagugaacuuuuuaccaugugcucuugacagcuagccagcauuguguuuauauuggcagggaaaagaugaccugaccuggagagcaacauucuccaaggauugggaccgaagacuucuugugugcaccauaaugaauuugugccuugccuuuaaacauaggcuuaacagcuauaacucuauuuguuguuguuguugggggaauggguacuuuuaucucauucuacuaaagaauaauguacaugcaucaauuuguagcuaggaguuacaacaaaaugcauauucuuaauaauaucuugcuacagaugccuaaucuuuguuaauaaaguaagggugacuaguaggaagggguuugcuggcuggccuuauagugugguuuucuugagaggucaugcaaaguacuccagagugucgugggccauuuuuaccuaauaguccagccagggcuucauauguaauuauagacucaaggaguuugaggaucuaaguuuaacaaauugccuugauucuuucugaggacaccauuagcaagccucuagugagucuuuggaaagacuucaaagauuuggauaauuaugaguaucuagguuaucaaacaaauuucacaauccuguugaagcaguaacaugaaaauauggugauacauggcuuuagagauccuagcaccugggagauagaagaaggaaggugccgaguuccaggucauccucugcuaccuagugugugaauucccgcuagucugagcuacaugagacccuacuucaaaaaaaggaaaagguagugauucuuggcugagagugaauggacugaggaggucuagggagucauuuuguuugucuauuuugguuuuggugguuuuuuuuuuuuuuuuuuucaagacagaguuucucuguguagcccuggcuguccuggaacucacuuuguagaccaggcuggccucgaacucagaaauccaccugccuuugcucccgagugcugagauugaagcaagguuuugcucuauguccuuggcuguccuggaacucacuuucuagaccaggcugggcuugaagucacagaaaucgaccugccucugccucccaaguacuggaguuaaaggugugcaccaucaccgccuagcuucauuuuauggcuuuaaaugaaagaaaggucuuuggaaaucauaguuuuagggguuuuuuugaggugggggucucuauauaguccuggcuguccuggaacucacugugucgagcaguaguucucagccuuuguagucagauaccaaguauuuacauuaggauucauaacaauaacaaaauuaugagguagugacaaaauaauuuuaugguugggggggucacuacaacaugaaguguauuaaagggucacaguauugggaagguuuaaaaccacugauguagaacaagcuggucuugaacucacagugaucugccuaccucaaccuaccaaguauuaggauuaaggcauguaccacccugugcagcucuugauaccuuuuagaaaaauauucuugugugcaaguguggggauccauuccaugacacacagauggaggucagggcaacuuuugggaguuguuucucuccuuauaaacuuauauggcuuccagggaucaaacucaagucaucagguuugcaaggcaagugcuuugccuuuugagccauaucuguccauauuuaaacagccaccagaacaccucuuugguccucccuuuuauucacacucacuuuuuuugcaugcccuaaauuuucuuguccucuguucaauucucgucaaauccagcugugccucuagaucagugguucucaggggucauaucagauacauuaugagucauaacuagcagaauuauacguaugaauuuacagcaaaaguaauuucauuuugggggucaucacaacaugaacuagauauuaagggguugcagcauugggaagauugaaaacccauggucuacugccucauaucuuuguucacuaauauccguggaagaggaaguucacauguuuuugacaguggcuguuaugguuuguauaugcuuggccagggaguggcacuauuagaaaguguggcccuguuggaguaggugugucacugugggugugggcuuuaaaacccuuauccaaaugccuggaagccaguauucugcuagcagcucagaugaacauguagaacucgcaacuccuccuguaccaugccugccugguuucuaccauguucccgccuugauacuguacugaaccucugaaccuauaagccauuccaguuaaauuuuguccuuuauaagaucuaccuugaucauggugucuguucacagcaguaaaacccuaagagaguggcuuuccaguagaugaugcuaugcugucuugaucaccauguucuguguucauuuaguaaggaguagaaagaacccugucucuaggaaauccauauaguggugccacauguucuaguaauaguaauaguaauaccacuucugccaaaucgguuugguugguucacaggugaucuccauagucagcucacaguggauuuauuagcacugacagcaguugacuuucuuccccacaaaaagcuuucuucauuuagggacaccacucuugucuccuaaccucuguaacauuuuaguuccccuugcuaguucccauccucugucugacccuauaaaauggguccuuuaguaccuuuuuuguaucaacucacucuggguaauuucaucuaguguaaugauauuaaaggccaucucuggggugaaggagauggaugauucagugaguaaagugcuugcugucuacacaggagaaaacugaguuuugaucacaacauccacauaaaaucaggucacaaugguaugugccuaaaacuucagugcuggagaaauggaggcagagacgcuaaggaagaagcuaagcuaagugagagacccugucuuagaagcuaaacugaacagugucuggugguguccucuggccucucacacauguccauauaccacacacaacaaaugaaaagauaauguacaugcuugcaguuuuucguuuauaccaugagcgugggcuugauuucuauauguauauauccuacugcguaugugacauguuuuuacuuaauuaucuauuguaagccugacauugaaaacaaaguuggagcaauguuaggcuuacugagcaguugcaagaaugaugcugacagcucucacagcccucauuuuuguuuuacuugaugcuaaugucccucuugacacuaaaaauuguaaaaacuaaaauuaggguuggggagauucauuggcacuugucuuaguuaggguuuugcugcuaugaagagacaccaugaccaaggcaacuccuguaaggacaauauuuaauuggggcuggcuuauauguucagagguucaguccauuaucaaggauccagaacauggcagcauccaggccgaauggugcaggaggagcugagaguucugcaucuucaucugaaagcuauuagcagaauacugcuaggacuaggguauuaaagcccacacccacagugacacaccuacuccaucaaggccacaccuccuaauagugccacucccuguucuaagcauacacaaaccaucacaguaguguuugccuugcuagcaugaaagcauggggucaguuucaagaagccauguuucuaaaaauguaguauaaucggucgcaguugucggcccacugcuggaaaagugaagaugaaaagauccuggugcuccucacagcuuauuuagaucacccacuagccucuacacaagcagugugcacacacgcagaaaaacccuaaaaugaacauugccacugucuaagcugaacaggauuuagguuuugcuagucugcccaaauguuccaggguauaaucgaagguuccauguuguauuuaguccccuugaguuggugauguuuuguguuuuuaaugguacuugagagaggacuugccagguucaucacagaauguccuugaguuugggcuuuugcaugugauuagauugaagccauggauuugaaggggagaugcugggaugauacuaugacauccuggauuuaagagauaauaaauuaaacaguuggucucuugaugucauuauuuuucccaucgcuacagauuuuccugccuuaauaaaucauaguucucacuuuccuguugccaacccugggcuggagcuuuugaaucaaaaacaguggugggcagaguguccuaccaauuccaugcauguuauuagucaccuuugcuccucuuuguauucuuacagagaaauucuaugaguucuccaaaauccacccaauccaccacucgcuaccaucucuccuacugccacccugcuucaguuuauugucaguaguauccacuuaccaguagaaucccucuucccauggcccuuucuuuuaaaaucaaugguuggaucuuccaaccauuguucucuuauuaguuugauuuuucucuucaguagccacaccagccauaacauagacuacccucugcucaaaccgucuaguauucucagcgccaacuaaaacaaauccuucccuuaguacacuuggcuucucccucuucugauucuccgcccgucccugaucuuguuacuugccuccucaucuccuaccaucuccugcuuguacuucauugcuaaaugccacucagaccuuaaagcucauagaguccauuccagcagcaccaggcuugguugguuucuuugaauauuuuugaucuuugaaauuuucuuauauaaucccacuccuagaaucccucuucccauggcccucucuuuuaaaaucauaaccuacaguguuuaauuagguuugcuuguaugagucucugggguugcuuacuggauaaugagaaaauuaacuggaggcugcaucccaaagagugagugccucucccuuccucagcagccacucauuaccaacagcuccacagcuggacgagcuguugugaacucucccauccaugguggaauguugacugcagguaaccacagcuccugugaguuguugaguuuaacugcuguguagugaccagaagacagcauuuuacagcacacuucuccaugcucuguuuccuccauccucccugaccccuguuccacaacauugccugagccuggggaugggggagcugucuagauguucuauuuaagccacacacucaacaaccacuuacucuuagcacucugaccaguuacgaaucucuguauucaccacuacccacuacaaaaauaagcuacucuaagguugaaacaacacuaaucuauggguauaaauaaacacaaauauuuagaaggcagcuaagaacaugcccauuuagcaaacuaacaguagguucucagggucuaugauuccaucagcuuuggguuucugaccagguuuacacaugaaauucuucuguggaacaggcccaagaucugaucagaaauagguuguuacccccaaaacauaacacuguuaaacuaaugggcauaccuuguguagugaaucaguauguagcaugcaaggugugccaguggguaaaaccuuagaugacuuuucuccccuagugauagcuacauagugccucuggcacuguaagccagccagcagaaaggagggucccaggucagugccagcuuuauuucucagagccuugcaaccugaguguguggugucuucaacaaaggggucuagagcauugccaagagcaauggcaaaagccgauauuguucugcagagggggagggggaggggaagggggagguucuggcccuuccugaccaacaacucaguagggaggcaucuugcaccaggacuucucaguaaucuuuccugaccauucugaaauaaucgugugcaccuugaccuucccuagucccuuucacccuuuuuucuccucacuucaucaucuuacacaguauauuuagggauuucugaucuauauucacuagauugucaauuccauuaaaggaaagcauuugcuugucuagagaauauaaacuuuguauauaauccuuggauggaugacugaacggaugccaugcaaaauauacucaaacucuuugucuuucaagaaauuuacaagcuggggacaagcagcuuuacaaaugccugauauaaauauaugccacuagaaaaacaaggccuuuuagaaaauuaagagcuugaaguuagguaggcucugaagucauugcagacugaagucuguaguaagaaaaaaauaauuuuuuuacaauuuuguuuuucuagaaaaaacaaaaccuuugcaaaaugcaagguguguguaguuuuuuuuaaacauuuuuaaaauaagcuuacuuauauauaaauacacuguagcugucuucagacacuccagaagagggcaucugauccuguuacauaugguugugagccaccaugugguuucugggauuugaacucaggacuucugaaagaacagucaaugcucuuaaccgcucagccaucucuccagcccaagguguguauaguugaggaaugaugaaauaguugaggaaaguuguauaaaugguggugauacauguuauuuuuucaaaagacagcucagagaucuuuaauucagccugagcaucacacagguuguguaccacuucaugccagccuugguggggccuagaguggagaguaauagaauccaauagaaguucugaucuagaaagauggcuguggaaagacuggauggcguacacagcacagcagcagaaacaaggaauguuuccucccucugccauccuccucucuccaccaccucugucuuacacacacacacauacacacacauacauacacgcacacgcacacacacugcucucaaccauuuagaaggcaagcucgguguaugcuucuaaugaaggaagaagaagcaguuaaauaucuugagauaauggucccagccuuuaaagaaguuaaccaaaccauguauguuuguauacauauuccuuuuaaaagaagaaaagacuuaccaaccuacaaccugcccacuaggguaggcuacacagccuguaggccccuggaucuguugggccuuguagacaguauaauuuuaucucacuugguaaucuacacccuguaucucaaccaagagaagagaagacacauauuuguacauacaaacacauguucauaaacuguuauagauaguagcauuagaaguccuagccaggaguaauggcucagacauagucgcagaacuuuuuuuuucccccaacauuaaacauuuguuuguuuugucaucauguaggucuauaccauguguguauaaugccagugaaugccauaagagggcguucaaucccaugaaacuggaguuaaagauggucauuaguccccaugugugugcugagaguagaaccuuggcccuggaggaacagccagugcucuuaaccacugugccaucucucaggccccaaaacuuguuuuguuuuguuuuguuuuugagucaggguuucucuguguagcccuggcuguccuggaacucacuuuauagaccagacuggucucgaacucagaaauugaaagaaccuaguggggaaacccccacucaacucccgauucggugugcacccaagaaucaugaacaaacagaccgucuugauguaaaaacaugaaguaguuuaauggcggagcuccugguugaaacauaucucacgcaggaaacaguggauucaaccaggaggcuuggaagcuaggggguuuuauagaaaaggggcugggguugggggaggaauuggugcggcuucacaugauugguccauuuaaacaucagcggacuguacaugcagauaacauuuaacuuaggucagaaaggccuaaggagacgccgggccugucuggcaugucauucucuuuaucuuuauggccaagcagccucaggaaugucuuaacaagggggcugcccgggcauguccuggccuguucugcuauguucucagccccagguuucaaagcucacaaacaacucuuugggcuauuugacauaaauuacgugaaucacaggucucaaguuuuauuuucuuucaaaauccaccugccucugccucccaagugcugggauuaaaggcgugcgccaccacccagcaacuuguguucuuaaauacuuuguuuguuccacagacaauauggauuaaccugauugcuuccucuugauuaaaucuugguuauaaauuauuaauaagaucugugaugugccuauaauucagccaaccaggacccuugaugucacugugucccaucacuggcauuagauuacuugguuauaauggucaaaguaauauauagcagguugguugguugguuuugguuuuggagauaggguuucucuguguccuugacugucaugcaggguuaguuugaauacauuugacuuuuuuucuuuuuuuaagaauuuauguguguaaguggugugguaaaucuccucccaaauaugcccuggcaaugaaaauacgacacaguuaauaugauuacaugcugugcacacagauugggcagaucucccacuacacuaccaucuuccccaucuaugagaccccuuagaacuugcgguuucuccaggccuugugcuugugcuccgcuuuucuccuucuuccuccucugugucuucucccucauccauuuucuccuucucccccacaccuucugcuccaccuucccuuuuaucugcccaaucaucagcucuccuuuauuuuacaaauuaagaugggaagcagguuuacaggaaaucaccugagugcugacucauuccuguucacaaccccucacaggagaauggaauuaacaucaaguauaguuagccccaggacuauccacaccauguaagugucuguuugcaguuuuguaugaaugugcaccauguacaugccugcugccugaagagucagaagagacagauccccuacaacuggaguuacugauggucaugaaccaccaugugggcugggaauugaacacaaguccucugcaagagcaacaagugaucuuaaauacuaagccaucuguccaguccauauaucgaucaaguuuuacauucucaaguuaaccuguguuuauaauaaauuuaccacaugcauuguauuaauauucugucccucaaaaauauaaccuagggccagcaagaucacucagguaaaggcauaugcugccaaacccaacaaccugaguccaaccuccagcauccaaauggugggaggagggaacugacucccauacagauuccacaccugcuccauggcgcgcacacaguaaacaaguuaaaauguaauuuaaaaagaaagaaauaaaaguaauguaaccuaaugguaaaaguuggauaucacuugugaugguggcaaaaucaugacuggcuaagcaucacucuaaccugguaaguugguauucuacaagaacuuuuaaagcucugucuauuuacacgcaugacuucaugaacuccuuugaacuccuuuauucaauuuacuauuguuggcccaugacuuaucauuugagaaaacuguucagguuagacuagugggaauacuaucagacuacucuaguaccaguuaagcugucccccagauguuuguagugcuuucuuacuuugguaccagaguuuuugcacucaacugucaucagacauucuuuuuuuguugguuuuguuuuguuuuccgagacaggauuuuucuguguagcucuagcuguccuggaacucacucuguagaccaggcuggccucaaacucagaaauccgccugccucuagcccccaagugcugggaucaaaggagugcacuagcaagccuggccagacauuguuuaagacauugauuuugguguggucuuuagaaccacagucuggccgguaggucuauuuuuuccugccuugggauaaguuguuuguucuucucguacgguuucuuuucugacgcuucucugcauagcuggugcccuuugagcagucugacagaguuuuacuuuauugcuugcuaaauaguuuggcuguccuuaaaucuucugagguacuuucaaaugugguuuaccuggugauaguuuuaugguuuguuagaugugucugcaacgcauagugcuucuauggguuagugcuccagugcucugugaauuauguucucacauaguguggcccaguaugaguauccgacuuuccucuaaucccuuuaaguacuucuuucccagaccuugagggugcuuuucuaacagacagcaucauuaugcuucucucaugccucuggccauccucaggaugcuggagaguuugcuccucuggcacucucuaccuuugaucucugacagaagcuaacaagaggagaaggauuucuuuggacucccaguucagaggaaugcaguccaccucuaauguaagcaugcuggcaggaguagcuugguccuuggugcugacaaagaaacaaaggugaaugccaugcucagcuggcuuucugcaucuucccgucuuuacauuuauuauuuuuguaauuggugugcacuuugugugugaguaugguugaagggacaaguucaggugucuguccucaccuugcauccuaucuaauagagucuuuuauugaucauaacacacucuagccuagcuagccauugagaugcuccugucugcuauugugucuguccuuguguggguucuaggacuccaaacucaggccuauaugccugcaaugcaagugcuuuaccuguaagccaucucucuaacccuuuucccuucugauucauccugggaccacagcccauggucugguacuggccacauuccagugucccucuucuguuaaacuggucuggaaacacacucaaggauacaaccaacggugugccucauuaguaauccagguguuugcucacagaucucuggcuuucuucaucuccccaaacgcaucuuuuccugauaccuaauauagucauccccuguccugccaccuguccccaccucugcacuguggccugaaugugcgcuccaggcagucguaagguucaccucuuguuucuugagucuaguguuauuucaguuaagaaacuaacccauucccuuuuacuucaucuugacuggaaaaaguauauccaaaaauuuugaaaggugaauaaagccaguucaauaaaacucuucaauuaauuuuuuuaguauugcuuuuuuguuuguauuuuaaugauacauuuacugguguaaguaaacuuucuguuacuuuuacagcuugccccuaagcguugauuugcucaacagcccagacuuacuagaaacaaccauuggugauguaacaaggacgucagagacuucggcaccauucccagcaccagauaccauuaauguugccaccaggucaaaugaauuagaggaauucaaagcugaaugugagaguaagcaccugcucuguaauuuaugacauuuaaaacauucuuguugcauguauguuuuugaugggguaugccguguuaugcauguggagaccugaagcaacuuggagggucaugucucuccuuccagcaugugaguuccaggaaucaaacugagagccacauccucaggccuugaauaaagcagcuguaccugaggggcugucaccaaccucagcuccuuuugauuaucuccuuuugaagcgagauauuuaaaucacuucuuccagaaacguugugucuaauagcuuaguugagaauauuuaaauccucuugccuuuugauuuaaggagagcuagggaaaguuuaagauaauaacaguauuacuagguuuauauuaucaugauggauugaacauguauuacuguucacucuggguuuguacuuguucucugaguacaaauuaagaagcuaacagaagcaagagggcaggcaucaugaauguaaagcugccugcgugacaugaccucagccagccuagcuguauacagugaaacccugucucugacaguuucucuaaaggucuucuggggcacaagauagaugggauguuuuaucuucagcagcuuuuagcuccuaaaagauauuugcuauuagugccuaccugccaaaaaguaaauacagaaugaaugcugcuuuucuuaauuuuuucaggggauaaagaguagaaaguaaauugcucauuaaaaauacuuguauauuugcaagcuuuguuugauugcaaaggguaagucugaugguuaaaaaaaaaaaaaaaaaaguagccgggcugaugcaugccuuuaaucccagcacuugggagacagcagcaggcggauucugaguucgaggccagccuggucuacagagugaguuccaggacagccagggcuacacagagaaacccugucucgaaaaaacaaaaaaaggaaagaaaaaaaaaaaaguaaaauguaaaguuuaaaacugucuuaaacaggacuuucccguugcagguuaguguaauaggguucguuuucaggcaucauguguuuauaugguucgugccacaauugguuuugucauaaguaaaauagaugccaucucucugccaccuaaacucuuuagaacacaacggugguauuuagucacucagaugagaguguuagagaaagauagugcucugcuucauacagcgugcucaaguaccacuggcgaguggagaugauccuaagcaagcacuugagauacccugccaagcaggccugcuagcacuucacaauaauguuuaaacuguuuagcaagaccuaaaucauuauguugguaacauuugaguaguuucauuuaguuuuucuaaaagcaguaaguuauuggacauucuucacaaggcuggagagagauggcuuagagguuaagugcauauaugcuuugaguuugguucccagaaccuauaauuagguggcucacgguagccuguaacgccagcuccaggaccauacaucaacuggccuccagaggcaaacuguacacacaugcaccuacccacacacaaaaacucccacaaauaauuaaaaauaauaaaauaaaaaggcauuuuccauuacuguuugucagauauuacuguuuuuuuuaugccauccuuuccuuuugguaguuaauuuugguaaccuugcccugacucuaccuuccauuagaaaugguugcucuuccuuaacuuagaaauaaacaagauaacaaacccaagcugucaggaucuagauccugccagaagcaggacuaccuuaaugcacuucuaggaucagaguagaaauagaguccuguuaggagaauuccuccucaggggagauaugaaccaaaucucaucccaccucauaagauucccaggacaaaccaaaggauuccaccagaguucacagugggcaacuagugaguuuauugggcuuguguacugaaugugagugagaucugcauccagcaugacugauagcucccuaggagcuacuguaaauagauccauaucggaaucuuccucagccuguacuguauacucuggucccucucccauauaccuucaccccagcccuugugcagggaggguaaaauuauauccaaaugguuaggagaagugacuggauacucagaugaggauccagugacccaccuccccuucuaugaggcaaugucagcaguccauaagaccaacauaauggacucacacuggcagaguugaucucaucaauaaauacagugacugcuuggcacagaggacuguucuacaucuuuuuugggugguaaggggguucaaaauaagguuucuaugugucuuugaacuugcuuuguggaucaggcuggccucaaacucauagagaucugccugccucugccucacaagugcugggacuaaaugcaugugcuaccacacccaguuucuccaucuuuauagagguagaaauuuuauuuacauucuauuuuauguuuguuauauaaauuuuaaaaguuuaauuguuucuguacuauauaauguuguauuaccaaacaauugaguauguaauuauuagaggauuguauuagguuaggauaacaugauauaaugaagcugggaucccuauaaugaucaaauaagggacugguaagauggcccagccagggaagugcuuguugcacaaagucugaugacaugaguuugaucucaggaacucacauaaagguggaagagaaaauucaacagaauugucuucugaccuccacacauacaagauggcauagaauaagauggcauagaauaagauggcagggaaauacuuucucccccacacacaugcauauccaauaacaauaaauaaaauuuuaaaacauuuuagauaugauaauucucuguauacuuugaagucgugcauaaagucauuuauaguguuuuacugguauagaggagaaauuuauaaauguagaaaagcaaauuuuguaucaauauaagaaaaaauuuuaaguuccuucugccauacccuauagaugccuaagaauuaguguguuucucauuauagaaaguauucaagaagggcuugaaugcuaugguaguguuugaacaagaaauucuuccaaaguaaagagaucucacuaauguaacuuaguucauauuauaccauuugcuuaaagccaaucagugcggcuagugagggccuuuuguuuuaagaguguaagucuuggguguggggaagaugguuccacugguaaaguuuaugccacuaaaaccugagaaccaaaguuuguauccacauaaaauccagccaugacagcacaugucaaugaccccagcaugguagggggaagggcagagacuagaauccucagagcucauuggcaagacagucuagcuaaauugaugagcuccaaguugccucaaaaaaaguguuagaggaagacaacuaacauugacuucuagccuauguauuacauacaugugcacacauauaaauacauacauauauaucauacauaaacacaaacauuuuuuagagaacaaaaagucuauuuggucuugcuuuguuuuaacacaaggucucucuagaacauucuauguaguuuaggcugacuuugaucuuguagugauucccuagcccccaccuucaagguauuggaaauacaagcauguauucuuauuucccauuuauauucucaaacuuucuguccucuguacuguguacuauaugaugguuauaguaugaaaaugaagauucauguaaguaauaugggaaaaaauacugacaucacacagagacacaugaacaaggcaacaguagcucagcaacacagcuuuuguaaagagcgcucuaccacccagaccaggcaggcaagcaagcacaccagaguaggaaagucacuuaguuuuuauccugucacugggugcugacugugccaccucauugguaaaagcucacuccguacagucugauaugauuugcuaauucauagauggcgccaaaggaagggguauaauagagucaagucucaggaauggugggcauccaggaaucuggcaaacaggcaugcaugcaagaguuuuggaaaguggaggagguuuguaaaauacugguucugggugguuacccaucuuuauaagaaaagacugauucugacaagcccccuucccugagaauacuuuuuuuuccccuuacucagccagcauggacugaccuucuacugucugugguaacugucaguuauuguuaaaguugauugggaaauguugguugagaguggucugaugaacccugggacaagggcacuaacacaaggaauuugcuaucauggcuuaaggugcuucggcuuccuagcaaugauucuuggccacgaaauuaaccuggaccaacuugaauguuaggccaagauucuauucucuuuaccagaaguuuucuuuuaaugagcuuuuaccuuuucuaacauuauccucucugaggagguaacccucaauuauuuaaacaccagauuagaggucagagcccccaagcacuucugacaucucuagcaagaacauuucugacuuagagucaaggaacugguucccucaaggggcagggcauuuugccccugccuaagcugcaggcaguuugugccucauguucucauucucucacccauauacucugaaccuaacuaaccgccaugauaggccuagggcaguguccagugugggcagacaagguaccaggccaguaggccuggcugaaaaaugacaagaguggacaggaugcuuuauuuaaauuacugccaggcauaggggggaaagggaacccuugacuguugccuggaaauaagugugaggaagaauuaaaggcaaaagcuguuagcauuacaaguccuaugccagggauuaggaggaaccagaauacaggauauuuuuuaaauauccaaaucaaaauccacuacaguuucuugaugcacucacaagagcauucuccauuugauuccaucucucccaccccccaaacaccccaguuuggaucccuaaggauggucuugaaaggaccaguuuuuagguacuuuaauggcuauuuaaauagccauuaacagacucuccaagaagacuucucaagaaagagggaaaagccagguggugguggcgcacaccuuugaucccagcacucaggaggcagaggcagguggauuucugaguucgaggccagccuggucuacaaagugaguuccaggacagccagggcuacacacaaaaacccugucucgggggaaaaaaaaagaaaaagaaaaagaacgagugaaagagggagaagaaauuuagccaucaucugauucuuacguuaaaacaauaaugggccugucucucuuggguguauguaggugcuguaguguugaauugagcagucuaacauuucucuuaccaagaagaaaauggauaguaagaaaugguucuuuaaacauugugugugugugugugugugugugugugugugugugugugucacauauauaucauggcuagucaggcccugacuucacagagaucggccuguuucugccucccaagugcugaaaucaaggguugugaaaccaugcauagcuuuaggauuaacucuuuuuuuuuuuuaagcagggucucacuguguagaccaggauggccucaaauucauaaauaucuaccugucucuaaagccauacaccagugggcccagcccuaagaucaacucuuaauugaguuauuaaagaguuguuggagauuuuuguguucauuuugauuauuccacuuauaaugaaguaaaaacagaacuuggguguauacccucauauaacuaucagccaggcagacuaauaagaagcuuuucuuucuuucuuucuuucuuucuuucuuucuuucuuucuuucuuucuuucuuucuuucuuucuuuccuuccuuccuuccuuccuuccuuccuuccuuccuuccuucucucucucucucucucucucucucucucucucucucucucucucucucucucucucucuccuugcuuuuuuuuuucagcauuaaaggaugacacagagaagcuuaaacagcuugaaacagagcagacuaucuugccaucucuucgaccuaccauugacauuaaugucaacagccagguauugggaucucuucuguaucuacuuguucuacuaccguuuccaggaagacguccuuucccagaccauugucuuaacuugcuuucuguaaccgugauaaagacugugaccaaaagcgacuuggagagaaauggauuuauuucaucuugcaguuuaccaucgucauaaaaggaaagaagggcagguacucaaggcaggaagugaagcaaaagccauaagggauacugcuuacuggcuuccucuccauggcuuauucagugugcuuucuucuacaacucaugaccaccuccccaagggcucuagcacaucagucagucaucaagagauugcccacagcuugcccacaggccagucugaugggguguuuucucaguggagauucccucuuuucagauaacccuagcuugugucagguuaacaggaaaaguaaccacacagcaguacuaucuguguugaguucugauugaccuguuuuccauuucaaaagaugaaauguguggauauguaggagggaagggagaaguuugccugacaacauuaagaaauucauggggcuucgaagagggcugggcacaggguauggugcuaagagauggcucaguagcuaagagcauuuguugcucuugcagaggaccuacauaugauuccacgaacccaugaggcagauaaaacucugguuucagauauccucguuugaauucugaaggcaccguacacacaugugguacacauauauacaugcaggcaaaacacucaugcacagaaaauaaaaauaaaucacagggaaaaaauaucaggucagaaguagguauaucucaguagguauauauuccagacuagccugguuuacauacugaauuuuaggccagccagggcuacccagugagauaucucuuaaaaauaaauaucuugguuuuugguuuuuuuugagacaggauuucucuguguagcccuggcuauccuaaaacucuuccuuguagaccaggcuggccucgaacuuagaaaucugccugccucucccuuccaagugcugggacuaaaggaauggaccaccacugcccagcuuaugauuuuuuuuaagacacacggagaagcuggagagaugguccgugguuaagauuauuggcagcucuuccauagaacugaguucacagcacccgcauggaggcugauccaaauagaggcucacaaccaucugccauugcagucucaggauaucagauacccucuccuguccauugcacucacaugcauguacagauaaguacauacaaaaauuucaaaacuaaauaaacacagugaaaaaacauuauugggcuggcuuagaguaauagauuaagugguuuagguuuuguuuuguucuuuuuucuuuguaauaucuuguguuuugagacuuugcaauaaggguuguuauagugugcaaaagaugauaaagauguauucaagucuacagcauagucuucagaaauuugggggaaaaugucaauauguuuggaugagccaggauuguacaagaacuuagagaauugcuguggccugagcuugcugguucagggccaugaucccaggcuccugagaagcuaaaucagaagggucaauucuaucaaugauuucaacuucagccuagagucucuaaauuaaaaccaaacagagaaggggguggggugcacaagguccuaggaucaguucccaggaacacacgcacaggauugggacugacuucugcuaauaggagcuaggugguuacagggagggucagcucuuaaaaagggauuuucagacuuuuugauaucagaagcuuucauaggaaagauuguuaaaaauucagacuuagagccacacuugcugguauauucuuauaaucuuagccuuugggaggcugaggcaaaauuaccagcucaagaucagucugcgcuaauagggaaugucucucaaaaaacaaaaauuuuaaccucauauuuuggggugcuaccuagaggcugaaauagaaaccgcauugaaaaacacaaaauugaaauaagaacaucaaauauguuaagagauggaaggugguaugguauucacaccuauacccaucauuaauuacuauuuaaguuaagcaaaauaguaaauauaauacagagagcuuauauuucuuucaaauguauuagucugccuccauuuguuuauuucuaaaccacaguguuuauugagugaauuugugcauuauuuucaucagugugucugagaauguuuacauauuugucacauuguuacauauaauuuguuacaaaaagucaccuccuucacuggggacaacuccagaguuaguaccaugaaguaugaaugaucagacauaaugcccaguguuuaagcaacugaguuacugaaauucuugaguuaaaacauucauagagaauauauaauacuugcugacauuugucccagguguuucagauuagccccucaggggccagucccuucgauucuggagcucuuuaucugcagauaguuacaggagcugggugugucagcaacagaagauagcugcuuggggcaugucauuucuugguugucugaauaugaaauuucagcauuccuguuuaccaauaacuguggccuauugaaagugauuauaucuuuuaacauucaggaagaagugguaaaguugacugagaaaugucuuaauaaugccauugagaacccagcauugaaugcaguaaagguuccuccugacuucaagaguaauauuuugaaagcucaaguagaagcugugcauaagguaagauuucuuuaauagacaugguccugaaguacccuggcuaguuuuaugucagcuuaauauaagcuagcuauaauaaucagaggggagggaggcacaacuaagaaaacaccuccaaaagauuaggugguuggcagguauguaaaacacuuucuuaacuagccguugauggggggagggcccagcccauuguaggugaugccagcccuggacuuaugguccuuuguucuauaagaaagaaaucugaacaauccaugauaaauaagacaguaaguagcacuccuccauagccucugaaucagcuucuauaucauugcuucugccuggcuugaguuccuauucugacuuccuccaaugaugagcagcaauguggaaguguaaaccaaauaaacucuuucaucccaaguugcuuuggucaaugguguuucaucacagcaauaguaaccguaugacauggaaagagagcaggggugcaaaugacagaguuccaagacgaugugcaaggugaugaaagccuuuggccacucuguucagacucagcuguggucaggauaaggugcuaacaaugcucugguauagacguucuuuaaaacaaacacaaagccaaugccuugaaaaugacuuguaagguuguuuucauuuuuacacaaccacuaagcccagugacuuucuuuuuuucaauauuaaguuucuaauccuagaucuucuuuauccauccacuacccucaguuuggggagauucugaagcaguuagcaacagacugacacacaaggagagcugacugaccuggugaaggacagagcgaggaccugccccuguaggguauggcugcccugcuccccgauuggcuucucuucacuuucagauauggccuugacccccccuguggaccacagcuucuguauaauaaaccuaaggaaacacucccagacugucucaccucaaugaucacaguugauucuucagucccagcugaccagaaccacauagguagccuaccaacggcuucuagagucuuuucuucccucuuagaguuuauaaaagagagcuccaucaucugcauguucucaacuaugucuucuaaguucccacaacagcucuuuaagcugugagcuugcaacaguuuuucuagcccaaaauuccaaaguccuuccauaaucugcccuaaauuauggccaggucuauuucagugacuccccaugagccugauacagccugccucgggcuucuauugugauaaaacaccaugaccaaaagcaguuuggggagaaaaaguuuauuuuaucauacacuuacaagccacaguccaucgaugaaaacaugaugacaguaggaacugaaacagaggucuugaaggagugaguccugcuugcuuggcuugccaccugcccaggaauggaagcacccccaguggucuucucccucccuaucugauuuagcaaauaaaggccuaugcugccaggacagacagcuucgguuccauacccaagccccacuuaguggaggcaaagaacgauuccuacaagcuacccuccaaccuccaugcucaugcugugguguuugauacccacuacccaagcacauucacagauagagcauuauuuaaagaucaugauacucuaaagaaaaagaaacuaaagaaggcaguaugaacuuuuucagucagaguagugaaaauauuauguguuuguuauguagcugggaauguuuuccagaauucaucagacauuacugucuuaaacauuaccucagaaaugauggguaaaacugaccucuuuagauaaacauuuggauuuccuucuuaaacucuucauuucauuuaaggagaaauaggauccaaugauacagcuaaccauuuucuuuuuaucauguaaaucugaaaaaaugcuggcauugaaucuuugugaauuuugucuguaguggguaacacgcuuuagcgucuuaagcaauuaauagcuuugugauaagaagauguaccauguauauucugaacuugucuuacauuauuggucuggcuacuggauaggacugaacuagauguaauauugguaaaauaucauuagcaucuuauuugaauugaagggaguugauuuuucuauuuuuagaagaauaaaagauaaacuuguuacuugaauauccuuucaaauauuuaguguuucauuaucaugauuuaauuuucuuagguuacaagagaagauaguuuauuaacucauaaaaaugccagcguucaggaugcugccacaaacagguacaaucuuggguaaacugaauuaaguugauuuucuuacuuuuuuccuuuucuucuacaucuucuuuguacaucaucaguggauugacuauaucuauuggcgagacaucuugaauucacucuuugcuauccaucagagagccagguaguaucuaguuuuagauuguuugaagcuauucuuagucauucuacauccucauaauugauucaaacuaauacaauaacaaaaucagguugaauuaguauguagucucagcuucaucuugucaucacgguaaccugaaugacaaagauucuaacauuaacugaguaaauguguuugcuguccccuccuucucuucuuaaugaguacgugccauuuguuuguguuggugggcaauaccuccgucuucaucccucuuuccuuuuguucauccuuguaucagauggguugguccuuccccucugucucugguuugguugguugguuggguuguuuuguuuuuuguuuuuuuuuuuuuauugguuucaaguugauggguaguggacagacuuccuuuaccuuuuguuggguguaguuacuugugacaaaucagcuuagcuuuuuucugucugauaauaucuucauuuuguccucauucuugaaggguagcucccuuagauguaggauucuaaguugauauuuuucuuuuuuaauaacacuuuuaagugugucauaaacugcugucugaucuuagauuuuuuuccauuuuuguuuuguuuggguuuguuguuauuggauauuuggcaauuuuucuuaauuaaaaaaaaagcuuuuuuucauauacuaucuucuaaucaugccuuuucccuccuccaacucuucccagaucuuccccaccuugccaacaaccaacuccacaccccuccuuuuucucuuuaaaaaaaaaaaacagaccaaacuuuauaaacaaagaaacacagucacacacacacacauacacacaccacagacacacaaaaacagcaaucaaaauauauaagcaaaagaccaauaagacuaaauaaauaaauaaagguagauagauagauagguagauagauagauagauagagccuaaacaaagcaauuugagacaaaaagucuacaaaacuaccuuugaauuuauuuuauguuggccuuccacugcugaggccuauccuaaugugugguuuauauucccagugagacucuuuuggagaaaauggauuuuuauuugcaaacaguuaucaguuacagauagcuucucuuuagaguugggagcuuaucucugcuucccccucucaguaaugagacccuauucccuauucggcuuagaccugugcaggccauuugugcugccacggucucugugaguccacaagugcaucaguccugcuaugucuggggucaucccacuguuaccucuuagaaccuuugugccuucccuaagugcaguucccuaacuccugacgggagggguugaugaaggcaucccauuuagguggaaugcuccagaaucucugaauauucuccaguuguaggucucuguacuugguuccguuuacugcaagaagccucucugaugauggcugagcagggcacugaauggcagugaggaguauggcagaaugucgugaggagucauucuaguacucuauuuuuuuugucugaacaauaguauucgauuuuccccuaggcacaugucccauucagucucagguuccugaccacccaagcagugucaguaugaguccuguguccuagaguagacccuaucuccagagcaccauuguuauucgaacagcaucugugccacuaucucaguguauuuaccuuguacacaaggucacuguuguugaucacaggguuuauagcugggcagguaguuaccuuucuccuuguggagucuagaguaccuuccaguccaugaaugauaaucaguaggguuuaagccucuaauuacacaccagcuugacguuuccauguuuguugagauaugucaauguugucuucaucaguagggccuuacccucaguuguggacaccaacugcugacuuugaccugagauguuugggagcgugcuugguguuccuuugguuaauggcuaacuagacguaacccauuccugccauugcuauuuuacaauaguguuuaucaguguuggucuuagggccugcucuaucgaugucucaggaagagucuuuuccccugccaauucugucagcuucuggggaucaggugaggucuaguuggagaugagugagaagugugaaucuguuugcauucuuuuacauacagcuguacagcuugaccaggaccuuuuuuuuuuuuuuuuuuuuuuuugaagaugcugucuuuuucccaguauuucuuacuucuuuauccaaaaucugguguccauagguauguagacuuagucugacucugcauuuuaauucuauuggucaaacugcccuguauuuaagccaauuuuuuggguuuuuguuuuuuuuuuuuuguuuuuuugagacagaguuccucuguauagcccuggcuguccuggaacucacucuguagaccaggcuggccucgaacucagaaauccgccugccucugccucccgagugcugggauuaaaggcaugcgccaccauugcccggcucuuaagccaauuuuuauuacugguuuuauuauuguuuauuaugugcuguuuuuauuacuauagcuccgcaguauaacuuacaaucuaggaugcugauaccuucaucugaucguuuauuauucagaaugguuuuagcucucugauuguuuccauaugaguuauguuugaaaaguucuaugaagaauugugucagaauuuugaauggaaucuauagauuaauuuuguuaagaugcuuauuuuauuauauuaauucuaccaauccauaaacaugggaaucuuaaucuucuaaugucauccucaauggucucaucgucuuaaagcguuuguuauauaagucuucaacaagcuuaguuagaguuauuccaagauugaggcucuuauaagaaguguuguuucccugaucucuuucucagucugucucuuggauauaggaagacuacugacuuuuuuuuguuaaauuuguacacagauauuuuacuaauaguguuuaucagcagaagaaguuucuagguggaauuuuuagugucauucauguauacuauaaagauacuuugacuucuuccuuuccuauuuguauccccugaucuccuucaguugucaauaagacaacuagauaagaauucaaguacuaaauugaguugauauggagagugaauaacuucauauuguuucugauuuuagugaaaugcuaugggugucucuucaguuauuuuggcuaugggauuacuguauaucaccuuuauuauauugagauauauuccuuggaucccuagucuccaggacauuuaucaugaagggguguuagauuuuaucaaaggcucuuucuucaucuaaugagaugaucaugugguuuuugucuuucagucuguuaugugauagaucauuuuuaucaaauuacauuuauugaacccuccuauaucuuugggaugaagccuacuuggccaggguaaauaaucuuguuuauguguucuuauauucagcuugcaaguauuuuauugaguaucuuugcaucuaugaucauaaggaauauuggucuguaacuuuuuuccuucucccccccccacacacccccccccccaauuuuuuguuguuguuggaucuuugugugaguuaaaugucagguuaauuuuacucuuggaaaugaauuuggagauaauaugaggaauauugauuuuaauucuucuuugaaggucuaguagaauucugcccugacuccaacugguccugugcuuuuuuugguugggaaacuuaagcaacuuaaaccuguaacccugaaauggaauaguaauuaaguugcuuaucugauuuaacuuugauaggucauauauauuaugaaauucauccauuuccuuuagguuuuucaguuugcuggaguacaguuuuuugaaguauguccuuaugguucucuggauuuccuuggugucuguugugacccuuuugucuuagucaggguuucuauuccaggacaaaacaucaugaccaugaagcaaauuggggaggaaaggguuuauucagcuuacacuuucauacugcuguucaucaccaaggaagucaggacuggaacucaaguaggucaggaagcaggagcugaugcagaggccauggagagauguucuuuacuggcuugcuucuccuggcuugcucagccuguaccagcccagagaugguaccacccauaaggggaccuccccacuugaucacuaauugagaaaaugccuuacaguuggaucucauggaggcacuuccccaacugaagcuccuuucucugugguaacuccagccugugucaaguugacauaguacaauugaccccuugcaacuugacauacaaacacaucacuaguaagccucaacccuuaguucuuauucauccccaagaucuuaaguaacuuuaaaagucccacaaucuuguauauuaaaguucagucccauuaaaaugcccaauaucuuugaaaauucaaagucucuuaacugugggcuccacuaaaauacuuucuuccuucaagagggaaaaauaucagggcacagucacaaucaaaagcaaaaauuaaacuccaacuguccaaugucugggauccaacucaggaucuucuaggcuccuccaagggcuugggucacuucuccagcccuguccuuuguaguacacggcuugucuucuaggcuccagcugccuguacuucacugcugcugcuguucuugguagucaucucaugguacuggcaucuccaaacacugcugucuucugcugaaacuaggcuucaccaacagccucucauaggcucucuucauggugccaagccucaacuccuuugcaugaccccuucuguccugggccaucaguugcaacugaggcugcaccuucaccaauggccuuccauggccccucauagugcugaggcucagcugcucugcauaaccccuucaugccuucagaaccaguaccaccuggguaacucuuucacauuauuaaguccagccacagcacaagguacaaccuugaucucuggaacacagcuucugugcucucagaaaacacuucccagaagaugucaccucaaugaugcugguuucuucuuaaacacugcuaauuucuuagccccagcuaaccagcaucaauaaucccaguaaugcaaagguuucacuuuacugaaaagagucuuuaaucuucccucugaaauuauacaagccagaucuccaucuccugcacuguucucaacauuaucuuccaagcuccuacacaacauuccaaagagcucuuaacaccgaauggaucuucuggcccaaaguuccaaaguccuuccacggucuuccccaaaacauggucagguugucacaggaauaccccacuaugcugguaucaauuuguguuugucaggguuucuauuccuggacaaaacaucgugaccaagagguaaguuggggaggaaaggguuuauucaguuuacauuuuccacauugcuguugaucaccaaaggaagucaggacuggaacucaagcaggucaggaagcaggagcugaugcagaagucguggagggauguuccuuacugacuugcuuccccuggcuugcucagccugcucucuuauagaaccaagacuaccagcccagagauggucccacccacaaggggcuuuucccccuugaucacuaauugagaaaugccuuauagcuggaucuccuagaggcacuuccccaacugaagcuccuuucucugugauaacuccagccugugucaaguugacacaaaaguagccaguauaccuuucauuucaaauuuuauuaaucuggaucuucucugucuuuagcuaauucagcuaaggguuuuuaagucuuacucauuuugucaaagaaccaacucuuuguuucauuauuuuuuuauucuuuuucuuugcuuauuucuguuucauuuauuucagcuccaaguuugauuauuuccuuaccacuaugucuacucuuuugggguguuauuuguucuucuuguucuuuggcauaugccacuaaguuauuaauacaagaucucaucaguuuuuguauguaggcacuuggccuccuagaaccgccuuuaucagguccuauagguuuggguaugucauauuuucauuuaauucuagaaaguuuaauuuccuuccugguuucugucuugacccauuuuucauucagucaugaguuuguauacuuucuguuaguccuguuguugauaacgaacucuaguccaugguuguuagauaagaugcugagugucuugauuuucuugauuuggugagauuugcuuuuuguccacauauguggucaauuuuagagaguuccauaagcuucuacuaagaaaguauauucuuuugcauuggguaaaauguaaauaucugccaguccauuggaauucucacgauauuuaacaucuaccauuuucuguugaguuuaucuggcugaccuguuuauugguaagagugugggguugaagucucccacuaugacuguagugguguuucucuuaugaacuugggugcccuuguauuugguguaccuauguuuuuuaaaauuacaguauauccucuugguggauuuauccuuugaugaggacauagugcccuucccuguuucuucugauugguuuugguauggagccuacuuugucagauguuaaaaugacuacagccacuugcuucuuagguccauuugcuuggaaaaccuuucuucagccuuuuaccaugucuauacuugauacugagguguguuucuuggacccucuuaucuaguccaaucuguuagugccauuuuacuuuugaacugagacuauugauaaugaauuacgggggcuggagagaugggcucagagguuaagaggacugacugcucuuccagagguccugaguucaguucccagcaaccacauggugacucacaaccaucuguaaugagaucugacgcccucuucuggagugucugaagacagcuacaguguacuaauguguaauaauaaauaaaucuuugggcccgagcaaccagggacugagcgugaguggaguugaccagaguaaacagggccuaccggaccgagcagagauccuaaaaauucaauucccaacaaccacaugaaggcucacaggcauuuguacagcuacaguguacucauauacauaaaauaauaaauaaagaaaucauuauaaauaaauaaaugucucuuuaaaaaaauaauaaugaguuaccaauaagcaguguuucuugauuucuguucuuuuauuuuuaugguguggguuauucucccucuuuaauaaucccaguucugggauuauuuauuccuugugucuucuuaggugugguuaaucucuucagauugaauuuuucccucuaguuccuucuguagaguuuaguugcuaaauagauacugcuuaaauuuggcuuuauuuaugggauguuuuucuuucucagucugugguuauugauaguugugauggguaggagucuaagcuggcauuagauaauguuuguagaacauucaucccagaccucuggcuuucagucuucaaugagaagucaggugcuuugggccugccuguaaaggcuacuuugucuuuuuuucugaaccuuuaaauauccuuucuuuguuuuauguuucaguguuucacuauuuugguuauuaugugucauugggaaugucuuaccuggcccagucuguuugguguucuuuuuacaccccccccccccuauagacucaucuguuugaaugcuuggcccauagggaguggccuuguuagagaaaaucugucacuagagggugggcuuugagguccaaaagcucagucacuuccuacugccugcugauccagauguagaacucuuagcuccuucacuagcaccaugucugccugcaggcugccaugcuuccagccaugagaguaauggacugaacuucugaaacuguaagccagcccuaauucaguguuguccuuuauaagaauugcuguggccauagucucuucacagcaauagaacucuaagacagcuucuuauaucuuguuaggcacuacauucuuuagauuggagacauuuucuucuaugauuuuguugaaaauguuuacugugucuuuaaccuggguuucucuuccuuccacauucccuauuuguagauuugguuuuuucauagaaucccagauuucuggauuguuuugugccuggucuuuguuuugaaccucuucugugacagaguuagccauuuccucuaucuugcuaucaagguguugcugucucuuuccauaucuuuacucugcuagugaggcuuaacucuaacuuuguuugacagcguacauuuuuuauuuccagguguuuuuuuuucagcguggguuucuuuagugauucuacuucuauuuucauguuuuaaacuguuuucuuuauuucauuccucuguuuccucuuguuuucauuaguggauuuauuaguauccucuuuaagguccuugagcauagucaccuggcugcuuugacguucuugucuugugucucagcuguguugcaugucucagggcuacaguaggucuugguagaggaauguuguccuggcugugcguguuuguucugcagugaggucuagacaucuguaauuaugauugaagugcuucuaagcauuggccucugguugucuuuggauggggauccauucuuugauugcuguuuuaggagguauaaccucucacgauccuagguagagaguucugccagucagugguuggcaaagaggaauagagaugagcuuggagaaauagcugagaggagcugugggaagagauagggugauccgguccucaccaaaaggcagguuacccagggaguagaagugugaggggaggaagggcucccuaaaguuggccgcaggaagacaaagaaucucuggagagacagguggaagggcuaggaagaccuuggggcugcuucaagaguccgaguguucaguagauggaguuggaaugagaaaggaggcaccuguaagccggcugccucagagcugagguaagaguagcaagaucauggaggaaggaaggauggauaaugaaaaucaccuaccugagccccagccuuguauggccacuguggguccuugguagaaagucuuucuagauacugguggcuaacacaaaggaguggagaugacuagcagggaaggcugcgagaggauugggaaggaguugagcugggucugcaucaagaggcagauagauacccaggaauguuuugucacugcccuguaacccaggcucccgugaccugcuccuaucugucaguugcugggguuacagguagagguuuucugaugaaaaaacugaccuguccuuaugaggauccauugggugggagggaucauuucucaagagucucuguguggccuggcuuucaguacugaauaguuaacacagauggcauagaucucucuugagguuaccucacagaguucuugagcucaugugugucucuuuccuagccauuuucagcugguguuuauucaggcaggccuucuggcccuucuccgagacucaacucacucugcuuuccuuguuuggcuucugcauucgauguugcauaaacucuguugcucuguguaagcacauugauuuuucugccuuguaaaucugcuguugaaaagauguagaaaauuuuuaacuaaaaagccauacuuuuuuucuggcucuaaguuuccauuugguucauuuuugucuguugucacacuguucuggucucaugcaguucuuguuuucugagagaauuugacccaguugagcccuucggccacugaaguucucugugcuuucggagcuucugcuacagucuuucuucuugugagugagucacaguuugucacauuuaauuugaaaaguggacauuuuggacuugaugauguaauucucaaagcugagucuuaggcuuucuugguucugccugcugugugguuauauaauaguugguaacuguucaaaguaacacuuugagaugucuuuguuaucuguggucucugaugccugcugcccuaguuuagaauucagcuagugauuugacagaguucaugugacuagagccaagacauaaaagaaaaugaaaaaaaccagaggaaaguagggcuaaguaggguucuuagcuuccuaagaacaauguauucuuuacagaggaccuggguucauucccagcacccacaaggcagcucauaaccgucuauaacuguacucucuucugaccuguguggcaccauggaugcauaugaugugugaacauauaugcaggcauaauacuaauacacguaaaaguaaaaauaaugaauucuuuaggguccugggaagugacucagugaguagaggcacuggcugccaagcauggcacccugagccuaaucccuggacgcacuugguaggaagagagagcagacucccacaguuuguccuccuagccuccacacaugugugcaagcacgcgugugcacacacacacacacacacacacacuaauguaauaaaauguucucauggucuuuacaguugucuguguugagacauugugcagcauuuagaaggcuuccagggcuggggcuguaggggugcugucuccccuguacccugagcuccagucugcuuucagcaggggacccagaguccuaccuuggcacauucagcauuuuccaaauugcuccauuuuguggcgacuucaggguuuuccccccaaauuucuuccucuguggcuuucuuugccucucagcagaagccuaagagaagccucaguauccuaugcuaucacugccucccuugagacagggucugucgcugagucugguguuauccuggcagccaacaagcccaagugauccuugugucucugucaccuauagggcugggacuacacguccuguaugaccacacccagcauuguuauauggguuucagggauuugaacucaggucuuugucuguguacgguaacacucuuaagcaugggacuauuucaaucccagauccuuuauucagguuccuguguggacuguuuuuacuacuuuuauuauguacauaaauuuuuaccauaaauuuuuauugguuugcaugguuuuuaaacuuuguaagaugaaauauuuuugcuguuuagguuuuuacauuucugaaauuuaaaauguuaccuuuuguuuuuucauguuaccugcuguuuagaaguccgccgcaguuguucauucuuccuuugcagugaccuuccucccacagcaguguggaaagaugcugagguaggggcuggccugcacaugggcugcuccccauguggucagcacuguaagcugcacacgaggccacuucuagagcauaguccaucacuuuaaaagucaguauuuuaucgauuccguuucugagugauuuccuugaccagaggugaagugacuuuuuucuguaguauucauuaguugggacuuuuuucuaggguuuuguuguuguugguggugguuugguuugguuugguuugguuuuuuuguuuguuuuuuaauguuuugagacaggauuucacuguguaaccaugacuguuauggaacucaagucuauagaccaggcuggccucgaacucccagggauaaacuugccucugccuccuaaguacugggauuaaaaaugugaccacugcugccuggcuuaguugggacauuuucaucauuacuguguccaaaguuuucagugacaguaaagaugagauuuccagcccguucugaugacuuagauggucagcugugggccucccucuccuuuccuggcacugaaaccacagauagaccauuguuguucucaucaggagauaaagaccuggucguaugccaggccugcaggucacaggaaggucagcauccucuugucuaccuguugcaauaucugcagaauccuggguguuacuucuucugcacuugcucuccacccugugcucucacuguggcgccuccuguuuccucacucuucuccuuuguguuucgugauccacugagcuuucucggucauauaguuuaucacagacuagagggaagaagaagcuaacaaagccaggcuuuguggcacccacaucuuucuucccagcacuugggaggcaguggugaauggaucucuguaaguucaaggccaccuggucuacauaguuccaggacagccagagcaaauagugagauccugucacaaaaaaagagaaaagagauccuccucacuucccaucuucuguauaaucccucuggguuugaagcucuaaccauacuuuucuaaaguagaucacucuugaauuuccugaaggcuuuaaacucuacuggcaacccuuaguuuuuagguccuauguuuccuggcccccuuaaagacaagucuuuucuaucaucuuagugugacuguaggaaggaagcuauuggacucaguaucuaaagagucuguguuggauaucaaaacugaguguuccuccccagcugcccuuucuuccucuccauggcccccguauucuccuggaggaauuagugccaccuuuauccaggccugcuuuuauuuccuuccaguacugcauucaaugaaaaugaugugcccgucuguaaagauucccucacuccggugcauggcacagcugcagacagugccucuguacuaaagguaagaagauugcuuuccauuuuucaaaagacaauauugaguuuaaccuguacuauaaugagggacagcuggugacuuguaguuggcacugggaauugaggcaagaggcacagcugagcuucaucuccuggaaagacaagaaucuucuucccagucucuaugcugcuugugucugcuucagcugggggcagucugcuugcuggcugugccucuaccugaagaaacagcacuuugguacacaucaauuuguuuaguaguugccgcaaaaugauaucaacaauacauguuuuccuagagcucucuauugucaacaguccugcauuuccaacaguaacuucuuuucuuacgugaucacauuguauugcugaauugcauugacuuucugcccuaacgcaaugcauggccugcaucucacugccaccugggugcccuuucccuucucaggaggauucagcuggggcaccaggacucuccuauccaaaccugccaggcuggccacaagccagucacugucugaacuaccaggcuuuaucuguguagaugcaagagcugcaugaauauucacagaguacuucuuuuucuaguucugauuauuguauaguuucuucuccuugaaauggaauaaucauucaaagcucauuucugaauuucccuuuuugcuuaaaggaucaauaauagguagggccuggucacuauuagaaauucagagacugcgaagagcuuaguacgagggcagucauucauggacucuuggugcccugucuucuuuaggaugcuacugaugaacuggacgccuuacuucuuucucugacagagaaucugauggaccacacaguaacaccucagguaagugugucuugaaacagcaaggucaaaagacacuugcuuugaaaauguucuuguuugguuccaauuuuuuuuuacuugauaauuuaguaaacuuuucaucagaauuuuuaggacuggggagauggcuugguggguaaagcauaugcuauaugaggaccugaguguggguccccaaaacucauauaaagcugagcacaguagugcacauaaaaugagguagaaauaggauuuccugaaacucuuagaccaauagugagguguacacccuggagcagaagaaacccugccucaaacaaguagacugacaccuaagagcucugcgugugcagcauggcaugcaugcucucacacaaacacuaagagcuuacauuuauuucuuuagcauugccuuucuguacucaaacucugcugcuuugaauuuguauuucucucuguggaaaucacacaucacuauaaaacuguucauauucaacaccacauuaaauagcaucagagaaaaccuggagccuggaccagcauaaagaguuaagacaaggagcucugugguugagagcucuugcugcucuugcagaggaccuagguucuguacuggcguccauaaaguagcucacaacaccaguuaacucaguuccagaggauccauugccuuauucuggucucugcauucauugaacacuuguaaugcauuuacauacauacauacagguaaaacauucauacacauaaaauaaaaauaauuuuuuaaagaguuaagacaauaaccugggcuuaguaguuuaugucuguaaucccagcauucaagaauauugccacaagucuaaggccagccugauccaucaaacaaguucuaggccauccagagcuauagcaaaagcccaucugugucuauagcaaguguuaaggcuaugaggguauguuaucuuuucaaaaagaugggaucauaguuaacaauuaguauugaaaaucucaucccuuguuuaaccuggaaggcugaaguucucaguauucucaccauaaagcaaauaagacgguucauuucuccagcuggacuuccagucacguuggagauauaaaacagcuucagggacuguagggcaggaacugcugaggcaaccugauuccugucugaggauuugggggugcagguggcacuuucugaggaugcuugugucaacuguaauugaacaaacucgaguguauuucagaguugcccagaagguguacugaauagaaugcugggccgcaccucagaguuucaaauuguguauaucuuggaaagaccccaaaauuugcauuucuaaacauguucccauguguuuagugauacagacaaccaacuuagaucaauaaauaagacaucaccaaaggagaaguaaucccagaucggaucuugaaccauaauaaaucuugaaauagauaagacauaaucucuaaaaucagugccaaaucaucugaagcccagagaaaccgaauuccuaagcgcaucgcucagaggacuuaaugcuugcucuuugucucacugccuaggggagccuuguaagccagacagcaguguggcaaagcggcccacaccuuagcccagcacucgggaggcagaggcaggugaaccagucauucucuuguagacuucaugggcuucugcacaugugcagaguauagacagucacuuggacaugcucauaaaaaagugaauaacuaagagggcugagacuugugucagcaguaguaugcuugccuugaaagcaaguuccuuguuuuauuuuguuagauuacagcuccuauucugaggcauuuccagggauggagauguagucaaugcagugauugucuggcuuuagucccuguagcauaagcuggccuagaaguaauuuaugacuccuggcuucacuuuccaacuguugagauuacaggugugagucucuaccacaccugaguugucugacuucuaaaacuuuauuggcauuuguuuauguaucauguguuuaugucugugugccacuguucauguggguucagagaacaacuuacaggaguuuuucuuuccucagaugauguguguggcagguauccccuucagauggucaggcuuacccacaaggccuuuaucccaugagcuagcucgcuuacccuuaucugacuuucuaauuuugaccaguuuaaugaguugucucaguguuucaauuauauaaguuauauuggauagcgccccauauugauacuaauuuaguuuccuguguggaagguagcuaguggguuguuggccucuuuuuguugguuuuccuuuuucauacucauuuccagagcuguaguuuagcuauuaacuggagguuacccaccccauuggguggacuccagccauucuccauucuacaaagaggaaggucaacacagaggagaaauauccuucaugauuguaagcaaagcuguggucaagcaaggccuuugacuuaucuagaugccacaacagcuggccaaaugagccagaguuucuucccaaaccuggugaccucugaggaccagaccccuuuuguauguuuguuuuuaaagugauugauuuuggccaccugaauggucucaaacacccuguguacaagcauaacaaaaauuaaaauaaugaauaauauaaaacaaacagcggcccaugcuuuacaggucucugugugagugacugacaugcuaguggaacaaucacagcugccccagaugugaccacauuuaaaggacucucauccucuuccugauguucuguguuuauuccugauuauucuucucaugucuccuuugguuuauauaguuuguaaaaucagacuaagaccacaccagguaucaccaucuuguugaugaacagcuguagacuuggaucucuggaccuuaggauaaaccugggauggaacugauaggaucuuaauuaugacauugcuaaucucuggaccuuguguauccaacacuauuuuaacccuccacucauuucagacugcagacuagccauguucagaugcuccuaugauaaacaaacuccagugccugggagucagccagaguggacaccauaaguccuucuagggucccaguguccacuggcagcuccuguguuguguguguguguacacucacagacacacaaauaauucaauauaauuuaaagauuuuaaaaguaauaaacgagccaggcagugauggcacuugccuuuaaucccagcacucaggaagcagaggagcagagacagauguaucuccuaacuucaaggccagucugcucuaccaagccaguuucaagacagccaagaaaguuucaagacacaagaaagaaggaaggaaggaaggaaggaaggaaggaaggaaggaaggaaggaaagaaaaagaaggaaaagaaggaaagaaggaagaaaggaaggaaggagagagggagggagggggaguaauaaaagggguaacagguagcuguagcauucuugaguuauagcuuuuccugacagucuauuaaguaguaugaguguugcagaagccuggguugagaguuaguuagcucaagaggcucauugggaacugcauuccugagguguguuucacaguagaaaaauauuauggauguaauaagccagucuucccuaaaaguaaguggcuaugauuuuuuuuuaggugucuucaccauccaugaucacaccccgguggauuauuccaguaaguucauacucuuuaugauucuucuuuugguuaccauuucagacuauuaaaggauucucaaguucuuguuuuuccuacaaguauuggggccauuaucaaagcucuguuaauuuaauggcuucaguuuuguggcucaacuuuucuguaaaugcugcaugauucagacagaauaaaaaaauaaaacucugagguagaaggggcuggggcagcugacuugguggucaggaguacuuacuuuauugcagggccuagguuugauucccagcacccacguggcagcucauaaccauugguaacuccaguuccgggggaucuaacucuccucucuggacuccacaggcaggcuccacacacacaugugguauacagacauauaugcagacaaaacacccauacacauaaacaccuggggacaucagagccucuuuccugcuccagucagugacacugaugugaagcugcaagguuguuaucugacuguuauuccuuccucuuccacagcagagugcuaccaucuccaaugggcuugcaggauauggagcaucuuuggcagggacagaugaauguagucagaaagauggauucucacugauuucccccccagcaccauucuugguagaugcugugaccaggugaggaauuacuucuuaguugcagcuuucagaacaucuaauaggagaaaauuuaaguugguuauauuuaaaaugauaguguucuuguaaggucuuaauugaaccugauugaaaguauuuaagccuuuucucugaauacuguuuaacauaguauuuuuuuucuugguauugguaauuauucauaaaauuauugggauuuguuugugaagucuuuaguagagaaaaauauuaguagggucuuuaaaucucuugaguuuaaaguucaguuguuauuucuccuuuccugcuuuacucuucugauugugccugcaaucguagugacgcauaguggguggugcuuuacugcacguggcaaggcgcgguguggccugggaggugaggucauucccaaggugaggagauaagagugugagcaugggugauauggguccuugggggucagccuaaaaucuccucaccauagaggagaagcaaaaucggagccucgugaagaauggguuaaguguacuuuagccuggagucagggaagcaggagcaucaacuauguagaaaauguguccuacaaaauaucucauugcucaugagguggcaccacaucuccauuuaggucugucaucucucuucucggcggguccgugugggugcuggagacaugaguccaucacuuacuaggccucuuucuuccauacagcucugccccucccuugccugaagacucaaccuugaagcagaagugcuugcugacuacugagcucugagggcugcugcuccccaccuguaacuggauugccccacaccguccccagucagcccuggauccauguguccuuuacuuggggaaaaccuucuaccaggauuugacuucaacuccauaaugagaguagcuacauuuuccguccaacuggaagucuaccccauauaacugcuuaacugaagauaccuccuccuccuccuguaacuguauuugcauugccaauuccugaagcaaugaagguaacuaguuuccugcaaacugauggcuccaccuagcgguugcaacuguuuauagcuuagagcaaggcuugcuguccagagccuuucauugcuguuucccuggguugucaggggagcacaccugaacugagagccugcuggagaaaugcguggcacuuuccugugcauucccuggaaaugagaauuagaaaauggauggaaacacuauguggcuagaucccaggccagcuccugcacaguugcuaggauucuuggagaagcugagaacauagaggggugaggcugucacccagacuuugaauucugagcaguaaugaccuuacaucaaagguaaauguuaucuuuggauaacuagagagagguucagucucuaggcgugaacuccucagaccacuuuccuauuggaagcaccuaaaccccucgccuguuuuuaacuuugcagccugggagggagcaagugucagcucagagacccgaggccugugcucuucuuccugagccaguggggaauucggcccuacuaggcuuaccaguuggaaagucaggaccuguuuaggcauagccuccaguuccuuucgguguacacugcgugagcuuacagcuuccaagcuaaaaggaaaagaaaaauacuuggcagaaauggggaaugccugugagagggcuuggguucuugaauggguauaacaaaugaagucaguuuacauagggguuuuguauucauuuuaaaguccucuagaaucccccauuccuuuagccuguacccaaaaaaaaaaaaagauaauguuaaaguaguacccacccaucauagaaaaguguauggauaugaaccuaucaucccaaaacagaaaugacacugaauagcuuuaccugcuuaggcugaaggaucaggccucaguugcuguggagacaagggugaugugcagacggugguggugccaguaguguugcacugaugcuaagcugcuaagcuguguccccuggaguuuguucugcccaccaugugauguguacucauucuugcuucucaguuaagaagacacccagcucguggucuaaggagcugugauuugaacuacccuggcuuccuugugcauaguuugugcucaggcaaacacuaaugucuugauugggaagcccaggggguucaguuucacaguguccagaggagcuggacaguuuagaaacacuuucuaaacagucugcuaaggaguugcucuucuugcuggcugucuccccuuagccaguaguguaucuugugugaucguccgcaguguuuuuuccaguccugagugauaagacauuucuuacaggaugacacuuagaauuggggcuugacccaggcacacugcacuggguuucagauuucuggugucuggaaguccuggauggccugcaaggcuagcuguucugcu

SEQ ID NO: 333 - RNA, 179459 nt, Mus musculus
ugcugcggccucggagacggggugugcuugagagaggaggaggagacggaggaggcgguggaggcgagggaggaggaggaaggagaggaggaggagaaggaggaggagggugaccgaggcucuccuuugcacucucacacagagccgccucccuggagucacccgccgcuucacgccgcgcgcgcuucccugcuccgcggacgcgacauuguucuuuuaagacucccgggagcugucagaaaucggggcuccgggacuugaaagagacuugacuucggcccgcagcuugcggggaccgcggcacuuucggggcgcgugugaagggauuagcucaucucgccgcgaggugcgagcgcgcgccuccccgcgcacgccagccccgccgcagccccgcaggaugacggggugcaggcggcccgcggccguggcgcggccgcuguggcggcggcuguucucgggacgcugagggcgagcaccucgacgcggaccacgcgcuucuuucacccggccgcgagcccggggccuccugccuuuuuguauuuggauuccccccccccccccccuuucuccagccgggaggacgcggcugugauaacgaagguaagagaggcgcuuggggcgguccuucgcucggccuguuugggcccccuuugcaggucgugggcgcgcaccugaagcucgccgagccgggcggccagacuacccgaucgacuucccuuuucuuagugggucggagcacucgaaucuuccugggguuuauaguugaaaucugcuagggaugagugcacgggagaagggguggaauagaugcggagaugaaauguuccuaaacucaagguaaggcuggagaaucuucaguauuucauuugugggauucuuuuuucuaauuguuaauguuagguuaauugacucauauaagcaucuuuauuuuuuuuccgcacgcgguaggaacacacgcuaucuuccauugaacuugaaagucucuugugacuugcuaguauuauacuugcuuuuaggaaucaguaguugggcccaaaaaguugagauguagaacaucugaacuuagauuuuucaugcugcuuuggaaucgucccuaccuucaugauguuuagauucagcgugaguauguagucaagaacagaucgguguuugugggguuuuguaaaauguuaagcacagucauuuguggcuuucuggcuuuacauuuuuguuucggugucaauguuuguuuuauaguuacuuacaggaaaaauggagcguaugauuauccuuuguggacaggaacugugcuuaccaaagcguagacaccucaauugucccaggacgauuucuggaaaucaguucaaucagagauucaagaaaagcuagauguguguguguguguguguguguguguguguguguguguguguguguagguaguuaaaugcauguauggaugcauuugcugggguuucuaaaguaauggaacaauuuacaguuucaaugauaauccauaucgauguuucccugaaacuuaugucagagacuuuauguuuggcuuugcaucacagagugacaucaguguggacaaggacuacguaggggguuuuaaaaacugccuguuccaggaggacuagucauaccuaacuuuuggaauaagcaauucaagaaauacugagugugugaccagaucuuggguccagaugaaauaacacaguuauuuggucacauuuaaaagauggcuguggaggaaaaacaagaaaagcuaauguaucugacuuguaaagucagacuagaagacuggaagggcaaauauggcagccuuuugagaacccuggguuugugaacaaacauaagugugucaaaggggaaaacuuguuuuccaaaacgggagggaugaccuuaaacaauuauucagaguaccuaguagacuauaaccuagauauauuauuuaaaucuugaauuugaggauuacaaauuuaauacucuuuuaaagaaaaagccaguuuacaaggagaagcuuaugagcugucuagaaccauuuuauucacucauacgaucagucaugccaccuuuuuugucagaauacauuucugcuccaauuaacacagaagcuauuuuugugucucuucacauuuuuauggcauucuuaucuuuguucauauuuugucauagcacaugugcaugaaugugaucuugauuucuaagaucuacguaguuauguuuguauguguacaugaguacaugacaguguuuuguauuuaccugcuccuuaaacauuugcuaaaaagauuguuuuaaacacaaggaaucaucacugguuuaauaguuuuucuuaauacugaguugguuacaguuuguuaagguagaagaucagagauuccucaaaaguaguaacagaugauugaauauacucacuugguucucaucuuggguuccuaauggcuucuagguggugguaaauugugucaagucuucucuccucccccaccauguccuaauuuaguagcuuuaaaacguuccuaguaacauuguugcuuuaaauuuaugacacuaauuucuaauuuaagcuaggcauaacaccagcaucuauugaacacauuugcuaaaaauacuuucugggucggauguacuuagaaugcagccucaggaagauucacuugaacgguucuagugugaccaguuguggauauuauuuuuaaaagaacuuuaauaaaauuauagaaucuuauuaauaagauuuuuaucaguuuaggcauaggugccaccuuuuuaguauauaaaaugagacaguaauaaauuuuugugugauagcaauagaaacuuuuuucagauuuuaagaaaacuuaugugaacucuguugauucuuaaguacucugguuuguauaccugaaauguuuuaauuuuauguauugcaaauagaguucuaaaaugauguauaguguggauuauuuauuuaguauauauggccuuuccuuaacucugaaagggagaccaguaguuagguuuuugagugaauuaucuuuaaggagcaaaauacgaauuagauaauuuaaaggagaugcuuacugagagcacuucuuuccuccucugagaguuuuuuuuguuuaaaagcaagaaaccuuaaaaaacauguaggagucuagucuuguuugguagauguuuaagggcaaaugguuuaaaggucuguuugaauuuuuuucauacuaggaaugcaaaauuugugaauuuguuaggaauguaagucuaugcauuaugaauuaauguagcuaaauagacauuguuacucaucaaugaaauuugcuuauugauagaaauauacugguuuacaaacugagcugaguuuugguauuuuuuucuggauuuuugcauguaacaaaguuuuuaaaugauacaguucaaaaauguuaaauuuacuggcucaguagaagccuuaaagauuaauuucuggaaguuggauuuuuuugaggggaagaggccaguaaaguacuguagagaaacauugguauguuucauguaguguucaauuagcacagauagugagaaggaacauaaugaagaaguaauauagaauauucuuuacuggcauaggagaacaguugucuagaaauuuauuuuauagccuuugaaugagaauuagguguagucauaaaauauaagggauguuuauuauauucacuguuaucuuuuauuucauuauucccugguagaaacagugaaagaaagguaugaguauuugaagaaauugguaagaacugaaugcuuaagaggaaggcauuaauuugggaggcuagcuuauuucugucuucucacaggagguucuguggaguacuagacagaaagaagauccagagggggaagacuguuaguauuaucuguugaguuccagacaguguacauauaaaaaaguuauuucacugaacuaucaaauauacucuuaauguguguuuauuaguucacuuguaugucaaccuugugccauuugcuccuguucaagcagaauucaaaccaugccugucccacccuaaagcuuguucuuuagagcagugcaguccaguuaaguuuucuguagugaugaaauuacuuugcccucuuuuccaaauuuauugaaguauaguugacacauaugggggaaguauuuuuucccuucucugguagauaugguagccauuagccauguguaggguguggaacacuugaaguguaggaccgguuuaugugaaagacugagguugaugcugcauuuuguuuuagucauuuaaguuuuuagccaaaugugguugcuuguuacauggucugaguuagcauagcuuuaagaucuugcuuccuagaaaaucugaggucugguauuccgucuuccauggguuuacacaacuuaauucuugagcuucaauuuaaccuguugagaaaaugaugggauuaccaaggcucaguuuugcuuuaaaguucaguaacuucuuagaacacaccaguggcauuuaauauucacaagcauuauucugaaggaguuuucccuccccacugaguucaucacucauauaaagacuuuauuuuugagaagaauauuucugcacauacuccuauacacaguuauuuggugaaagcacuacuuuaucuuuuuauuugucucacacuggccaaggugaugauagguaagugcucugccauugaacuacauguugaauaaaaacugaaucuuuaaaaaucccauuuuuuuuuuuuuaagauuagcaacuuuacaaaauagaacuguuguacaugagaguggacucauaaagcaacaggaaagaaaaaaaaauccuugccauuuucccauguaaaauauauagcaguuccuaucaaauuaauucuuaaccuguuugcugggcuuugaaaacuucuccuuguuugaucuuacccuauuucuuauucuugcuuaaaacacaacauugcuuuccccuucacccuugucuccucaguuuauacauuuuuugauuuuucauccauaucucugaaguaugaacuuaagaacuuacuuuuuuugcuagauaauccaguuaaaacgaucuggguuucagaccuggcaguaaguaccuugggggcaauguuuauuuguuuagauauaauuuuguauauuuuucuuauaucaauuaaaaaaaguuuucaugaguguguucacauguguauacaugugugcuaacccaugcagguucauguagaggccagaagucaacauuucaaugucuuucucaguccuuauuccccuuuauuuuuuucauaguuggguuucuuuuucuuuucuuuuuuguuuuguuuuguuuuguuuuguuuuuugagacaggguuucucuguguagcccuggcuguccuggaacucacuuuguaguccaggcugccucaaacucagaaaucugccugccucugccucccaagugcugggauuaaaggcgugcacugccaccacucccggccggguuucuuacuaauccuggacuagaguuuagugguucuggcuaaacugacuggcuggugagcuuguuucccugccucaugcuuggguuacuguuaugugucaccauuuucagcuuuugauagguguuggaauuaaaauucagcauccaacucugagccaucuccccagacucacucccucccucccucccucccucccucccuucuccuccccccuuuuuguaaguuuuaucuaauaaguauaagaacauuuaaaacaagaguuguuucuuuuuuauuguuucaugaguucagcuucuguucagcaauuuuuuuaaaagaaauuuguaauuaaaaaaagauuagcauuuacuccaaccaccauuugaauugauauuuuuguuuccuuccaggcaacaauccccccccccauaacccccauuuguauguauuuguuaaaguuuugugacaaagauagaauuuugaauacaauauauuggaaacauuucauggugcagggucuucaauauaagaaaaagaucacagacuuuggagccaaauaaaugaauuuaaaaucuggucuuauaaaaaccuuggcaaauuauaugaccuuuaaguugauuuuuuuguuuguuuuguuuuugagagaaggccucauguuauaacacagacuuaaaacuuauuauguagcccaggcuuaccuugaacaaauacagucuuuuugucucugguuuucgagugcuaguguggcuuugaauuguuguagaguacuaagaauguacauauuugaagcaucuaggauuaugcuuuaaguaaguggcaauuggcauagccacuuuuucuguuuuauauuaccauguucaugaacauaauuuaaaugauaauucaaacauucagauagauaacuuacuguaccuaacacauuuggcuguuguuaaccaguuuauuuccucagucuaaaacuagagggcugggguuaugguucaagauuaucccaaauaucuauuuugacaaaaacauacauguucuuauuuuggaaaaaauaguuauaccuuguuuuaauuauugcauuuuugaaaaauuugccuuauuggggacuaauguauggcaaacauuccuuuacuuguuaaucaaacauuugaauuucugauauaguggcaacaguguuaucuauaaagguaaauauaguuugauauauuuccuuugaguucaaauucuaggcugaucguacauguucacguacacaauuuagagugacaguguauuaagaucuggaggaaugagacuuggcauuuggauauggucuugaagggugaguuggaacugaucaggguggaaagaauagcuuguauaaaagucagaagugugaaaggguauguaauauauuuaaagaaaugcaaguugucuguuauauaugugcaucucugagugggcauaguuucuuguuccuauguguguuugcucugguaggggauggaaccaggcuagaagacucuugugcuugggcaaguggggucauauuuagaccuuuagaaugcaucuuccuguugagcauguaagaacuuguaggaugguuuuuuucugacuuuaaaucaucucuuggccuauccaagugguaaaaugauuguuuuauuuauuugaugucaaguugagaaaaguacgguuuuagaacccacuccaccuuggaaucucuacuaugccauaaaaaauaaaacaaauaccaacuccuagaguaagcauaaauuaaggucaugccaaagucuuggucuuuuuuuuuuuuuuuuuuuuuuccuuucuaagacagggucucacuguuuggcucagucugaucucaaacucuuggcaguccuccugccucagccuuauggaggcugagacugcagguuugaguugcuuugucuagcucaaaggucuuuuacuuucucuuuucuauucccacuacccuuaguacuuguucauuguuuucuuuguguaugacugugugaauauguaugugaaauaccuuuucauuuucguaccuuguaaauuggcauuagcaauaggcagcgguuacagauacuuggauaagcaaauaaaauuuaaguauagguuuuagaaguauggguuccugauuuuagaguuagugguaccaagcuguauaaggguauuaggagacaagaauguuguuauagugguguaggugagguaugaaaagaauuagagauggggaaauaaagaaugacaguauauuuaaacauaguucgagaaggaggaaaaaaaugaaguuagugcuaagauuuagccuuuggcaguucuccuuuggaaaagaugggccaaauacuuuugaauauauuuaaugaaccagcuguuuugcugacaccaugguugucauaaguuuacacugaacuuuuugagaauuaacacuuugaaguaauuucacaccuaaugaaaguucuuaaagagcuucugaaaucuccuuaaccacauuuuaacauugaacuagcucuauacuauauguauacacaagauuagccuggggcauuuguugugauagccuuucaucuguccagagguuccccugguauuagaauugauacuuucuucucuucugcuguaucuauuuuguuguuguuuuuggaaagaccggguuuccugugaugcgggucaaucuugauuucguuguauagccaaggucaaccuugaacuuccaauccucaugucuguacaucccaaaugcugggauuacagcaugugucacugugccagguuuaggugaugcugaggauggaauguagggcuuuguauaugcuagguaaguaacucuacugaccuaaucaugucuucaucuuagcccucuuaacacuaucauguuuugaugaaacuaccuaaucucuuugcuggucuguucucauccuuaguuccacuuugugguuguuguuuuuugguuguuuuuguuuuuauuuuuguuuguuugacuuuugggacagguuuccccugacuguucaggaacucccucuguaggugagguugaccucaaacucacagagcucugccugccucugccucccagaguucagggauuaaaugccuguaccaccaccccuggcucuagcuccacauuucugaugagcgcacuauuuguaaucugauaagucuuucugaaccauuugagaauauguuauaaagagaaauacccaaauagucuauauuuaccaaaacauagacagccuuucacaaaacugccugaucaggaaauaaaugcucacacaacacuuaacuucagaucuauaaaugucagucacauuucccccaugguccuaaugguauuucuuuguccuuuguaguccaauuuagaagcugauuuaggaucauauauuguauuucacggucauuucucucccuucuuuugcucaaaaaaauuuuuuuggccuuuauuuucuguguuuacugugugcuaagauaguuguauauagguuagaagacaacuuuuggaaauugacucucuucuaccauguguauucuagagauuguuagguuugguggcgucauuuuuacauucugagcgguuucacuggucucuuuuuaccccucuucaguucagaaucauuccucacuaacccuucuagucuuuaaugaccuugacaguuucaaacagucuagcccuuuuauucuguaauauguccuguuaguuaaaugcuccaauggcugcucacaugcacacuaaggacauuguuggcaggaguacuugccacagaaagaugugcuauucuuagugaaccacccagagacacaguauuggcccacuacuggugauguuugaccuugaacacuauuagcucaugcuuguugagugucucugcuguguaaaucauaugaagucagguaaugugaaaaccuuuugaauuuuguuuuguuuuuuuccuguucucauauuggacacccaacccaaagccuugugcugucacugagauaaaucucuaaccaccacucuuuuuuuuuuuuuuuuuuuuuuuuuuuuuuaauauggugcugaggaucaauucuagggccuucauauauacuagacucgcuauucuuaggugaggagacacccaagacuguaccaguuccuaucaucagagcuuaaacauuauuacuuaggcuuacccuugugugggguaaacucguuguuacagauauuauucauggaauucuguuccuauuuggugguucuuacuacuuacugugauuugaaauuugauuucacugcucaaauuguuccagauuuuguaguggaagccuuugaaguugaccucugugucuucuggccaugucucuauccuuggcgcacuucuaaucacacagcauauucugagauuaucuuauuuuucuguuccagcugugcaauuauuacuuucuccaaggaauccugaauuuuuuuuuuuuuuucagaagaggagguguuuagaaacagaaauaggcgcuugguguguuuguuuaaauugauaaaacaguuuucgucuagcacuucagaauccucucuagcccuucucucugucuguguuuauauuugauuuuguuuuaauuuuguuaguguuggaguuuagacccaaggacccgggcaugcuaggcaagcaccacugacccaugucccauucuguauuugugacugucuuuuccaucagugagaaauugguucucaccauuccuuaguguaacuacuuacuugcucaguuacuuugugugcuacuuuuguaacccuaggauaguguuuccuucccugccacuuuugaggcccauguuuccucaagucagugcuguuaagauacaguaaucacuucccacuuaauuguguuuucucuaaucauaccaaaauuugcagagaaauguuaaaccuacucguggaggagaacaaagguaaaauucaggaaggugugucagucugaggagacagcucagucauagcuguugacacacaaggaucuuacaaagaucuuaguucauuucccagcacccccaaagccaggugugguugcauaaguuugugaucacagcaauggguagguggagcaagguggauucuuaggacuuucuggccagccagccuaggcuaauuggcaaguccucggguaccaguuagagacccugucucaaaauacaacacguggacaguucccaagaauaacacccaaaguugaccuccagcaucuauauucaugucuguacacacacacacacaccacacacacacaccacacacacacacucuucuccccaacagacacauaaacaauauacaaauuaauaaauuuuuaaauucaugugccuuuuggucuauaaauguaaauagcaaugcaaauuuuucaaauucagauuuguugcugcuuaagcaucuuuauacuccuguacuucaguacuucuguguaagucugauuuggaagcuaauggauuuaaaguuguuuaggguuuauagcucauuguagaaauauucuguuugucagugcuuaugaagguaaccauguggucuuaaucaucauugaaagauuaagaguucuuagaugggaagaggacugaaugaauauaagaaagucugcuuauugaguaaaagguaaaguagagaguuuugugaaagugucaacugcuucuaagugaaagcaaaagccagaaugcugugauuuggacuauuggaaaguuauuggugaccuuagcuaauugguuuucagguguauuuuggaaagucagcuguuugauugauauauggauuaaacauuuaaguucuuugaguuucaucucaggcucuauggauuuuuaagaauaggugaauuuuuuagaauguagaggugguugauaaagcuauugugacuuacacucacuagagacuuuauugcuuuagcagaagaguuauaacauagggucuuguuaagaaacacuauagaggaaacaagauauaaugugucuauuaugucuauagauaauagacauauuucuauuacuagacaaauuucuuuaagaaauugagaaggccuagaucagauuaggagacagcaucaagaagggcgucaauuuuuagguugcguacaucuuaauauuugcugggcuaagggaaagaaaggguauuuggaagacagauaagcaaaaccauguggcaauauccacuaucagaaacugcucuuaaauuaauuuugguagauauuuggauaggucccugcucccauuucagaugauugucaucuuagugagucuuuagaguaauacaagcaucauuuguuaaccuuauuuuuccuuauuuaucuuccauccuuccuuucuuuuuuucauuuguuuguuuuuuguuuuugaaacagggcuucuuuguguagugguagcuguccuugaacuugcuuuguagaccaagguagccuuaagccuccggaaugcuggaguuaaaggcaugaacuaccuaccaugccugacccuuuucaccuuuauucauucuuagaagcuuauauugucuuuauuuagguaaguuugaaaucuaaggugcagcuagaagugauauagauuaguuaucauuaguuauaugcaaauaauauagccacugcauuuaaucaguuucuaauuauaacaguaugcauuaucugaccccucugacuucucgauuuauuuuauucauuauuuucagacagaugucauaucucaggcuggcuugaaauuuacuguauagccuagccuaacuuaagauugcaagcauuuugccuccucucccccuacccaaguucugggauuauagguaugagucaccauuccuggcacaauuaguuuuagaauuucacuuccuuuauuaaaucaguaauguggcuacuugguucagauuucaaauaauauaaaaaggucuguguagagaaauuugaacacuacugcugcuccuuuccuacucuuuauagguagccucuuuuucuuuuuggacaguauuuuuauuuauuuauuuuuuucuuuucaaggcauggacaguauuuauuuuaugaaaguaaaaacauauauaauuuauuuauuuauuuuuuguuuuguuuucccgagacaggguuucucuguguagcccuggcuguccuggaacucacuauguagaccaggcuggccucgaacuuagaaauucgccugccucugccucccgagugcuggaauuaaaggcgugugccaccacacccgggucauauauaaauuauuauucacuuauuuuugcauguggaaacuagcauacuauauugaugauacuauuuuacauuaaaguuuuuucugcacgaagucuaccuugaagacuaugacuuuaauauguacagacagacuucuuuccucucucuguucuuucaaacagggugacauacuuaauuguguaaauauaaaaugaagguaacaaauucugauuacuuaaguucuucaguuuuuuugguccuuuaccuuauauagcuaauuuuccuuuaccccuuucuguauggacuagaguucccacagauauuuuucacuaugauguaacugacuuuaucucaaauccucuuaugcugacugacuuaaacuaaccuuucagauuuucuggcccagccaaagacuuucuccugauuuccauagccacagugaaggcuggaagaaaaagagaaaggcaugaaacuaauauuuguugagcuguacuggguguuuuaaaauaugauacugcaagacuggagagauggcucaaaagugaggaguacuugaucuuccauaggacccagguuugaauccuagcauccacauggugacucaccaacaucuguaacucuaguuccaggggaucuuucucuuggccuccaugggcaccaggcaugcauguggcacacaagcaugcaugcaagcaaagcauccagucaugcaaauaauacauuaaaaaaaaaaaaacccuuaaguguauugcaguuaauucuuucaacauguggaguaaguaguaguguucucuuuuuauggaugagaaaguuaugguucauaaaggagaguuguccagacuuccacauccagauagcucaguauguaaaauguguacugcucucacagagaaccuggauagaguuucuagcaaccauugggcuuacaaccacuuguaacugcagcucuaagggaucugacacccauuucuggccucugcaggcaccuauacacauguaaaaacccccuucccaguauauaaauuuaaaaauaaaaaacuugcaacauuuuaaguuggugugguggcagacugugauaggaaagacaaguuuggucaccuauuuuguauugccugugaauuguaagaagacuaaggaagaauaauauuugcugaccugugaaaaacaugugaaauccaaacuuuacuaucaguaggguuauuauuauuauuuuuaauauauuggauauuuucuuuauuuacauuucaaauguuauccccuuuccugguuuccccucugaaaaacacucuccccuacccuuuuuccucucccccugcucaccaacccacccacucccacuucuuggccuuggcauucccccucucuggggcauugagccuucacaggaccaagggccuuuccucccauugacauccaacuaggccauccucugcuacauaugcagcuggaaccaugaaucccaccauguguacucuuugguuggugguuuaguuccugggagcucuggggguacugguuaguuuauaauguuguuccuccuauggagcugcaaaccccuucagcuccuuagguccuuucucuagcuccuuccuuggggacccaaugcucuggauggcugugagcauccacuucuguauuugucagggacuggcagagccucucaggagagagcuauaucaggcuccugucagcaggcucuuguuggcauccaccacagugucuggguuuggugauuguauauggaauggauccccaggugagucagucucuggaugguuguuucuucaguucucuacuccacacuuugucucuguaacuccuuccaugaguguuuuguucccccuucuaagaagcaucaaaguauccacacuuuggucuuccuucuucuugaguuucaugugguuugugaauuguaucuuggguauuccgagcuuggaacacaaccacacugauuuguguuauuuguggcugaaugcaugcuauaaugcuagaauuaaguuguuccaauagagaucaccugaccuguaaaaccucaacuuuuacaaaucuggcucaggcuggagagauggcucagcaguuacaagcacuggcugcucuuccagagaaccuggguucaauucccagcacccacaugauucuucacaagugucuguaacuccaguuccugggacucugacauccucacauagaccugccgcaaaacaccaauguacauuaaaaaaaaaaguaagaaaaaauuuaaaaucugucuucuuauaggaaaagcuuuaaaauuuuuauuuuauguacauaugaauguuuugccugcauguguguguguaugcaacuaugugacuauguguaugccugaugccuacagaggccagaagagaacuuuggaucucuugaaacugcaguugugaccuaccaugugaguauuggaaaacagacacugguccucuagaagccaucucuccaggccccuccuugcaggaauguuuuaucagcucugguuaagaauauuaaguuuaacaguuacuaggauuguuucauucccuuguuguaguuguauuaccaguuacacaguuagauuuguuuauucaguuuuugaaagaauagacuuuuaaacaguuuggcauuagaaaugauuuaguuuuagaacuagguuaugcagagauacuguagucuugcaguucauguaguccuggacuguccaguggguaagcauuaaccagaagugacagcuugaaauucauuaaaaaccauuugaggcugaggguaucucucuuugugcuggagccuuugaguucauauguaagacccaggauucaguccucaguacucauuaaaagacaaauccauaagccauauuuaccacauuuuaacuguuuagucauauucauucuauucccuuaacagaggaagaaaucauagcucagaaaaauggaguggcugucucaaggaagcuguguuuguuaaaauuuaggauauuaucucaguggcuuuccaagcauucuaaauguuuuuguuguuacuaaaaaggaaugaccucugcagcugcuuuuaaagcucuccuacaacauaguaacuucagaauaucuaucuaucuaucuaucuaucuaucuaucuaucuaucuaucuaucuaucuaucuaucuaucuaucuucaagacaggguuucucuguauagccuugacuguccuagaacucuaucuaucuaucuaucuaucuaucuaucuaucuaucuaucuaucuaucuaucuacuauuuucaagacaggguuucucuguauagucuugacuguccuagaacucacucuguagaccaggcuggccuugaacucagaaauccgccugccucugccucccaagugcugggaucaaaggcgugccccaccacugcccggcucagaauauuuauuuuaagaacuaauaauugguauaauggaugcccuguuuuugcugccuccuucauucauuugugcaacaaaaacauuuuuuguuguuguacaaugacuuacuuaggaagucaauuuaggaacuuuuuuguuguuuuuaaccaggaggaaaaagcuggcccccuguaauucccucccccaacuuccaacacauaggagcagugaguucuuuauaucuuaguuuaacuuuuuuuuuuuuuuuuuuuuuuuuuugagacagguucucuguuaaacccuggcuaauguggcugguuugaaacuuguuaauuucuaggcuggccuuaaacucagagaucuacuugcuucugccuuucaaguacuaggauuaaagauguuugccaccaauuuaggcuaaccucuuaauauguaaauagaaaugauuucauuucuguucucaguuuucuaguaguguugaaauagauuauacaauggaucaaauaguagauucuuccaugggugacagaaaaacacauuaagaaugauuuuagcuugcagaaguagaagucauuaagauauggugauuaaguaggucuguauucaagugccucuccuaauuuugcuuguacaaucuugggccagucaccuaauccuucuagcugucaugccuaaccuuuuagcuuuucaacaguguucucaucucaaaguauaugcuugagaacugugcacaagacucacacacucacacacucacacacacacacacacacacacacacacacucacacacucucucacauacacacucacacacacacucucacauacacacacacacacucacacacucacacacacacacacacucacacacacacacucacacacacacucacacacucucacacacacacucacacacacacacacucacacacacacucacacacacacucucacacacacucacacacacacucucacauacacacucacacacacacacacacacacucucacacacacacacucacacacacacacucacacacauguaaaauaauaacaaaaaacaaaacccucaagguuguaaguuuacaguuucguuuuuguuuuuuacaucugugugugcaguugccuuuaaagaccucccaggagagccauggccuggagcaaacugcugcagccaaggggacggacguucucuacugcaucuaguugccaacuuagugaauaccagcaagagcaauacuuuaggccacugcgaaauccaugaaguccaugguggggcacaggccugcauagcacaguguggguggggauccccuagcagcccucagguuacaugaaccuacagauccauaugucaucuagauggcauccaugcaccaccuaaguuuacaguuuguguuggguagcauucauaacuacccuuagccaugggugccuguaggcugcuaguugaacaucuuugcaucugcaaagagauaaaaauagugaacuaucacuguuuuaagaaugaagugauagaaauaaaguauucuaguuaguaucuaaaaagcaaugucaacacuuagugacaugaagcaaucgccauuuuaugauuucuagauucgaugugugaggaauucuaauguaacagggcccaggaaugauuguuguuuacuuuucuacaauauaauauaugcuuacugggcuaggaauacuggggagucagaaugcuuggggaauagagggacccuuuccaggcaugcuuguuuaugugucucaugacacaagcauaggcuauagauuggagcucuuauucaugaacuuguggcagagggagggagauaugcuagcugaguuuugagagaaguguccuuagaaugaguaguccaagaaaaucagauagaauauaaagccucugauggucuuagaagucauuaaggcauuuucuucaauacuagcaaguaaccagucuucugucugcaaggcaagcuuuauuccuaaccccuccaaauuauuucuaaaguacuuuauauugguuagcuaauauaugagcuauaggagaugccaugcuuugaauaauucuugaaccacagguuacuuaguugauuaaauaaacaaauuaaucuuuggcaucugauagauugauuucagccuuuaguggcuggaacacuagcuacugcauuuucuagccauguaaaguugucaggguuaugcccccucuuuuuucaucuuuagaaauaaaguuaauaucucucuaugaccauuuauaagaacagguugacaguaaguagguaugcauacuauauauauaaaaucuuucaggucgaguguuaaagcucaguagauauauguaccagaaacuuguuauguuaaaggcuaguacugaauagguaugcauacuauguauaucuuucagguccaguuuuaaagcucaguauauguguguguguguguguguguguguguguguguguguagcagaaacuuauguuuaagacuaguacugaauauuaauuuaaauauuuauuuauuugagacagucuaucauggagcuuagguuggccuuuagcugguuuuauaguucaguagaaccuagcauuucugauucuccugcuucuacuucccaaguauggggauuagaggcuuggacuaucaugccaaguucauaauuuagguacugaaguuuuaaaaguagcaugcugcccccuagggacaacacaguauuuaaucaauuguggaaauuucucaucuuuggccugcauaagcuuauguuuggaauuaguauuaacguuaggcagaauuaaguuuuggguucuuucuuuguuugccuugcuuugguuuucaguccucuccccuuccuccccuuuaaaagagaacuaagcuuuuauuucuauguuucucagaugaagcuggcugaguugguugcuaugagaggauuagucaaagagaucaaaucucauauccuccccugauuucuggcucuucuuggcuucagccuugguuagaacagccagcagcagcaacagugguggugguggcaaccauaagggcagcagucacaaaugcagaucgauuggccaaaaagaccuugaccuuucaagugggaagguguacucagucuccucaaagccaggaccuacuuguauccauugacaauagaguaugguacuaaggccaaagucagguaaucagucugcagacaaacacuggcaacauuuggacaccuucuaggaugugagaaugcauagucugcucugugaugccaaguacuuccagguuguaaaggcugccgugucaaacaucuguuggaugaucagcccagaggagaagggggaaauguuccauguucacagugaggcuucacuggcuacuacuuuguccucaguuuuuauuagcuagcuguacaucacucagaauaucaaugguaccucuagagauuuuaguggugguuccuaaagccuggaagaaagagguuaucagaccccaaaccagugugcugagcuggcacaguuaccucacauggggugaaggcaccagcagcuggcaccuuauuggccaacagcaacuaaucuugauaaggucuuuaaaguccacauuacccuggauauaaagcagcaguuucuccagagcuugguuauuuaccagacgccccuucauggccuugcacaucaugguguucuugcccuuuaguaccacaaccuucccuguggaucuguugcaucuucuuggagcccacauuguuugcucccacacugaaacauuuuggcuaaucauccaaaaguuggaugaucuuaaggaaguaguuggacuucgaggucgcuguaucuuuccuggacauugugauggugcaucagggauugccacacaggguuuaaagacucugucacuccaaagaggauaacuggugauccccucuuuauuguuauuauuguuauuauuauuauuauuauuauuauuauuauuauacuggcauaaguaaauuuagaauucucucuucucaaauuaacugaguggcuuuguauuuuuauuuucuuuuugaaauuuugcuagcuugcuauuuccuuuugaaaucuauuuaauuugggaauauguuuuuuuuuuuuuuaaagaauggaacuccaaccaaauguuuauuuagaauaaaagauuagaucauaaaugacgaaagcuaauacuacaauuuuauuuuuguuuugugggguuuuuuuguuuguuugguugguugguuuaguuugguuuuucgagacaugguuucucuguguaguguagucccagcucuccuggaacuuggucugcagacuaggcugaccuuaaacucaacagaaauuaccugcuucugccuuugccucugucugccaaaugcugggauuaaagaggucgcugccaccaccauucagcuacauuuuuugguuuguuuuguuuuuguuuuuuuuuugugauucucaaccuauggggcuugaucccuuugggggugguauaucauauaucuugcauaucagguauuuacacuaugauucauaacaguaacaaaacuacaguuauaguguaacaaguauuuuuauugaguuuaguuuguauccuuugccuugauaaauuuguccuuuuuguguguaggcuucucuuuauuagcucauauuaucuguaaaugaagauacuuuuacuucuuccucuuauuuacuuucuugcauuaaucuaugacuuugaugccuguccagguuaggguuuuacugcugugaguagacaccaugaccaaggcaacacuuauaagaacaacauuuaauugggguugguuuacagguucagaggucaucaagguaggagcaugacagcauccagggaagcaugauguaggaggagcugagaguucuacauguuguucugaaggcaaacaggaaaagacugucuuccaggcacuuaggacaaggauauuauagcugcuguucagagugauacaccuacuccaacaaugccccaccuccuaauagugccacucccuguuccaagcauaugccuaaauaaaacuaucauugauaugaugguuacggugacuuuuucauauaugcccuugguuauauugaauauauuauguguaguauaauauauucuucuagucuuagccugcugauugguuuugcacugagaugaacauaguucugcaccuucuggcauccuggauucccaggagugugcagagagcuuuucagucuuguggguagauauaucuccuucuccagucggcacuguuuuuguuucagucaucuucuuuucuacucuaguaguuacugauacuuuuggcuguuauguuauugaauaaucacuguugauaauuuuucaaaaagugcuuggauaaaaggauguaacagucagguuuuagauaaaacaagcaugcuaugcuaguaggauuuuuuuagguaucuguuaaaaugguuagauaaugguuucucuagaaauugggacuuugaggaagcgucaugaucuuucuuuucugaucuagugguugaaagauguuucuauagcuuuuacaauugcuggcuuaaugcuccccuucucugacauuuuacucccuuuuauugagaauagauuuccucacauaauauauccugauuacaauuuacccucucuccaucccucccaguuccuccugauuuuccucuuaucuggagucacauguuuuuuugucucuuacuagaaaacaaacuggcuucuaagggauaauaauaaaauaagauuaaaaacuaacacaucagaguuaggacaaacuaacagaaguaaaagaacucaagaguaggugcaagaaucagagagcuacuuguugaaacacucagaaaucccauaaagaaaacuaaacuggaagcuguaacauauaugugguggacaugcugcagaucuguacaggcccuaagcaugcugccuuugucucugugaguucaucggaacauugaucaugaugauuuagagaaccuuaauuucuuggugucauccauucccucuggcucuuaaacuuuacacuucuucuuuggugagccuuagggagggauuugauagagauaaccaauuuagggcugaguguugcaaugucucucacucucuguuauugucuagcugugaguuuguuuguuuguuaaucaucugcaggaggaggaagcuuuucuaaagaugacugagcaagguagugaucucugaguauagcgaaugucaucaggaaucauuuuauugcuguuuuuuguuuuguuuuuguuuuuuugguuguuuauuuuugaauaaguguuugguuuuauucuaagucccuuggcuaucuagucucuggacuuuagugacccaggucugguuucuaucuuguagagcaggccuuaagucaaaucagacauucauugguuacucucauaagcuuugugcuuggcauauacugucagcagggcagcauuguagaucaaaggguuugugucuggcuugguguuuuuguuucuuucuugguagcauauagaguaccuuuuuguacaaaagacccuagaauguagagaaugaaggcuuuacguaggcaccaacuagccuuuucaauauuuaaagaguugugagguuucuuuagcaauggggcuuugccaucaguuuguggagucuuggcaacagccuggauuguauggggguuuucaugggauggauuccuuuggccaauaacucagauggauauaacccagucuugguucuagaagcuucauuuggugacaggagauagccagcugggacucugucuuccccauucuuggugauuacauucagaucaccuucauguaaauauuuggaaacuucuacuguauuagguuuuuauacuacuccucagugguccuuaauuuuagcugucucuccauguguucccucccuuggcuccuucuuuccuuccccuguccuuccccacuugaucucccauucccacauccccauccauaaccaucuauuccuaguccauuacucucucuauaacccguagcucuauggauuguagcuuaguuaucauugauuuaacaccuaauauccacaaaagcaaauacauaccauauuuaccuuucugagucugggauaucucacucaggaugauguuuucuaguuccaucuauuuaccugcaaaauuucauguuuuuugaagaaaauguccaaguaauauuccauuguguaaauauaccacauuuuuuaaauccauucuucuauugagggacaucuagguuguuucuaauuuuuggcuguuaugaauagagcaucaauaagcaugguugagcagaagucuugugguaggauaaagcauccuuuggguauaugcccaagagugguguagcuggaucuugggauagaucgauuuccaucuucccaaggaaagccacacugauuuauuuccauacuggcuguacaaguuugugcucucaccagcaauggauaguguuccccuuacuucacauccuugccagcaugaauugccauuuguuuuguugaccuuagucauucugacagauguaagaugaaaucucaaagugguuuuauaugcauuuuccugaaggcuaaggaugcugaacauuucuguguuucuucaccacuugaguuuucccuuuugaaaauuuuuuguuuagauuuguaccccauuuuaaaauugguuuuucuuuuucucuaucuaguuuuuugaguucuuauauauguuggguauuaacucaucagaugugugguuucucauucuguaggcugcuucuuuguccaaaugaugauguacuuugcucugcagaagcuucuuaguuccaugagguccuguguguuaauuuuuaaucuuagugccuguguuagugauguucuguucagaaagucuuuuccugugccaaugaguucaaagcuauucuucaaucagguucaguguaucugguuuuauguggaggucuuugauccauuuggagcugaguuuuguagagggugauaaguaugggugauaaguauguagacauccaauuuaaccaacacuauuuguugaaaaugcuuccuuuucuucguuuguucucucucucucucucucuguauguguguauguguguauguguguguguuucuggcuucuuaaucuaaaauuuggugucuguagauuuguggauuuauuaugucuggguuuuuaguuugauuccacugaucaacaugucuguuuuugugccaauaucauguuguuuuuuuuuauuacuauaaaucuguagaacaacuugaaaucauggauaguaauaccucccucaguucuuuuauuauucaggauuguuuaaguuguccugaguuguguuuccauaugaagcuggaaauuguccuuccaagauuuaugaagaauuguguuggaauuuugaugaggauugcauugaaucugaagauugcuuuugguaggauagccaucuuuacuauguuaauccuacugaccaaugaacaugggagaucuuuccaucuucugauaccuucaguuuuuuucuucaugucuugaaguuuuuauuacacuagucuuucacuugcuugguuagaguuacucccaagauauuucauauuauuugaggccauugagaaagguguuguuucccugauuucuuucuuagacguuuugucauuuguguguaggaggacuacugauuuuuaugaguaaauauuguauccagcuacuuugcuaaaaguuuucauuuuugugguggaguuuuuagggucacuuauguauacuguuacauuagcugcaaauaaagauaggugauuucuucuuuucuaauuuguauuuccuugaagucuugcuguagcuaagacuucagaaggugccauauugaauaaguauggagaguggacaaccuuguuuucuuccuuccuugaguggaauggcuuugagcuuucccauugaaguugauguuugggcuugcuguaaaucgccuucauuauguugagguaugucccuuguaucccuagucucuuaaggaguuuuaucaugaaggaauguuagcuuugucaaaguuccuuucuauaucuaaugagaugaucauguuguuuuugucuuucagucuauuucuaugggugaauuacauuuaaugauuuauguauguugaauaauccaugcaccacugggaaagauaucuacauaaucauguuggcugaucuuuuugauguguucuaggauuugguugcaaguauuuugaguauugcaucuauguuuauaaggaaaauuagucugugauuuucuuuucuggguuuguauguggauggguugggcaucaggguaacaguggcugaguaaaaaugagcuugguaauauucuuuaugucucuaguuuuuggaauaauuugagaaauauugacauuauugauauuaacauuucuuugaaaguuugguagaauuuugugcuaaaaccaucuggcccuggccuuuguuuguuuuuguuuggaagaaugguaauaacuguuucuauuuuacuaggggcuguaggucugcugaaauggcuuauaugaucuugauuuaacuuugguaagugguauguguugggaaaaugacccauuucuuucagauuuuccagguagaguaaaaguuuaauguguauccuuaggauucucaggauuucuuugguuucuguuauaucccccuuuugacuucuaauuuuguuaauuuggauuuuuuuucucuaugccuuuuaguuaauuuggauaaggguuugucagucuuucuguuuuucuuaaauuaucaacucuuuuuucauuguuuuuuaguuauuuuuucucuuauuuauugagcccucagcuugauuauuuccugcccucuacucuuuuguucaugauuucuucuuguuguucuagagcuuucagcugugcuguuguucuaguaugagaucauuccaguuugguguguguguguguguguguguguguguguguguauguauguauguauguauguauguauguauguauguauguaugugucuuaguuaagguuuuacuucugugaacugacaccaugaccaaggucuuauaaaggagggcauuuaguuagggcuggcuuacagguucagagagguucagucuauuaucaucaaggcuggaucauggcagcauccaggcaggcauggugcaggcagagcaccugaaggcugcuagcagaauacuggcuucuaggcagcuagaacgagggucuuaaagcccacauccauagugaaacaucuucuguaacaaggucacaccuacuccaacagggccacaucuuauaauagugccacucccuggaccaagcauauacaaaccauaacagugugugugugugugugugugugugugugugugugugugcugcuuaagcuguagaaggguuuuuuuuuuucuuuuuucuuuuuuuaugaacuuagaugaccuuguguuuggugcuuagauguuaagaauugcaguguccuuaguguuuuuuguuuuuguuuuuguuuuuccucucuuugaguuuuuaguguccuuuccuauuugugauggcuuguauaugcuuggcccagggaguagcacuauuaggagguguggccuuauuggaguaggugugucacuguggguaugggcuuaagacccucacacuagcugccuggaagcgagucuucuaccagcagccuucaggugaagauguagaacucucagcuccuccuguaccaugccugucugaaugcugccaaguucccaccuugaugauacugggcugaaccucugaaccuguaagccaguuccaauuaaauguccuccuuuauaaaucuugcuuugauuauggugucuguucacagcaguaaaacccuaagacacuaucuuuuaugauuaguuuugguuugaagucuguuuugauagauauuaaaauggcuacagcagcuuguuucuuuuuuuuuuuuuuaagauuuuauuuauuuauuguauguaaguaaacuguagcugucuucagacacuccagaagaggauaucagauuucauuauggaugguugugagccaccaugugguugcugggauuugaacucgggaccuucagaagagcagucggugcucuuaaccacugagccaucucuccagccccagcagcuuguuccuuaagucccauuugcuugaaauaucuuuuucuauccuuuuacccugagaugauaccuaucuuugauuccuugauguuaagaugugcuuauuggauccagcagaaggauggauccuguuuuuucauccauucauucugugucuuuuuauuuggcaguugagaccauugaugcugacaaauaucaaugggcaguguuuuugauuccuguuauugugcaugcuuuccauuuuguagucugggauuauuuauuuccugugcuuucuucacuauaguuaaccucuuuaguuuugggguuuucugucuagugccuucuguagagcuagauuuguagauagauauugcuuaaauuugguuuuauuguggaaugucuuacuuuuuuccauuuauguugauugaaaauugugcugguuauaguaguauaggcuggcaucuguggucucuuagagacuguagcaauccauccagacugugccauugacuuggguuccuugucuuuccucuauuccuguuauucuuagauuuggucucuucauaguguuccagauuuccugcauguuuugugccaguuuuagauuuaacauuuucuuugacugagguacccauuucuucuaccuugucuucagugucuaaaauuuucucuucuaccucuucuauucuguugguaagacuuaccucugauguuccuauucccaaauuuuuccuuuccagauuucccucaguuuggguggugguauuauuauuacuauuauuaauuccauuucuacuuucagaucuugaacuguuuuauuaauuuccucccacuuuuuguuuacauuuucauagauuucuuuaagggauauuuauuuucuguuuaaagaccucuauuaaauucauaaagacuucuuuagggucuuuuucuugugcuucagcuauauuagaauauucagagucugcuguugguugcugggcucuaauggaggcauauguccuggcuguuauugauuguguuuuuaggcuggcaucuaguuauuugggauugggaagauuguaauucuggguguaacaaacauucugggaucaugccagaugcaccccgacugggggucccagguaaaauguguguuuuauuauugggagcugacacuuaggaauggggagaggcuaggggucugaaggaauuuggagagagaaaggcagaugguuuccaccaggaucuguuuauuuaguguccuuggaauggggguagagagugaagagaggucaccccaagaaggucggcuauggaugagauugguauauuggauuuggaggagcagcgggagagguaaacaucugcaguuagucuauuugcuucucuggucagagucgccucuggagucccacagaaugccugcuggaauugggucugauaaagcagugaguggggaagggaagcuaggaggggauaucaggugguccacgagagauggcagcagugaggaaaugugaccacagcuagaguucugcugcacuagcuuggaaugagacuggggaauuuggauuuggaggggcugagggagaagugaagaucuguagucagccuauuugccuuuuguuuuugcaaagggccuacauuauugggacaagggaauugaguaaacaucucauuuaaaaacucuacaaagcucauucuuacugagguuuagcuguuuguuuuuaaaauaaagcucuucaggguguagcaagcaaccuuuuuguuaauuuccagacuuucuacaauguugauuuugacacuuuaccaguguccuuuuaccuuuauggaggaguggguuuccagcagucuucuuuuaccuuuuagacacaguucuccaucuuuucuuuauucuuuuuauauaaaguuggauguaccaaauuuuacaguugccuuucagaugacuacuuuuuguauucaaaaguggaaauuauaaagauuacaauucaacaaaagguaacuuuauuacuuucaagugguugcugauuuuguuuuuuuuuuuuuugagauuuauuuauuuuauguauacucggauacugucagcuuucuucagacauaccagaagagggcauuagaucccauuacagaugguugugagcuaccaugugguugcugagaauugaacucaggaccucuggaagagcagucagugcucuuagccacugaaccaucucuccaacccccuguugcuuaguuguuguggguuuuuuuuuccauauucuagcuuauacuuauguugaacuuuaauucaacuuggugcuuuuuuaauugggcaggcauuuuauguagacuaaccaguaaguacugguggguaaguuccauuuaugagcuauuagcaugaaaaaaaguuauucuuggcauuuuaggaccaagaaacuuguuucuaaguuaaucauuuguugcuuuauuuauacaaauauuauuauuuuuagugacacuccauuuuugcagcuaugacuauggugcagaaauauaaguuaugauuuacuaucgugaauauugagaaaaguagauugagaagaguuguuagugcuuugccagaugcaauguugcaugguucuuccugagcuugucacugauccaaaaauaaaguuuacucaagagauuuuaaauuauaacuccaugcaauguguugugguagauaagguuguuagaagcacuugacuguuguuacuuucuagcucuguaauuacaaucuagggucauuuaaugguucucuauuggucuauccauagcucaaaguacuaauuccaauuuguuaguauuuuuguuuuagcuuucucaaaugaaacacagaaaacuaguaaaaugagaaaaugguuauuuaaacgauacuugguuuuccaguguuuggacauauuuuauugacaaauuaucaaguaaauccaagauuaccuggcaaauuagcuaguagaagagcaauccuuuaauuaaugauaaucuuaauuaagaauccuuguaaaugagauaaaugaugacaguacuuuuuagagguggacauuuaaaacagaauaaauaauaauuugaaaguuacacacaagacagaaagaacauuugacuuuuaagucaguggauucuccuuagugaaguugaaaucauugacuucuucagucagauucucaccauuuuaaacagcguuccuaauucaagcaauucuauugcccuagaaacuuucuuccaagagauugaaagaauguauuggggauuuauaacccagaaauauugacucaggaagcaagaaaaggaagaaagaccagauguaacuuaagaagguuagcucaagugcugguucucuguuucugucucuucaugaaauucaaccaguaguugauuguguauuuuuaaaguaauugaucauuugcuagucaaaagaaacaccauuuagaaaaaaguguuuuaaacccaacccauuauucuaguuuucaaaauaaagggauaacuuuugcucacuaggaaaguuauguaaaucagaauuucuuaagauacacaguagaaggaaaauagaaaaaaaauauucaauauaauauucuugugagaaagguaaaauuuuaaaaggaaagauaugaucacuucauuccucuagauuguuuuaaaagccuuuguucucuuguaucccaagaguauacguuugcuuguuuguuuguuuaauguaugugaguacacuguagcuauacagaugguugugagccuucaugugguugcuggaaauugaauucuuaggaccucugcucacuccagucaacucugcucgcucagucccugcuuacuccagcccaaagauuuauuuauuauuaugcauaagugcauuguaucugacuuuagaugcaccagaagagggcgucagaucucauuaugggugguugugagccaccaugugguugcugggaauugaacucaagaccuucagaagagcggucagugcucuuaaccacuuagccaucucuccagcccgaguauacaguuguuaaccuuaacagucuccucuuauuuauacuaggauauuuaauuguauaugugguuguaccuucguguccaugggugauugauucuaggaccccagaggacaccagagucugugggugucucaaguucuuuacauagaugauaauauuugcauaaaaauguacauauaucuuuguaugcuuuuaagucuuauguuuauuauuuauacuuaauacaguauaaauguuuuugaagauuuuuaaauuauauguguuugugugaguuuugcacuuuagauuuuacauuuaaauaugauucauugacugcuuuugaguguaaagcaaccacaacaagaaacugguauugccaggguagugcgauagugccaagcuugaugacucaccagagucugcuuaguggagggggagcaucuacuguggcaaguuguucucuugacauccgcaugugugcuaugguguacacacaccccuuccccaaauuaaaagggguggggcacuucaaccaucauagagaguuauauauauacaacauaacaaaugagccucagucuacauaauaccucucauuuuauauucuaaagaacucuaugaaccagacuuaagcauagauccuaaacugaaauuuuuagaagaaaaugugaggaaaucuuaagucucuacguuuggugaaguacucuuggguaagacaccaaaagagagguucauuaaaguauuuaaaaagccagugugguggugcacgccuguaauuccagcacuccauccucagaggagacagaucuuuaccuacauaggcuagccaauagcucacacagugaaaaccugucucaaaaaagaaaaagaaaacaaaguauauuuauuuaucaacaaugauaaauuauagcauacaguuggaaaaaauucccacauuucuuaguguuuucaaauuccuggcauauuacuacucuuugauacccuagaacaauaaaucagcauucccagguauguucagagcuuucaaaauuauauuuuaaacauucuucuaacagucuucagacuauaugauuugaauaguuaaaauucuuauuugaagaguaaaauauaccagguucaacaguacuuacagagaaguacaucuuucagaaauauuuagugaaaaaacauaauuuaaaauucccaucuugccgaugugacagcccuuuagguugcauacgugguggggcacucaccacacugagcaucuuuuuagcucaucuuuuguagcuuuuagcauaacauucuguauauguuuuguuauauuuguacauuuuuuguuucgcuuuuauaauaggacuauguuuuaaauuuaauuccauguauucuacauuuauaccacguaauuugcaaacagggcuaguuuuauuucuuuuugugcgcacccugcccuucaccacucuccuuuucauugaauuauuugcuuuguuccugaucucaggauaaaaauguuuaggcucuacccauuaaauuaauuaggacaguagccauauagacugcuuuuuuagauguccuuaaucauguugauauuauuuuuguucuuuuugagaauuuuuauugugguaaauuucaucagaugcucuucuucauugauugaaaagcuuauaugauuuuuuuccuuacucauuuaaugugguagaugacauugaucaauuguguaacuguaacccuugccacacuucauaaauaaaacccuucuuauacgguucuuucaugcacugaugaauucuuccuuaugccuuggguguuucaguagaaugaaugaaaaugagaaguguugucuugugugcuuccugugagauuguagagacagugguaauugucccuuaaauagcaaaccaucuggguuugaaaaugccauaggguuuuaaguuucuuauucaaaauauaaaauagcuacagggcuauuuagauuuuucuguauauuaaugaaauuaugauauuuugugccuuugaagaauuggacuacuuuguuaaauuauugcacuugagugcaaauuguuuucaguaucaguuugauguugacaagguucaguuggugcccucuauuucauuccuaacaguaauacuuuuuguuaaagauuuauuuuuuuucauguauguguguacacugucacucucuuuagacauaccagaagaggucaugggauccuacuacagaagguuguaaaucaccaugugguugcugggaauugaacuugggaccucuggaagagcugucaauggucucaaucagugagccaucucuccaaccccauguuaauacuuuuuuucuuuucuuuuguuaaucuugguuuauugaucuuauaaaaggaucagcuuugcaucccaguugauuuucuuuuucuucuggaugguuguauagcagucuuuaauuguucucuuuuauuuccuucccacuguuuuuacuguuguuuuauuaggcuuuucucugaguucuuaaggagauuagauuauugguuugaggcauaucuuguuuucuguuauauauaugcagcccuuuauuagugcaugguauaucugugacccacaaauuuugcuaaauuauauuuuuaguuuuacuuaguuuuguguauuuuuugguuuuucuuaagauuucuucuuugucccauguguacuuagaaugcuauuuacuuccuuguguuuggagauuuuucuauuguuaauuuuuaguuuaauucuucuguucuuagggaccauacuuuguagaauuuccuuaauuauacuuacuuaguuuuguuuugugucccaggauauggucuuuaaugguaauucuucaaggaacauuuggaaguuauauguguucuucuguuagugacaagguguuuuguaaauguuguuguuguuguuaucauauucuccuauauucuuacuaauguauuuaauuauaucagcuauugagaaaugggaguugaguggauuugucuaguuuuuaauuguuaaauguaauguuaacauuuccuuucaucuuuuaucuaugagacaguaacuccaguuacugaauacuacugacuugaaagccuguuucuauuaguauuuuuauuucuauuaguauuuauaguagcauuuguuuacugauuauuuauauaguuuacuacuuauuguuuauagugcaugccuuuaaucccagcgcuugaaaggcagagcuagguagaucucugcgugugaagccagcucagucuaaagagcaaguuucagaacaaccaggacugcacagagaaauuaugucucaaaaaaaugcuaaaauaacaaaaaaauaacaacaguaccccaaauguuuguguuucgccuuguuuaauuuccuuuguuaucauuuucuuuaagguggaaguuguauggaaugccuaaaauguuuuuuuuuuucucucucuuaauaugauuguuaguuuuuuggguauagaauucuguguucugaauaauuuucuuccaggaaguugaaaguacacuuucauugucuuuuaauagcccuuauugacaauagguugaugcucuauuuuuuuccuacaauuauguaaaaauuuaucguggcagacagcuagguacauugcacugcaauccuaccaguuugggagacugagacaggaguuccaggccaaccuggguucauaguaaggcccugccaccuccccucucccauaaaaaagaagauggaauaguugguugaaacugaaauagaauuaucuucacuauuauuaugcuacaguuuuuuuuuuaagguaagaagaaaggggaauaaaagcaguuagagugauggaauugaaacaguccucuccccucuugucauuccucaauauuuuaaaaaaauacaucagcaaggaggaacgucccaguugcugagcucccauacuccuuaaaucuucucagucaaacaguucaaaauaaauaucuuuagugcuuuguaaucuuaacuuaguuaaucuacauauauauuuuauacccaauuucuuaaucuugauguuucaaaauuuguaauuuuucugucaauauuuuaaucugaaauguguauuaacuuuauuuuuuaagcuauaucauaucuuccaaaauccuuuuuauuuagugauuucugguuuuuaauccuagguuuuguguggacaguaaugaccgcacguuuccgauugccugcuggcagaaccuacaauguccgagcaucagaguuggcccgagacagacagcauacagaggucguuugcaacauucuucuucuggauaacacuguacaggcuuucagaguuaacgugaguauuuuguuuuuuucucuucuuagcauuugcaucaucuuugucaucaucaucauugucaucuucaucaucucuggaaauuagucugaauuuagauuuauuuuaaaacuaaaaccauuaaguuggaguauaauuuggacagucuuacuuaaggaagucuuuuugaugcacauuuauaacaaguauuccugcucauucagacuaagucuuucgaaaagugcuguccacugacuguuuacaaacagcagaauguccuaguucaugaacagaucagugguauaugggcaauuuuauaaggugcauaagggcgccagaaaagaauuucuuaucuuaaauacuguauauguuuucaggaaagccauauuuguacagucugaaugcaacuuguguuagauaaagauaaguaauaagacugaucuuucaaaaguauugucuaaaaagauuuauucaacaaauauuuguucuuguuuuuaguguccagcuucauuuguucauugucauuugagcuucgccuaugugauauguuaguucauucauuuucauugcuguaugcuguucuuuuguaugaacaaaccauaauguauccauuuuccuaccucuguuuagucuauauuuucuugguuuguguuuggauuauuucugcuauggacuuuuaaguucuuauucaugccuuaguaauauauacauguauacauacacauuuuuuuauuuuaaaaacuugaaauggaagaagaauguuuuacauacauaaacucccuuugcccagccugaacugcacucaccucuucuuucucuuuucuucccaaacuuucugaaagugguggacacaccaauaaguauuuagcauugugagagucuuuacauuaauacaaaaucauugucauacucccaaauuuagauuaaaugugugauacuaauuaauauguagugcauauuccuauccaagucucugccaugacauaucaucuguucccugaugcaucacuugugucucucuagacguuauuuuacuguguuuauguauaauaugcauggaauuuggaggcacacaucccacagugugaauguggagucagaguaaaagcugugugcagcuuguuuucucuuucugccacuuuugcauggguuuuggagcccaaacucagaugcuaggcuugugagguaaaugccuuucucuacugugccaucuugccaguccugcuuaccacuuuuuuuuaacuuaaaauuuucuguauauuacuuaguauguagcaaggccacuaauuuaccuuuaaaaauucuaaauuucauuucauauuugaaaacaaguugcaaaaguagugaaaauuuuauuacuuauaaggaaauugcuuagccaacagcucaguguguuugcuaaaaugcaacauuuuaaauuucuuuuguauuaugucuacuaauagaugaagaguagauugccaaucagaauaaaaaauagagggaauucuccuucauaaauauuucugauuaagauaaaccgcaugcauuagauaauugauaaagaaaacgaggcuuuuuccuuuguuauagauucauauuaaaauucuuuuggagguguacacuuaaucuuauuuucaguuaauauaaaauuuuaguuucuguuucaauuuauagucuguauuuguuucaaaauauuauggacaaauuugcuguuuaaaaucuugcauaauuuuuuucuuaaaugaauaaauuguuauaauuuaguugaccauaauauacuguuaugcuguuucucaauguaguaucauuguacuaauuuuaggugcagacaugcuuaaccacuaguuccaauagagauauuaagauaagaacuuccaugcuagaaaacauucuuugguaucaccucaggucaucagaaaauucaaauaucauggaacaguguuuaugagaaaugccugcugauauguaauauacuuauuccuuuggguaauuggauccaugacauccaaacggagagaguuaugcucuuuuguguagaugguguucauuuuaacuuaggcgaauagcuuuccaguuauauacuuugccaccucugugagguagaaacaacuaguuggggauuugacaguucugauccugaguauuucauaauauuuguuuauuccucuuaagucucagaaauccauauuguggucagcuugugguagggacaccuagcacucucuuuucacggagaacacugaguuuucuuugaugaugaccaaacaaugacuugugacaucaucuacuagucuuuccuuuucauauugugugcugugcagggucuaauuguguacauugaguucuucagccuuccaaaugcuaagaugauagguguacucuaccacaccuagcuuccuuaaaaggcuggaacucaagugauguguuuauuaucaccaaagccugcuuuuucccaacugguagucauccugugaaagcuauuccuuuaucuuuucuggagggaaauugacauaagaaagguaauaaaaguauagguauaucuuuccuggaucuucuuucuuguuauuucucuggucuggacauagugagcuaagccugugauugauuuauuuccaaauuguggaauuugcugucccuuucacauucugaauccuguuaauuuuucagucauccuuccauuaaacacuucaaaaccagugcaucuauacuauauaaguugauuucuucagcuucugagguuauucuuccuaauuuucuaauuuacuuuuacuuuaguguagcagcuuaacaguaaacugugacaaagaagggcugagaauaacuggcuugucucuuuaguacugugacuauuagugacacacaaccaccauuuauuauuguugaggauuaacauagaggugacucauaccugcuucauuauagaucagagcuuagcuggaagucuuuuuaggcuggacuguaaucauuugaagguuuuucacuuaugagcaugacugaagacucuacugcugcugagggaucaucuguaugugaccucuuuguuuacacuggaauucauggcauagaaucugguuucaggugguguacacucugagagacagggagaaggggaggggaaauaauuguaaccauagugccuuuuccaagcuagccugaggaguuacuuaagguuacuuucacccuguugugcuuguuaugauuaucacuaaaucacacccaagagucaaggaaaggucaguagacuucucuugauaauaagcugcaggauucuggaggaucauguggguucaaaaauacugcuguggaccaacuaggaaaauguguuccacuauggcccacuguuagaggcauucuucuugccccaaccuuauuacucaaugacccucaucuucuuccauuuuaccuuguaguuuucuccagagcugcccacugcuucuuuguguuacaugaauuauuuaucuuuguguacuaauauuuaaaguauauaugaauguguaagaucugaguuauauauuuuuuauuuauguguaagaauaaauguguggugauagauauguguguuuuuauuuggaaaaacuaaaagacuaaacuguuagaauuuauucgacauacauugcucgacauacaauucauaguugcuucacaggcuccaauauuuacuuuuuucuuuuuagcauuuugagacagaaucucacauacuagcucaagcuacccuggaacuuaaaauauagcccagggugaucauaaaauuccuguuagucucccugccucaguuaccuucauguugauauuauaggcacaagacauuauaacaaguauuuacagaaaaaagaacaaagauugugacuugaaauuucuuuuucauguuucauuuucaccugguuuauauuuucucuuaauuucuuaaggaugaaauuuucuuaaaaggggguuguuacgacagacuuguuaugcuuacugucugcuccuguagcacaauuucaccuaacagaucucccauuuucucacaaaacuacauacauaauaauacauaguauuuacauaacaaucuguagucaguuauaaaaacgaaccaauaaauaguaaguaauaaauaaugucaauuaugucuaaggaguaacaaagcaaggaccuguucguuuuaaacucguuuuguuaacuauguccuugacuaaaucuacaaauuuuuuuuugaaggaagauauuauauguaaaggguauuuuaaaaaguaauuaauguggugcuugagggacaccucaacaguuaagaguacuugcuccuuuuacauauggcccaaguuaggcuuuuagcauccuauauggagucacaguugucugauuccaguuucauggaugaugccucuucugaccucuaagaucccacacaugcacacacacacacaugcacacacacuuuuuaagggaauuaauguaucaaacugaagaagaguuagaguuaucacuuaauaaauacucuucauuuuaucacccuagccaagacuguuugcuacuuucuucuuggucuguauuuuuuuuuuacaccaguguuuaagaaauguccaugagaacaaagccuauguagaacucuguucaucugaucauuuuuucucaaggauuguagguugucuauugacuguuuaaacacacauguacguguguguauauauaccacauauauucagcuuuuguaagugauuguaacaagacaguacuucaguacuaguuacucuauuuagccaaugaaaguuuaaaaaagaaugucuugauugcuuuaaaauauaagauuaugucauuguaugauacugggcuuuuuuuuuuuuuaaacuugaaaacauuuaauauauuaauguguucagagaucauucuuuauuugaacgagacagauaauuaugugaauuagaaggacuugugucucauugauaccugccuacagacaucuuauaaaaucaagauggucugaauuacacuaauuugauaaagagguaaaaugaugcuugauuuccaaagauagaacccaagcagcugggccauugcuuaguuugauauuuuagauuucuacuaaguagucauuuaccagauuugagacaacuuaauccuaguugagcaagguuagcuugaaaaauaucuuucauuggcugaucaauugguaauacugaauuaguuaacauuuuuguguuugcuguuuacaaagccaucaucuuaaaacauuucaucaauguuuauacuuuuuguuucucuaccauagaguuuguaugagaaauuaauugugacauacaguaacuugugaguuaccuauagucuuugugucuaugagugauagacacuugguuaagacagaaucugucacuggggccuggguauaacucugagcuuucagugccagugguucuuauuucuuaggguucacaccucugagcucuugguacuagaagcucucugcauguaguguuaacagcuuucccagcuucucuugguaaaucuagcagcucuuucuuugcucuggacaacucaauauacacuucacugcccucuggcugcuagguauuuucuggaccuugguguugguugcagcaagaguugugaacaaaaacugauucuuuagaggaucaagacccuauagucuaaaguuagcuuuucuuucccguaaguauaauccacccagcaacuauucucuagcuaaucauccuauaaaugaaaagugcccauaugcggaagauugucugcucuugauaugucuuaacuuccaaauggugaaacaaugcuggaauuuguuuucuauauuuauaugcauuguauguacauacauuacuuugaaaaaucuuuguucuaacauacaucacacacacaccauguaaacccccuacacacauacacgcacacaauuuuuaccugguaacuucuuuccuccucacugggaaucuguuauaguaauauacauuccucuuaaauauuuuuugggggguuuucgagacaggguuucucuuuauagcucuggcuguccuggagcucacuuuguagaccaggcuggccucgaacucagaaauccgccugccucugccuuccgagugcugggaucaaaggcaugcgccaccacgcccagcccucuuaaauauuauugauauuuuuuguuuguuuguuuuuuuaguuuuuugaaguccauauauccuuucuaaaauuuuauuuuauuuuaugugugugagugguuuugccugcauguaugcuugugcacuguaccuggcagccugauacaaaguuaaacaguccucuggagccagugggcagaggggagcugguguuguuggcggugggguuggagguggggcaggcaggaggugaggcugauuauaggaaaaguggaaaaaaagaaguaagggacaaguaugggagggccacuggugaguuccaggcagcagcgaguguaucucucauagccuucuuauacuacaguaccaugggaaggaaagccucaagcgaacagaaauaguuuugcuaaaauguacaaaagacauuuguucccguuccaaaaaccucucuguuccuuccacuaagguuaauagaaucuucaguucuuagccuugagccucagguacaccaccucuuagcauucuaugccucagcagcugggaaaucucccaauaggcccugacuucuugacucucccuggcagacagauuuuuuucuuuccuuuuccuuuguuucagagaagcaguaaaacaacugccgacaguguaccgcaugcauaccuggugcccuuggaagccaggagagagcaucguauccccuuggaauugauuaugagcugccaugcaguuacugggaaugcaggucuucuggaagcagccaguguucuuaacugcagagccaucuuucuagccuccuaauuuuuuuuuaacauaguaauuuguuuaguuuccacaaaggaaagcaacagcugcuguauaugaagaguuaguaauaguguuaugacuuuuuuuucugaauguguaagcauuuccuuuugacuuguuuaugauaaacaucaaagcugauaguuuuagcugcuucuuugauaguuuagaaaaaaauccccauguaaaaggagaucuggaaguagacacuuuacauugaauaaguacuuaauuuuagcacaauguuagcuuacaucuuggauucaguaauuuuucucuuuaacuuuuuuacugaugcuuugugaauuucacaucaugcacccugguccuacauauuucugucuuuccauauccacccuugacccuugcaaaccccuucccccaaagaaaacaaacaaaccaacuaaaaaucucacuguagaagcuguggugugucacuguuugucucauaguauacccuguuguucaaacagcuuuacuuguaaguguucauugcaaugagucauuggucugguuugagacaguuaauugcuucugcuaugaugucaauaguggaucuucucugagauuccuuuuggauauccugugucauggagauccugcagcuuugguucugcaggauugucccuuucacaagcucuagcaguucauaaaugggguagauguugggguggaccucaaagaccuggaucugguauugggugguagcugagucagucugucccuuaggccagcucacauacacccaugccaccagggacagcucugcagugcugcacagggaaggugcagccauguccaaggacugcagcugguaaggggcagggccagguuugcucaggccucagacaucaacauggcccuagguggcagaccagacuagggacuuccacauagccuuuugugguaacauaagccacugacaucaacauagacccccugcugcuggaaggccacagagccagacauagcccucaguggcauaugggccaggauauugccauggccuuagauggcagugcaggcuacucacaucaggcuguuccucaccaucucugcaucuccauuuucgcuucucuucauagugcacaaacuucucagcuucucuuucucucccaccuuucccucacauaaacuguucaucaucguggcaccugcuugugacuugucagcagugacaucuucuuuugaaagauaggaugauuaaugucuguccaacucaaagauuacaaggaaaauaaauccuuggccaaaguuaaacagagcacagaaaaacuguaauucagcauaggguccaguuuuaugguugaacagccacuugguaggccagugaugagaagcaaaugcagcaggacauggagucaguugggagucugcacuuuggagauacugcucuucuucugggcuaggaugcaacucugagaauaacaaccacucacacagucgucaguuuucucaaaggaugaaagcacaggcucauugacaccugaguuugcuacuggaucuauugauggacaggguaacccaccauuuuccaaggagcaagaaccacaacugccucugaguuuccuguuccaucuuucuuccaucacccaaggcuuuucuucuacucucaucucuacaccaccuucuuacucacuucuuucucuccgaucauaccaacacuuaauugcuugcuucugccaccuugucucauccaauacauuuuccuuuuauagugcuaggaaucaaacccuaggucucauucaugcuaacgaagcacucagccacugagcaguacuaccacgaugcuaucgucgugucacuuaaaaauauuuugauuuuuagauuuuauuuuauguguaugaguguuuugcucuguauguauauuuuuucaaaagcaugccuguugccuguggaguucagaaguggucauugcagauacucugcaagagcaacaacucuucuuaacuacugaaucacgcucuagcuccaggccauuuauuuuuauuauuguguaauucuuuuacuucauuuucuuuugaggcagggucuuguuguguagcucugacucaccuaaaauucacuguauaccagacuggccuugaauuugguuuucuuuaaugguuacuuuucacagucaacuuagcacaaucuagagucaccugagaagauagucuugagauugucuaguuuagguugauuuguguccauguuugugguggauuuucuuaauugcauuaaaauugagguaggaaagcuuagcuugaaugugaaugacacuauuucaugaauuaggcaaaaagaggggagaguguguguguaugcucucuuuacuguggauauacuaugacuagaugcuucaaguuccugcugucuuaacuucuucacaaugguggacucuagucaggaaauuugagcuaaaaaaggcccccuuuccuuaaguucaggauguuuuaucauggccacagaaaggcaaguaggauacagucuugccuaugucucugucucuugagugcugggaguaccggcaucaccaccaugccuguaugauacuacuugucauuauuaugagacagcuuauauucuuuuuaauuauauuuugugugaaaagucuacuaguuuugcaaaaauucuaggacaccuacuuagaucugguccuggauuauaugauaucuaguuaucagauggguaguuuaaauauauacccauaucaaaauuaaaacuaagaauucugaacaauugcuauauaauaagcaguguaguauagagaggcaacauaguauaauaaaaauuuggggcugaggacauuggucaaugauggagucaguacuugaggugguagguuuaauccccagcacuggaaaaauauuauuaauauuuuugugguuaucccaacguggaauaugaagaaggauuuucaguucaagaacuacaaugaguauauaaagguccaguauaacauuggcuaccaaacaaacaaacaaacaaacaaacaaaacaaaacaguacaugagccccagcaccuuugccuauuaagcuaucucaauggcaccaaucuuugaaaaaggcucaguuuaugcucuguuuguuuccacuuagaguuuuaugaaugcguuuuuaaaaauaaguugacaaaaacaucgccaugggguguguacaugcauuugcugugugcguguuuauguauguacaugaaggccagagguaaaucuuggguaccuuccucauucacuuucuguuucaacaccuuaucaaaaucacuauuauuugcgguuugucuauuaugaagaaccauuucuggaaguauuucuuuauccagaaaggugauccaagucuauccucugauaguugcugaaggauuuuggucuuuuaaggccuauuauaaugugccauugggcuaaacauagaggaaacucuccccuguauccuguugguccucagaagaacaucuuuauaaauagguacuucaggcaccaucaagguuaaaugauuacuuuuuuuuuuuuuugcuuuuugagacaggguuucucuguguagcccuggguguccuggaacucacucuguagaucaggcuggucucgaacucagaaauucaccugccucugccucccaagugcugggauuaaaggcgugcgccaccacugcccggcuaaaugauuacauuuuaaaaugcagaauccuuuuaguuuucagugaagauauauacauucauauaugugaacuguauaugcauaauggaucagguuauaguuauuauaaagagucccagcuuagcugugaacuuuuucuuuucaguauauuaacccuuacuuacacucacucaguccuagguucuauacaauacagcuaggguacuguugaaguaauaguucacauaguuuagggucaugaaacugcuuucugaagacgguaaguagcucucuguccaagucuacagagcugcugcucagucuucucuacagccaggucucaaacgucucucuuccuucuuagccuaccaacaaggaucuuuguuuacuaaggcaguuauuguucuuaaaacucuagcaacaaaaugcaguacauuguuaggaauaaucucuauuuguaaaauugcaauuuacccuaagguaucuguaguuguauuuauuaucacuugagcuauagcuauucuucaaaugccuuguucuuuuauugguccuuaugugaaacaagggaaauugaagggcuagcaauauuaacagagcgacuaaaaccacacauaaacuuuggaauuguuucaguauacuauuuuuuaucauucacugacucaacuaaucaaauauuaauuuacugccuuuuaaaaacauccuacugagaauuguuaguacauggcaaguuucucucucagcuguuuucuuuuuauucucauccuggcaauuuuaucugcucuauuuaucacccuuucagugacagccuguaaggaauaugaccauucugcacauugccugguguuucuuacaggcuuuccuuugaaauguggguagaaacaucugugaccuuaaauuuuuauaaucugcaugcccacuaaaacauuaaucugcacgccugcaaaaacauuauguggacaaaaccuagguuuugcugccagcaugaaucagagcugggccaugguugaaguagucuccuugugccuaauacuacuggauucauaaaaaaugcuucuguggauggucuugugcaagcaaggugucagguugcacucuauacucaagaaaaaaaucuuucccaaugaguuuauacuuggcccuggcauggguuguagucuuacugauaucuaagguaucaucaaggaaucuuuccuguuuucuugguacaaaaauuuggcuuuuuaaaugacuccuaauuucuuuaacaacugcagccuuauugucagcaauuuuaagugccagacuacauaauuuucuggccaaacuauguauuuuuuccccaaucuuccuguuuuguucugucuuguuugcuuuaaaaaaaaaaaaaggcuaacaaugacugaacuauucacugaccauucauagccugaguacugaauuucuuccaucagauuaauuaauacguugccuuuaaauucuacuucucucagugucuuaggcccagacaagaugcuaguuuuuuuuuuuugccacacuauaccauggaauguccuuuagucauacagucuucauucucauccaaaaucucacgaaccugggcuucauugucuauauuccuguuagccuucuccuaccuuuaaguccucuuuauaucauguguggucuauguagcucuuaccaucacaguuucccacaguucuccuuaaaugaauccuauaugcuuuagaacccuguuguuaggcagucacaguaucuaucucgugucuugacuuccacuuuucuauuagcuuucguugcuguuauacccaaauagugaaacaacuuauugugauuucauggucuuuuggauguguuaggcagaacaucauaugggaucuguaguagaauaaagcugcuuucuuuguggaagccaagaagcagaaagacaagaaggauccagggcaagaugcagcccuuagucuccuuacuuauucuacccuguugucuuagucagggguucuauuccugcacagacaucaugaccaagaagcaaguuggggaggaaaggguuuauucagcuuacauuuccaaacugcucuucaucaccaaaggaagucaggacuggaacucaagcaggucagaaagcaggagcuguugcagaggccauggaaggauguucuuuacuggcuugcucagccugcucucuuauagaacccaagacuaccagcccagagauggucccacccacaaggggccuuucccccuugaucacuaauugagaaaaugccccacagcuggaucucauggaggcauuuccucaacugaagcuccuuuuucugugauaacuccagccuguguccaaguugacauacaaaaccagccaguacaccugucauguuuccaguugcuccccaaauaguaucuccaacuauggaucaucucuucaacauaugaaccugugaggauauuuuauaucuaaaccauaaaauaugcacacauguuuucugucucuugcucucgaugccuucgugaccuguacacugccagcaaaaaggcuguugguauauguggucccuuugcuuuguacuuucagagccauuagucaaaauaaaggucuuuuggcuuuaacuuaccugcucuuuuauugugguguuuacaacagaaaguuaaugaagcaagggaugagcugauuauuucuuuuuuccauuugcauuuuuaaaauaaugagccccacuuguucaguguggccacauuaacaagagggucaaagagguccagugaaccccucaaaucuggcuuccucuuucaaagaguauuuucauuuaauauguuugaguguuuggccuauauguauuuauaugcagcaugaccauguauugccuaugagggccagaaaaagagcaucgccuggaacuggaguuauaggugguugugagccaucauguguguggggaugucuaaacccagguccuguggaagagcagccaauaaaugcucuuaauugcugaaucaucucacuggucucucacuugugucuuuaaaaucuuccucccacacuuuuuucaaaggucauugcuuuugaaacugaacuucucuccuggacugaaguguuucuaauauuguuccuuuuaaguccacaaguagcaucaucaggauccauucgcuaacccagacauacaaacaugacauucucucucucuucauuuuuuauuuuuuuaauaaaaaaauuguauuuacuuagaagcauucagaaugucaacaaaacagccgcaauuuuuuuuuuuuugcaauuacagagugguauucaauuaacagaacaauuaucuucguauaagcugcaucagagacaacugaagaugaaaaaaauaaaacccaaaaauaaaaccaaaagaaaaaaaaaaccaaacuacuguccccauauauaacuaauuugcgcugugcaccaacaagaaccugcuuuaaauuuccaugccaauuuacaacccccagacuguaccaggcaagguuaguggcuauugaaaauaccaccaggacaggguuaucuaaagacacauucgguaguguguuaacuauacaaaaaacacuguacaguuuaaaaacaaaucuuacacagccuuacauuucaauuuuuuucuuuaaaaggaaugaguuguguacagggggguuaaaugcuuuauagacaagaaaaaaaacugcgcuagaaccaacuuauucaucaucaucuucuucaucuucgucuuugucuuccucuucuuccuccucuuucucaucuucaucuuccucaucaucuuccucuuccuucuuuuucuugcucuuuucagccuugaccacccccuuuuucgcugcaucagguuuuccuuuagcucuguaggcagcaauauccuucuuguacuucuccuucagcuuggcagccuucucauagggcugcuugucaucugcugcaguguuguuccacaucucuccuaguuucuuugcaacaucaccaauggauaagccaggaugcucgccuuugauuuuggggcgguacucagaacagaacaagaagaaggccgaaggaggccucuugggugcauugggguccuugaacuucuuuuuggucuccccugggguggggggauguagguuuucauuucucuuucauaacgagccuugucagccuuugccauaucuucaaauuuccccuuuucuuuagcagacauggucuuccaccucucugagcacuucuuggagaagucugagaaguugacagaagcauccgggugcuucuucuugugcuccucccagaagguuugcacaaagaaugcauaugaggacauuuugccucucggcuucuaaggaucuccuuugcccauguuuaguugauuuuccuccgcacuugccccggcgcugucucuauggagcucaauguacugcaauggcucgcucucucucucuuuuuauuauuuaaagauuuauguauuauguaugcaguggccugccuguauguaugccugcaggccagaagagggcaucagaucucauuucaugugguugugagccacuauguguuugcuuggaauugaacucaggaccucuggauaagcagacaguacucuuaaccucugagccaucucucuagcuccaaaugugacauucuugauguguccuuuuuacccucaccuauagucaguucccuuuuugcuaaucuauuauuuuggaauugguccauugccacaggcccucugguccccugugccugaguagaaaagagucucuagaguagaugggcaagagauuaggaugaaaaaugacaaucagucaaacacacaagagagguguugaaucugaauguaauuuuccagucgagcaucagacuuuuauaauacagaauaaauugcagaacaaggcacauugaauuuuuccagguguaaaaggagugacuucaaaaggaaccagauaaauguauaacacuagagauuagcacagaugcaaggggagugacuacaaagggaauuuguagggaccagauaaauguuuacauuagaaauuagcacuuucugccaggcaagaguuuuacauuaauuguuaauagccccaggguaguuaacucuugacacgccucaagaauaauguagugucacugaccccaaaauucucuaggccucguuaauuuuuaucuauaucugaagacuguccauuuucaguauaguauacuaauuugcucuuggcauggaauguagucuguaauaagaauuucuaucuuagugagaauuuuagucucuaucuguaaacagcugaguaaaauggcaagugcuuaauuguuuacugaauggguaaagcuccuugcugcuaucuggagucuaagaacacugggaaaaggcuuuagcuauguuagaauacaaucuuaaaaggcauuuacuauaagguaaagcuauauagagugcacguggauccauacacuagacuaaaguggauuuggaaaauuaauuuuauggguuagggaaauagccaaagauccgggaguaaguuuccuugaaacucuuuccucaugagaaagcuuucagacuuucaucugucaagcugacuccaccggagucccugacaguccauaugacuuugucaucuuugauacucuaauuuaugucaccaaaauacuaacuaguuauacaguuucucuuaauugaacuuuuuguuuuuuagauuuauuaauuuuuuguuuuauguguauguuuugcugcauauaugucugugcaccauguacauacauggugcucauagaggcuagaagaugggcucugauccuuuggaacuagaguuaugaauuggugugagucaccauuugaguuuuagaaacugaacucagguccauugcaaaagcaacaaagacauuuagcuaucuuuccaauccuuuuggucuuuauuaucaacaucuccauuucaccacacaaagccauaugacugcuuuuguuucaaguuuuaaaaacuuuaaugaguuuuaaucaguuuauuuuugcauuuauacuggagguauagcaggaaaugaguauauuccaucauguucaaaagaaaagaaugcauuaaacuaaccuccuuagcagcuucuuuuaaaauuaauucauuuuguuuuauguguguacauguuuugacagcauguaugucuguggacacuuaugugccugcuguccaggaaggugggaagagaacaucaaauccucuugaacuagaguuacagaugguugugagccacuaugugggugcugggaauggaaccuguguccucuguaauagcaacaaauucucuuaaccccugaaccacccuuccagcccuaccuuagcagcuuuuaagaaguaaugcuucuuaaguacaguaaaaguaaagucuuuuccuggaccaauucaaccagaauggggagaggguagagaagauugcagcaguacuuaauuuucuuuuaaugcugguaaccaaaagggcaccagcacuauuugaagcacauacuucccuccauugguugucagucuuggcacaauuuuggccaguaagacaugauauguagucuuuugugugguaacuuuacaaguauguuuguucucuugaacauuaucagaugugagaucugcacuagaaugcagacgaagcagaagggagggaaccuaguucuugauuguuucucauuggcugauuuagcucuacauuuauacuuuauauuaugaaaaagaauauguccucgacucugagauuuguucugucuuuauuuggaaucuuuucugacuauagcccaugagaggaaauuuuagugguaaaauacaccacuauuguguuuucuagugaacauacuugaugugcuuaagcuauuuuuccuucaauauuggauuuuauauugcuguuaaaguaucugaaguaguugauauaguuacuauuuuugcuuaauacuuacaaauuuaggcuggggagauggcucagauggguguaaagaauacaagugugaaggccuaaaauuagauccucuguacucauauaaaaagcuggcauagcaagcagcacuugucucuaacuucauccugggguauggaaacaagaggauccuaggaacuugguguucauccaguuuaucguaaauggugagcugggcuguucaaaaauaagagagggggcaggcaagauggcucaauggguagaaguauuugccaacaaucuugaccugaguucaagcgcuggaacuugcaugguauaaggagagaacugacuccugaaaguugaacucaagcccccacauaugugcuguggcauguacauguguacuuguguagacacaaguagacaaauauaaaaguaauguaaaaauuauagagcacaguagaggagauauuugacaucaaccugacauccccauguacacauagaugaauauuucuguaugcauacacaauuuccuuacuguuucccaauaauauguaucauuuugcaguuuuauaauuaaauaaauauuuuuaucuuacucauuggauuucauuuauuguuaucuacucaugaugucacugugauaucuuaauuuaauuucuauuauuuuugaugaacuaguuaauuauuuuguuuuauuuauuaguuuuacucauuauuuaguaaauuauuuaaucaugucgggcaaaauuuaguagcuguggaacaugggaauaauaaugucuacauuauugaauugguaagguuaaagugcgacauuuucuaauauucuauaauuauaaaguuauauucugaaaaaucaaaggccuuccucaaauaucugugaaguuuuucccaucuucugcuuuuuagcacuuugacacaaaacuguauuuaaacuguauucaacuuucuagucgaauuuuaacaaagaauaaaaggcaucgagagauagcauugacuuauauacauauguacauauacauaaguuauuguggcaacaauauaaaauaacaaaaauaccaggauaauagucuauagaaugcauuuucaaucaaaagcuuaucuuuuguauuuauuauuuccucuaugaaguguuuucuuuaaaaaguauuaugucaugugagaagcuuuacucucaaccaagucauugauauaaauacaguggccauuguaguuuuaaacaaaaagacaaaaauguaugcaagaguaaaaagcauaaagcaccagguaugguggugcacaccuuuaauccuagcacucagcaggcagagaccuguggaucuuugugaguuuaagaccaguuagggcuacuuagugagauccugucucaaaaaggaaggaaaaaacaucauaagacauagccuauugaagaugcuuucauauuauuucucuuccagaaacaugaucaggggcaaguucuguuggauauagucuucaagcaucuugauuugacugagcgagacuauuuugguuuacaguuggcugacgauuccacagauaacccaguaaguuuaagcaguuaccuuucauuucuuguaguuuuucuuuguguccauuauauaaagcccuuuuuuauuuaaugaguuuuaguauuuuuuaauuagauucaauuuuuuuuuuuuuuuugccuguuaaacuuucuuugggauuuuagggugugugaguccacuccuguuauuuauagcuauaagucaaccuguaaguguaguacuaguuucauuauaucucagacaccuaaagguaagacuaaggcccauugcucuaaagagagaauaccaaacaugaaggauaagguaccuuuauauuagugacucucaccuguggguagugacccccuuaggaaacuucuauuucccagaauauauacauuacaauuauaacaguagcaaaauuacaguuaugaaguagcaaugaaaauaauuuuaugguuuggggucacaaccuguauuuaagggucucagcauugggaagguugagaaccaugacuuuauaggucuauauaaaugaaauugggguugccuugguguggauauucuaggaaaauucuuaauuuguuaguggaaauugucaaagaauauuuuguguucuuugaauguauuuauaauuugaauuauguuauuugaauaacuuagaagaauauuuuauaaagauucuuuucacaugagaaauuccauuucagaguugcacaaauugccaguuuuaagcuccuugguuuccaccaacccuuuagugcucccauucaugguucuucuuagaaguaugagguuagagaaauagaaaaaaagauagggucaaucauagauauguuuacuuugacaauaaagcauuauaaacugcccugaaaaaauacauuuaugaaccuagaugaaggauauacuaacacaucuuagcugcauucuuugcaauuuuaugugguuagacugugauagaauuaacaaaaacaugcuaucauauugauuaguguaacaaaauucuguuuuuguuuuuuuauuuucuuuuguuucaaacacaaaguguugcuucaguagcccacaguggccucauacuggguucucugccuaucaguguugagauuauaggugugcuaccaccucugcucaagaggaguauauuuugaaagaaagauuuuguacuguuuagaaaaauuguaaauugaagacaggguucucugaaucaguguuuuaauauuuauuguuuuggagggauggcucaguuagcuuccuccucuugcagaagacuuauguuuauuuucuagcacccauaugacagcucacaagccccugcaagucuaguucuacgggaucuaauggccucuucaggccucugugggcuccaacacacaugguacacauagacucaugugggcaaacaugcauauguauaaauuaaauaaauuacaaguuccauuuauaaggcuguuuuaauagaugguuaagagaaugguuaagagaaauuuaaguucucuuaaaagaggcguuggaaaaauuucaguguaacacucauauuuaaacacuucaagucauuauuugaauccaaggagguaaguccugaguuacguuugacauuaauaaaacuaaaaacuugguccuccuaauucccuaugcucauuuuuuuuaaaaaacagaacuguuauuuauaccacacaacuuuauauuuaaauguuuagaaagaccuaucuaaauuuaaggaagaguuuuaggaguucguuucuuauagugucucacuguuaauugguauaugugugcgcagguguugcauguauaugaaugugugggugugaaagacagaacaggaagugggaugucuuccucuaucauucucuaccuuguuuuaagauaggauuucucacugaccuggaagcuuauuguuuuggugaggguguuuuaccagcaagcuuucucaucuaccugucucuacccucuaaugccugggauuauaggcagaaacagccuagccuaguuuuuaugcgggugcuaaggguucagacucaggucuucaugcuugcacaguaagcauucuuacccauucagccaucucuccagcccuccgauugucacagugaaauuaccuuaaggccuuuaaggauaauuaauauauuaaaauaaagggcauucauucuuuaaagaaaaagcaagaggaguaauauuuaugaagcauuuacuguagauuuauuaauuaacuguuuagcauuucauucuuacuaugaauaaaaguauuaaguuuuuaaaugaaaaauaaaugcuuauaaaaguaguaaaaauuucaugaaaaauugauuaguuaaccaagaaaggauguuagcucccuucuaucuaacaaauccuaugcuuucuuuucaauggaaguuuccucaauaguggauggauggcauaggagcuaaaagcauuuggcauguaagccugcugaacagaguuuuauuccuggauccucuguaaaaaauagagaccuccaaaugcaugcuguggugugcacucaccccauacacaguaaaagagaaaaaugaugauaagcaugaaaugagauuaucaucacugaucaaaagaaauauucuaaaaauucccauaugauuguaguuuuaaaucuaaaauauuuguguuguauguauuauguauaugugucuauagucuauauauuauacauauaauauauauauacacacacacacacacacacauacuaguuuuugaauauagaaguuauucuugccuuuggcaaauagguauugaaauuuaauugaauucauuaaaaaugcaaagaacaucuaaaucuuuuguuuuacagccaauacagaaucuuaucucacugucucuugagcaucuuucuugcuuacauacagauaagcuuuggguuuuugaaguuuguaaccuuaaacauuuaucacuuuagcuuuugcuauuauauacuugguuugguuagaugauuuguuuuguucuuuugucuuuuguuuuuuuucucuuugucuuuugaacagggugucaucauguagaccaagcaucaugcuugcuuagaacccuuaaucuugucucaguuucuacugcuggguuguaggugugcucugccacugauuuaauauaauauacaauaauaaucuguacuaaauauauuuuauugaggaaaacugaauuauauaauauuuauuaugcauaauuuuaaaaguaguuaagguucauuuaucaccauguuguuaaguuuaugauucuugugcauuucccuuuuucguuucuuuuucugcauucaguuaguuacaauaucugucaguaggacaaagauuagauuauagauaacuguuagcuugagcuuccuucagguuuuuaguuugcauuauggacauacuuuguugguuccucucuuugugauuuucaaacuuuggauuacaugaagauuacacaggaggagacauagacaggucacauagaagaugggucauuuuuuuuuaaaccaauuugugauuuggcauaaguggcuaguauacuugcuuauauuucaaauguuaguguucuguuuucuuuugaaagauguguuucuucugucauacuuuauagacucuuauuucugauuguacacauuucuuugguagccuaaugaguguccuuaguagugauacugggcucugucuuaacuuuuuuugggagagagugacagaagaacucaagaaucagaauauuucagaaagaagcagcaguauauacagaaauucaagguuuucaaagugaccguacaagaaugcuaaauuugaggacucucgugaaauuucauuuuacuguaaugcugugauaggaaagaucggcuuuaagcaauacaugagacuaugaaguuccauugaauccuauagcugucugcuuauaguauagccagugaccuaagguagcaaauuaaagacaguuggaagguuguuggaauaaugaaaucacuuugagaaguaauaguuagcuaagaauuguggcguacacuuuuaaucucagcacuugggagacaaaggcagaaccucugagaucgagaucaaccuggucuacaaagugaguuccaggauagcuagggcuacacagagaaacugucccaaagaagaaagagaagugguaauugggaaugaagaaaagugagugagugcuggagugaaguaggagauaaagucauagacuguauugauguggcuauagauaguugagugagauuucagggaauagacuuaaaccaacucauuccagcagcauuuuuaaauucuaggugauuuuucacauuguuuacuaaguugcuaaguuauauugauguccagauuuuaagacuaucuuauuccuuuguauaaaacuccagggcauccgauuaauuaugucauaaucuuguauuuuugguaaacauuuuaccccuuccuuuucucccucuugcucuggcccugcucacuccgggccauuagguucuuuauuuguuucucauuacagaugguugugagucaccaugugguugcugggauuugaacucaugaucucuggaagagcaguugaugcucucaacugcugagccaucucaucagcccuuugguaaacuuuuauucuaguaguuuguuuuauuuuuccuagugugcacugguaaauuauuauaucauguaggcauuuuuaccuuuuccuguccagucuuuauucuguuuguucaucauuuuuuccuauucauuguugcacugcaaggguucacuaggacauggcuuaauagaaguaacaagggagguuugucuuuuucccaucugaaccuuucauuaucaacugugcugugagcccuagguguuuuguuuuuguuuuuuuaaaagcuaaauaaacauaaucaaagcauuauuuauauaaaauaaaauuuaauauccauccauagugaaaaaccaaggcaaaaguacccuuucaguaugaaaaagaauaugugcuaaacaccagcugauuugccuuagggaaaugaaaugaaaugaaaugaaaguauacauccacuggaaucaaugaaguaaauauuccuaguuggucugcuggcagagauaagaauuucaagguaaugcacuuaacuaccugagaaacugaguuaaauugcaacuccaaggacuaugaguauuacaaaagaguucaaggucagccuagaugagaccccaucucaaauuuaaaugcauagaaaggcuugggaauauaucucaguggcaaugcacuugccuagcauguauaaagucuuaggugcaauccccagaaccucaacacagacaaauaauuggugauuauuaucaacuauugguaguaauauaguacaaaagguaacuucuuguaaacagucauuuguucuuauaguuucagcacacaggaugccaaggaagaagaauugugacuauuugugugugugugugugugugugugugugugugcauauaguguugggcagucagagaacaacuugguaguaguuaguucucuccuuccacuauuugaguuuaucuaccuugguggucagguuugguggugccuuuauccacuaagccauuuuguugggucuuuacuccuuuucuaaaacauucuggcugguuuuuuuuuuuuguuguuguuguuuugguguagucugguauuuuuuguuguugucauugaggaacucuuggauccuucuacagaaacacaguauauaaucucucagcaagaguccacauggcuuauaagucugcgcuugucuggaccuuagcuucucacugauuucucccuuucaaaacucaccuucaguuaucuacaguucugccuuucugucuucugacaucucaagcacauugccugccucaaaaacaggguuugccguuggccaaagaacuaggaagguguaaaucuuaccuacugcaguuauguuuuguuuguuuguuuguuuuucaagaaucgauuugcuuuuuuucccuuuuauuuacagcacauaguauaucuguguugguauguucaugccauugacaacauucaggaaaucuuaaggauuagaaaaaucaagccagagggauaccuccagaagguggugagaagagaaggguaaagauguuauuugaagaaguuaauggcccaaagcccccaaauugaagaaauaucugggugguuaaaaacuguuagcaaaucuggugguggugguggcauacacaucgaaucccagcacuugggaggcagagacaaggggaucucugacaguucgaggucagccuggucuacaaagcaaguuucaggacagccuguuauacagagacccuuucuggaaaaacaacuguuggcaaagagaaucuugaaagaagugagagagcaaugacucaacagguucugaggaucuucaguguaauagguaaucuugguacaaaccuuguaagccagaggcaguggaauauauaguuaaaauaguagaaaaaaaccccacaguaacagacagucuguauccagcaaaauuacaucaggugugagggaaugccaagucugauaccuguugucucagaaggcuuggauauaaagccaagcuaguuacaucguaagauuuagucacaaaacaaaauaagggcuaggguggagguuaaggcauucucaucucagguaaaugacagcggagagaguuuauuaccacuagauuuaccuuaaaugcuuaggguacagccuucaaguugaaguggaaaaggacuggacaguacauuagggccacauuauaaguuuucccacaggauucauuacuuuugugacaaaauaucugacagaaacacugaagaaaacaguuauuucagcuuauaguccaugaggggcuaguucaucaugacaggggcuagugaagcagggcacaguggcucacaucucggugagucaggaacuagacaaauguggacaauaguucuuaaagcuuagcaacagcauagcaauuccucaccagauauugagagucagacuauccacucugucuguacuccaaagauggaaaguauuuacacacacacacacacacacacacacacacacacacacacaaucuuacagaaaaauucaaauaaaaaucaguauuuaacaaaauagaugccaacauuugaagauagucaaggccaugaacuagauuugccuaagcggauaaaccauauuuuauauuggggagaacagccuguaaagauaaguaguaccaaucuugggguuaaagagauauauugaauuuuauauaggaauugcauauaauaggacuuguuacauuaauaaguacucaauaaauguuaaaauagaacaccuuucagugcuugccauacuaaugaggacuugaguuugauguaacaggaaccccgugaaaaagcugaacacaggcagcagugcauguuuaugaucucaacagcgaggaagcagagacaggaagagccuugugacuuacuggccuuguuucaaaacauaaagugaaggguuagcaagguggcucaguggguaaaugugcuugcugccauaccuaaugaccugaguuugaucccugggacccaugugguagagagauaugacuccuaccaguagccucugaccucagugucaacacaaugguguacuuaugugcacccaauaaaauguaaucuuuuuuuuuuuuuaaguaagguauugaaugauugagaacaccaaacauugauuucuacccuccacauguacccauguaccacacacagacuccaguguggcaugauuagauauauaccauacacacaagaucaaaaaagaacaaguuuggaaauuauacuugcaauaguuuaaaaaaaacaaaaaaaaaaccaaaaaaaccccccugguauccacuaguuaagauaaacaguaguugcuguggaaguuaaggcuuucaacauaaugacaauagugucaaguuuaaucugacaaucacauaaucuuuuucucaugaacuuuuuccagaauauuagcauguauugaccacauuggggcagaauuuuguccuuguucaguucuccuucaaaguaaaauauucugauaaaagaaacacaaauacuuaaauaaaugugggaacacagcuuagaaauaauauaauaauaagcauugagaaacuuaacaacauucaugaaugacaucagugagacaggacuuagggucuugaauaaaacuaugaagguggaacucuuauaacauguaguacuagacuguuaaauggcagaguucacaauaaaaagaucauugaaucaaaaaauccuugugagagacucagucucagaaaagaugcauggcugcugaggaacacuauccaagauuguccuccaguuuucacguacauacauccuccuguuccagcacacaugcucaugcagacauacagguauacccacauacaugugugcaugugcauacuugcauauaugaauaugcauacaaaauaaaauaguuuauauauuucagaauauacucaaggcuugaaaacauuuguauacacaaaaauuugugcuuggauguuuauagaacuauuacucacaaagaacagaauaaccuaaccuccaaaagggacacaucuauggauuggaauauuaaucaccaauagaaugcaguuuguguaguucguuuuaguuaucaacuugauacaaucuagaacugacugggaaagguguuccagugagggacugucuaaguuggccugugggcaugccugugugagauuuucuagaguauguuaauugauaugggaaggagagccuaaaaguagguacugugauuccauggguccuggaauguauuaaaagaagaacgugagcaaagcacaaacacaaaugcuuauuuuauugcuguuuacucuuaauccuggaugugauauaaauaccuagcugcuucaagcuccugcagcugugauuucccuucuguuguggacuuuuaguggaccuggaacugugagcuaaaacaaaucccuucuccuuuacauugcuuuuguugauguauuuuaucacaauuagaaacaaaccuaagacucagugauauaccacuguucucucacuagcaugguacuaauuuuaaaaaguuuaugguacuggauacagagguguggugccacaugcuuguauuccuagcacuuuggagucucuggcaggagguuuuuaaguucaaagccaaaguuagcucuaaguacugacacugucucaaaaaccgagucuaacauacauugauuuuaaauuuuuaaaaauugugaucaagauugaauaucuuuauauauuuaaaugcuauuuauccucuaguugugaacuuacugaccauugucuguccucuguuaacauuggucuuuuucuucuugguguauaagauuuuuuucuuuuaugaguugauuuguuuuugaauuguuucauuuuguuuuuuuuacauuuacuuauuguggguauauguaugaugguaugcaccugugccacagcacauguguggggucagagaaaaacuuuugagauucaagccucccucuaccccgugauuuuaagggauuaauuucagguuaucagacuuggcugcugaaccaucuuuccagccccuuccuaggaauuuguuuuuuguguuuuuuguuuuuguuuuuauuuaaugauuuuuuuuaaaaacugugaacucuugucauuuaacagccuggcauuacauguuauuaguguuccaccuugauggcuuuaaucaagacccuaaguccugucucacuuaugucauucauaaguguuguuaaguuucucaaugcuuauauuauuucuagcuguguccccacauuuauuuaaauacuuauguuucuuguaucaggauguuuuacuuugaaggagaauugaacaaggacauuaggcuuugaguagauuaaucucacauuuagauaaucauuaaaauaguuuaugacuauacaguuuaguuugcuuuaaugcaacaguuugagcaaaaguaccuuggggacaaaggaguuuauuucaucuuauagguuacaauccagcaggggacauuaaggaagaaguaugacacagaaacccugaagaaauuuugcuuacuggcuugcucccauauucuuucuugacucccuuucuaaugcagcccagauguaccugccuaggaauaguaucaccuucuagaucacuagcagucaguaaacaacauuacuucuaauuuacuguuucucauuaaacccuuuucaaaaaugcaaucuucaaguggagcagauuuucaauaacugauaugcuacuucuucagggaaaaaagaaaucucucuucuuuauuuuuucagagguggcuggauccaaacaaaccaauaaggaagcagcuaaagagugagcauacguauuauuuacuugauguuuugcaaauaugccuuauaaagaugauggacuaauauaaucugauuaauuauagcuguuuuuguuaauucuaggaggaucaccuuacaauuugaacuuuagagucaaauucuuuguaagugaccccaacaaguuacaagaagaguauacaagguugguuuauggaacuauuucuuuugaaaacauuaucggagaucuaauaugaaaaauaaaauuaacuaggccaaaaauaaauaaccaugcuaaaaaugugaacuuccaaaccagcauauagaaaguuuauaaaugucccaagguaacuguuuccuccaugaacgggagagcaguuaggaguuggacacccagagccaacucauccagcccaggcagcacugcaggacuuaaaggaagaagugagguggcacuggaaugcauccaaggcauucugcauggugagaguuucugggguguggauauauagucaugcaaaagcauauucuugucuuuuucucucuuuucacuaaguacaacauaaaauuucuaaaauauguguauugccaucaugugcaggagguauuuuuuuaaaguuuuucuaaagauuuauuuaauuauuauauguaaguacacuguagcugucuucauacacaccagaagagggcgucagaucucauuacagaugguugugagcuaccaugugguugcugggauuugaacccuggaccucuggaaaagcagucagugcucuuaaccgcugagccaucucuccagcccacaggauguacacugaacuuuauaaaagauguugcagggauaaagcacauuuggcaucuauuugcccauuuuacugcacguucuaagucuuuucuuuuucuuuuucuuuuuaauucuuuuaagguuuauuuauuggggguggggagauggcucagcaguucagagcacugacugcucuuccagagaaccugaguucaauuuccaguaaccacaugguggcucacaaacaucuauaaugaaaucugaugcccucuucuggugugucuaggguguacucacauuaaacaaacaaacaaacaauuuuuuuaaagggggugggcaggagagauggcucagcgguuaagagcauugacugcucuuccagagguccugaauucaauuccaagcauccacaugguggcucaaaaccaucuggaaugggaucugacgcccucuuuuggugugucugaagacagcuacaguguacucauuaaaugaaauaaauaaauuuuuaaagaauuuuauuuauuuauuuuuuguacaugaguacacuauuguucucuucagacacaccagaagagggcauuggaucccauuacagaugugugguugcugggaauugaacucaggaccucuggaagaguauucggugcucuuaacugcugagccaucuccucacccaccacauucuaagucuuugcuugucauuucuacuuaagaaaguacucaagaaugacccauaugaucauuucagcuguuuccuugagaauuagguaaauguuuaggguauaaguuagaaaaauaaugacagucauuacaguaagcuguauaagugcagauuacuauauuuggugaaaugcagaauuaguaauuuaaaugaaaagaauuagaacacuauucccuuuguacacuucccagauauaaggacauaggugguaauucaucccagccaaaaaaucuuugaccuucagucuguccugccugcagguugugcugggacagggguagcacagaacuugugggaauggccaacccaugagugguucaguuuagccccacaccacaagugggaguccaagccugacaaugccuggauggcuucucagcauuacuuuagugaugcaauagaauggaguaccagaagaauaaagcuauugaauuaguauacacugcuauuucucgauauuuguagaguucucaauaauaauugaagcuuuuaaaugacaaaaccaaaacaacaacuauaauaacaauaauaaaagcuuuuauucuucucucauguguuacucccagucucccacuacucccagucucuuugcuuacuuaauaucucccccagaucaucuaacuccuccucuguuucccuacagaggccauguuuauugcuucaguuucugugagcuccuaugagcccugauaauugauucugugugcuguguucuugugauguccucuggcuccuacaaucaucccuucucuucugcaggguuccucuggcucugccuagggucuggcugugggucucugcaucagcuaccaaucaguugcuggaugaugcaccucuggugauaauugggcuaggcuaugagaauagcagaguauaguuagggaucaugguuguccugguuucuggccaaccaggcaguaucaggcauggguucccauuuguggugugggcuuaaaucaaaccacucauguguuguucacucccacaaguucugugcuacccuugccccagcacaucuuguaggucaagauuguaggucaaauuuuuguggcuagguugauguuaaaaauguaguucuugaaaaucuuuuauguuugcugaugcuuuuuugaugauaagaggacccuggaguacaggugccauguuugacagauggaauauuugcaaccacuaauaaaugucuuuaguuuacugucauagcucuuagguuuuguguugccuuguuccuccuuuacaaccaugcuuucuuuugucucaccaugcaauuuacacaugacauuuagcaaguauguugcugaugguauuggggggggaguuguuuguuuuuugagacaggguuucucuguguagcccuggcuguccucgaacccacucuguggaccaggcuggccucgaacucagaaauuugccugccucugcuucccaagugcugggauuaaaggcguacgccaccaugcccagccuuuuuuucuuuuuucuuucucucucuuuuuuuauguuaaauauuuaaaaugaucuuuuaucauuguaaguaauauucaguauauuaaauuuuuuccuaauuuugcaggaacuccaaggaaauuagucagaauuaaugaacaauuuuaauuauaaaacacuauaaauuacuuucaauuuccagcuacauauauaacaaauuuaaaacaucaauuuacaaugagauuucuaacauuuuuuuuuaauguuuaugauauuuguuaauacuaaacuacugccaguuauauuguuauaguuauuucccuuguugcuuugauuagauacuugacuagaaacaacuuaagggaagagggcuuauuuucacuuggaguuuaggauugauuacaggccaucaugacaggauaggcaaggcagaaagagcuagaggcacuuguguuauuaacauccauaagcagaaagcagacagagaacagaaaguaggucuggguuaguaaaccucacagccugccuucacuucuucuagcaaggcucugacucuuuaagguuccacaaccuuccacaagagcagcaccagcuggauaccaaguguucaaauuccugagcuugcgggggcauuuuacauucaaagcacagccagguucaauauucaguucacacagaaaacuggauuuccuauuagaacuuaaaugugugccuguguguaauagcauauacuggaaauaauggguauauuucacugauaauugagucagaacuugaagaaaguaacaaaaaguaagcaguugagaauugugcuugagcugucaggauaggagaccauuuuuauuuuuauuagauauauuguuuaauuucaaaguucuuuauuucucauaaauauuacuauuguuaaguuguggcacaugaccccauuucauuuaaucauuauucuauacaaaaguauuucucuacccugauuaauaaguuagaauuuagauagguagauauucugauauaucuguuugcuuagauguucugaugcaaugugacucaaaugagugcaacauauauacauuccucaguuaauucuaguguuuuagcaagggagccagggcuauugaacaauuuaauguugggcuaaagaauauggcucaguguuaaaagcauauacuguucuuacagaguacucuacuuugguucucaguacccaugucagguggcuuauaacugccuguaacccugauuccaaggagaucccucuucugaccucugugggcacauguagucauauagucauacccacacacugauauauacaagcauagacaaugguuccagauuuugcucuuaauggguuuucugugugugcaagugugcuugucucuuaaguguguauagguuucuugugcuuucucuuugaauuuuuauuuauuuguuuguuuguuuguuuguguguguguuugucuugacugauucugguuugugauuauauuauauuauuuauuauuauuauuuagaugcccgcuuuucuuuuuuuaauuagauauuuucuucauuuacauuucauaugcuauccccaaagcccccuauacccucccugcuccccaacccacccacuccuguuuccuggcccuggcauuccccuguacuggggcauauaugaucuucgcaauaccaagggccucuccuccuauugauggccgaauaggccauccucugcuaaauaugcaacuaaagacacaguucuggggggggguacugguuaguucauauuguugggaaaggaucuuuaccaauccuaaaucagauaggggacuaauauccaauauauauaaagaacucaagaagauggacuccagaaaaucaaauaacccuauuaaaaaaugggguacagagcuaaacaaagaauucucaaccgaagaauaccaaauggcugagaagcaccugaaaaaaauguucaacauccuuaaucaaaucaagucaaaacaacccugagguuccaccucacaccagucagaauggcuaagaucaaaaauucaggugacagcagaugcuggcgaggauguggagaaagaagaacacuccuccauuauuggugggauugcaagcugguacaaccacucuggaaaucagucuggcggauucucagaaaauuagacauaguacuaccggaagauccagcaauucuucuccugggcguauacccagaagauguuccaacuuguaauaaggacacaugcuccacuauguucauagcagccuuauuuauaauagccagaagcuggaaagaacccagaugguccucaauagaggaauggauacagaaaaugugguacauuuacacaauggaguacuacucagcaauuaaaaacaaugaauucaugaaauucuuaggcaaauggauggaucuggaggauaucauccugaguaagguaacccaaucacaaaagaacacacaugauaugcacucacugauaaguggauauuagcccagaaacugagaauauccaagauacaauuuguaaaacacaugaaacucaagaagaaggaagaccaaaguauggauacuuuguuccuuagaauggggaacaaaauacccauggaacgaauuacagagacaaaguucggugcugagauggauggaaagaccauccagagacugccccacccagggauccaucccauauacaaccaccaaacccagacacuauugcauauaucagcaagauuuugcugacaggacccugauauagcugucucuugugagacuaugcccgugccuggcaaauacagaaguggaugcucacagucagcuauuggauggaacaugggccccccaaugaaggagcuugagaaaguacccaaggagcuaaaggggccugcagcccuauagcaggaacaacaagaugccugcuuucuaauaagaaauagaaaggaagaaaaucuauuuucaaauaaagaaaagaagaaauacuuaagugugaugauccugauuguuaacaaguugcuaccuuuuugggaauaguuucccuuucacacacacacaaaaaaagaauguuugcucuuccuccuuacuuugagauagaaaccauuuugaauuagugggaagaaaaagcaguggcaucaaaagucucccauuguaaugaauggacguuaguguuggcaaguaccaguguuaguagaagugauuuguuuuaaacuccuaaaacauacaacuaguuaacuaaggcucacccauauuuuagaauuuugacccauuuccuuggcuacuuuagaacuugccuucugguuuuuaaucuaauaauucccaucuuuaaccaaaguuaaauggauauguaaaugauuuucaguaaguauaaguacuauuuuuauagaauuuuacaaauauagcaaggauauauauuaacuuuaauuuacagcuauauaacauuuuauacuaaagaccuuuuagauuuuuucuucuuuuuagugguuuuaggccuuauguuaagugguuuuaugacuuauguuaccagccccaucuuaaaguuuugauuaugaaaucaaauagauuugauagaauuguacugugcugaauaaaguaaauaauauuuauguugaguuuugaauuuuuaaaagcugacugaagcccauaaaucccuguuuaauaucauggcauuuguuuuuaugccaauauuuucagcacaggugauuuugcccagguauugacuaacuuacccucuaucagggacagacggacagugccaucuuguaaggaccucagcaguguaucauguucaugcuaaaggaagaugacuguuuaaacacuuuaauaccagagcuauaguagaagacagaauucgauucauuuucugaugaaagagcuuucuuaacuccaguggaaguggguaguuguuuuuccacaggaagguuaagaagaaaaugaucuguacauaacaggccugugcuuguccugacuuucuguuuccacagaaaggauguuuuuuuuuuuuuuccccacugguuucuagugugcucuuuggcuccugugucauugaugcuuaaauugucuaugcuuccaguucuucuugcaugaaccaauguucagacuguugcuuuuaagucuuuucuccccggcagcagagaucuuagaagucugaguugguuuauaauacaaauaagauacucaaauauaaaguuccauauauuaaugauuuuuaaagauuuguaaucaauucacaaaauccuauuucuggcauuuuuccuaaugugcacauaugcugaauuuauaugugcuaaugaguagauaacaaaaggaaauauuuaaauauuuaauuuuguuaauguaaguauagacuauagaagaacucaauuugaugauucuacuaaauaucuucuuuuuuuaagguaucaguacuuuuugcaaauuaagcaagacauucuuacuggaaggugagcuauuuuuaaggguuuucuuacaguauaguuuaaaaauguuuuaaauucuguauuaaauaacucaugacugauagcuguaauuaaguuuuaaaaaugguuauagguaguauuaguuccuuuuaucagucuuuuguuggggauuugguuucuuuuguuuguuuuuugagaccuugucuuauuaugaaaucuagauuggucucaacuggcagucaucuuaacuugaugaauguugaaaucauaguugugugccauaaaacccagcuuaauuauauucauugugguuaaaaugaaugcagauagaaacuuccagugucaaugguauaacaaacuacaguauauuuaaaauuauauuuauccuugaguuguauauuguaucuuuugucuuacuagauuauccuguccuuguaacacugcugcccuuuuagcaucauuugcuguucaguguaaguaucaaucuacuuuaagucaaguugcuuaugguuuuguaguuuauauugauaacacauugcaggaguucuuaagauauauaggaaguagaaacuacugagguaauucaaugaaugucuaggugguuagcaauuauuuuuacaugaauuaccgcaacuuguuuaauguaacacuacaaacacauucauuucauaauuauauaugaauuaaugacauugcugauuuuaguauaauuaaaguauuaaagugugauuauuuucuuuuucuuauuagcugaacuuggagacuacaaucagucagaaaacuuggcaggcuaccucucagauuauucuuucauuccuaaucaaccucaagauuuugagaaagaaauugcaaaguuacaucagcagcacguguaagcauuuguuuaaucuccuguuugauaagcuuuauagacaacuauggugguuugaauagaaauggcccccauacauucauguguuugaaugcuuggcccauagggaguagcacuaacaggagguauggccuuauugcaguagguauggccuuguuggaggaaggguaucaguguggaggugggcucugaggccuccuaacucagccuacacccaguguggcacacagucuucuuugcugcuugaggaucaggauguguguagaacucucggcucuuuccgcauuaucugucuguacacugccaugcuucccacaagaugauaauggaugaaaucucugaaacuguaagccagucucaauuaaauguuuuccuuuauaagaguugccauagucauaaugucucaucacagcagugacucuuaucuaagacagaaaccuuucuagagggaagagugucuuacaucauucuuauuuuauuguuguauuugauacaggaauuucuacuaucauuauaaagaaauacguggaugauuuauauuaaaagcauuucauuguuaauuuaucacauauaugugcuuuguuuuuauuucuguaacaaccauaaauuauauguaaacaguuuauguuguauuuaauauuucaucucaauuggcgguuucuacccugcuuagauuauucaguucccagauaaaagacacaacuuuuauauuuauaaucauuuuaauguacuagagcuggguagauaucuacucucuaagcuauuaugucuacuuuccggucgguaaccccaagauauaacuuguucuguuccaccuggcugcucuuaacuccacuuagccaguucucauggucguguuuucaugacuuaccuaacccauacauagcaucuucuccucucuccaccuucuuuuccuucuuccucuucaugguccuccucagaccuaggaacugaaacccuaccuacuucucuuuugccuaacuauaucaucuuuauugaaacaacaguaaauuaacgagcaagacuacauaguaucacuuuccuuaugugaggauucucuugucccugaggcaaccagggccaguauuuagaauuacaauauauagcaacagaccaaaccucaacaauuacccuuuuuaaucuaaaugaaagauucuuuuauaauaauaaagaguauauaauagaagcaauuauggauggaaauuauuacauaagugacacaugaaaaaguccaguuuguuugguuuuggcagcuuaagagaaaguauuuuauuaucuauccuaucuugaugaguuugaguuuuguaucuaaaucauuuuuauccuaauuugcauuauuagcuuaaaaauaucuucuuaguucuaaaauaucuuccuaaauacuaaacaacuucagguuaauugugagacuguaacuaucuagccuucaaccccaucagagacccaaggaagaauauuuuuuuuucccccaagacaggguuucucuguauagcccuggcuguccuggaacucacucuguagacuagacuggccucaaacucagaaauccgccugccucugccucccaagugcugggauuaaaggcgugcgccaccaccgcccagcugaaagaauaaauauuaccggaguaugcaggaaguacagaaaugcagcuuccgaaguuauagaaaugacagcgacaguccucaaaacuguggaacaucuaucuuuagcuuucuggcccagaauaucucauagaccuuuugugaagcaggaauuaagaaggacugacucacuuacccugucuuggcagagcuuggcaguugacuucccuguaucugcuuguccuuucuggacggcacucugucugcggaugauguuagggcauuuucuuuccccaguggcucgugugccaugauugaaguaacucccuaugggguuucugaagcucaucauucuuucccaaguugauggcuuacugccaggaguugacaugucucaauauuaaaacagauuuuaaauaauaauuuaaaauaauaauauuguguuuagaugcauuauucugugaacuucaagguuuuugaagauuuauaguguaucuaacuaaacauugucugucuucagcuagcuauuaucugugcaaccccaggauggauauuucugucguaaugcagacuaguaucuuacaagaccaugagcuugauugacuuuuaauuugcauuacuuaauuauccuaaacaguuuguaaucgcagcuguuaaaaggauugggacuaagccuuguaccuuaaaugaauuacauaaggauaauaccuauauaagaagugaaccguacauauauuaugucauaacaaaauuaaucuuaaauuuuguaucaguauacaaagauaccaaugaaaaccuaaaccuguaucaauauacaaaauucuguaccaauguaacaagauauaaccucaaauuugcaucaaaauauaaagauuucuaucaguguaagauuauggcuuuaaaauauuauuugcuuuaagaguagauucaauaaucuuaccccuguuuaucuaauuucuuauauuucuuuuuuuggggggggccuuauauaaauuuuuuuuucaucuuuaaagauuuuuuuuaauuauguauuuuccucaaugacauuuccaauguuaucccaaaagucccccauacccucccccccccacuucccuacccacccauucucuuuuuuuggcccuggcguuccccuguacugggguauauaaaguuuguguguccgaugggccucucuuuccagugauggccgacuaggccaucuuuugauacguauguagcuagagucaagagcuccgggguacugguuaguucauaauguuguugcaucuacaggguugcagaucucuuuagcuccuuggauacuuucucuagcuccuccauugggggcccugugauccauccaauagcugacugugagcauccacuuauguguuugcuauauacccguuuuuuccuuuuaaccccuucccuuaccuaauaaagaaagauagaaaauaagaaaggaaagauaaaucccugaaucuauccuccucccugucaaagaccauaauuauuuguaaaucaugcccuaaaaugcuaacauaucuaucuauaauucaugaaauguucaaagucauccacugaaacuuaagggagugggacaacagucuucuuauaauuguuuccugcugaacuggggugaagauuuccuuuuuggugacccaagagaauuagaaaaauggcuaagucaaaagaaagcuuacuggccuaauucguuguccagucuuaauauguugauuaagugaagucuugaaugggucagucugaaaggcuggauaaacagagaucaucugggauuagcaguccuuccugaagcuguuccagacgcaagugucuggaaacagcaucagguuaagacaggaccacagagcugaaacagcaggucuuagaaucucaacaucuugaaagugaagucugucagggaugcccuccuggucuuucauucuguaauauauaaaccuuacaaguaauauauaguucuauuuguauggaaugugcacaguauaccgaucaauuaaagaugauuuucuguuccuuguuugaacaggugaaaaauaacugucuuuccuuagaaguuacuuugaucauaugaccaaaauguaaauauaaaucuccauuuuugccauaugaaaggaugguauguaauaauaagucgugagaauucuauagccaacaagauuuauuugcuauguauagcugaaguucuggcaggagauauuuuccugucuagucaguuucuacaacuggagggaucagcaaauaucaccuguuuguuuggccuucuugauuuucuccugucuguugccaagauauucagggaaucuccuuuuaucaaauaaaucugauccuuauuauuuuggaaggaauccaaagccuuuuuuuuuuuuuccuguuaacacaaauacagagccucucucccaacauagcauguccuuuuuucuuccagccuaaaaucauuaaaaaauauagauugacccaauuuggcaggcccuuuucuacuuaggucugcuccauuuugaccucuuucaaagaagaauuacaauaccaucauaaccauugaacauauaacuaccuucauuugauaauuuaaaacaguuaaaacauuuuaaaacaauuauuauucauugagacaggguuucucuguguagccuggggugacuugaauuugcuuuguagauuaggcuggccuugaacucacaaggaacauauuugucccugccuuugucucucauguauugagaucaaaggccaggauuuauuaauuaauugucuauguacccaugaaaauguaucaauucccauuucuuucuuccuucauuguagauuaauaucuuugugaauaaauauaucuauauuccccuuucucuuuaaauacauuaauccaauaucuuucucuguuuucacguuuguuuaaauuuccuuccauuuacuauauaaacauauucccaagcaaccuugucucugguuuugccuuggcuguguguccugugcuaggguaagucauaaucagcucuccuucgggauuccacauuuaaagagacugguugcuaacuacagcaugacacccuauuguaaguuaacucuuacguguugucuucaguucucuugugggagccccacauuccaaagagacaagcuagcuguucagaguagugugaaacucuauuccauguuaguucucaugaacauagcuuuucuuuuucuguuggaugaaaguaaaacaacuguccuaaccccaacucuggguucccauaaugaccaguauaucuuuccuaaggcaaaaugcuuuuuggcaacagaaaagcauuuucuuuugauuugaaauuauaaaacauaccuuaugggaauaaauauacccauauuuucuacuuuuuuauuuaaauuuaagacugauauauauuaauuacuuaguucuuuaaacaaauaauuuuaggggguuggagagauggcucacuaauuguugcucuuacagaggacccaaguuuaguuuccaguacccaaaucagguaacucacaccuuuaagagaucuugaugcccuuuucuaaaagggcuccauggguaucuccacacacgugcacaugcccacauauaaguacauaugcauguaguuaaaaauaaaauaaaaauuuaauuuuaaaaacagaaauuuuggaauaauguguuuauaauaugcauuacaauugacuuggucauuuucuuaguuuucaggguucugaaguauguugauucuguuuaauagugaauaaagggagaaaaguaacaaucuaaugaaauucuuucauuguuuacuuguuuacuuauuucauucucaguaguauucaacuuugagaguauuuuuaaucucaucauuugugauauucuuucagauuuacauacuuauguguaugaguguucugcauguuguauguaugucuauggaccaugugccugccuaguaccuacuaaggucagaagagaguguaaggacuagcguuuaaggaauugaaucugggucaucuucaagaguaaccagugcuuaacugcugagccaagucuccagauguaugugacaucuuuucaagaacagaauuguuguuuuguuuugauuugauuugguacagggucucucugcagagcucugaguauccuggaaugccauguaguccaaccucaaacucauagagauccaccugccucugcuucccaagugcugggauuaaagaugugcaccacuaugucugaauuaaccuuaagaauuguuuuuuguuggcuuagaauucauuuugugcuaaucuuugauucagaauagugacagaacaaagauauuguugcauauugguuaaaagucugaacuagaguucuuggcuuaaacuacuuacuaucuuagaaccuuggccauagucccguuucuguugcuuuguuuccuuagauuuaaauuugagagaauuaaaauauguugaguuagaaauucugaaucuucuucuuucuuuuuguuuuuuguuuguuaguuuuugaaaguuuguuaguuuguuauuuucagaaaggguuucucuuuguaucucugguaguccuaacucaagcuguagacccagcuggcuucaaacucagaauucugccucauaggcacugggauuaaaguuaugugcuacuaccuccuguccagaaauucugagucuugggauuauauacacaacauucucaagcugcuaucuaguaaaugguagguauuaaggaaauauuagcucuuacugccaauuugguaauaauuuaaaugucucaaaaaauuaaaaaacaauagcucaaucccuaauuuugaacagccaaugggccaagcauggcaaauacauguuuuuauauguaguacaauguauauuuguuuauauuguaaaucaaaaauaucuaaauaugucacugaauauuuggaucaaaccuagaccuugcucauauuaggaaagugcucuaccauugagcuaauugguugguccgucugucugucagucuguauauuaaauauauuuaaaguuuauauuaagguauagauuaaguacauuuacgucucuauauuuuaaauacaugggggaaauaauauuuuauaggaugugaaauuuucugaaaucuacugucuacaaaugaacacucacaugaacagacauucucaguuuuuguguuggauuugggaugcuauugcauucuaaaguucuugauacugaaguaauuuauccagaagauuugaaaauacuguuuauuccuuucugguaaaaaguuuuuugaccuugaauuuacuguagacuauaaccacuuaagaauuuaaacuaggccagccccaggccaccuugggcaugaacucggcugauggucccacaguccccagaggacucuagacauugcaggcacccuagcacacucaggaucuuaggaucacugaggagagucagccucuagggagggcucugacccccgggacucaggugagagugccaucuuguaucccgggucucuccgagaccaguccgcacaggagagcucgugggccgcagaaucaacaaaacuucuuggacagggucccuucaagcuuucaucuucagccaggaggcagagcugagcuccagaccucugugcaccuucccugcaagaggagagcuugucugaagagagugcucugaccacugggacuuaagagagaguuggacucuuaggauugcugacagaggcuaacagaaucacaggaggaacaagcuccagccagagacagcuagaacaucuaacaccagagauuaccagauggugaaaggcaaauguaagaaucuuacuaagagaaaccaagaccacugggcaucaucagaacccaguacucccaccacagggaguucuggauaccccaacacacccgaaaagcgagguucagauuuaaaaucauauuucaugaugcuaguagaggauauuaagaagggcauuaauaacucacuuaaagaaauacaggagaauacugcuaaacagguagaagucuuuaaaaaggaaacacaaaaaucccuuaaagaauuacaggaaaacacaaccaaacaggugauggaauugaacaaaaccauccaagaucuaaaaauggaaguagaaacaauaaagaaaacccaaagggagacaacucuggagauagaaauccuaggaaagaaaucaggaacuauagaugugagcaucaacaacagaauacaagagauggaagagagaaucucaggugcagaagauuccauagaaaacauggacacaacaaucaaagaaaauguaaaaagauccuaccucaaaacauccaggaaauccaggacacaaugagaagaccaaaccuaaggauacuagguauagaugagaaugaagauuuuucaacuuaaagggccaauaaauaucuucaacaaaauuauagaagaaaaccuaaagaaagagaugcccaugaacauacaagaagccuacagaacucaaaguagacuggaccagaaaagaaauuccucccgacacauaauaaucggaaaauccaaugcacuuaauaaagauagaauauuaaaagcaguaaggggaaaaggucaaguaauauauaaaggcagaccuauuagaauuauaccagacuucucaccagagacuaugaaagcuaaaagauccuggacagauguuauauagacccuaagagaacacaaaugccagcccagucuacuauucccagcaaaacucucaauuaccauagauggagaaaccaaaguauuccaugacaaaaccaaauucacacaauaucuuuccacgaauccagcucuuuaaaggauaauaaagggaaaacuccaacacaaggagggaaauuaugcucuagaaaaagcaagaaaguaauccuacaacaaaccuaaaauaagauagccacaagaacagaaucccaacucuaacaacaaaaauacaggaaggacgaauuacuuuuucuuaauaucaauggacucaauuccccgauuaaaaaaacauagacucauagacuggcuacauaaacaggacccaacauuuugcugcauacagggaacccacuucagggacaaagaaagacacuaccucagagugacaggcuggaaaacaauuuuccaagcaaauggagaagcacauucauuacagaaacuuuagugaagcucaaagcacacauugcaccucauacaauaauagugggagaccucaacaccccacucucaucaaugaacauauccuggaaagaaaaacuaaacagagacacauugaaacuaacagaaguuaugaaacaaauggauuuaacagauaucuauagaauauuuuauccuaaaaccaaaggauauacguucuucuuaucaccucaugguacguuuuccaaaacugaccauauaauugaucacaaaagagaccucaacagauagaaaaauauugaauuuaucccaugcguccugucagaucaccacggacuaaggcugauuuucaauaacaacauaaauaauaaaaagccaacauucaagucaagccgaacgauacucaaugauaacuuggucaaggaagaaauaaagaaauuaaagacuucuuagaguuaaugaaugaagccacaacauacccaagcuuacgagacacaaugaaagcaguccuaagaggaaaucucauagauccgagugccgccaaaaagaaacuagagagagagcauacacuaguagcuugauagcacaucuaaaagcucuagaacaaaaauucauccaagaggaguagacagcaggaaauaaucaaacucagaauaaaaucaaccaaguggaaacaaaaggaauucuacaaagaaucaagcaaaccaggagcugguucuuugagaaaaucaacaagauagauaaaccuuuauccugacuaacuauagggcacagggacaguauacuaauuaacaaaacagaaaugaaaagggagacaaagcaacagaaccugagaaaauccaaaacaucaucagauccuauuacaaaaugcuauauucaacaaaacuggaaaacguggaugaaauggacaauuuucuagacagauaaccagguaccaaagauaaaucaggaucagauuaaagauucaaacagucccauauccccuaaagaaauagaagcagucauuaauagucuucaaaccaaaaaaagcccaggaccagauggguuuaguguagaguucuaucagaucuucaaagaagaccuaauuccaguucuccucaaacuauuccacaaaauacaaacagaagguacucuacccaauucauucuaugaagccacaauuucucugauaccuaaaccacauaaagacccaucaaagaaagagaacuucaggccaguuucucuuaugaauaucgaugcaaauauucuaacaaacugaauccaagaacacaucaaaaugaucauccaucaugaucaaguagaguucaucccaaggaugcagauaugguuuaauauacguaaauaaaucaguauaacccacuauagaaacaaacucaaagaaagaaaaccacaugaucucauuagaugcugagaaagcauuugacaaaauccaacaccacuucaugauaaaagucuuugaaagaucaggaauucaaggcccauaccuaaauauaauaaaagcaaucuacagcaaaccagaaaccaauaucaaacuaaauggagagaaacuggaagcaaucccacuaaaaucagggacuagacaaggcuguccacucucgcccuaccuauucaacauuguacuugaaguccuagccacagcaauuagacaacaaaaggagaucaaggggauacaaauuggaaaggaagaaguaaaaauaucacuauuugcagaugauaugauaguucaguagcuggauauaaaauuaacucaaacaaaucaguggccuuucuuuacacaaaggauaaacaggcugagaaagaagcuagggaaacaacacccuucacaauggacacaaaugauauaaaauaccuugguuugacugaagugaaagaucuguaugauaacaauuuaaagucucugaagaaugcagucgaagaagaucucagaugauggaaagaucucccaugcucauugauugccaggguuaauacagaaaaagugacuaucaugccaaaagcaaucuacaaauucaaugcaauccccgucaaaauucuaacucaauucuucacagaguuaagggcaauuugcaauuucaucuugaaaaacaaaaaaccuagucucuuagucaggguuucuauucccgcacaaaccucaugaccaagaagcaaguuggggaggaaaggguuuauuugucuuacacuuccauacugcuguucaucaccaaggaagucaggacuggaauuuaagcaggucaggaagcaggagcugauacagaggccaugaagggauguuccuuauuggcuugcuucuccuggcuuguucagccugcucucuuauagaacccaagacuaccagcccagggauggucccacccauaaagggccuuuccccuuugaucacuaauugagaaaaugccuuacaguuggaucucauggagacauuuccucaacugaagcuccuuuuucugugauaaauccaucugugucaaguugacacaaaacuagccaguacaccuaggauagcaaaaacuguucucaacaauaagagaaccucugguagaaucaccaugucugaccuuaaguuguacuacagagcaauugugaaaaaauuugcaugguacuagaacagcgacagguagaucaauggaauagaauugaaaacccaggaaugaacccacacaccuauggucacuugaucuuugacaaaggagcuaaaaccguccaguggaaaaaagacagcauuucaacaaaugguguugccucaacugguggguuaucauguagaacaaugggaauugauccauucuuaucuccuuguacaaagcucaagucaaaguugaucaaggaacuccauauaaaaccagagauaaugaaacuuauagaggagaaaguggggaaaagcaucgaagauaugggcacaggggaaaaauuccugaauagaacagcaguggcuggugcuguaagaucgagaaucaacaaaugggaccucauaaaauugcaaagcuucuguaaggcaaaagacacugucaauaagacaaaaaggccaccaacagauugggaaaguaucuuuaccaauccuaaaucugauaggggacuaauguccaauauauacaaagaacuuaagaagguggacuccagaaaaucaaauaaccccauuaaaaaauggguuacagagcuaaacaaacaauucucuacugaggaauacgaaugacugagaagcaccugaaaaaauguucaacauccuuaaucaucagggaaaugcaaaucaaaacaacccugagauuccaccuuacaccugucagaaugacuaagaucaaaaauucaggugacaacagaugcugucuaggauauggagaaagaagaacacuccuccauuguuggugggauugcaagcugguacagccacucuggaaaccagucuggcaguuccucagguaauugaauauaguacuacuggaagaucuagcaauaccucuccuggacguauacccagaagauuuuccaacuuguaauaaggacacaugcuccaccuuguuuaaagcagccuuauuuauaauaccaugaagcuggaaggaacccaggugucccucgacagaugaauggauacagaaaaugugguacauuuacacaauggaguacuacucagguauuaaaaacagugaauuuauaaaaaucuuaggcaaauggauggaucugcaggauaucauccugagugagguaacccaaucacaaaagaacacacaggauaugcacucacugauaaguggauauuagcccagaaacguagaauacccaagauacaauuugcaaaauacaggaaaagaagaagggagaccaaaauguggauacuuuguuucuucuuagaaugggaaacaaaauacccaaggaaggauuuacagagacaaauuucggugcuuagaaggaaggaaagaccauccagaaacugccccacccagggauccaucccauaaacaaccaacaaacccagacacuauugcauaucccagcaagauuuugcugacgggacccuaauauagcugucucuugugaggcuaugccagugccuggcaaauacagaaguggauguucacagucaucuauuggaucaaacacagggcccccaaugaaggagcuugagaaaguaccuaaggagcuaaaacggugugcagcccuauaggaggaacaauaugaacuaaccaguaccccccagagcuugugucucuuguugcauuauguagcagaggauggccuaguaggacauuaauuguaggagaggcccauguucucgcaaagauuauaugccccaguacaggggaaugcuagggccaggaagcaagaguggguggguuguggaacaguacaggggaggggagggcauaggggacuuuugggauagcauuugaaauguaaaugaagaaaaaaaucuaauaaaaaauuauuuaaacuaaguugucuggugugauguggaugcuguuuuccuauaaaagccaucccuuuauaaguaaaaaccuuucauauagccuauugaaaucaaugcuuugaagauaaauuggaguuuuaaauuuuaccugaaaaaaaguuccuuaaauaaggaaugggguuguauugccacaagguaguucuguuugaaauccgauucauugaaucuaaaaacaaaaacagaauuaccuaguuuaauugggaggacuguguaguucacacaguuuuuuuguuauuauugaggggucacauucauuuugauuguguauugucaagugguuggcuccuacccaauauuagugaugaaaaaguugauacccucgguguuauaguucucugcuauauugcaugcuaacucauauuacuaaggauguuagcaguauauuugaaauagaguagaccuuguaaaaugacuguaaauuagguaguucugaaauuuuuguuuugagaaucacuaaaaauauauauuaaauauaaagcuuuaaccucagcuuuccuguggaauuguauuucuuuucaucucagauguaaccuaauuauuuauucuccaucuguuauuguuauacuaaauacgauauauuuugaaacauagcaaacauuguugaaauguuaaaacagauuaauagaagaacuuuaaugaauacaugauugcucuaaaaaucucuugauacucauguuuguacauguuaugacaguguauauacauuauaccccauauauuucauauacagcuaugguauauaaaaugaauuaugagaauuguuuuaaaguuguguaaggaaauaagugccuaugucaauagcuauaaaaucagcuagagguuuuaaaacguacaguauucuuuuccuuuuauucacuucugaccuuuaguacuccccaguguuuuauaguugugggugucuuuuaaauuuuuuuauaauuuuuuaaaagauuuauuuauuuauuauauauaaguacauugcagcugucuucagacacaccagaagagggcauuagaucccauuacagaugguugugagccaccauguaauugcugggauuugaacucaggaccucuagaagauuagucagugcucuuaucugcugaaccaucucucuaggccuuaaauuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguaguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauuacuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauuugcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguacguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaacuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggcgggggcaccuguccuccgguccggacgguggcuggcuguccccggcccacaaagggugcugccucagccccucugugcuucugccuguuccagaagcugucagguucucuggcgcacccucucaccuguucagacuaauuuccuaaguucggcgggucccggaccaagauggcgaccgcugcugcuguggcuuaggccgccuccccagccgggcgggcaccuguccuccgguccggacgguggcuggcuguccccggcccacaaagggugcugccucagcgccucugugcuuccgccuguuccagaagcugucagguucucuggcgcacccucucaccuguucagacuaauuuccuaaguucggcgggucccggaccaagauggcgaccgcugcugcuguggcuuaggccgccuccccagccgggcgggcaccuguccucuaaauuuuuaaaaauaaauuauuucaccauucuucaacuucccuuuccuacuugugcuccuuccagugcucuguguguguguauauaugcauaugaguacaguuugcugagucuauuuggcuuauguuuuuauaauuuuaggguucaacauuuggauagccaauuagaggguuuaucgcugggaaaauuuuugucucucucaggaagcauugguuguuuaucuaggggugggaucuuaugaguuucccuuuuuccuguuagcaauucuguugguaccaccauuguuuaagcagcuaaauuguugggguaucaugaaugaagcuuaucauuuguagaagacacacucucacuguagacuuccugguuugcugacucuuguagucuuuuugcuccccucuuccucaguauucucugagccuuagguucaggaguuguuauagauguauucaguggggauagcauccucccccaugauccauuguuuuucugcauuuugaccugcugugauuuuucuguaauggucucaguugcuuuaaagagacagcaaaaguaccuguuugauaaggggauaggagcuacaguuagcucugggcauaaugaaaauauuuaggauguaauaaugaauuauacuguuuuagaaaaaugaugguaguagguacucuacuaccuuaagguccaugauuucacuagcccuagcucucacuguauucuuaauauuccuggaaaauaaagaagauaaucugggaaaaauaugaauuacugcaaguaugaccuugauauaagguagauguuacuauauaaaacuuauacuccacauaaucuuuuuguaacuuguaacuuuuuuauggaucuaguuuuugaccugauguuuucuuuacaguggccuaucuccugcagaagcagaauuuaauuaccuaaacgcggcacguaccuuagaacucuauggaguugaauuucacuaugcaaggguaaguaaagaaaaauaaacuuagaugguguaaggcuucuuuccuugguaucaaggauuuuaaaaucuuuuuaguauguguacagugcugggguuauggaaccagggccucaaguauuuuuauacuuagccauaaacuccaacuccucaaaauuuuaauuucuugagagaacuagguaacaagauaauuugugcuugcugcugaccuaguugcacuaaaaauuucccuuugcccuuuuguuuuugacacugagcuaucucagggucaaauuuuacuuguaaaucccaugucugccugucaugucuuuaaaucuauagucacugcauuuucauaguguaacucuuuaucuguuugaaacauuuuugauuuagagauuguuauccucugagguuuauucgugaaagguuguccaucauauguaguuauauuccuuuuuguguuuuaucaagauuuuuauauuucuuagaaguacugaaguacagcuauuuucaguaaaauuauagucaucacuugagucagcaguggaauuuuuauucccuuagacacuuucuugagccuaauuaggcuaauauuagccauaaaggggaaugugaugguuuguacauucuuggaccagggaguagcaucauuuggagguguggccuuauuggaauaggugugaccugcuuggaguaggugugucacuguggguguuagcuuaagauccucacccuaguugccuggaagucagucuuccacuagcagccuuuggaugaagagguagcacucucagcucugccugugcaugccugccugggugcugccaugcuccugccuugaugauaauggacugaaauguaagccaaccccaauuaaauguuguccauauaagaguugcccuggucauggugucucuucacagcaauggaaacccuaacuaagacagggaguaagagccacaauuuuccuuaguuaaauuauuuugaacuugccucaauacacaaacaugcauguucaauauccacuggggaaguauucaaaguucuguccuacauugcuuuugucacucagaguuucacccaaucaaguucuagggaaugagcucuaccuuuuauguuucacaaagcuaugucugucucauuuuugcccccuuuuuugagacaguguuucuuuguauagcuuuggcaguccuagaacucacuuuguagaccaggcuugagcucacacauaaguuuuaacuggacauuuuaaagcauaaccuaauuuuaaaaugugguucuaucaguuguacaguuuccucuuuaaaagaaaaaaaaaaaaaaccuacugcacaaacaccaaugggaauauguaaaaaccuaaguuuaaaaauaauaaaccgcaaauaugaaaggagggugaagaaacuuaaaaaaaaaaaaaagaggcaaaaaguuaacgacaauuaaggaauuacaagauaucaaucucuugaggaaagcagacuaucuggaauacuaacaguggacagacaagucugugacacaggcccuuaauccagugcacaugaggcagaggcaggcagaucucugagcucaagccuggucuacaaaguuuugauguuugccuuuuuuuuuaauuagguauuuucuucauuuacauuucaaaugcuaucccaaaagucccccauacccccccuccacuccccuacccacuuacucccacuuccuggcccugguguuccccuauacuaaggcauauaaaguuugcaagaccaaggggccucucuucccaaugauggccaacuaggcuuuuaugaggcaauaacaaacuguuaggauuuauuauuagguacaauuaaauuuuguguuaucuuugaaauguguuuuuuuuuaaaaauuaauccuguuuuaauuauuuuagagugucauguauuuauuuauuuugaaggaucaaaguaacaaugaaauccugauuggagugaugucaggaggaauucugauuuauaagaacaggguacggaugaauacuuuucugugguaaggauuucuaccaauacuuuuguuuuuaucauaaucuuacuaaguauaauaauucauauaaaaguaaacagucuuuaaacuguuuuaguuuugucagcuuacuugugugauacaauauauacuuuauuuugcccucugggaaccuauccaaagacagcaagauaacuuauuucaauuuguuuuuuuuuuuuuuaaaucuaauuauuuuuauuucauguauguugcuguuuugacugcauguaugucucugugugaggguuuuggguccaguggaaauggaguuaaaaacaguugugagcaggccauaugggugcugggaauugaacucagguccucuagaagaaccaucagugcucuuaacuccugagccauuucuucagcccucaauaugguuucuuaaaaguauuaguugacagaagccauguagugaaaggcaauggcaagcaagcgagugaguuuccuggaaaaaguucacuguuuugcauggcugcaauggguacacucuggagaggcccagccucagagacuucaucccagguuugcuucucccugcugauaugccuuuccugcuauuauuauauagccuaaugauccugggcaucagcccacccauuugggcaauuuccuucagaucagcaugaauuuauucuguagaugaauugauaaauuccugauuugauuccaaugauuuuaggaagaaaguuuuaaggagaugguuuuacuuguuuugccagaaagaugcaaugauguuagaaucaagaauagaauaugccccuuccucauagaauaguaaguaaggcugcauaaugaguacaggagccagcaggaaccaugacugggagagugagaaugaauauagggaaggcagaaagaagaugcaagagacagaauauggaagagcuguugguuaauaccaugccaacaagcaagaguauuuucucagugucuuuuaaagguaagcaagauaaacaaugaccacaaaugcuuauguggcaagucuauuauacauaguaucuauauuugaccauuugaaggccauuuccuucagacuuguacagucucucaaugagauaugaguaaguggaggaauugggcaggcaaaaugcaugucuuaauuaaaaauaaagcagaggucaguagacucauucauaauuagucacaagcaugaagucaccgaagguuaauucuggaugugcucccacaugcccuacuuuuucagucuauacaagccaaagcuuucucagcuauuggcacagaaacacugccugucuuaggugucucaucaagaugcauggaccuuacccaucauugguacaugaauccuagcauucaugcccugucugcuucugaaagauucuuacuagucuuuuuaucuauaagaagcacuuuauuagucacugagcagaaagaaagccugucuuagguugccaucugaaagcacaacacuuaccugucuuugguacacaaauaaucuuguauaucuuguauuuguggccugucuuugguugagaaggcuuucaagaugaucuacccaucauugacuaccaacuucugcuagagaaggcuuuggagcuugaauuuaugaaacuuugcuuugauaucuguaaaaucucugaugauuccucucaaaagaacagauaauagacaugccacaaaaaggaucauaaagccaaguccuggcaagcccaauaagagagauauaaaugagaaccaugaagaaaaaauggccuguaacuuuuagaauaucauuugcaaugcuaaacaaacacuuugcaguucuuaaacuuacaaccuucuuauauagggcuauucaaucuaaagaaauaauaguauuaugccauauaccugcagguacuguuuuacucugguccaguuaugcugacucuuauuauacauuuuuggauucauacaaauucuuagauauugaacaggauggguucugacuuugauuccuuguaucucauccccugugaucuauauuauaucauauaaugugccaguucuuuguucuagcugauuuucuaaauccuaaauccucuuguaugcugaggacauugcuuacauuuucuucuugauaauuaacaaaaguagccaugugcaccucuuaugcuagagcuaguauaaaaguaguagcacuggguaacaaguguuaugagagcaacaacauuggcaaugaucagcccaaccauacauuugcuucuugccagagcaugaucuaauucuucaaauauuuguaagccuuuuuuagaauaacaggguucagauaaauuuacaggaauuggaauaaaaacugguugauguacuacaaguacagauugaccaucauacagugcagaaacacaauuggauaaaagacaauaaaaauaagaaacuuugaucucaucagagccaauaacaaagguaacauucccaauuaguaaaagauuaggaugucacaucuacuuuaaccccagaaccuguugcauuuuuuauccacagcaaaaauaacaucauacaaggcagcuacaguuuucaaauaugucccugaaaauguccagaaucagccagcccuucagagugagucggaaaaacuggucacuuaaaaggaaagaggagggucauuuuaacaacuuaucuauuugauugauuuuuuuucaaaguagguuccacggucuccuuguuuucuguccugcaaggucuaagagccugagacaaggcagccugucaagucugagauagaggcuuucccaucuuaaugcuuuguacuacagucuuagagauauauuucuuccuagucugagaguccacagaaacaaauccaacauugguacuauuucuaguaaaacaaauagguaggcccucaccuaaagcaguguaauucacuaauuuggaauacuucucacucucagacuaaggaaauccuaacaacugaauauuauauagaagucacaagccuuucuggccuugaacauauagaaggaauauaugccuaaugcuuccuuauuuucaucaccgggacacucaucaaguucucagucagcaucauucuuuguccaaccaucagcaugucucaccaguuucucuggcaaccaccucacuucuucagcaucuugcaaaaaaacacaaacaugcccucuuccccauauuaauacuggaucaggauuaugcuaugugacacuaagcaggaccuuccauuucaacugagcauaaguaugcugaguuguagggugcuauagauacucaucagcagagagccccuuggcauccaaggucaaaaaauuauaaauaaaagauuuguggucaaugaguauacaacuuccuuuuuuuuuauguuuuguagaugauuuuuugaguucuugggcucauuuuauaauuuucucuccuuggggacaugcaaaauuauguauaucauauauauuauaacuuauacuuuauagauugaacucauuuaaaucaaauuuuaacauuuaauauuuaauguaucauuuuuacuuaaguauauuuaauauuuaaugcauaugauauauuuacuguguauacuauguauuaauguacguaaauaacauuuaauguacagacauuauauuuaacauguauaauuuaauuuuaauguauauuucuauuuaacauagauuuuuauauaugcaugugugaacaugcauguaauuauuauauacauguuucaauacauauaaguucuaacuuauaugauauauguuagcuuauauaauuuauauuuggggucaccggcuguuuuggaucagaacaggcagauagcaauacuugucuggaguccauuugaucuaugacagguggguccaauucuuaggacucuugauucccugaagcuuaugugaacuuucauguacaaaaggauguaaauuaauauuuaccauuccauugaauuucauauuuuagaaauauaguuaacaggugcuuguuagaaaacaggaguagacucaugucuuugagaccuaguuaaagcuauaggcuugcaacuauauauaaacagauugaacagagauguuuuagcaauauaggaacaucgcuguuuauauucagaagacaacuguuucauuaacuuaucagaccuccacugaucaauguuaaauuucugaacuuugaaauuacuauagcaugugggagaaauaugaaucauuucccuuuuuuuuuucuuaaaaucauuuuuuacaucucuauagcuugcauuuauauaccuuaaaacaucuucuuagucccuccaacauuuauaacuugaucuuaucaacuuuaaacaucuuuaccugcauuuaccaucuuuaaacauuuuuacuuguauuaaucaaguuuaaccagcuuuacccucauuuaccaccuuuaaacaacuuuacuugaauuuaccaaauuuaaacaucuuuacuugcauuuaccaacuuuaaacaucuuucaucugaaggguuuuuuauuucuaacucaucaucauucaaguucuuuuauauccucuaaccuuuaucgcuugcauuuaucaaucucaaacguuuuccauaaacauuuuuuuucuuagaccauagcuugcuggguuggauuauaacucaccuaugucugcugcugagcucuguuguugcccccucugcugagaagggaaggguggaagcuaucuccuccaccagugucugccauuuugcuuccucaggaaaccaaagacagaccuuuaauaaaaaaucuaaaaaacuauguaauugcuguugcccuaguuuagcgaagcauauugaguauuuggcacaaagagcauaaggccauuucccaucccccacuugacuuuuacuuuuuaugagcguccuuacuuuuuucugaguucucuuucuauuuucccuaugucuuuuacuccugagaaauacucacugcaucaguucccuuuucuuuuuccgagcacucacuuuuuuuaugauguccuuccccuccccccccacccccccaucgucaagccugaugcuggccuccauucuauaggggccagcuggucagucaacacaggaaccacgacugggggaguuaggaugaauauaggaaaggccaaaagaagaugcaagaggcagaauaugggagaguugcugguuaauaccacaccaggcaagcaacacaaaaugugaccgauuccaggaagaaaacaaugacuacaaauguuuaugugacaaguuuaugguauauaguaucuguuuccuucagguuaggacagucuuucaaggacuuauguguaagcagaaguaaaacacacaacuuaauuaaaaacaaaguaaguggaggaauuggacaggcuaaaaugcaugucuuaauuaaaaacaaagacagaugucagcagagucauucaugauuaaucacaagaaagaagucagcucaaguuaacuguggaugugcucccccaaaauaaggaaugcaaugagcuuucaugagaagagaaacagaccugggacaaguaauauggaaaauuuaugcuuggacuggggucauugcuguguuaauuuugacugugugguucuuaggccuguggaaauaguuugugggguuaaguguggaagaguuuaggcauuuggacuggaaaacuccaaaauucuguacacagaacuuuaugggucauugugauguaaguuuugaaggccagaaugcagagaaguggagaguggaggucuggcucaugaugguuuaaagaggaacaagguccauaugggaaacuggacuagaggccuuuucuauucuagcaacacaaaacaaacaaaaaaccuaucugacuuuuauuuaucccauguccugagaauuuaaguuaggcaaaauucccaaggaaugggcuaacuuauuuggcagaggaaauuugaaggcaguauaauuucauacucuguggcuugcugcuuacuccuccucuucagguuacagugacuaaaaguaaaaaguggagcagagagauaaaaaauacguagguuuugaggaaagcagugugagcaaguauaaaacuacauaaauggcaaauuuaaaagcagcuguaaucuuuagagauuuguaucauuaaagagaaaucuucacacugacucaauagaagugguaucccagaaacauugaagacuccaucuugugaaaaugcaaauucaguuggaaaaaaaaaacaaacccuaaacugagaauauuacucaagggguuccuugcucaaaaacaacuauuuuaagaacuuguuucccagguucaccacacagccugcaagugauguccauccugagcuugcaacacaacuuaaucaccuuuauacucuacauacuuguuuugcaguccuuaagacuuaggauugaggaggccaugcuguguuauauaaugguuccagggauuugcuaaggccagacaugaugugggagguuuggagucucagugagaaggcagggagaagcuauuuccugaaguugugaacaugaaauucauguuacaguggcaaccacaggauuuuuuuuuguggaccaagggaugcccacugaaagaauacuauaggaaaugaagagucuguguaugcugcaggcagcauaucuagagaggucugagugcccgacaacauuugagucccagaagucucauauguagcuacaggguuugacuguuuuccuugcaggauuucuaucuugcuuuguucugaucucuggaauggaacuauuaacucuguuccacugacugaauguaacuugguuucuaaauguacagguuuauggauaaggauuaucugaggcuucaaaaguuuuucucagcaauuuggaacugucaaagacuaugggaacacagaaauaaauauugggcaugucugucaaggaguuucuaccuugggguaauaguguuuuucaaccugugaguugugaucccuuuggcaaaccucuaucuccaaauauauuuacauuauaauucauaaauagcaaaguuacaauuaugaaguaacacaaaaaugauuuuaugguugggggagucaccaccauaugagaaacuguauuaaaugguuguggaauuaggaagcuugagaaccacugggcuaauuaccuagaaagacuacuauaaaugggggcagcccaauuccuuaggcuguauucuugagcuaaauaaaaaaagaaagcugaacacuagcauucaucuuucucauagcuucucacaugcagacacagugugaccauuuguuuuugccgccaugacuucccuucaaugauggauuguacccccaaccugugagccagaauaaacccuucuuccuucuguuuuuuuucagguguauugucauaguaauagaaaaguaacuaagaaauaaaccagucagauuggcaccuuguaauccuaguacuuuuuucuuagagauuuauacaggagaaacugaguucacuuaaaaaaaaaguuuguucauaaaauucagagcuacaguauaagauaaaauaaaaauccaauaaaaaaugugccccaguugagcaauugagaggauaaguuauagaauaucuaucuacaugguauaauucugcuccgcauuagaaagaaauggaugcuugaaacacuaaagcacacagauccuccuccucccaaaucacuauacuaaacccaaaagaacacaucucucucugugaaauccuaggauacauauauuuuuaaaauuuggaaacagaaggaaacuuugcaagauaaaaugauaaaacaauuacaugaugauuguucugugguaguuaugcaagugaacagauuuuuaaaaaaaguuuauuguucaccuaaaguugguaaauuauauaaauacaaauuauaaucucuagaaaaccaauaaaacuaaggaucauuuacuguuucaucuuacauuuuugaaguauuuccuauguaauuguuauuguggcauguucaaggacaaaaacauaauucuuaucuguaaguacagauaggacacacaaacaguaauuuucuuuuucuuuuauacuauuuauaaaugucagaaucauacauuauaauguaauauaauaauuuaaauaauauaauuaaauaugcauauauauuaaaaugccagugauaauuuucucuguguuuucaaaguucuauauuauauaauuuuuacuuuuuuuaaacuguuaauauaaaaugaagauucuggcaaucuauguacauugcuaugcaagcagaaaagaauauacucuauggaauauugaacugaauuugagauggcuuuuauaggauacagagaagguuucucaauuggaaggggacugaauuuucaggaauaaccuaguauauauaggguauaugugcuagaaaucuugaugcagcauuuuauaguuacacauacuagagguguguuuaaaguugggaaauaauacucauauauccaaggcuuuauacaaguuggguuuaagaaaaccaagcaaugaauguuaacauugaaagauuauuuagaaaauacuuuuaaauauuguuuucaauaauuaaauagaugggauuuaacauugcuagauguauuaagcccauaucacugugugcgauaaaaaauuuuuucccaacuauucucaacaguacacaguacaaaacuuaugcaaagauguuaagauuguaaaagaggaacagagaauucagcuucccaaccagacauguaagguguuaacuaucuugcucccacaacaaaggcaaaccgaauaaaaccagaaaaucaacaauccuuggguucuucaagaaguuggagacacugaguaaacucuuacuuugagaacuagagacaggugacuuguagagaacugacaguugggacugauuaaaagguggaugacugguuacuagguggcagaaucuauacugguuuaagaaaaaaacuuuugggugucccaucuucugagauuuuucaagcuucaugaauuuaaguugcacuuuccaauucucauggugagaccucagguuuauaggccaaugugccacuuugacuuaaucauaagauuaagcggcauuccccagaucacauacuaaaggcccugucauauaagguccuguguaauaacaguauuacaacugaaaaacugcaaggaaagcaaccuaaagagguguaauuccaccagagaacuccuagaccugauaaacagcuucagugaagcagcuggauacaaaauuaacucaaacaagucaauggccuuucucuacacaaaggauaaaacaggcugagaaagaaauuagggaaacacccuucucuauaggcacaaauaauauaaaauaccuuggcgugacucaaacuaaggaagugaaagaucuguaugauaaaaacuucaagucucugaagaaagaaauuaaagaagaucucaggagauggaaagaucucccaugcucauggauuggcaggaucaauauaguaaaaauggcuaucuugccaaaagcuaucuacagauucaaugcaauccccaucaaaauuccaacucaauucuucaaggaauuagaaagagcaaugccacaaacccuuugggucccuuugucugcgugaacagggucucuagucgcaggugggcaaagcgucagcaggugacaaacagaccaacaagcgagauuguguagaaucucaauguauugugucagguugaacaucaaacuuuuuauaccaaagaaauaauaagaaacaaggcaaaauacaauccaccaaguuacagugaugcaauacaaaaggaauguauacaucaaaagaaggugggggggggcaggcugcugccccaaaagaagggagccagguguaaacuagucuauuguuaaacccaccaccaggaguucugcacuagcagaccuuaucaugaauacugcaauaucccaacacucuuauuuccugggucuacagaagaauauaccaacuugcuucuuaaugugaagcuauaccuagcuguagagaagaucucugucucagugggauuuccuagcucuauuauucccuuguuugggugagaguugcuacuguccuugguaaauauuuugcagacaagcucugagcuacuggcuccgucuuuuguaaugcuuaauuaauaacugaauagguaacuuccuuucugcauuccugccagauuucaagcucagauuugaaguuugcagguuucugggaccuugcaacaauggggaggcuuaacuauaacagaauuuaauguuaaaaggcauuuauaauaaaauauuaaaagagagcucauggauccauacaccagauuaacacgggaauagaguaugaguauguggguaaaugagaaugcaaaaacuccaggaggugagcuuucuugaaauucuuccuccuugagugcuuacagacuucuucagccugucaaccagaccugaccggagggcguggcagagcaaucugcaaauucaucuggaauaacaaaaaaacaaggauagcaaaaacucuucucaaggauaagagaaccucugggggaaucaccaugccuggccuaaagcuguacuacagagcaauugugauaaaaacugcaugguacugguauagugacagacaauagaccaauggaacagaauugaagacccagagaugaacccacacaccuauggucacuugaucuuugacaagggagcuaaaaccauccaguggaggaaagacagcauuuucaacaaauggugcuggcacaacugguuguuaucguguagaagaaugcgaauugauccauuccuaucuccuuguacuaaggucaaaucuaaguggaucaaggaacuccacauaaaaccagagacagugaaacuuauagaggagaaaguggggaaaagccucgaagauaugggcacaggggaaaaauuccugaacagaacaacaauggacugugcugugagaucaaggaucgacaaaugguaccucauaaaaguugcaaagcuucuguaaggcaaaagacaccaucaauaagacaaaaaggccaccaacagauugggaaaggaucuuuaccuauccuaaaucaggggauggauauauauauauauauauauauauauauauauauauauauaucaagaaaguggacuccaaaaaauaacuccaugaaaaaauggggcucagaacuaaacaauucuuaccugaggaauaccgaauggcugagaagcaccugaaaaaauguucagcguccuuaaucaucagggaaaugcaaaucaaaacaaccuugagauuuuaccucacaccagucagaaaggcuaagaucaaaaauuccggugacagcagaugcuggugaggauguggggaaagaggaacacuccuccauuguuggugggauugcaagcuuguacaaccacucuggaaaucagucuggcgguuccucagaaaauuggacauaguacuacuggaggaucccgcaauaccucucuuuggcauauauccagaagauguuccaacugguuagaaggacacaugcuccacuauguucagagcagccuuauuuauaauagccagaagcuggaaagaacccagaugccccucaauagaggaauggauacagaaagugugguacauuuacacaauggaguacuacucagcuauaaaaagaaugaauucaugaaauuccuaggcaaauggauggaccuggagggcaucauccugaguaagguaacccaaucacaaaagaacucacaugauauguacuuacugauaaguggauauuagcccagaaacuuagaauaccgaagauauaagauacaauuuguaaaacacaugaaacucaagaagaacaaagaccaaaguguggacacuuugccccuucuuagaauugggaacaaaacacccaugaaaggaguuacagagacaaaguuuggagcugagaccaaaggauggaccaucuaguaacugccauaccuggggauccaucccauaaucagccucaaaacgcugacaccauugcauacacuagcaagauuuugcugaaaggacccugauauaacucacucuugugaggcuaugucagggccuagcaaacacagaaguggaugcucacagucagcuauuggauggaacacagggcccccaauggaggagcuagagaaaguacccaaggagcuaaaggcaucugcaacccuauagguggaacaacaauacaaacuaaccaguacccccaggagcucaugucucuagcuguauauguauauguaucaguggaaagagaggcccauuuguccugcaaauuuauaugccuaaguacaggggaacgccagagccaagaagugggagugggguuggggaguggggggaaggcaugggugacuuuugggauagcauuggaaauguaaaugaagaaaauaccuaauaaaauaaaggaaaaaaaaagccuaaagauagcaggagaaccaggaauaugggcacuagaagaauuuaagcauagcccuuugucaaggaagugugaaguuucagcuaaggaauguucaucuggauucuuucauucaguaaauuauaucugggcucaauugcaaauuucuagagauucaaauaaaggggaaaauuuugaaagaaggaaaacacugaaauacuaaauuuuuuuguagagaaauaaaguuuaagaauugcauggcacuuuucuuuagaaaaccuacgacauauuugcaauuguucaacgaaaaagccuuaucaauuuaguuuauaguuguauuuuagaaacaagugaaaacuagauuuucucaaacaggaauuaaaggaauuaaagccuuuuuugugaggaauguuaaacuaaguucuucagaaaaaaacagcaaccauccuuaaaauuuaaagaggcagauuauuaaaguaggucuuaaaaguuuguuguauaguugauaugcuuuaugaaauucacuguuaauauaaucaauguuuggaguaugguuaugggacacaucauuacccagucuaauuuugagccauuuuccuuaccuacaaaaauuuuaucucuugucuuaacucuuaccaccaucccuaaucauaugucuauucuaguuacucuaaagugagguacucuguguuuggguggcucguuuagcaaguuucaacauucauguaaagaacauauaucuuuuuuuuuuauugcuuaucucuuaguuacauaccuuuuuuuuuuuuuuuuuuugcaacucauuaguuguuuuuuugcuguuaagacucuagugcucagguaagugccuuuaauccuagcucuugggaagcagagguaggcagaccucugugaguacaaggccaagccuggucuacagagugacuuccaggagagccaaaaaacccugucucaacaaacaagccaauggaacacugcauguuuauaggacuguugguagcaggcauagacaaaagaguagaacuucugaguuugcuaaacuuuucccucauguugugcuauuaccuucccucucuauuggggaucugugguguguuaauuuuacuauauuucccccaccauuuuucguuugucuuuuggcuuaaaacaucuuggccaguuugaaaugauauccuuucuuaauuuuacuuuguauccuuuuauggcaaauuauuguugaacauauuuccaugcacuuguuguucuuucaucuguccucuuagaaauacacaagauggaguugauaauuuguguguauacuauucacaagagauauauaugaaacauaaagagauaggcugguuuaauucauuauaaaagauuaaccaagggcauggauacaaaagagcauuauagcuaucucauuauauaaaaugagcaguaaucauuucuugauagaaaacauuuguaaggcacacaagucauacaaguagacuuuugcuagagauccuauccaguugguguugaaaauuguauucauugguguuuuucuggaauuuguaaagugaagaugacuagaaguuagauuagguuuucugcuuuauuaauuuaaaauugaauaacacuuugcauuguuuauguugcuugugugauuuuuuuuuaaugaugggugauguauacauuuaaaaauauauguauccuauuuaaacguuuucaaauuauuuacuuuccacaaauauaggcugugcuuuaccccagucuuauuuccaguuucuaaaagaauuacccuuugucauaugggaaaauauuauauccauguuguuuuaucucuauguagugagaccacaagauguaauaguaaaauaagauuuggcucaguguuagagcacuugacuaucauaaguccuagguuuaauuccuagcaacacaaauaaaguucagaccuaaaaccuaagcuuagauuuccucuauuucaaaugguucugccugacuuggacugguauauuuguuuucugaagugauugaaauuugagaaguuuuucucugagaguacucacaacuuuguaauugauaugagugugagucacaaaaaucaaaauguagaauuacuguaaaaauauuagaaauguuagaaaauuagguuccaaaucacauuuuacuaagauucagucucuuugaucucauggccuuuaagugucaugggcccuaaagucucagaauugcucuuuauaucauuauuacaaggaaccaaacuagcuugagucauggaucauauaauggaacauugaaaaauugguguuauauaaauugcauauguguaggcuagugugguggccacccaggaggcagagccagguaagacuggucuauaggaaagccaaggcuauguaguaagucucugucuagaacaaacaaacaaauacauguuuuuuaaaagguaauauauaagggucagauaaaaguauuuacaguuuuaagauuaaaauguuuuacaaaucucugaaauuuuuuauuuuucccuccaugcuuugucguauaaaaauacuuuaauguuauuuaugcuuuuugagauuuuaaucuuuggaaauacauaauucauaguagauauaguuuaauaacauuuuucucaguuguguaccuaaauuuucuuuaguuuuauaggaagcaccauguguuuuuacauauugcauauauuaaagauuauaugauaaaauaugaagauauuaauacacauuaaauuuaagacuauggccacccaccugugugcacaucggcagcacaaaucagauuugguguuauuaauaacaaaaacaaaaauuaaaaaggugccaugaaguuaggagggaagaaggauggugacuucaaagcgaguugggguuacuggcgaggagauugguuacuauucauuucauaaacguaugaaacauucaaaacccaugauauauauaaaaauaccuauaauuuucccaauuuuuguauauuuucuuuuuuagcaguauuuugaauacuccaauucucuuuuaugcagguugaagauuguaaaaauuucuuuuaaaugcaaacaguuuuuuauucaacuuagaaaagaguuggugaguauugauuaauaauuauugguaaaaauaaaauauuuuaagauugccuagccauaggugggggagauggcucaauuuguauagugcuucuagaagugcaaggauuugaguuugaugccuaggucccaaguagaaaagcugcauuuauaauucugacaaugaggaggcagacauaggcugauccauucaacucccaggccaaugagagacuuugucuccaaaaaagggggaaacaucucuggggaauaacaccugagauuaucuuucagcuuccuagcacaugugcacgugcauguacaaguagaauagcacacacugauuuaaaaaacauuuaaaucuuugugucacugugaacaaaaaugcaguaaauacuuguaaguuuuuucucuauacuauacuuucauagaaagcucauuucauuuuggaaaugcugaauauauaguuucuaguucauggacauacaucuuguaucaacuuccuccuguaaauuaucuuacuacgugaucaaauuaaacuagcuuugccuaguauaauaugauaaacuauuauauuauuauaacaacuuccuccugcaaauuaucuuacuacuugaucaaauuacacuagcuuugccugguguggugacauaagccuuuaaucccaagcauguagaaauaaugguuuagggcaagauccucauacaaaucauauacauauuuacagacugcaagcaaacuaaccuuagucuuugcuuuacaucaaauuuuuauaaaucuuugcaaauucguacauuucaagacuuauguguauaaaauuucuuuaaaauguuaagaauauauuugagucagcugcaguaucugccugcuagaggauauuuucuuauuuuguaacagugacuuaucauuuauguuuuccuaauaugggagauuuuuccaaauagaauuuuuauugaaaugaacucauauuacuauguagagcaugacagaguccuauugcuaauggaucuaauguguacuuguagucgcuaaccuucccaacagauaggcagcuuuauuuccauuuguaaugcagugaaguagguuagaugcuggaacuuuaagaagugaagccauauagcauguccuuuuguacuuggcuuuuuucuuuaacaauaugaaauucauauuguacugacuucagugauaauuguguuguuuguuauuaaugugauauacuacuaaguguauaugcuauaaauuagcauuuuaguuuucuguuaagagacaguuuuacuauuucccaguggggaauauuuugacuaauacugguacuaaacauuuuuaugcauguaugugccuuuguagguguguguguguguguguauacaguaaauuucaguaaauauucacagaaggauauauaauaaaucuuguuauccagaaacuagagaauaggagcuggagagaugucucagugauuaagaucacuucuagagguccugaguucaauuccuagcaacgacaugguggcucacagccauuuguaaugggcucuaaugcccucuucuggugugucugaagacagugacaguguauucauauaaauaaaauaaauaaaucuuuuuuaaaaaacccuauugaauagauaauuuacuuagaguaacuauagagaguguuguagaagaaaauacuauuaauauaccugauugcagugaauguguugucaguaauaguaauaacaagaguuaugaaauguaacauuuguugaaaacaguguaugugcuugguaacauaugaaccauuuuuaguauacuucucauaauuguucuuugagagauuaugccaguuaacaccauguuuaccuauaaauaucaacagcaucaaaagucaacuugcaagugacuaaagacaacauacagauguauuuugcagaaggucaauucccaauguuuucucuauaaaacacuuguuuuuaacuauccaaaguuauaggcagguacaguggugcacacuugaaauccuugugcucaaaaggcagggacaggggacuagcugcuuguuuaagguuaccccuagucuacacuaaaguuucagaccaggcagagcuacauagcaagacuuuaucacaaaacaacagcagcagauccaaacuuucacuugcuauacuuaaccucuuaggacacuuuaaguccaucguucacaaauuagaaagaaugucauugcauuucaaauacaauuacagugacaaaaguacaugcagaguguuugaagcaaugguuuaauagggaggccacauauuagacaguguacacacacugaaaaaacuuacuguauuauacucuucuuguaagguguucugucaucuuauauaacauuuacuguauaucagacaauauguaaacuguaacugcauauaaaaauguuagugauacuauuuaacuuucuaguaaacaacaagcuaugcuuuacuuuuuaauuugaaacuacauucuuauaucugaacauuuuaucuuguuuuaauuauggaaaauauuuucaugaugaaaauauuucuugaauaaaacauagaagaagcucuuaaauauaaucauucauuguuucagacuguuucagacugauaaauguucaucaaaagauaccauuaagagugauguagcacuggcuguauaugcaguaauaugcaaccccaaguccuuccauauauaugcuauccaaugucuugaauaccacuucagaaaugacaguaucuucaugguagccagauauuuccaaggcugaggcaagguugugaguucaaaaucaaccuuggcuacauugugugaggaccagcuucagaagcuaaaauaagguacacauggugcucuaagucucuaaucccugcauuugaaaggcuaagguagggaaauugcuacaaauucaagucuagccugggcuggagaaggucaugcuuugaaaaaauaaaaucaauauccaauuugccauuaacauguagagauguugaaccuuauuuaagucaucaagaugagguacauguuauaaccaaaaugcaaaacacugaaauaagaaaaaauacaaauagaugagguggcacaugcuuauaauucaccacccaaaugauugucggugugggaacugcuauaaguucaaguccagcuugaacauuauagugaguucuaggccagccuaaagcacaauauaaaaugccaucucaauacaaaaauggacacaaaucaaaaccagaaaaucacugaauauggugaguguauggaacacacacuaucauugacaggaaguacuaacuacuuuagcuauacauauaauuaucuagcaacagaaauguguacauauguacauaaaaucuaagaaugugcauacacaacauugcucuucuaucucuaacuugggaaauaucaaguaucuauaaacaguaaaguauguaaacuauugugcauauauuacacauuacauauauaauaugaacauauuacgugcacacacauaaauauguauauauauguauguauguguauauauguauguauguguauauauaugagauacucaggagauaugugcuuugguauaaugugguucaugccaaaagaaaaacuauagcaucagucucuucuaaugcuaauccauuucuaaugugauuuuuauaauaacgcuugggguguugaauauucuuucuuuuaaucaaggcagaauuacaaauuguggaucuacacaaauuuaauuugugguccaggacuauauauugaagcagaauuauagcuaauaaaauuuguaaauauuuacuugaaaauaguaaaaaauuuaaaguuauuucuaauaugauagagaauacaaguauguaaauguuguauaauuacagaaguucacauuuuauaaaucuuuuuauuuauuucacuuagccuuuguuaauaaagucauuaaaggagauuagcauuuacaaggcugguauaacuuaucugucaaaaguacuaucauauccugacauuuuucuguuuucucugaauuuugucauuucauacagcaugaaucuagagaaacauuacugggauuuaauauggugaauuauagagcauguaaaacuuuguggaaagcguguguagaacaucauacauucuuccgccuggauagaccacuuccaccucaaaaaaauuuuuuugcacauuauuuuacauuggguuccaaauuccgguacugguaaguacuacuucuauacuauuuguuuuguuuuguuuuguuuuguuuuguuuuguuuucguuaccuuuagauuagaggucuagguuuagagagauggcucacagguuaagaguacuggcuuuucuucuagaaggaugcaaguuuaauuccuagcacccacauggcaucuuacagcuguguguaacuccaguuccugggaaauccaucauucuuuucuugcccccacaagcacugggccuggauaugguaugaaagacaaaugcacacagagauaagaggaaccaauuaaagagauacagauacaaagcaauauaaucaugguuaguugcaaaaccuacugagucaaaauccccauagcauucuugucugugugucuguaucaguaagucuaugaugucuugugaugcacacuagauuugauaacccaugccguagguugcaauguauuuuguaaauaauuugccauauuugcauaguuuaaucccaauagauuuuauaauuccuaaugcauuuauuauuugcaugaaaacauuucuauaagauauauucauuucuuuuauaaaagccaagauauauuuuacauaguauaaaauuuuuuguuuaaaaaauucacaguuuaacauuuuguagagcucucuccccugaguucaaaauaaccauuaugcaaauaggcaaaaaguugaauuuguugaguaauaaccacagauccugacauuuuccuguauucucuucauucugucuauaauacagcauaaauuuugagaaguaacuuuaacuaaaguuaacccuuaaauuuuuccuuuauuuuauguauauuuuuuuccauuuuguuuguuuguuuguuuguuuuuguuuuguuuuuuuguuuuuucuguguguauaucugugcaucaugugugugcaauguucaugaugcugggagagauaccuuauguuuggaaguauagauaguuagaagugcuaguaugggugcugggaaucaaaucugcuuccuugagaagagcagucaguauucuaaacugcugagcuaucucucuagucccccuaaauuuguuugacuugcucucuuuaaguuuuuuuacuguuacauaauuagguacgguuuggccuuaacauauauugcaauauguaaucaccagauauauccacagcuucagaugugcaucauguccuuguggugagaauguucuuaacucucucuacuacguaauuugaaauuuacaacuguuaaucacaguugaucuucugugcuacagaauaugagaaauuauuuuaccuauucgcugugccuuuugccauuuauugauuuuuuuucaauacuccccauggcaacaauuuuugggaaauaauuauuuguagaaaccuugauuaguccuaucuguaaauucuaaaaugacacauaaaaguuaguuuuaaaguggaaucuaguaagacuuacacagaaaaaguuacaggugaucuaaugggccuucuucugccucccgagugcuaagauuaaaugugugcaccaccaccgucuagcugcuucuuucauuaaugcuuguaugguuugucuuuugaucagucuuguuagaaucucaucacauuggauuauuuuaaaacaaccuauaugccaaguaaaauuuuucuucagacuuaaguagcucaguucuaaaaugagauggguaggaagugacugaaaauauuacgcagccaaguuuugguucaaauaaguuuagaaccaacauaguagacauuauucaguaugcaaaaaucucaagcauuguaaggucucugaaucaggaguuagagaguguuauucagugcuuaagagcacuugcugcuuuugcacaugguggcucagaacugucuguaacuccagugucaggguucugauauuauagaauuaguaugcuuucuuagugagaaauaaccguacacucaaaguuuaauggaagaaaaagcucuuaauccagaugagguaguacauuccuuuaauccuagcacuguugacauagaagaagcagguggaucucugugaguucaaagccauccagggcuacacaaagaaacccugucucaaaaaaccuaaaaaagaaaggaaugaaugaaugaguaagugaaagaaagaaagaaagaaagaaagaaagaaagaaagaaagaaagaaagaaagaaagaaaggaaagaaagagaaagaaaaggaagaaaggcuuuuacaagagucacauauaagauaaccuguguaucaaacaaauggucugucgaucagauaacuaucuguucuauuuuucuuuccuaauggaagcuaucugguccuucuagaccagugguucuuaacuuguaggucagacaccuuucacagggggugcguagcacacauucugcauaucagauguacauacuacuauccauguuacacuaugaaguagcgccaaaaauaauuuuugugguuguggucaccacaacaugaggaacuguauuaaaggguggcaacauuaagaagguugagaaucacugcgcuagaaccuuacucuauaccuacccucuaguucuauggauuguagcuugguuaucauugacuucauagcuaacacccacauaguuaauacauacccucuuuaucuuuugagucugagauaccucacacaggauaauuuuuuuucuacuuccaucuauuugccugcaaauuucaugauguuacuuuuaaagaaacugagcaauguuccauuauauaaaugcaucacauuuucuuuauccagucuucuguugaggcacaucuagauccugaaacuucaaguuuuuuucuacaucacuuucuagccucugaaagcacuauucauaguacacauacauaaauauagaggguaaaauaaaauugaaaauauauuuuuauaaguuuuuuuuuuuuacaaaauagugaaaccagaccaaguaaauaacaagaaaauaacucaaauaacucaagaaaauaagauaacucaaaaaguguuggugcaaagccccgagaauaaggguaauaauaaaggguaagcuuucaccaucauauccauccucagcaacuaaggaggacucgagagaggagucaagaugagagaagcuucuuaaaauuuaaugauaaguuuuuagaaagaagaaguagaugagaagaaguauuugaguccccauggacaaaauuuuucaauaugucauauuuuaccuaucuacuuugugauguuuccuaaacuuuucuuccuuuuugcaguggagagcagcuaccucucugagcaaauguacuguaaucacagaacaagauuaugcccacaagucuagccuuuucuaagugaauauguagaaguuucaguaggcuggagagauggcucagagguuaagggcacuggcugcucucccagaggacucaguaaaauucccagcacccacauggaagcucaaaacugucuguaaauccagucccaggggaucugaugcccucacacagaccucagugcaggcaaaacaacagugcacauaaaaacaaaauuuaaagaaaagaacuuuuagaauaacuuuuauauuuuuguaaugagauuucaaauuuaaaauuggcuuacauuucaauuauucuuuucauuauuauuuucucuaauacuugaauuauugccauaacauuuuauauauguauacuuaacaguugguacuuucucauuguuuaaauuuauauugucacaauuugauauuguaacugcuacagauuuuuauuuuuuuauuuuuuuauuuuugguuuuucgagacagaguuucucuguguagcccuggcuguccuggaacucacuuuguagaccaggcuggacucgaacucggaaauccgccugccucugccucugcugggauuaaaggcaugcaccaccacgccuggccagaauuuuauuuuaaucugacccuuacaugaugucuuauugacaauaugcaauauaaauuccuuuugaacauuaacuguucuugauagcuuguuauuccagccauuugaucaauagaguuguauuucagucugcuucacugcuauauuaauauaucagucaggagugugagaaacucagagcucuuuuugauauuuuaaguaaaauaaaauuaauccagagacuugguuacauaggcacuuaaaaaaccaaaaaacaaaaaugggagacuaaguggggagggauaguuauuaagaaccaagugugcaagaggaauaauguguaagggucauguuugaucugaauucccugagccuagacaaguuccuguccuucccagacacuuucauggccaguccaguugguccaggcccugacagagcagcacugccucaucaagauguuaucuuccacugccccagcacuugccaguaccugcuuugcauuucucccacuuuucugaucuuucaucuacccauugugaaaauauaaccuaguagaaagcuaaguagaaaggaaucuagaaaauggagugugauuacuuauagccccauaacaaauguagcaaagcacagaauuagggccugugacagucuacugcauaucaguguuuggacauaagccauauauauuuauaguaucugugcuuauagcucuuguucuuagcuuuggaaugcauuggaaacucccuuuaauuauuaaaauguuaauucucuugcaacugaaguaggaaagggaggaugacaaaaucuauacauaguucuuucccuaauggacaugccucaugguaagcaguggccaggaauauugaugcaauuguuauacuuaaaauauugaaauauuauugaccagaaaguagagcugggaauauugacaaaguuuuuugcuuucuuaaccaucuguuuauauacaugcuuauugcuauucuguauauccaagagauuaaaugcauucaaauuaaugaagcugaauauauggccuccauagaggaaauacauuuuuuaggaaauuucacauuuaaaaauauaguuucucauuuuucuauuaaauaucagucaugccauuuauuucaaaauuacuuauauuuguuuuuuaauauggucugaaauuugcuugugugacuuuaggaacuuguauuuuccuacuuuuauauacauuaaauaucuuuauaaauggcugugcuuucuguauuagaaauuuauguucauuuacaacucaguaagagguugcccuuuuaaacucacugagaacuaaccuuucauuaagacaauuaacugaauacacugacuuagcauggaggaggaucagaaucuccacugcauauaaagagugccguuuaggcaagucaguuucaaagaagaaacuaugcugaacauccacaauauuucugaccucauuuuuuuuccuagagucaaaaaccugaaauuucuuguauugugucauggaaggaguugauggacagucuucauaucuguaauagcaggaaaggaaaaagaaguuauugaaauuaccaaauaauuagguuauagcuaaccuauucuauuaggguaggucaggguguuggcuaacucucuucuguuaggguaggucagggccauagaguuuguuugauucagggcaccucugacuuuaaagagaguauuuuaguaaggaaccacaagaaaggaguuccuaucaugaaacacguguuuguugucacaucuugguuuauuaaauugaggaacuacucauuaagcuucaucuguuuggauggaacuggaaggcaguccagucguuccuucuuacucugaugcuuauuggggggggggggugguuguuguuguuguuguuaccacaaauaucuuaucacuuauaaaauuuuaguauaaucauguucuauauuguaguuucaugcuguuuuccccuuuaagauauuaugcauauuuauguauuucagugggagaacugaaguccagucaguucaauauggcaaagaaaaggcaaauaaagacaggguauuugcaagguaagucaauccuguuuuaguauuugaggguuuucuuuugguuuuuugacauuuuauuuuaugcugucuggcaggggaggagugacacacaagagaaaaacacaaaaguucuuuuauuccauuagguagguucaggguuaaacucacauugucaggcuuggcaguaagcacuuuuauuuaccacugagcuauuucaccaguccaacagauugcugaauuuuuuaaaaaagauuuauuuauuuauuauauguaaguacacuguagcugucuucagacauaccagaagagggcaucagaucucauuacagaugguugugagccaccauguggauacugggauuugaacucaggaccuucaaagagcagucagugcucuuaaccacugagccaucucuucagcccccagauugcugaauuuuuaaaagcauuaaaaugauuagaaauggggauuggauagcugacucaguaguuaaaagauccagguucaguucuuggcaccuacaugguaguacacaacugcauauaacuccagauugggggaucugaugccugcuuaugguccauggacuuuugcaugcauguaguguccaugaacauauucagguguacccacauacacauaaaauaaacauuuaaaaaaucauuagaaauguuuucuaaauaauauacuaugucgaugaaauggaaacuaguuugucuaguguccugcuuuuuuuuuuuagacauauuuaagaacuuuagccauguauucagaacaauaguuuugaauaggcuaagucaaguauugcuaauaaacuuuuuacuagaaaguuacucucauauuacauucuuuuaagcaauguaaggaauccuauuauccagcccauuuauauagcuacuaaaucaugcuauuaaaugauagccgcuuuugaauugccuuuuaaaaaguguacuuaccuuuauuucauuagaguuugggagggccaguuuguuuucuagagacaaaaaugauacaauuugggaaaaaguuaaggauagagaauggguuagcaaaguauggguuugauacuuauaacuaauuaggagauaauuacaguaauccaagcaaaacuaauaaagaccucuaccauacauugauguagaauagggaacaaauuugagggaccuaacaucgacugcugauguuagauggcuagagggacaaugaaacaaguguuuguucccgguggaaauuacuucgagagcaaaaagccuugaagaguuguaugucuggcaucuacuguugcuagaauuuuggaagcauuuauaaagauaacaggaaaauuuuacuuggucaaaaauucaaaggucuuuucaacuuuguauuucuagaagaaauaguuuaguguuugucguugcuuuuucucauuuucuuccucccaacaugaaaauuauucccuguuucuaccaauuagugauagaucauuauauucuaaaaucccgacaguuucaagugacuugaagaauaugucauccgcaacagccccuuacaaacuuauuggcauuuauucaggguuuuucccuucauagacucagguguguguguguguguguguguguguguguguguguguguaucugucugucugccugguaacuaucauggacaucacuguuccaauuagaaagugguauagaccugaaaaacaaagggguuuaguaaaugucacucaaauguuuucuguacaacugaccauaagauaacuuuacuccuaguggcauaauuguucuaauuuagaaagaaccuguucugguuuuuuguacugucucuuacuugcagcacucucuauuuuugaaaaucaaagcauugucuuauuuuaaugauuuuuguacauacuagauuuuguuaugccugaucuucauuguuuugucauucacuauuaauauucuaggaagguugucagggacugucuuuuuuuuuuuuuuuuuuuuuuuggugugugugggucaggaggauagauauguuucuuuuuuaaggugcuagguucccaaaccuugcacaugcuagccaaguguucuacuuugguacuguaugcucaagucuuggugcgaaguuuuaauagugcugggcugucuuaaugauuguuuugucucuggaaaucuaugcuuuccugggauuguuuaaguuuauuuagcucgcuuguuuguuuuuuuuguuguuguuauuguugguuuaguuugguuuuucgagauaggguuucucuguguagccugacuguccuggaacccgcuuuguagaccagacuagccuuuuacucagggaucugccuggcucugccuccugagugcagagauaauugugagcaccaccauugccuggauccuuggauuguuuuuauaagacucuuuuaccuuauaauuagcuacuaaauucucuaaugguuuuagcaagaauuaggucauuuugguuaagaauuccagauuuauuuucucucuuagaauuuuaaauggcaguauaaauaggaagacgaaaaaggccuuuaaacuuuauaugaaaaauuuuaccaauaacuaccuuauuuucccuuuuauaucuaauuuuugaauugcuuucacacuuuuucaguuaucauauaauaauaucugaggaagagaugagagcaaauuuuucuucaacagaaaaauaaggugccacggucagaaaauaaacucaccacauugcuaacagugugguauuuuuuucucugaaauuuccgcucagaacaggaaauauagacaguaagcuugagugggugggucucugagguuagagcuguuaauaaauuaagaugccugaaauuuaguuagcucaagacauuuccaaacauguuuaguucauuaccaagauugaaguguucauacaguuuguacuagguaaguaugcuggauuuucaauuuuucagaugauuuuuuuucucucaguaauuaaucuuagcucuuaucacuuacauuugaucuaauauaugagggaagaauaguuugugaauaguaaggauuaacacuaguaaaagaacuauaggugguaaauuaugguaagcuugagauuuuauguuuuaaauugaaaagacuauauaauauauuuucauauaugacuaauugaauuuauguguucuccacugugagagcuuaaaucuaauagugugcagauucaaguccuaaacuaaaacucacagugauaggaagaggucuuugaacuuaaauuacuuugaaacauuuggaaaaugaaauuugugucuguccuuuuuguuugcuuguugguuacaaguagcaucaugucucuuuuagaagaugcacauugauuuuagaguucaaagagauuagccuaaccugugagaggauuuggcugucaaacccugaaaugauaggauaauuguaugauuuugauuuauaauuauucauaauuuaacaaacuuuuaaaauuuuuauuuauuuauuuuccugcauauaugucugcaugagguuacuggauccccuggaauaggaguugcagacaguugugagcugccaugugaauacugggaauugaaccaggauccucugauagaagagcuauuaggccaucuggguuuuuucuuuuuucuuuuuuuuuuuucuuucuauuuauuuacuuuuuauuagauauuuucuuuauauacauuucaaaugcuauccugaaaguucccuauacccucccucugcccugcuccccuacccacccacuccugcuucuucgcccuggcauuccccuuuauuggggcauauaaagucugcaauaccaaggagccucucuucccagugaugaccgacuaggccaucuucugcuacauaugcagcuagagauacaagcucuggggguacuguuuaguucauauuguuauuccaccuauaggguugcagaccccuucagcuccuugggugcuuucucuagcuucuccauugggggccuuguguuccaucuuauagaugacugaacauccacuucuauauuugccaggcacuggcauagccucauaugagacagcuauaacagggucccuucagcaaaaucuuucuggcauugugcaauagugucuggguuugguggcugauuauaggauggauccccggguaggguagucucuggauaguccauccuuucaucuuagcuccaaacuuugucucuguaacuccuuucauggguauuuuguucucuauucuaaggaggaaugaacuauccaccaauuggucuucccuccucuugauuuucuuguguuuugcaaauuguaucuuggguguucuauguuucugagcuaauuucuacuuaucagugagugcacaucuaaugccuucuuugagauuggguuaccucccuaaggaugauauccuccagguauauccauuuguccaagaauuucauaaauccauuguuuuuaauugcugagcaguauuccauuguguaaauguagcacauuuucuguauccauucuucuguugagggacaucuggguucuuuccagcuucuggcuauuauaaauaugacugcugugagcauaauggagcauguguccuuauuaccaguuggaacuucuucuggguauaugcccaggagagguauugcgggauccuccgguaguacuauguccaauuuucugaggaaccuccagacugacuuccagagugguuguacaagcuugcaagcccaccaacaguggaggaguguuccucuuucuccacauccucgccagcaucugcugucagcugaauuuuugaucuuagccuuucugacuggugugagguggaaucucagcauuguuuugauuugcauuucccugaugauuaaggaugcugaacauuuuuucaggugcuucucagccauucgguauuccucaggugagaauucucuguuaagcucugcaccccauuuuuaaugggguuauuugaauuucuggaguccagcuucuugagcucuuuguauauauugguuauuaguccccuaucagauuuaggauugguaaaaauccuuucucaaucuguugguggucuuuuugucuuauugacaauaucuuuugccuuacagaagcuaugcaauuuuaugaagucccauuugucaauucuugaucuuacagcacaagccauugcucuucuguuuaggaauuuucccccugugcccauaucuucaaagcuuuucccuacuuucuccucuauuaauuucaguaucucuggccuuauguggaggucuuugauccacuuagacuugagcuuuguacaaggagauaagaauagaucaauucacauucuucuacaugauaaccgccagcugugccagcaccauuuguugaaaaugcugucuuauuuccacuggaugguuuuagcucccuugucauagaucaagugaccauagcuguguggauucauuucugggucuucaauucuauuccauugaucuaccugucugucacuguaccaguaccaugcaguuuuuaucacaauugcucugaaguacagcuuaaugucaggcauggacuaggccaucucuuaagcuuaauuuaauaaacuuuuaagaggcuaaaauauuguacugaaaauucagauuuuuucauaaaauuaaguguaaagaaguauguagugagccuguuguacccaugaauuuagauauuuaguauaagaacaauuauucuuguuauuuauaauuagaacucagugucccuaguagccaugauuauuuuaaaucuuccugcuguggacauaaaacacgguggacuacuauuugcuaagcauugucauucucuuaggccauucuguuugugcaguuaauauguuagaaaggaaauuauaggcugcaauuauaagcucaaucucuuuggauuuaggugcacacugauuucacucuguggaucuguuugaaauacuaaauuuugcauuuacuuuguacuuugguauuuuuucuuaauuuauauaaauuuauguaauauaagacaacaggaagaaaguauggaugauuuuuaaggcgaaaaucuuccaguaaucuaaaaaguauguauaauacuaugcccagucuuuauuaauauuagaaaaucugaaaauaaaauucacagaaugaagaucuuugaauauaaugggcuaugacaaaaaaauagcauuaauuuuuuaaacaauuuuuuauuagauauuuucuucauuuacauuucaaugcuauccugagaguccccuauacccucccccugcccugcuccccaacccacccacucucacuuccugccccuggcguuccccuguacuggggcauauaaucuucacaagaccaagggccucuccucccaaugauggucgacuaggccaucuucugcuacauaugcagcuagagacaugagcuauggaguacugguuaguucguauuguuguuccaccuauaggguugcagaccccuucaguuccuuggguacuuucucuagcuccuccuuuaggggcccuguguuccauccuauagaugacugugagcauccacuucuguauuugccaggcacuggcauagccucauauguuuuauauguuauuuuugaauuuuguccaguacauuuugaucauauucaccuucucucauccaacuuuucuuagacccacucuuucuuuuauccuccaacuuuguguuuguuuuguuuuuguuuuguuuucuccaucaagacuaauuuguguugcccaaauagucuuggauguguagcuuucuuuuagagcaugguagaauagagcgugcugauguugcauuauuaaagaaaagugaccccucauggcagcuaauaacuaccaagagcuccucaccugggaagggguuuagucuagcuccgggauacauagcuuuugcuuugcuguuauaaccacuuugaauucaugugugcagccaccuuacagugcuauuuuguacaaauaaauuuuuuuccuuaaauuuuuaugauuugauuuuugaaguaguaugccuaugucuguuuuauugugauguaauagagaauagcauacauguuuuuaugggucuuagaaaauuuauuacucagauuaaaaguguauaaggugauuuauuauguguuauauuugucacuuaauucauuuuauuaaccuccaaaauaauucuacauaucaaaaaaguacacauuuaaguaaaagauuuuucaguagugcuuaaauuuacaugcugaagacuuugguuauuaacauuccuaaaauucucagggcuuaugucucugaauauaguuauaccauuugaucuguggagauuagcaccuuuuucuuagcaggucacuuaauucuauuuuaucacuaugauaacugacagauaauaaaacauauccuuuugugcuggagcaauuucuuagugguugggacccauugcuacucuugcagaagacuaaaguucauuucccagaauucauucaaugcagauuauagcacccuauuuuuuacuuuagcuccggaggaccugaugcccucuucuugccucuucaggcacucucacuuauguguauagacacuuccaagaauauauacacauaacuaaaauuagaauaaaucuuuuaaaaauacccuucuguuaccuaccacaagauacaagauacggaauguuuuuuacagaaagaaagggaaaaaauuucacugacuauacuucauguaaaagaaaaaauaaauaaauucagcauacuuuuuuaaaaauuaucuuuuuuggaccucuccuccuugaagcagaggcucagaaaaucaucgaggagaugaaguggugggaauuguucagugcacuuugugguaaacuguguucugaguacaguagcuacaagcaaagauuuauaacauuugcaauuugagaaaauguuugauagcaaacuauugcuucucuuuauaucuuuuuuucuauuauuccucauucucuuauacuuccuagacuaaucccuuuuuugucauauaaaucaaauaaagccuuuuuuggaauuauuuuauaaauauaucagaguaagcaaacucuuugacuaugacuuauuaaaagaauuuuaagauuugacucauaucaaaacaaaaccuuuuauguauuauucacuuauuuucuacagaucuccaaguaagccuuuggcacggaaauuaauggauugggaaguagucagcagaaauucauuaucugaugacagguuagaaacacaaagccucccaucccggucuccaccuggaacucccaaccaguaaguggcaagcccgcgucaugcuugcauuuuguacuuauuggcuacggacuuuauugccuaaagaucacaauuuauaaaaauuuaaguucuuuguucaaauuuucaaaaaaaauuuuuauuguguuuuacuuuuuuuaagcgugagucagucucucucucucucucucuuuauauaugaggacauguggccguguguaugcaacaguggacauguggaagguagaaaacaacuugggggaguaaguuuuuccacucuaggauucccaggauugcaaccaaguacucaggcuugagggcagauacuuuuaccugauuggccaccucaccugucccuaacaggguuuuuguugccucaaacauugccuguuugcuugcuggucauuauaaaagugaccuaaaauagccuuagggaaugagcaagaagaaaauugaacagccuuuacuuuccucagcaguugauuuucaccagaaggauaauucaggauuuagucaugacuugaaauuuucauaaaacuguuauuuauauaguccauuuauuuccauauagauuaauaccagaauuucuaaggggcuauagccuguuuaaaaugcuuuguuugcgugaaugugaugcaaagcucuaguaccucuguggcuaggaaaagacuuuuaacaguaaccccaucagcucagguugagcuguaccaagaaccuauggugccacucuaaccuuguguguauugcacucuggcaguuuuuacacagcugccagguuuugcaauagguaauaaaaagauaagaaagaguuccucaaauauguaccagcgggagggcaugguaagagaagcaaggcaaggacuggggaagggagaaguguaagagagaucaucuaaauaauagcaauagcugagauuaaguuucaagagaaugaaauaauuuuaaggaugauauauuuuuuuaaagagacaggacagcagagugauuaaacaguggaucuagaguacuguuuggaucuugaaguuaauugcugucucauuuucuuaucuacaaaauccuacuuguagauggauacaugccuguaaucccagcuuccuuguuguagugucauacagucuuaaugagguaacaugugaaauguugaguaaagcauaagauuaauaguaaggucuuagggcagcuuguagacugcagguacgucuugacuucccauugaguguucuuuucauuuauauuucacuguaagagauucuacguagucagcauagacuuucacacacacacaaacacacacuuucucauuaaaaaauaggauuaaaacacaaggaaagaggcagguggauuucugaguuccaggccagccuggucuacagagugauuuccaggacagccaaagcuaaacagugaaaccgugucucaaaaaacaaaaaaacaagggaaaucaaaguauacuauuguucagacuuuguuuuucuucauuuagucggaauucuucauucacacaagaggcaacccggguucggccgucuucaguuggucauuugguagaccaugugguucacaugucccccagugaggauuuuguaagucagagaucuccaucaucaacgcaagcuaauagcauaguucuggagucaucaccguaagacuuuuucauuuugcuucuuauuucuuuauuuucaaauauuuccauuuucuucacuugaaauaucuuuggaaauuagaguacuuaauacaagguguuacuuauauguaguuauaaacacauauuuguaaauguacucauuucuccuugagauaucuuguuccuucucuuuccuuuaccugucugguuacugacuauuauuucaauuuuuuguuuauacucccaaauauuuuuuucagauaauauaauaguguagucagugaguuggaaaauguaagaguuuucuuaauauuuuuaaggaaagaaacuauaaauaugaauauauuacaaaaauauuaagggaaaaauaagugagaugguuaucacacucgguuauagagcaugcucacaucuuucuuuuuuaucuuuuucaugcuuagagauagguucuuccuuuguccugacuagccuugaacucacaguguucuuacaugccucugauccucaaguguuugccacuacuccuaacauuauuucuaaaaucuguuccuacuauuauuuuagauagugauugauaaagucagcuuuuaaaguauugauagccauugguucaaugcauagccuacauauccucacauuaauacacaauaucuucauuuacuagcuuauauaguggaaaugacacauacauuugacauaauugaacgguagugucauagucaggguuucaauuccuggacaaaacaucaugaccaagaagcaaguuggggaggaaaggguuuauucagcuuacauuuccacauugcuguucaucacugaaagaagucaggacuggaacucaagcaggucaggaagcaggagcugaugcagaggccacggagggauguucuuuacugguuugcuuccccuggcuugcucagccugcucucuuauagaaccaagacuaccagcccagagauggucccacccacaaggggccuuucccccuugaucacaaauugagaaaaugccuuacaguuggaucucauggaggcauuuccucaacugaagcuccuuucucugugauaacuccagcugugucaaguugacacaaaacuagcuaguacauuugaccccuugucaacuugacacacaaacacaucacuaguaagccucagcccucacauucuuauucauccccaaggucuaaauaacuuuaaauguccugucccacauucuuuacauauucuuaaaauuucaaccucuuuaaaauauccaucucuuuuaaaaauccaaagucuuuuuacaauuaaaagucucuuaacggugggcuccacuaaaauaguuucuuccuucaagagggaaaauaucagggcacugucacaaucaaaagcaaaaaucaaucuccaaccauccaaugucugggauccaacucacaaucuucugggcuccuccaagugcuugggucacuucuccagccaugcccuuuguagcacaagcgucauccucuggcuccagaugcagguacuccacugcuacugcugcucuugguggucaucucaugguacuggcaucuccaaaacacugcaugaccccuucagucaugggccgucaauugcaacugaggcugcaccuucaccuuccauggccucucacagcgcugagccucagcugcucugcgugaccccuucaugccuucaaaaccaguaccaucugggugacccuuacacauuaccaaguugugcuucagcaggaguacaaccuuggcuaucucuggaacacagccucuuugggcuuucagaaaacacuucccagaagaugucaccucaacgaugcuggucucuucuuaaucaccgcuaauuucuuagcuccagguaaccagcaucaauagucccaguaaugcaaaguuuuugcuuuaguaguucugguaucuuguuaaucacagcugauucuucagccccagcuaaccagaacuacagaaucuucacaaucaaaacagcaauggcccugaaaagagucuuuaaucuucccucugaaauuucacaagccagaccuccauccucugcacuguucucaacauuaucuuccaagcuccuacacaacauucgacagagcucuuaacacaccgaauggaucuucugacccaaaguuccaaaguccuuccacaguccuccccaaaacauggucagguugucacaggaauaccccacucugcugguaccaauuugucuuaggguuucaauuccuggacaaaacaucaugaccaagaagcaaguuggggaagaaaggguuuauucagcuuacauuuccacauugcuguucaucacugaaagaagucaggaguggaacucgagcaggucagggagcaggagcugaugcagaggccauggagggauauucuuuacuggcuugcucccccuggcuugcucagccugcucucuuauagaaccaagacuaccagcccagggauugucccacccacaaagggccuuucccccuuaucacuaauugagaaaaugccuuacaguuggaucucauggaggcauuuccucaacugaagcuccuuucucugugauaacuccagcugugucaaguugacacaaaacuagccaguacagguaguaccuacacaauaucauaaaugaguaaaaaaaaauacauuauugaagagaaaggaagaaacuguacagugaaugucaccaguuauuuuuuuaaguucacuuuacaggcugaucacagcccccuuuccuccucucuuuccaguuccacccuuacaagucccuucccccacuacccccucuucuucuccucagagaaggaggaguccccgccuuggauaccagccaauccugggagaucuggucccagcagggcuaggcacauccucucccacugaggcccaacagggcaggccagguaggggguaggggacccaaugguaggcaacagagacugagacagcgccugcucuacuucuuaggggucccacaugaagcccaagcggcacauuuacaaaugcuguccagccccugcauguucccugauugguggcccagucucugugagcccccaggggcucagguuaguuuguuguccuugacaccucugguuugcucaauucuuguucccacucuuccaaaagacucccugagcucagccugauguuuggcugugggucugugcaucugcguccaucugcugcuggaugaaaccucucaggagacaguuaugcuagguucuugucugcaagcauaacagagaguaucauuaauagugucagggguuugcuuucucccauggagugggucucaaguggggauguuccuuggcugcauaauaaagauggagcuguucccucaguaucugcuccaucuuuuuccuguauauguuauaggcaagacaaauuuugaguugaugucacucccucaacccuuuagaaguccugcccaguuacaggagguaacaacuucagucuauauccuccucuuguuggaaucucagcuaggcucacccccauagacugccuuauccuucccaguacaaggucuccagguagucccagagaugccucccaccaauuucuauucccauuuucagcccucuccaaaccccucaaucuccccauaccugauuaccaucccuauuccccccgacccccgcccuuguccuaccaaguucccucucuccauccacuuccggugacuaguucccacuucugggagauuccagcauccuaccuugugauguccuuauuacucaguuccuuugggucuguggauuguccugcacuuuauggcuaaugucuacuuauaagugauacauaccauacauacaugucuuccuggcucugguuaccucacucaggaugauauuuucaaguuccauccauuugccuacaaaauuuauguuuucucucucucucucucucucucucucucucucucucucucucucucucucucucucuuucucucuuucucaauagcuaaacaguauuccauuguguaauggaauggaccacauuuuuuuuauucauucuuccauugaggaauaucuuaaguuguuuccuguuucuggcuauuaugaauaaagcugcugugaacauagcuaaacaaaucaggaucaaucuuuaagaaagaacaugucuuagauuaagggguaaaagagagaugaagaggucaauaaaguguuaaagauauucugggaaaacaugacagucuauauuagcuaugguuuuccuuaggccaaacaauacuagcuaugcugcugagacauauaaaagucuagccuuggccaggcguggugguccaugccuuuaaucccagcacuggggaggcagaggcagguggauuucugaguucgaggccagccugguuuacaaagugaguuccaggauagcccgggccauacagagaaacccugucucgaaaaaccaaaaaaaaaaaaaaaaaaaaaaaaaaaaaaaaaaaaaaaagucuagccuugauaacauuuuuuaaaggaauacacacacauguauauguauguguguauauuguuuuguguauaugcguauauagauauauacaaugauacuuguaaaaacugaguugauaggauugauagaaauugaugguuuugagggucuggagagauggcucagcaguuaagaguacugacugcucuucuggagguccuaaguucaaaucccagcaaugacgugguggcucacaaccaucuguaaugagauuggaugcccuuaauaaauaaaucuuuaaaaaaaggaaauugauuguuuuauugccuuuaaaauuauaacuaauucuuuuguuggggacugacaauuuuaucuucugaauuuugaaacuuuaaaaguaagaaguaaaucucaagagcuaacuaaacaguucuguuuuuguauauuaauuacauccuucaaagauuuacuguauuuucuaaguugccuauuuaagugauucugaacacuaauuaguguuuuucguuucuuuuguauaacuguggccagauacuugagagaaccacuuacaagggaaaaagauguguuuuaguuuauaguuuuauaaucuugaauccuggcuguugauucugggccugucacaauggaauacuguucagcagcuaaauaaaggacaagauuaugguagcaagagacuacuuaacucagagagaaaagcagaagggacagggacuaggcagucaccaaggaucuacccccaguaacuacuuugugcacguacgucuuaccuguuaaguuuccacaaccucccaacauauuaccucaaaguagaaacuaaauauuuaacacaugaacugaaaggaguauuucauguccaaauuauaaaagucaucuguguaauacaauguuuacuuuuaaguccucucagcaucaguauaaauuagccagaguuaaaaagccuaaguuuuaagccaaaacuuauuuaaguaaauaagauuaaaugacugguaauagcaggauuggcacuauuucugcugguguauauuuuagaaaaugcaagucuuuccuagaacuacacuuuaugacccagguuuauauuaaugucugucucagaggauagcagauuagcaaacagccuugggugucaguucuuacaaaauuccuaccuuuuguuugagauagcauuaggugguaauuuauguggccuggaaugcagaaaaugucagcuaucucuugcuuuuauccagugcuuagcaauugaugauacuuauacauucuuuccagagugucuaacuuucauucugaauguguccauaccauauguaauuuucaaaauauacucauaaacauguuuuaaaaacaauuaaauaaaccaaauaugucuuggccaaaauugaacaaccucugaauuuacaagcacuauccaggacagugauuucuaaucagaaguacaauaggggaaaaaaauccugaagcuuuucaacaguacacauuuaauuaaguauucuaacacauagaaauguggacuuagcaguuuuugcagaaucucucauauacacauaacugaacacugauaccuucauggccagguauaaccauguagauauuccuuaauaacugugcuucaguugguucugccauguauuuuggccagaucaagauacaagaaguuucucugacucgauugccaucugauuucagccucacacaauuuuuuuuuucccaagccccggguuuugagguuaaauuccuuuuauguaaacaaacaacuguuugcaaggccaaaaaaaaaaaaaaucuuaaauucaggggccauguaauacccacuuuuuacacaugcauagguucuaucaaaggaugucugguuugauuugccuuuucauaccaagugugccauaguucaggagaguauucgggaucauaggaauauuucccuggacuaacagugcuugaauacauuagcccuuugucuuaguuaggauuucuauaccugcacaaaacaucaugaccaagaagcaguuggggaggaaaggguuuauucagcuuacacuuccauacugcuguucaucaccaaggaagucaggacuggaacugaagcaggucaggaagcaggagcugaugcagaggccauggagggauguucuuuacugggcuugccucuccuggcuugcucagccugguaucuuauagaaccaagacuaccagcccagagauggucccacccacaaggggccuuucccccuugaucaguaauugaggaaaugccuuacaguuggaucucauggaggcauuuccucaacugaagcuccugucucugggauaacuccagcugugucaagcugacacacaacuagccaguccacccuuugaaacuugucuucuuggcaguuaaaagggacagaaugaaaacuggggcaugugggguaagugaucccgggccaugaagacagaucuuaggaaagaaacuuagagcugcucucuaaagggcuuuacacagacacuuggugauuggcugacauugugcauuuacuucacuuaguuagaguuaugccauacuagaaacuuucaugaccuuucucccccccucccucccuuccuuucuuucuuucuuuuacaagaaucuaaguuuauugacuaaacuauacagaauauacaguuagucauaaguaugucacuaaguucuuuucguuuucucuuuacucaaaauaaaaggacuugugccagaaacauggaucaguggauagaagauacugucaacaaaacuaauaaucugaauuuagagcucaugcacuacacaguagaaggagagaagugaauccaucaacugucaauaacugcccaugugcuaggacagaaacacaaaugugcagacauuuccacaaaaagaaauaccuguaauaaaaaugaaaauugaccuacagacuauuauucaacuccuuauuuauaucccaauguuaaauuuucuuucuuucuuuuuuuuaguguuuaccuuauaacuuuauuuuuaauggaaauaaucacuuucugucuuucucucuuuucuuucccccccaaccccccaacgcacccccguuuuuuguuguuguuguuguugcuguuguuuuucuuuauacaggguucaauguagcccaagcugccuugaacucacuguguacccaaggaugaauuugaauuuaugaucuuccagccucugugucccugaguauuggcauucucaguauguaccuccauguuaggcuccuugucuccuccuguuaugauaaguaauaguaggagaaugccuuugacuuguuuacuuauuucuuuucuuucuucuucuucuucuuuuuuuuuuuuuaguuauuuuuauucuuuuuacaauucugucauugcccaccuccugguccuuucucccauuccuccucaucccauucauccuccucugucuccaagaggaugccuccaaccccaaaggccucccuacucccugguccucaggucuccagggaguuaggcacaucuucucccacugaggccagaccagggaauccuaugcuguauaugugucaggggccucagaccaccucccauaugcugccugguuggcagcuuaaugucugagagaucucagaggucuggguuaguugagauugcuugucuuccuauggcgccuauccuccucagcuucuuccagccucccccagucucuucuccauuuuuugucccuacaguucuuuuagacaggaacaauucuggguucaagcuuuuuacuguggaauggcaacccaucccucuacuugauacuccgucuuucuacuggagguagacucuaggaguucucucuccccaaucuugaccauuucauuuaaguuguuaguguagaaucucuccaauuucuuuaugaggccacuuagugcucugaauuuuccuuuuagcacugcuuucauugugucccauaaguuuggguaugcuaugucaucauuuuuuauugaauuccaggaagucuuuaauuuccuucuuuauuucuucccugaccaaguuaucauugaggagagaguuguucaguuuccauggguguuuggguuuucuguuguuuuuguugugauuggacaccagccuuaggccuuggugaucugauaagauaaaaggaugucucugucuggagccugcuuccugugucccugggucgcugcaggucuccugggaggccuucagacuuguggugucuucagagggcaggaaugcugaugaucugccccgagcaaagcacagggcagaagggaggugagacuugagcagaggggauggguccugagucugcugggcuacucgggccuucaaagugcugagguuauuugggugggucccuuaccuguugaccuggcucaacacaucuccugggagaccuucagacugcggggucuucggaggggcagacacauugaucugcccauguggaaggcgaacaucaugaugacuuuuuuucuuagaaacuucgugugaagccauuaagucacacuacccaguuuuaaaccccucucucucccucucccucaaacuauugguuuucuagcaggaaucuucugaagaaguucuugucucuacugcuaagggaaagaauauaucaaaggucacucuagccauuucuguuaucuuggauuacauugugcugugauagcaauuaagucuuacuuacauaauuggaauguuugcuacuacuguuaucacucuauguucagauucaacacuugugacucuuuucuguauuaucuucauaccaggacuugaagugacaagucucuggccaaggaagaagauuaauaauauuucaugaacuauuucuuaaagcuuccuuuuuggagauagcacaugauacgcaauccauauuuuauccaccaaacaagucauaugcauaagccugaugucaucccugaaggaagguaaaggguauucuuuaaaaugauaaugccauuuaggcaucuauuaucaguacuccaaaguaagacagcucuguccuugaguaucagagccauguacccuuacacaucaacuuuccuaccuuugugcaaagaggcagcaacccuuuuuucacucagugauauucugccaucucagagauagauaauagcucaauaauggcuuaauggucaguauucucaugaaaacuguuuucaguucuagaaagaugcuucacuucagaacacuuaacugcucuuguacaagccccagauucaguuucuagcacucaaaugaaagcucauaauuauaacucaaguaccagagaauccaguucuagcacuaggcaugcauuugguauauagacauacaugcagauaaaacacuuacacacauaaaaaguaaaauaauacauuucaaaaagaauucuuuuaggguaaacacuuuuaauauaccuuuaaccccagcacgcaggaaacagaagcaggcagaucucucuauugagcucaaggacagucuggucuacagagugaguuccaggaaaaccaggacuauacagugcaaaccuuucuuuaaaaaaccaaaacaaacaaagaaaaagccagugauuuuuaucaaguugguaaacuuguaaauucacagguaaaagaaugaaucuaguucucuuggucuugcucaguucaaaaucaacucagaaagcaugaauaaccuuaauggaagaccagaccuaauagaggauaacaaaugggaaguacugcaagucagcaauguggacagcaaucuuuugaguagcacuccaauaauucaggaaaaggacagccaaaauugacacauggaauugcaucacauuaugaggucuacacagcaaaugaaacaauuuccagagaagaaagacagccugcuggguaggaguaaaaucuuugcagauauucauugaauugauuagcaucuugaacaugucaggaccuugaaaaacuuaacaacaaaggaagaaguaauccaauaaugagugggcagauaaacugaucaaauaguucucaaaaagaaggacaggccugugagacccugccugacucaugcggccucuuugcacucuugaucaucaucuaaccaggcuccgugcucuaaaauaguuaacguugcgacggguaguagugacaaaagccuuuaaucccagcacuuaggaggcagagacaggcagauuucugaguucgagguuagccuggucuacagagugaguuccaggacagccaggacuacacagagaaacccugucacgaaaaaaccaaaaaaaaaaaaaagaaagaaagaaagaaagaaagaaagaaagaaagaaagaagaaagaaaagaaagaaagaaagaaagaaagaaagaaagaaagaaagaaagaaagaaagaaagaaagaaagaaagaaaggaaggaaggaagaaaagaaaagaaaacaaacagcaaggcauggugguacacacuuuuaacccaggcacucaagaggcagaggcgggacagucuggucuacagaguggguuccaggaccagccagggauacacagagaaacccugucuccaaaaccaaaaucaaccaaacaaagaacgaaugcugacagugauguggaagguugcauaaaaagaauccuuguacacuguuaauggcuacagaaauuagaguagaugauccuaaaaaaugaaaauuaucauuugauccaucuuuaauacuccuaggaaucgaagucaucauacacuaaugauaacuacuuacccaucuuuacuaggaguauucacaauagcuaaauuguggaaucagccaagcugccaaucagaagaauggguaaagaaaauguagaaaaaguuacaaugaaguguuuauuauucagacauaaaaaaaauagaaaucauguuguuugcagggauuuggauagaacuagagaucaugauguuaaauaagccagacucagaaaaacugcguuuuccauaauggguggaauauaaauauaaagggggggggggguauggguauuaagaaacaggaccaaagucagcaaggaggacauaaggacagaaaaggauaguggagaucaaaugugagaaaaguacauagcaugcauggcauaugccagaaugccauagcaacaguuuauccaauucauucuuugcaauaaucuaugcuuugaaaaaugaaaaaauauucuguuccuauugacugucucccaagaucauuuucacggaugccagcauaguaggguaggaguugaaccacggguucucccuucuggcuuuuguggaaauagacuguuugcuuuuaaaaguuacaauuucuaccuugaaaucccuccugaauaacuaucaauucccauugccacaaauaagggguuauguuuuucaauacuuuuaaauuguuuucucgccuuagcaccuggcaggauuccauguaguuuugucucuaccaugauuaauucaauauucuaaagucugucacaugcuuguauuuauuaaucucaagaaccauugugaaagaggacaaucauuuaagcucauucgacuauaccuaccaggcaggauuuuuuuuuuguucaacacccaauucugaggguuuuucuucucuuuuugauauuauaaguauaccauuucuccuguugucccuaaaaccuuccuauacucccuuacuuguucucuuccaaauucauggccauuuuuucauuaauuguuguuaaauccaugcauucauacauacauguaugcacauuuguacauauuugcaccuauauacauguguguguguuuucauauauguuucuaaauauagccugcacugucuauuucugguuucuaugcuuucaaggcuggccugaccauuugguauuggauaacuaauuggcauaccauuggcuugccauaguuaucuguaguucuauguguaaaguucaggccuuguaaaguuaaaaaccaaacaaaacaaaauugaggugcaugauucacaaagaaccauugaaauguuuuuaaaaguuuaggccuuggcaagcuuuucucuaucuauuuugaauguccuuguuuacauccuguguaggucgccauguuggugagauuuuauguguuuguuuucugauauuacuaggagguacagucucacaggaaaugcucugauucucucugacucuuuccacucccucuucuccaauguuuccugagccuuagugcaggaauuauuauguagcuauaucuguugggauuagauucuucaacucugugauuugauugguuuaguuuuccuguaauagucuuuaucuguuggaaagaguuccaugaugguggaugaggacuacacuucccugugaguauaaggacaaauauugagaauguaguuagggauugugcuaguuuacuauaguugugguuguugguucuucuucaugauccaugaguucacugucccuggguuuccaguaccaggcaugauuuuucuuguugaguagauccaauuauagagcuguugguuaccacuaaggucugugugccacugucuaccuuuacaguuguggugucuugcuggugacuguaguucacaggugcuauagcuagguaggacuguugauugucuucuuccuuuggaaguuugcuuucucauacgaugaaagcuacuccucaguuuguagcaaauuaauaucuucauaggaaugucuuuaagguauucuauaacuguugauuugaguuuaaaaaacagguuuacuucuuuaaagauaauuuuuuuuauuaaagcauuuccaaguaaaugcaacaguuaaaaaguuucuacacauuagacauaguugguaucuggugcuuuaccuaauuuagaaaaagguauuuccaucagaugacuucuaaaaauauuuacuucucacugcuuuucuuaccuagaucacaagagaccccugaagaugggcagccaccagcuuuaccacccaaacaaucuaagaaaaauaguuggaaccaaauucauuuuucaaacucucagcaagaucuagucacccauacuaaugaauccuuugaugugcccucuuccccugaaaaguccacuguaaguagcuuugcuuaaaaauacacuaugcuccuaaaaagcauucacaugcagauauguuucaggaaauuuaaaguaacauuagaacaugaaauaagaugcaagggguagacuccauaagaugcaucaguaccuaguguuggaagucucuagugcugugcucccugcguuuccauuuauuuccucagaguuccucccauuaucaaaagucuaaagcauucuguuuucuuauggguacuguuccacuacaauagguuuaaucaaaggagaucagaauucuugccaacaauggcaacuuuaguacuaacucuauggugguguucaugugucucuucuugcauacuuggauauaguuaugguuacugaacuuguauuuucaugguagugguuauauuuuuaaaaacacaauauagggaaucaucaagaaauguauguuguuauauaaauaaaggcucuagaaacugagcccuuaccaaauuauaagaaucaggagaugaagggagcaaaaaagguagaaggaaaaguggcaacaagguauaaugcaggagcccaauagaaagggagcacuugguccaguguuacagguaauucaaguaagaccagaauugacacaugauacuggauuuagucaugggaaaauauuuguugucguuaguuuaguuauggaauggugggggugaaaaccugacugguauuaaauagaguuagaggaaagggagauggcaacuucacauuugccaguguucuuccaauagaauggaaggaggaaugagagaauguguauggaaguuauugggcaaagaaacuauuuuccucacaacuaccauuuucuuaggauauuaauucuuuauauaccauaggucauacaagcagauaaauccuauaauuuauauucugaaauuuauuuuugucuucucaagccuaaugguggcauuccacaugauaaccuuguucuaaucaaaaugaaaccugaugaaaauggaagguuuggauucaauguaaagguaauccagaacgaaugucauauuuaguuuuuauauuacaauguucuucauuugguaguauuugauguuuuauuuuacuauuuuccagggaggauaugaucagaagaugccuguaauuguuucccggguagcaccaggaacaccuguaaguuaucccacauuuuaucuaaucguguuucuaagaauauauacuuaagggucaggugugaugcuuaccuaccuuuaaucccagcacuuaggaggcagaagcaggcagaucucggugaguucaugccuagcucugucuacaaagagaguucuaaguucuagaccaccuagaacuacaaacaacaacaaaagccaaaaacuaauauauacuuuguaaaauguuuuuguguguaugaaugcuuuguuuguaugucucugugcacugugugugacccucagagcucagaaugcaguguugcauccccaugaaacuugagguuugggcaguugugagccgcuguauggccccugagauucaaacuuggguccucuacaagaacaguaagugcucuuaacugccaagccaucucuucaacuccauuuguacuuuaaaaaaauuaguuuggcauauauuuugccucccuguauguaucuaucuauacuacacuugugccuauugccugaggagacuggaagauggcauuggaucccuuaguacuagaacaagagcaaccagugcucucaaccacugaacuauuucuucauccccagaaucuguacuuuuaaaaaaacaaagcaacaauaacaaaaaaccauugagauggaguggcaguuaagaacacugguuguucaauucucagaacccacauggugguagcucaaagcuccauuuaacuccaguuccaaggaguccaauagucucuacaaguuaucaggcauuuugugggguacagucuuacaugcaaucaaaucaccuaaacauaaaauaaaaucaaagcacuuuuuugccuaaaggaagaaaaguacuacuuuucaacuugucaaauguuaaaucuaagugcuaaguaucacauuguaaguugcagggaaagagaaaucuuaauugaaucuacaucuuagaaagaaguaauuacucugaguguuccugcagugcuaaagaguuuuguugaaaaaaaucuccuuauucaacaaauguagaugaagguggaguuuuaugagauuuuuuugauauuuuuguuguugcuguuugcuuuuuauuuacuuacaguaguucauuauuugccucccccccuccccccugucccccuuugaggugaguggguggguggaguucgaaacaggguuucucuguguagccuuagcuguccugaaacuuucucaguagaccaggcuggaacucacagagguccaccugcaucugcccgcccccaagugcugugauuaaaggcuugugcuacuacuaccuggguugcccauacuuucuguuuuaaaauuccuuuaaaugggaaugauacaggaucauuuuuaaauucuaauaugcacaugcuaaaacauuaaucuauaauagugagucaccuguugcucauuaauaagcuucuacaguaaugaauuuucuguuaucauuaaauaauuuuuauugguguuaucuagagcaugcuaaaauauuagcaguguuucuccugaauaaauggaauuacugauauguuucacuuucuuuuuucuuccuguuuaguuaucugaauuaugacacugaacauccuuugcucuuaugagcuauaucucuugcuguggugacuuccucccuugugcuacauagaacuaugcuauaaaaauauugugagauuuagaacauauugcgauagaacauuguuggacauauuaaagcaguagaaccuugucauuuuuagauuacuucauuaauauagauaccaccacagucuuccauguugugaccuuuuaagaaaaagaugauuaaaggaaacaguuucuugguuguuuuugauuguugguugguugguuuuucugagacaggguuucucuauuuagcccugguuguccuggaacucacucuaaguaaaucaaagcuggcuugaacucaagagauccuccugcuucagcaugcugagugcuggguuuuaaugucaggauuuuuuguguguguguuuuggguaccucagaaauggauaguucuggggguggguggguaagggggacuuuugguauagcauuggaaauguaaaggagcuaaauaccuaauaaaaaauggaaaaaaaaaaaaaaaaaaacaaaaaaaaaaaaaaaaaaaaaaaaaaaaaagaaauggauaguucacauuuaaaacaucauuuucuuuacaauggaaaucuuguaaucagugucuauuccucuuagaaaauuuguuuaaugucuaggguuucaaaucagaaagaaaugcaaaucaaaauuuauaucugacaaaaggcagguuaaauaugaggaaguuucuauccaugcugauggguauaguaaaagccucauagaggacucaugucccuugauacauagagcacaucuuuucugacugcauacuacccauagaguaauaugggaagacagugcuuucugcugaauuagcauuucuuccaauaguuuagcaaccauucuacuucauuaugaauauccuaauaugcauuuauaaaaguguagaaucaaacugguauauagaugcauuucccuacauaaggaaccauauaaauauuugacuucuacuuuaauaaaauauagccacaagaacccuaaauaauaaauaaaggcugacauuugaauauuugagauuuuaaaacauuuuauugaaauuacucacuuuuauuuucacaacucuagaagauaaaucaggcuaaguucuuguauuuucaagguguugacugucugagguuacacauuucauaagcacuggaggaugagcaguguucaguguucuuuccacuaggcacacugucuggcugagaauuaugaaauaauuguuuauaguaaauuugaguaacaugucuauuucuccuucccuuugccauagcauuucuuucacuuccugaccugccaucuucaugcuuguacucauguguuuucauagaacauuuauuccuauuucugauucuuuuaucuccuuuaucuaaauuacugaguuucucaauauucgggcaguucuuauuacaguagugcagaauuuuaaagauggccaugcaaauugaaaucacuuggaaaaauuauacuguuuuuaugacuuuagaucuguuuucuauagaagaggacauugauucccucuuagaacuggaguuacagggggguuuuuagcccaaugugggugcuggaaaaugaacuuaggguuuugggaagagcagccaaugcucuuaaccacugaggaucucuccagcugaagugcuccauuuugagauacaaacuuuuggacugaagcacuagcugcaaauguauacuuuaugcaguaagacauaauauauucugaaagcuaaaauuuggaggauguaauucagaaacugauguucuuuaagcugugggaacugaaauuguauauauucaaagaguacaaaauuaagacugccuguauguauauaugcauuuugacauauuucuuaucugaaucuuucuggacauaauaggccaugaagaaggaauuugaauuuucagugaaguuguaaaacaaaauaggguguucaaaagaaaacuuaauuucugcuuuuucaaguaaaagagauugauagauugucugugugugugugugugugugugugugugugugugugugugugugugugugugugaacuagaggcugaugacuuccucagucacucucuaccuuauuauuuuacuuuuugagaugguauccauuuuccuacccuugcaugcaugcuuuucuauauguaauuuuaauuaucuuucuauacgauguaaagaguaaguuuuauauuuucaggaugcugggcaccuauuugaacacuuaucuacauuauauuacaggcugaccucugugucccucgcuugaaugaaggggaccaagugguacuaauaaauggucgggacauugcagaacauacccaugaucaaguagucuuguuuauuaaagcuagcugugagaaacauucuggggaacucgugcuccuaguccgaccuaaugguaaguagucuguguagcacugaggauuuguccucauuuguugcuguuuacuccuggacacggcggccagagucggcaucuauacaugucaugucaguuuccucuucaaaccacagugcugucugucauaaucggagaaaaacaauccaaaaucuucgcuugcuugucucccagucacacuuucuuucaccucugaugcacaguggagucauuacuguuuccccagaucuucaaccugacauaacuuucaggucuguggacuuguguuuccucugcucugcaaauacuucuuguuuuuuuggguuuuuuugguuuuguaacucaugucuuuccuucauucaaaauuuuuuucucugcuuauuuuaccauaccuagaguggccucccucuucaaucauucuaagaauaguauagucagugaauauuuaaugaauaaauaaacuccauguugugcuucuagaaaaauccaaaacaaacucuaauuaaacaaagaaagauacuguuaacuauauuuuucguaagugguacccucuugacuaauuaugucaaacucuuaucugggcauauacuacuagcauuaucugcauuuauauucacuauagcacuauucucaguacccaacuuauacacccugcuguguccaccagcaguuauauaaacagcaugagguacuuaugcagagucuuguaucuuaaaagaaugaauguggccaggcaguggugacgcacgccuuuaaucccagcacuugggagacagaugcaggcagauuucugaguucaaggccagccuggucuacagagugagcuccaggacagccagggcuacacagagaaacccugucaugaaaaaacaaaaaacaaaacaaaacaaaacaacaaaaaaggcaugaauguagaaggagucuuuauuacagaagagacacagcaggagagucgugcgugggauuccgaucuguuguagucaugaaugagaauguuacagugagauguugcuuagagaaaagaaaaauucccuuuuuauauuuuucaaaggaggcaucuuauuuucuguauuuucuguuauuauccauguauaauacugaauuggcuuucuaagaauguuaaacagguauuaacagacauucauuuugauucugaggaacuuguuuguuuaggcuucauacugucuguuuugugucacagcugcaauuuuacaccaacagcaaucucucaguuuggcuuuucuguccucuucugauaacagcuccuguggcacucagugacaauagucaguagcuguuguacuuaagcugcuguguauguuuguacuuaaucuucagagccaccaaauaugauagguacauuacucucauuuuagaguugaaaauacuuucaaagacuauuuccuguuuauagauucauaaugggcaccaagccagaauauaaacuaaagucuuugacagcauaggccuuuuugcacuuucagauguuucuuuauauuuuaaaacugaggaggaacccagcuaggcccuuguaaagaauuauucuagauggagaccucacucauuuucuuucuuucuuuuuuuuuuuuuuaagauuuauuuauuuauuauauguaaguacacuguagcugucuucauacacuccagaagagggcgccagaucuuguuacggaugguugugagccaccaugugguugcugggaauugaacucaguaccuuuggaagagcagucagugcucuuaccugcugagccaucucgccagcccccuccacucauuuucaguguggacuuugucacaucuuuuuuuuuuuucucucucaaguauaguacaugauguuuccuaauccagcaagauggcugagaggaggcagucguuuacagagaauauagcuuuacauauggaugaaccauuuauuuguguguuaauagagcucauguuaaacaaaguuaaggagcuggauauggcucagcaguuacaagcacuugauguauuuacaaaggaccagaguuugacuuccaauauccacaugguaauucacaauggucuguaacucuaguuccagguuaucuaauaccgccuucuggcauucauaggcaccagacauguacuuguuuuacauacacacauucaagcaaaacguccauacauguaaaacuaauuuucuuuaaaauggagcuaagagggaaaauaaauaaggauaaguuguaggccuggcauuuauaggcccaacaucuaagaucugagcucucuuauacuaacuugaacaugaaagaugcuuagugacuaguugggugagagaauauggggcugauuuauucagcuuuguguucauuuaucauaugaucaaagcuagcauaucuuuagacauaaugguguauagacuucuaucuaugccauugauccauuuccuagaaauuaagggcaugucuauucagaucuccagcucaaaaugccucauuuucucuauuuuuguaaguauuuauuaacucugugugugugugugugucugucugucugucugucugucugucugucugucugucugugucugugucugcaugcucaugaucacacauuugaacacuccuguguguguugaugcuuguggcaugagcccaggaucccaagaaugucagaaaagggcaucuauccauuggaacuggaauuacaggagguugugaauugccagguggauguugguaacuggaccuagguccucuucaagagcagaaagugcucuuaacugcuuuagucuugccucauuuucuuaaugugucuucagauauuaaauauguagauggauaaagaacccuucuuuuuuccaaaggaauagcaacccccauagccuuucaaccccacagucauucuuguuuccuacacaaaggcaccaaucagauauaaugcaauuauuaguuauugaaucuauagaauacaucugucaauuucuuacugaauucuauuaagauucuuacugugcuuuuuguuguauuuuagcuguauaugauguaguggaagaaaaacuagaaagugaaccagacuuccaguauauuccugagaaagccccacuagauaguguccaucaagaugaccauuccuugcgggagucaaugauccagcuagcugaggggcuuaucacuggaacaguacuggcacaguuugauguaaguaauaacauuuauauuaaaucaguauuugcuaaauaguuugaggguuguuuagggccuaaucuacugugcauuaugauuuauaagguaaaauuauaggcuuagaauuuguuagcaugaagaauucuaaaauguaguuuuuaaaaauuauuuccauaauacugguuaugacuguauaaauaaguuuuuuuauaagaucuauuuguuuauuuauuaauuaauauguaaguacacuauagcuaucucagacacccuagaagagggcaucaaaucucauuacagaugguugugagccaccaugugguugcugggauuugaacucaggaccuucggaaaaguagucaguacucuuaauugcugagccaucucuccagcucaaauaaguuucuuuuuaaaagaagaauaaaagcuaugcaggaagaugucguucaguucaagaugagcccagaacaaugaguuauggggcaaucuaaguuauacaaugagaucccucucaaaauauauaaaaguaguaaauguaaacacauuucguauguuuuuuucauguaauuuuuuaguuuuuuuuuuuuaauggaaacuacaagauaauauugucuuauaaauucaaagcuugcgaaaagccaaaugucacagcacauaucauuuguaauacuggguaucacagcauuacaauuuuccaugaguuuggggccauccuuagcuauauguagcaaaguccugguauuaaaaaauaaguaaaauaagaauaagcaaaaguuaauaacauaacuuauauuuaaaauucauaguuuguaauauuuaaucuuuuucuaguuuuuuugucuguauagucuuauaaccucucagaucauuaucucagaugaaaaagaaugcuucuugauugauaaucccacccccacauacccccccacacccucugagacagggucuuucccuauaaugcuagcacuuucuguauagcccuagcuauucugggauucaaucuguagacaaggcuggccucaaacucagagaaucaccugcauaugcccccuaaguucugggauuagagcugcacaccaucuuugccuggcaugaauguuaaucucuauuuugauuugugaguauauaguaaauuugaaagucuauauuuaaaccagacauguccagccuguggcccacagguugcuuauauccaagauaguuauaaaucuaguccaacacauuuguagaugguaauauuuugucauagugaucuuuauuuaucuuuaauaaaaccaggaauuuccccauguguuuuuaaauauugauggcuauauacaaauauguuguauauaaaugcuuauaauaauaaaacaugcuaagacaugcauccauucuuuuuugaaaaugucucaguguaccuuugaacacuuucaaacuaaaauaaagccaaauguucuuuguagacuugcuauugaaauacuuuagugagcaaaauuguuuucaaacuuuucaaaauaucauagaugcauauugcaugucagaaacuaccaagcagacuauaucucugggucagcacgugucuguucugaaaaguaucaugguacgcacggaguauggaggguuuccauuggaauagaaacaagucugccaaaacaaagcagaacuguugauguucagacgguuucuguuuguuuguuuuuaaagcaacucuaucggaaaaaaccuggaaugacaaugucuugugccaaauuaccucagaacauuuccaaaaacagauacagagauauuucaccuuguaaguaucuauuaacucuuacaauauaagcuuaauauuuuaaauaaaacuuuauuaaauuuuuaugacuagagugugguucauuagugguauagcuuuucugguuuaaucccaaauaucaaaacagaagaaacuauuguaucuuuuaauuuuuuuuagaugaugcuacacggguccuuuuaaaagguaaugaagacuacaucaaugcaaacuauauaaauguaaguuuuuuguucugccuuuguuguugggagcaauugaaaaccauuguaaauuugaagguuaauuccuuuuuauugaaagucuaaccuugauucuuugugcaauugaugaacgagguaauagugaaucaucauuacuagggcaaauauguaguuagguguuuauaaguaaauagucacauuucaucagcuaaucaaugcacagcuucauuuaaagcuuuauuuaauaauaacauuguuguuuuguuaacuuugcauagccaauagcauuugaaguguaauucaugacugaagaaagcuaaucuacauucucuccauggugaauaacauugcaaccuucauguacauaagaacucuauacagcacuucaucacugugauuguaaauggugcaauuacccacaauaaaccugaaaaugugaagaauaugguacugcacaguaaucggggcugcauguaggcaguauaaaaggggaaugaaacagcugccuuuugaugucaucugaaaaaaaaaugcuuauccagugacucaaaugguuucuuccucaguaugccuagacauaaucaacaaagcccgccuccuguuuugaaacugcauaagaacuuuagcaauuauggaggcuagagagauggcaaagcaguuaagcuugcugcauaaucaugaggccccuucuucaaaggauuaggcagagagugauauaaguugccauacagcuccuccuuuuggccuuagauaaugacuuguggaguuguuguuuguuuguuuuuuuaagcaaagccaggauaaugaaacuuagaaaaauaaguaucacaguuaaaugaaguuuaaacuuagaaaacaaaguacaaauuuaaacuacauaaaaguucuacuguuuaucucugaaaaugaaaggccaaaaauuugaugauaacauacacguguauaguucuuuaucugaaaccuucaaguauucauuggcauugaaaauuuuuagauuuuuuuaagacuauucagugcguguagcagugcaauaggaaguaaauauuccuagcagguuauaauaggggcccuuuaauuauuauacugauacuauauaaauauucugagugggauuaagucaaagucacauuuugaugucaaaugcuuucaaguaaagucaccuuuaaaaugcuuucaaguuaggacaagguucaaaacaccaaaaucaguuuuucauuucagacuauuggucuuuucagaacuauggauaagggaauguagcuauauuggcaaguaucaauuaacuacauuccuguguguuguugguuaaaauguagacugguuucuuuggggagcaguuugguauuguuagaaguugaacugugaauacauuuguauccagcauuuucauuucuuccuguugaccuuauagguagauauauuuuuucguuugcuaaaaaugucagguuuagagaagagcagggcucaguuuacuuugcuacugguaacaaacauuaacaaugccuaaaauuucuguuuuauaaguuacaguauuuuuuuaagaagagucauuaaaagaaagaaauuagguacuaauuuggguauuaucuuucaaacagugggauucagaacaccauacacauuguguuacucuuuuaaaauugguuuuauagaaaaauaguuguuguauacagacuauuuaugugaaagagguacuaggaaguagaaaaacaaauuuacccucugguaauaaguggaagcugguuugggagggagacuucaaguuucaaguaccuuggguauuuucuaaauugcuauauguagguaucagcuuguugaaaucaaccucaaauguagaguguugauuccucuauauuuauugucuuauuucauucuaaaaacaaacuuuaauauuauucuaaugguucuucacauuauuuaaugagcaccauucagcuaaaaugaauggcagaauuuuucuuccuuagaaaauuuaccaauaaacuauuuauacuuuuaaaaaauauuuuuacaaacucuugguauuuaaaagaaguuccucuauaaugcugccucuuaagccauaauaguuugagauacggugguacaugccuauaauaguucagaugcugggcuacauagugagaccuuguuucaaagaagaaaaaaauaaaggaagguaguguuuggaaaauauuugcuuuaaguuccucuuccaccaauuaaauaaugaauaaguauaacuuuggacauugccaggaaauuucuuuuacaaguaaaauuauuaaugaagaucauuucuuauuuuaaugucuuuuucuuguuagauggaaauuccuucuucaaguauuauaaaucaauacauugcuugucaagggccauuaccacacacuuguaaagauuuuuggcaaaugacuugggaacaaggcuccuccaugguugugauguugaccacacaaguugaacguggcagaguaagcuauaguuuaaucuuaaacauuacuuaggcucuuuuuaaauuacauuguguuuauauacucagaacauccucuuguagccuuuuaucuuuuguuuugguuccaugcuuugaaucauuacagcuaaauacuuaagacugugaucagcacaauacuagcaacacaaauauuaccauucuuuucauuguauuuauuuaaaaucaauacuuuaaauuuuaaaguuuaauacugaagaauauuuggcaauaauaguaacugaaguagugauaauaaaauuugggugacacugaagagcuuuaugcugaaugagaaauuguuaacaaaacaaaaauuauuguauaauuccauuuuuauggaacaucccagauugguucuucauauguacagaaaguagauuaguagauaccuaaguccagguuugggaaagaggauggaaugggucagaaagcauaacagcuacuaaggaauauaugggguuuuuauggcacagugaaaaugaacuaagaguuuagggaaugguuacacaguucuaugaaguguacugaaagcaguugcacuuuaaacgggucagugauaugaaaauagagcuaggauauauagcacauacacauaugcacauguuccuacacaccugugauaaacucuuaucaggauguagccaaacagauuguuuagagaagguuuuuaaaggucagugaacagccaggcaagauggauaacuaaguaaagugcauagggaccuaaggugagauccccaguacucaccguaacauuuagaucugguagcuugcaucuguagcccuagagcuggagggccagagcagagauaagcagaucccugugcucauugaccagccagcuugccuagccauacugaagagcuacaaauacagugauagaccuuuucucaaauaaacaagguagugagugauggaagagaccacagugcuacaugugugugcauacacacucauauaugugcacaguaacauucauacaauacgcaccuguacacacgaaaauauuaguagcuauaagauguaugagaauuaguuccuauaaauuugaaaguucuuaaaaaauuagaucauuuugaaaguuggagaauucaaauuuaugucuuaaauagguaauuuucuguauucaaucuguugacaaucagguuaaaugucaccaguauuggccagaacccucagaaagcucauccuauggaugcuaucaagucaccugccacucugaagaaggaaacccugccuauaucuucaggaagaugacacuguuuaaccaagagguaagaagucaagagugucuguguauaagaacugcuguaaagacuuuggaaaaugaaaauguuuuuagucugagacuaguuacuaggaaacaaaaguuacucaacuggugacuagaaggauggaucaucaguuaagaacaacacuugcugggggcugaaggaauggcucagagguuaagugcaccgacugcucuuccaaagacccugaguucaauucccaacaaccacauggugacucaaaacauucuuuaaugggauccgauacccucuucuggugugucuggagauagcuacagugugcucauauauacauaaaauaaauaauucuuaaaaacaaaacaaaagaacacuugcugauuagucauaaggaaaauucagaucgcagcacugauauaauaagcuggacauaacuacaagugccugugaccccagcucugagaauuuagacagaaggaucccuggggcuuucugaguucuaucuagcauagcucugagcaaugaccagguuuagugagagauacuguucuaaaggaauaagaagaaaguaagaaaggaggauaccugauaacuuuucuggccuccacauauauauaguccacauacaugcacauacacacacacacuuuauuuaucuuugcauaguucugagguacucugguuauauaaauaaaaaugucauggcuagauauagcuagcuuuauauagcuauaguuagacuaagaaaaaggacuauguugaagauagaaaucacuaugcacacauacacacacacuugccuaccucuuggucaucuagcuaggaaaauaaagauuaaaauaaagaacuaucuuaaugauuaaccuacagauugguacauuauaauuauaagcuagacaguauauccuuaauuuauucuuauucaaauaaacuuuagccguuuucucccuguaaaguuuagcuucauuuacuguccgauuccuuuucuauauguuagcacaucaucaggcuccuuccuuauuggcuguaagagagccaguaaggcuguaugucacuugucauuaaucauacccuuggaguuccugccuucaaaaguuuuaaguauuggugggagagaccugggccuucacagucuuauguggcaguuucuuucuuccuuuggcuuuguuuaaaauggccgucaguguuacuaaguguuguggugcaaguauuuaauccuagcuugagccaaacauaaaauguugagccaacauaaaaaugcacacacacaaugcugggcggugguggcgcaugccuuuaaucccagcacucgggaggcugaggcagguggauuucugaguucgaggacagccagggcuacacagagaaacccugucucgaaaaaaaaaaaacaaaacaaaacaaauaaaauaaaauaaagugaaauaaaauaaaauaaaauaaaacugcacauacacugauagauaguagaucggcaaccuccacucccaaagucuugauugacuuugaccuucauugaaggggcucuagccagccugucaagccuggcccuucuuucuuguuuucucuuccugugcuagcccaaaaggcccauuuccuuauuaguccacuuucuccuucugaaacugacuacgaguccauuuaucaaaguauugaaguccagcaaucuaaagcccccuuuggcucaccuaauuaacaugcccaauuaaaauuaaucaucucacucugacucuuccccuuuuaccuuuauaaacugccaagucugucuccucucuguccauaggcaguccuuugucagcacccacccacucccaucccaaggacaaauacuccuucccccucuccuguuuccuauccuuucucccuuagccucugucuucugucuuucucucuuauuuaugcccuuuucgcgaacuuggucuugguggucugaguugauaccugucuuuucauucaugaucugcauuuaacauaaauggcuguccacagacugagugauguugaaugauaguuauauccuguuuuaaagugugugagucaguaauuugauaugauuuagucuuuuuaggaaaccuuuuaaaccuaaagaugcuguggagcuguagguguccuuucacuuuucacuugaaggaaagaaccucugaaauauuaaaugccaaaacuggcagaguuaggauuugaggauuugagccagaguucuuacuuuaauuauauccaucauugcuccccuuacugcagccaaguauauauauauuauauauuuauauacucuaucuguauauuugagagauuuuguauuuaaauguuuuauuauacucauuuaugugugcgcaaguguuugugguuuugucauggugcaccuguggaggucagagagggcagaagacaaccuaaaggagucugcugucugcuccacaguaugugucccagcaauuggguugagauggucauucuuggccauaagcacuccuagcagcugagccauuucauucuccuggggcuuugaugucauuccugucauggaauaauugucucaaguuuuguucaugcucacaaaguguuuacuuuaccaucuuuguucacguggaaucccuauuagguaaucuuuuaagcaguucucugaccuuaauuuauuugauuacccuguucaaaaugccuuagacauaaaaauugagucauuaaaguauagcaauguugccagguggugguggugaacaccuuuaauccuagcacuugggaguuagaaguagguggaucuuuaugaauuugagucuagccugaucuacagacuuaguuccaggacugccaaaagcuauacaaagaaacugugucucggaaaaucuuuaccaaaaaaaaaaaaaaaaaaguauagcaauguaaguagcuaguacuuacaaggauacaacuauuucugugaaauguuuuccuucaguucaaauguuguauuuaagugaguuuauacacaauggcaagacaaaauggaaaggugguuuuauuuccuucuaaagcuaaaauggcaugaauuuuauauuuuaaagguaauuccuaagucaaaguguguaacuucucauuuucauuuagaaaaaugagagccgucaacuuacucagauucaguacacagccuggccugaccauggaguaccugaugauucgagugacuuucuggauuuuguuugucauguacgagaccagagggcuggaaaagaagagcccauuauuguucauugcagguacuuuauuuccuguccuuaagaaaugaauaaguacguuguugggaaugcauucuguauuuuggccuuuuguuguaauagaagaugguagacaauggagaaaauucuaauauaaugguguagaaacuauguaaaaggauaaaaacaauaguuauuuucugguucuccuguuuuagucucucuucauuggaaugugucuuauaauugaugguaacuuggauaugaugaaauacugacaucguuuccauguguuguauugcuauaacaagacauuugaaacuugguaauuuauaaaaacaggaauguaguuuucaguuuuagauugcaaggcuaaguguggccagcagaggcugcuacucuacaaacuaggggagcuaauacagugcagagcccugugggccucugaagcuuaaccuguaugacuagcagcagauccaaaguggcaucuuucuuucugccacugggucacaugugauaauaucuuaauauauaccuuuagugguaauaucuuaauguuuucuuauuuuaacauuuuugagaaaaggucuuguauaaccuaaccuggucuaaaugcccuuacgauccuccaccaauucuggaguuguacauguauacuauacugccaccccaucuuacaaaauagaauuuuuguguuuuuauuuuuuuuaaauuucauuuccauguuuaacugguuuuauuuuucauuauucagcaagcuuuuuuuguuuuguuuuguuuuguuuuucaagacaggguuucucuguauagcccuggcuguccuggaacucacucuguagaacaggcaggccuugaacuuagaaaucugccugccucugccuccugagugcugggaucaaaggugugcgccaccacgcccggcuuuucuuuucuuuuuaaucuccuguuuuuuccuccucuucuuuauuuuaauauuuuuuuuauuauuuguuaaauugacaucauacaucccaauuccacucaucuccucaucccuccauauauacccucugcccuugcaaccuucucccaaaaacaaaugaaauaaaaccaucucacugugggagcugcagcgggucacacaguguaaucuguucccacacagcuuuacuuggaaauggucaucacaaugagucguugcuccagcaucaauacuggauccuugccuggauauccuuuuagugcccugugucaugggcauucgacaacuuugguucuguagaaccugccccuucccacacuccagugugugugaguucaucagccuccccaccccccacccccagcucuccugugcccaugcuaauggggccagcucuuccacuuugcucuagugggggauuccuccuccguuuuauaacuuauuucuacucuucuuuuuccuuuuacuuaacacuguuucuugugucccuuuuuccucuccuuucuuucuuuaucccauucauuacuauuuccaccuuugcuauaaaugauuuuuaacuucagaguauacuuaacauucauuuugccauuuuuuucuucuuuggucauugcggguguguuauggaguuuaaccaauuucacuguguuucgauaucacauucauugugggguuaccaauuuguuuucaucucccugaguaauauuggggguuuacccugcaagaauagucugcuagggaggaagauucccaaauaaaaguggaagaaaaauccauaccaacaaaggcacaaauuaagacacagaaauacuccucaauuacuaaauucaaacauacuaaaacagguaaaauauuggauaaauucaaacauuuuccuguaaaaaucauuagugacuuuaaggaaaauacaaauaagcagaugaaugaacuaagaauuucacauggggccuuggaaagaaaacuggcaacauagaggagaaaguaagcaaguggauagaaaaguuagcuuacacaugaauaagaaauuaaucaaggaaaucgagauguacaaaauacaaauagcaauguuggagaugaaaacuuuggaggaacaaauuuuuaauaaauauagaaaguagacugcaucaccaauggacuagacgaaguagcaacaauaaaagaacaucaggacuguaggcaagccugaagaauacuaugcaaacuugauuuaaaagcccgccuuuaaucccaguacucuggaggcagaggcagguggauuucugagugcgaggccagccuggucuacaaacugaguuccaggacagccaggccuauacagagaaacccugucucaaaaaaaccaaaauaaauaaauaaauaaaucaagcaagcaagcaagcaaaaagucacaaccacaauuuucaaaaacuguaggauguuaucaagagacagaaucuaggaaucugugggguagaaggaaucaaaauuaaaauuucauaacauuaugaacuaaccagcaccccggagcucuugacucuagcugcauauguaucaaaagauggccuagucagccaucacuggaaagagaggcccauuggacacacaaacuuuauaugccccaguacaggggaacgccagggccaaaaaaaugggaauggguguguagggaagugggggggggggaagaggguaugggggacuuuucggauacauuggaaauguaauugaggaaaauauguaaaaaaaaaaaaaaggaaaaaaauaguucuauauuuuuuucucuaucaugucauaaggauugugaagauuaauuuuaaaauuagguuccuaaugucaugaccuuauaaauuauaucuaucuccuguaugacucaguguguauguugcuuuuaaaguaguagaggugcauguauuuggacaacaugaagaguccaauggauaaaaauuaacacuguugacuauguuaugaguacagagacucaagacuauguauauucaggcacaaucuaaugaugaccaaucuuacuuauguuuaaaaauuugauugaucucaaauauaauucauuuaaacauuaaaaaaauuucaucuagaaaaucuauucaaugaaaauaaagcaguuuuccaaaucuagggaagaaaugaacaucuaagcccagguguuauuuagaaccccaaauuacaugaccaagagagaaccucuccauaguacaguauacucaagaugccaaaguguaaaaacacagcaauauuaaaaacuguagaagagggggcuggugagauggcucaguggguaagagcacccgacugcucuucggaagguccagaguucaaaucccagcaaccacaugguggcucacaaccaucuguaacaagaucugaugcccucuucuggagugucugaagacagcuacaguguacuuacauauaauaaauaaauaaauaaaucuuuaaaaaaaaaaaaaaacuguagaagagccaagcauaguggaacauaccuuggugcaaaggaaguaggaucuuugauguucaggccaggcaguacaacauaguaagccccuuuuccaaacaagacaaacacuguaagagaaaagacaguaucucacaacagcaagcauagugaccggagagauggcucaucagucaagaacacuggcugcucuuguagaaggccugucuuugauucccagaacucacauaguaacucauaacugucuuuaagucuaguccaaggcauuugaugcucucuucuaucuuccuugggccagagaugcaugugauaaacacacauaacugcaggcaaaacacuuaaacacauaccaugguugagauaguaaaucguugagggaaggggaguacauuagaucuuacaacagaaauuuaaaaggccauaaaagcaugaaaucguauauuucaaguccugaaggugaauagcuaauaaagcugcucuauuccccaaagcuaccuuuuaauagaacagaaauaaggacauuucaacucuaagacaguucauggccacuaagucagcauugcaaaagcuccugaaaggggaccgaaacacagggcaguaggaacaguggagagcacaggcuagagcugcuuucaugugaggacuaaauaagcaaaggauacuuaaacccaucauaucuuguuuaacaaaguaagucagugaaaguccuaaugcagauagagaaaaagcaaaaagcaaauauuaaccaaccaaaacaacaaccagcaaaauuauaggcgaaaagaagggaaagaaagaaauggaaagggaaggaaaaagaaaauaaaaagaaagucaggagaaccaugcccucaacauaauaaagacuacaauaaacauaccaaagacuacaauaaaccuguagucaacaugauagaugccaaaugcagaaaagcugaacgcauuuucucuacagucagaaacuagacaauucacauauucaauauauugcucuaugcgugauucaguauaauaucaaaauaagcuagaauaauauggcaagaaaaugaaaauauaaauaaauauuuucuggucaugugauaugauuuuuaaaagacucuacagacuccauaagaaaacucuuagcucugaauaacacuuuuaaccaauauuaaaagaaaaauaucaacaaacaaauauagguagcuuucauauagaucaguaagaagcuugucaacaaggaauucagugggaaaguucauucacaguagcuuaauaaaguaccuaggaauaaacauaauuaaggccauuaacgaccucuacaauaaaaaugcuaaaauacugaagaaaguaauugaagauacugaaagaugaacagcccuaccauacuuaugggcuaauauaauaauuguaaaauggcuguguuacuaaaagaaaguuacagacuaaacauaaucuuugucaaaauucuacugacauucuccagaaauagaacagaaaauccuauaacucacaugaaagcaaaaaagacccccaaauaaacaagacaaacaaacaaacaaacacaucauaaucagagaguaucacaguauaugaucucaagguaaacuguacaacuguagugacaaacgcagugggauucuggcaugaacagacacagaccaguggcuagaguaauagaaccagaaguaaaugcacacaauuacaucuaccauuuuacaaguguugacaacauaguuuuaacuuggguaguguugaucucuugauaaucacggauuauucuucauccccagcugauuagaaacagccaauuuuuaauuaaaaauauaucaacagccccaauagacuguuuucaaggauuccaaaccuuucucugaaacuucacaagcuaggccucuauuaucuuuguuucucucagcaugauuuuccuacgacucauuaggcuccgagcacucaaugucuuuuccagaccaaagcucaaaacccuccaccuuucuaccauaagacaucccaaggcauaaaaacuacauagugagguccaucacaguaaggcuucacuuuuaguaccaguuucugcuuuaguuugauuuucuuuugcugugaguaaacagugaucagaagcaacuugguacagaauuuauuuuauuuuaugucccucauggagggaagucggggcaagacucacagcaggauucuggggucagaagcugaagaagcaucacaaugguuacucacucacuccuacugacuugcuaagcuacuuuucuuaaauagccuaggaacaccugccaaggguuggcacuacccacacuagucuggguccuccuauaucaaucagcaauuaagaaaguaccccgaagcccauaggcuaaacugauggagucaguucuucaauuggcuuucugacaaaugaguugucagaacguaaccagacaaccuccucaauacauggugcugaaaaaucuggaugccagcuuuuaaaagaaagaaacuggacucauaccucucaugcuucauaaauaucaacuuaaaaugaaucagaaaccauuauauaagacuugagaaccagaaacucuuagaggaaacuguggauaaaacgugaugauacaagcaggaauucucugagcguguaaaagcucuagaaguaaugucaaguaaugacaaauggaauuggaucacauuuuaaagcuucuguucaaugaaagaaauuaucaguggagugaagagaugcuguuugccaaugggaaaucugacccgauuaauaucuagaugggacaaaacaaaauauccacuuaguaaauaagcaaauaaguugaacuaacaguucucaaaagaagaaacacaaauagccaauggauauaugaaaaaagguucaacauccuuuaguuauuagggaaaugaaaaguaaaacuuguuugucauuuuaucucauucugcucagaauggccauccucaagaaacuagauaagaaaugauggugaggauaugggaaaaguggagccuuuauucacgucuucugagaauaugaaucguuacagucucugugaaaaucaguauguggguuccuugaauauuaaacuaccacgugacccagcuauuccacagauuaauauauacuuuaaccacuugaugccaguucaauauaucacagauaugcuuacauuuuauuguuauuuuguuaauauauuauuaauaaauguacauuauuauauuuauuauugcuauacuguuuacaauagcccagauauggaaccagccuagaugcccaucaacagauagauagauagauagauagauagauagauagauagauagauagauagauagauagauagaggaguguggugcauauauacaaugaauucaguguaaagaagaaugaaaauuuaucauuuauaagaaaguugauagagccgggcgugguggcgcacaccuuuaaucccaguauucuggaggcagaggcagguagauuucugaguuugaggccagccuggucuacaaagugaguuccagaacagccagggcuauacagagaaacccugucucaaacaaacaaacaaacaaacaaaguugauaaaacuguagaucagguucagaaauacauuuuguuuugguuuugguuuugguuuuuugguggauauuuaguaagggaaaaauacaugcaaguaagaagggaaguagaagaaaaggaaugaaagggaagagggaaaguuaagggacaaacaaaaggggccauguuuucucucauagggaaucuagauuuaaauauacacauauugaaauaucugcauaugauaugaaagcaaaaagggggcaggugguaggaggcgaguacaggacgggaagugccauguuaugcaggaaaaaugucaugaaauucauucaucauuuuguaugcuaaccaaaaaaaaauuuuuuuaggaguucagugucagggcuggagguugacugcucagugcuuaagagaauuauuucucauucugaggaccaggguucaugacccagcacucacaugguggcuaacaaccaacuaaaguuccuguugcuggggaugucaucucuggccucugcaggcacuagacauaggcacaggcacauggugcacuuacauacaugcaggcaaaacacuuauacacaugaaauaauuuuaaaaaacaaaacaagaugcaaugucaacaagguuagauguaugcgucuuuacauuauagaaaucuucaguagcuacuauagucauguuuguagguuauaauuuuuuuuaaguaucucaaugguaaauuugauauaauuuaacuuuguuuaaaacauuaacuuacauaagguacaaaaaaccauaauuguauuuuauguauuuuuaaugauuuauuuuacauuuuuucuuuugcauuuaaauggauuuaaaauauuaaacaguuagcuuguuaguuuuaucaaauaaaaccuuaaaaggaaauuguuuuucuuuauugugauuugcuuuuucuuugcuauuucugcagaaaagccacaaauuuagcaauuguaccacuaaaacuuugcacauccgucuguccuuuuucagugcuggaauuggaaggacugggguucuuauuacuauggaaacugccaugugucucauugaaugcaaucagccaguuuauccacuagacauuguaagaacaaugagagaucaaagagcaaugaugauccaaacaccugugaguacugugcuucguuuguaacucugccuccacacaguggaucuuguuacuaaucugcauucuguagcuuuuuuuguuguacacaaauguacuuauguaugauagguuccuguuauguagcccagucugaccuagagcuccaacucugcaaccuccugccuuagcuuccugacaagcauguuccucaaguaugccccuaaauuauaccuuuaucguuuuaauuccgacucguaaacuguuccucuauaguauaauagucaauagcucuugguauuauaaauaaaaauaucguggaaaacagccacguucguuuugugugugugccauaucuguuugcuuuucauggugcaacaggugagugaaguugcaacagacaccuguggccuacagugucugcaauauuuacuauuuggccuuucacaagaacagcuuugucagugugcacauggcuuagcauguuaacucgugagugcuuugcuagauguagaggcacuugucuuggguuguuuagucaagaggaaugcugucugugagaguaagccuaaacuggagaacuggguagagcuuuguucaggacuacccauuguuguagaaagccuucccuuuuccuaagaacuuaaauuacauaacaaugacaaaauuccuacaauuuaaacuacuuauuuauuauauucuccacugucuuuucauuuugccucaguaaucaaaagaaucaagaaauuuuagaacuaguguuaagacugguuuuuguauuaauuaaagcagaguaaaauguuggcauaguuaguggccacaagauuucuugaugcuuacuggccuaacuacucuaaaaaauacccauuauuuucuaagcuucuaaauacacaaaauuucacacuuacucaaaaguuaauauuguaauauaauaaaaacauuauaaaugcccaacauuugccuacugaguuuuauuuguacaguuucacuuucccauuauuuaaagcaaaucuuggauggcauaaauauuuuagcauguaacuaaaagagaagauuauuuucuuuuaaaaaauuacuaucucacuuaaauauaauuauaauuuuuuucuuagauauuuucuuuauuuacauuucaaauguuauccccuuuucuaguuuccccuccgaaaaucccuuauccccaacccuuucccccugacagcuuuaucaggcuccugucagcaagcucuuguuaguauccgaaauaguaucuggguuuggugguuguuuaugggauggauccccagguggggcagucucuggaugguuauuccuucagucucugcuccgaaauuuguuucuguaacuccuuccacgaguauuuuguucccucuucuuuuuuuuuuuuuccccgagacaggcuguauagcccuggcaguccuggaacucaguuuguagaccaggauggccucgaacucagaaaucugccugccucugccuccagaguucugggauuaaaggcgugcgccaccacgcugggcucuuguucccucuucuaagaaggauugaaguauccacacuuuggucuuccuucuugaguuucauguguuuugcaaauuauaucuuggguauucugagcuuuugggcuaauauccacuuaccagugaguuuauaucauuguguguucuuuugugauuggguuaccucacucaggaugauauccuccagauacauccauuugccuaagaauuucauaaauucauuguuuuuaauagcugcguaguacuccauuguauaauguaccacauuuucuguauccauucuucgguugagggacaucuggguucuuuccagcuucuggcuauuauaaaugaggcugcugugaacauaguggagcauauguccuuauuacaugauggaacaucuucuggguauuugcccaggagagguauugcugggucuuccaguaguacuauauccaauuuuuugaggaacccucagacugauuuccagcuugcaaucccaccagcaauggaguguuccucuuucuccacauccucgccagcaucuucugucaccuguuaguacacuuuuuaugaaaugugaugcagcacaauuuggugcacuuauguguaagauuauaaugucuucuugguuaauugaccugugaucagaauaagaugucccucagcacuucugauuagcuuugucagauauuagguccgcagugcuuauuugcuuggaauacuuuuuuguccuuuuacuuuaaagugguccuuaucuuuaaagguaaagugaauuucuuguagacaacaaaagauggauuuuguaucuucuaacuggagaguugaggccacuaauauuuaaacuuauugaaagcauuugauggcagucauuuauuuugcuauuuguauuauaccugugcuucauuaauuauagcuuccuagucauuacuguccuguacuaaguguuauuuucaguauucucuauaggcugguuuauuggacacaaauucuuuuugccuguuuguaucauggaaaguuuuucuuucuccaucuauagcggguuguuuugcugaguacauuaaucugaauuuguauccggggucuuuuagaacuuagaguauggggacuggugagauggcucagugauuaagagcacugacugcucuuccagagguccugaguucaaaucccagcaaccacaugguggcucacaaccauccauaaugagaucugaugcccucuucggugugucugaagacagcuucacuuacauauaauaaauaaauaaauacuuacauauaauaaauaaauuaaucuuuaaaaaaagaacuuagaguauauuguucuaggcucuucugauuuucagauuuuucacugaaaugucagcuguuauugugaucgauuuuucuuuuaugugugacuugugagaucuucuucccuccccccuucuuuccuuucuuccugucuuuuuuuuuuuucuuuugcagcuuucuguucuuuuuccuuucuauuugcgguggugccuucugacuuuucuaauugguuuauugagcuuuucaagucuaucuucauuucugcuucaguuuucuucaauauuuuucuauauugaaauucagucuguaaacccuauagucuucauuucauucagccuuaugcuuguguuuccuugagccaucauuuaggcguuuguuuguuugguuugguuugguuuuucucuuugaguuucuucuaaguucauugaacuacuugugucuucuuuaagauuuauuuauuuauuuuauguauaugaguacacuguagcuguacagaugguuaucagccaucaugugguugcugggauuugaacucaggaccuucaaaagagcagucagugcuuuuaacugcugagccaucucuccagccccuauugugucuucuuuaaauuggaaucuuuugaugaaguuuaugauugcaauuucuguguccugagguucaucuagguuauucucauuagaaauuauaggacugguaauaagugugcuagauuuugucuuggguuucauuuuuuaugauaaggccugagcauguggaaucuuuacucuuucuaugucugauguggauacaggagacuuugccuugagauuggcuaugguaaaagugagguaaagccagguggauacaguuggggguagggcuggcaugcagaagacuggagacauugugugaggucucagaagaccaggcaucagacugggaggugcuggcaagauggacucuggcugagagcaucgguuugaucuggcuuggguacuguguaugguucaaguugggucaagguuauuugggguuuuuucccccuuuuuauugugauaaaauacacauaacaaaaauuuccauuuuaaccauuuuaugugugcauuucaguaguauugaguauaugaagguuguuggagaaguaacuuuaugaccucuuuuuuauaccauuuaaaaaguucuucauuuccauucuacuaaguuucuaguuaccucuagucuacuguuuguuccggaguuugauuuaucauauaaguagagucauacaguacuuggaguuugauuuaucauauaaguagagucauacaguacuuauguauuucugacugccuuaaguuaauauucucacaguucuccauuugguaaccaugucagaaucuggcuucucuucaaggcuaaaccauauuccauucuuuucuauaguagauuuuguguaauaauucuuccaucaguggacauguugcuguuucuagcuuuugacuauucugaauaauacuaccaugaugaaggauguauagaauaucucuuugagacugcaguuugauuucuuucagaucuguacuccauggaaauugcugagccauuaacaauuauaaugguuguuuuuauacuuuauuugaaauugauguuccaauaauggccugcacacuugaauuaguuuauaucuaaauucuaaauuuuuauaauuaaaaaacuacuuucuacaccucuuguuccuuugggggguguuuuauuuuguuuuuucaauugauuuaauaaauaguacuuguacuaugucauuugcuagagucucaguugguuugguuuauauucccaagauaguguucucuguauuuuccucaaaguggcagauggaucuguaggcuagagcaguuuggauaggaauucauuccucaagaugcacaugauguuugauuaccuucuuugugugauguuagcacuucuugggugaucaauacugccauccauuauucauuggguguagagugauggcaugcuguuuguucuuugauuuuugcuauuuacuggauucucuccaaguccacauucagcucccauuguuauauagaucaggccucccugccuaggaaagggcaccauccacaaugagcuaggccacuucauuuauuaacgagaaugauuuccuaaagauuuguuuauuuuuauuuucuguguaugaguauuuuaccugcacauaugaugugcaucauguauaugccuuuagaggugagaagaagggucagauucccuggaacuagaguuagagguggcucugagccaccgcacgggugcugggacucaaacccaagaucucuggaaaaguagcucucuuuuccucauuucucuagucuagaaugauuguuuagaagauaaauauuuaauucuuucccuugauuuccaggugcuguuuucuuuuucauuguguuuuccagugcuggcaaggauuccagggccucauacaugcugcucaagugcugucacugagcuagcuccugcccaacucagaguucacuguggguuuacuagcuuucuccaaugccaacaacagaauuuuguuugcuuugauacaauuuaaaaauugugaaccuaacugguaguagugguacacaccuuuaauccuagcacuccagagucagggacaugugggucucucugaguuugaggacaacuuggucuacauagugaguucuaguaaagcucgagcuacauagugaaacccugggguuuuuguuuuuguuuuguuuuuuuugaggggguggugguggugaaucuaaauauacuuuauguguuuucaauauuuuuuuugauguuacccaaaauuuuccuauguuuuggccagcagaaacuucaguuucuaaguccuuuuccuagaaccauaauaauuuuguuaacuuccuugcuagcagaaaagauugcuaagccagcuguguauuaaaugauccagauuuggaaacuaauuucuccagcaauucuugguucuguuauuuuagaugcuacuuuuugaguucuggggaugcaguauuguuauuagugauauuuuucuguaaacugucaugugucugaacauaaauguccaugauauaaugugaauugggacauacuuuuuuauuuaacaucuuuaucuacauuuuucuccuuucuuguuuaacaagaauacaauuucucuaggacagcaguuagacuaagaauauuaaaaguauucuucuauuuuaucucacauggccugccauaguuucaaaauggcagugcugauuaugaaagaguuccugcuuucccacaguuuauuugaacuuuggauguaacuccaaaacauaaucaauuacugucuuuaaaucccuacaaauagcugaucaaugugguugugucaucagguugauacaugcauuguuguuguuuuuaggauaguaucaguuuuaaaauuuaaaucuauaaaagaagaaggguggggacuggcgagauggcuuaguggugaaacaacacugggcuuuucuucuagaggacccagguucaauucccagcauccacauggcagcucacagcugucuauaauuccacuuccuggugaaucaacacccucacacagacauggcaacaaugcacagaaaaauaaaagcaaauaaaucauuagagaagaaggaggaagaaaagguuuauuauuugguagagccugaucucuuccucucugcuacuuucccccuccauucuuucaugaaaacacuuuaaagauuuaucauuuucuuccuuaaaaaaguuuaacaguaaauuuuaaauauauauuuauauuuuccuuuuaugaauguuauacauacuuuuuaucucucaccuuuuaauauuguuuuaugauuaugagaaacagagaaacaaagauagcgauuaaaugcgcaaguguaugugaggaggauauauguagucuuugucacuccuacuugagucuuuacagagauagggucuuucacuguacccugagcugaccuggcagccaguaaaugguaaugauuugucucugcccagacacacuggguuuauagcacauccagaaaugcccaguguuuuuuuuacaugggugacugagcuauuagucgaagucuucauucuuguucaacaaguaugcucaccugcugagcccucuccccagcccuuccuugccuuuuugugguuguauggguuugguuuuguuuuguuuuuuguuuuuuuuuuuuuucauuuuccuugucuucuugaaacaggcuguucugguguucacuguguagauuaugcuggccuugaacuuauggagcucuugcuucagucuuccaaccucucuaucugaaauccugugcuuguucucacugaucagaauagucugucacuuaucauuguuuaugugccuuuaaucccagcacucaagacucuggaggaccuuugugaguuuaaggacagccuuaucugcauagcaaauugauggcaacuuaaaugguuuccacuuuuuuauuuuaaagaagugaauauauauuuucaggguuuuuuuuuucuaauuuaucuuuugaauugaguuuucuggaaguaagaauguuuguuccaaagguaaaauaauauuauuuuauuagauauuuucaaauuucucuuuauaguuucaguauuuuaacauuccuaucagcagugucuuggguuuugccaagaaaauaucaugugagaguuucugguuuuuuugaguuuucuuaacuuuuuacccauugguaaaacuucuaacuccguucuguuucauguuuuaaguuuuuuaauaagcuugaugagugagauguuaguuuuugguuuuuuggacuuuguugcagugauucugguuuuuucuccuuguguuuuucagagucaauacagauuuguaugugaagcuauucugaaaguuuaugaagaaggauuuguuaaaccauuaacaacaucaucaaauaaauaaaacaaaaagguuggaacaaguacugggaaacugauuuuguuauguucacugugccauaauacugcuugcaagaaauggccucucacacaaaaagugaagaacucaaaaagacgucaagaacuucagcacuacugcacuuuauguuuuaaaaagucacucaaaaccuauuacucacaugguugaccauuuugugcuuugcucugaacgacgagugaaaacugaauauguucaggguaguuuauggaauuuugagguguugccaugcaguccccucggguagaauugccacagauaaggcucagaauucucaucucuuacacacccguaccuugaaagcaaaaaggaguaaacaucaggagucugcucuggucuuucccagugguucauguacucgcucuacugaguaccagauuuuauuuuucaaauguuagcaauaccauucucaacauuagccaguacacugccuguggaugcagcacaucuucccugccaucccaauagggaccugcuguugagaagaacauuggaacgugcuguucccaggaaaugcugcacaguguccauuuaccagcaucucagagaacuaacuaugaaucuauggauuuucuuggauuuaaugauguaacuuauauuuaucauaagguuggcuuauuccaaaucaugugauuucacauucuugauguaaaggaaugcaugcaucgugucuuaaccccuuaagugccuugagauaucuuugucuaaugaaaaggcacucauuugaccccauaggagguauguauguauacuguacauucuuauaguuuuaugaauuuuuaauaaguucacaguguuuuuaaaaaccagcuucuuauguugagaguuauacaaagaaggguaaggacauucuguuucuuacucagugcuugcuuggacuuugccauaaaagccaggaucucuguauucugcugagagugcaucugcugcuauggaauuguucacagucuguacauuccguuacugagugacagggguuaaaguuuagcagcguaacuuaaaagaggguuuauucuucaaauuucauauuuacuuuauccuaaguuaaaaaguguuguuuaacauguauauuagaaauaaauauauugguacucuuaaguuauagugacagaguuaauuaguuggaauauuaacaucuauaacuaaaguguugcccugaagcaucauucuaggucauaucaggcugucuucacacugcucuuuucauugggauucuuuagacaaggaauuagacacuauugacuuucucuaaaugugacccuucauaauaguaaaaugacaguuuucaugucaucauaguuuauauauaccuauuaaauuauaagcaugucagugaguccaucuugaugggagauccagcucccauugcagauguguauguuuuccuuguuuuaagucuauggagacagauuuuuaaaauugcccauuuaaugugagaacuugcucacuuuuucacauguuauuuuauauggauaugguuaaaauagacacauuugcuagugguuucagauuacuuaugcagucuugauaaaacauagguuccaaugguagauguuuuggaaugcuauuuaguugggagaaugauauacauuuaaaaaucuuuaguaaaauauaaaucauuguuucauauauucagaauccauaauaguaaaauucaguauuuaaauauuaauugccaggguaccaaauaaauugucacuuauaaauauuucuugucuuauuuuuaaagaaagaaauaaacauaucuuuacauca

SEQ ID NO: 334 - RNA, 5289 nt, Mus musculus
cuuuuuuuuuuuuuuaagagguuuauuuagcucauaauucuggagguucaggaaaauaucaccuucuucuucaugcucaucucuggugacaccuugaagaaggugucauggaagaggguacaauaucgggaagccaugggggaaggacuugcucuuuggauaggguuuuggccuaggucagucuugccuagaauucaccacuacguaacccauguuaaccucuaaccacuucaaccuaccaaguguugggguucacaugugugaggcaccauggcauguuuauuauucuaagacaggguuucacuguguagcauaggcuggccucaaacuaauaauccuccugcccaaaaugcugcaauuccagauguauaccacaguguggacucugcacuggucuugcucuuauucuaacaacugugcuugguauggugguucaucugcagcaacagcuacucagaaggcugagcuggcaagggcaacacagggagaccucaucucaaaaacuaaaguaaaccaaagcuuuaguuacuugugccugccagagcucacugugcaaggccaacacaaauccuuccugaagaugauaccccaaagggccucaucaccucccacugggccccaccucucaaaggcuucccuacuuucaacacugccacaauggggacacagcuuccauauuuaaacccuagcacuugagcaaauaaauugaggggccugcugccaccaucuugguuccucgcaagauuaagaguagauaguguaguguuagaguguuaagggccaagaagauggagccacgguguccauacuuuuccauguggguguugauguggacuuuuggcccuuagcuagcagcauacagcaacagcagugacugagggauguagaguguugucagccuggauggagagccauccaucuaguaacuacuuuauccaucuguccugguuagauuugucaacuugacaaagccuacaguccugagaagggaaagccucaacugaagacuggucucugugugucugugggggauuaucuucacuauuaauggauggauaguagcauccauaggcagguaguauuggguuguauaaaaagcuagcugagcagagacugggaguuaagaguuaccagaaggcagcauucuuucaucgucccugacaccagggcugacuugaguuccuguucugacuucccuccaagauggauuggaggauaugaucuagaaguguaaaccucuccuacuagaguugcuucuggucagaguauuuuuuuaucacaucuacagaagagaaagcuagaacaccauccacguaucagucccauauuguauucugcucuagagucccuuguccucaagagcucagccugccaugaccaggggaaaggacccguggcuggcagugcacucaacucuaaaccacauacaaagucugaguagaagccacugguuaucccacccugccauucuucagccuaccacagccaccagaguacccuuccuaugguguguggccuuuccucugaguuacacuggacccaggcugguauccuucaagacugcccagggaagagagaauuuccaaggagaagaugaugugaauggccaaguuaggucuagcucugugaucacaagucuccucaccuuguccugcuagggucucuuguccaaggaucaaggcaagggauaaauuagcuauaugcuaucugguagauuagggcaguucuccacugcaagaaagaaaggguggauauaucagaaacaugucugguggugacucaugguuugacuuccacaguccacuggaauucagagaccacuagggaagaaagcccuguuuauuuaugcugcguucuaccaggcccucaggcucacaaucucauacaacccuacaaucaguccuccccacuucauaguugagguaaacaagacucaagauucauauagggacucacgcucagccagagucuauucauggcgaggacagaguugaauuguuuaacuccaaagacggucacucuucugacccugggcugugggugcaaccacacuaagagauucaucucaaguucaucacgaggcagugccuaugcaagccaggacugcccuguugccuggauucucagaagcggccugggcugacuguugcccuccacaucuguuguagagagucccggcgggugguguagggcaaaugguugaugcgaaaccagugucuggggacaauguuuccacuugguguauacagcuuuucuccuugucugcccaaaagacugcguagggcuaaguuuccugacagaaucuucucauagaauuccacuccacccuggacauaggcugcagacagagaggccgugcggcgguccagccagccuuccagggcaagagugagagagucuuuggaaaagguauaggcuacauagccuaccacuauugccaccaaguuaaaggcaguucgcaagcucauggggccuccguagagccccagggcaugcuuggcacccacacuuauugcccauguuccugcuaggcaagcuggggcuggcagggucuguagggcagccacaccacucuccagguauaccaccuccuuggccaaggcaaacuucugggcauuaugagacauggucagggcaucucucagccuggugccugcugggcuuugccaauccacucuuugcccauguaugaucacagaguguucaauguuggucacagggccacccaggaagauggcagggauucccaccacagccccagcaggcaaccgugggaauccagcacucacaggcugaaaagugaaggcgguaaaaggcuuguagcagugacccgaagggacaccuauguccuuuagcaccucuuggaagaggcuccacagaugaggggaaagaggagcugguuggcccugaggccaguacugguagagccacuggacuaugggaucugggaagaggugaaaugagauuugaaccccaaacaggccugcacaggaacccaccaauaggcuuguucugugucucuguauaaaggcugcagcccuccacagaggaccagccaugaguacugccucugcugauagacuggccaagaagaagagaagucagccgaugguucugucagguugugggcuaaacaaccuccggggccacaauguuccuaacugaagugacacugcauuguggcugagaguacggguuccauccagaguccgacaccucaggcuucacagaaucagcuuucccauuggcagccagguguagagcaacugugauggguaaauacagagaggacauuucagugucucacagugguggacauccucuggcaauggcuguauugccauggcuagacacagcacuaaguauucgacagccucucuccaaccaccacucauccuagagugacucucuaacugacuuaggauucacauguuuaaucaccuacuguaugcuagacacaguucugagagcacugcguauacagcugucccucaguggcuacaaggguuuacuuccaggauccccacagauaccaaaaaucaaagaccaucaguugcuuuauauaaauagcauagcauuugcauaugagcucucauaaaauauauauauauauauacccaccucucacauacuuuaaguuaucuccauacuacuuauaauacccacuacaacacaagacuacauauagagcuagacuacgacuaaaaugucugccugcucagcagacacaguuuugcuugcauauuuucaguucuuggcugauugaauaugcauggacacagacagccaacuguacuaggaaauacauguaacacuaauaaacacagggaauauuuaaacgcacacauuuauacauaaauacuauaugugcauauccuuagaggauuagauucaagauacaaacauuccaagauccucacaugcucaucucuuacaaaaaggcuuaguauuuguuauuacagaaccuauuacaaugcaaacacuacauuuguaauuugugaugcuauauugcuuaggaauuaaaggccagaaaauaaagccauguucaguacagauacaaauuuuccuuccaaaacauuuuuugauauguagcuggugguaucaccaaauauagagucugaggacacagagaauucacuggauucagucagucuaagaaaaaaaaaaucauacuucagagcccauaccacaacaguuuauuuccagcugugaaaagggaugcagcuggacagguuuauuggccaaaaccacaaguggcagugucacaugcugccuagugucccuacuuccaccaagcucccaugguugagccacauuuccauuaucuuacgagguggcuguauuuggagcuucggccuaucauugaaauagaaacggaagguucgugggauagcaauacucagaucucacugcuuucgagcucagauccggacacauacagaaaaaauaccacaugaagauccagggguaagauggccauuuguuagccuugcugaaauacccagggagccuagcuuggccacaccugagucuuggaccuccagcucuggaacuaagaaaaaauaaacuccuguuguucaggucauuccucaugagacacuuuucuuggcaggcuaaccacugauagcaaagguucgguauuugaucacgggccguuagagauucauagcaagcuguucaccuuaaaaauguuaucuauuauauauacacaaacagaccaaacagaccauccaccucacucauuagcaaaguuaauauuguuuuuaaaguuaauugguggugguuuuuuuuuugagacaaagucucacaggcgcacuuuugaauauucugggcaccuuauuucgucugugauuaugucacuaugacuguuauuucucuuuggaugaaauuucacuuuauuccuaucuccgcgaagcguuugauuagcaauguacuacuguaaacaaaacguaggguucuguaucacucauuuaacucauucuuuccaagaggaaacugaggcuagaaaagacaggguccuuggaagggaacaaaaaaaaaaacaaaaaacaaaaacaaaaacaaccucucccgggucggccucugagucucgcaguuggccuagaagcagguguaggcucuggcuuuagaagagcucucaaugugauuccgcccugacacauaccgggcugcuuccaacaaccggaacaugacugaacccggaagcuggacauaagagaacucacagccaagaggagagcuuaccucgguagcaaccuuagaacacgccgcucccgcgccggacugagc

SEQ ID NO: 335 - RNA, 5289 nt, Mus musculus
gcucaguccggcgcgggagcggcguguucuaagguugcuaccgagguaagcucuccucuuggcugugaguucucuuauguccagcuuccggguucagucauguuccgguuguuggaagcagcccgguaugugucagggcggaaucacauugagagcucuucuaaagccagagccuacaccugcuucuaggccaacugcgagacucagaggccgacccgggagagguuguuuuuguuuuuguuuuuuguuuuuuuuuuuguucccuuccaaggacccugucuuuucuagccucaguuuccucuuggaaagaaugaguuaaaugagugauacagaacccuacguuuuguuuacaguaguacauugcuaaucaaacgcuucgcggagauaggaauaaagugaaauuucauccaaagagaaauaacagucauagugacauaaucacagacgaaauaaggugcccagaauauucaaaagugcgccugugagacuuugucucaaaaaaaaaaccaccaccaauuaacuuuaaaaacaauauuaacuuugcuaaugagugagguggauggucuguuuggucuguuuguguauauauaauagauaacauuuuuaaggugaacagcuugcuaugaaucucuaacggcccgugaucaaauaccgaaccuuugcuaucagugguuagccugccaagaaaagugucucaugaggaaugaccugaacaacaggaguuuauuuuuucuuaguuccagagcuggagguccaagacucagguguggccaagcuaggcucccuggguauuucagcaaggcuaacaaauggccaucuuaccccuggaucuucaugugguauuuuuucuguauguguccggaucugagcucgaaagcagugagaucugaguauugcuaucccacgaaccuuccguuucuauuucaaugauaggccgaagcuccaaauacagccaccucguaagauaauggaaauguggcucaaccaugggagcuugguggaaguagggacacuaggcagcaugugacacugccacuugugguuuuggccaauaaaccuguccagcugcaucccuuuucacagcuggaaauaaacuguugugguaugggcucugaaguaugauuuuuuuuuucuuagacugacugaauccagugaauucucuguguccucagacucuauauuuggugauaccaccagcuacauaucaaaaaauguuuuggaaggaaaauuuguaucuguacugaacauggcuuuauuuucuggccuuuaauuccuaagcaauauagcaucacaaauuacaaauguaguguuugcauuguaauagguucuguaauaacaaauacuaagccuuuuuguaagagaugagcaugugaggaucuuggaauguuuguaucuugaaucuaauccucuaaggauaugcacauauaguauuuauguauaaaugugugcguuuaaauauucccuguguuuauuaguguuacauguauuuccuaguacaguuggcugucuguguccaugcauauucaaucagccaagaacugaaaauaugcaagcaaaacugugucugcugagcaggcagacauuuuagucguagucuagcucuauauguagucuuguguuguaguggguauuauaaguaguauggagauaacuuaaaguaugugagagguggguauauauauauauauauuuuaugagagcucauaugcaaaugcuaugcuauuuauauaaagcaacugauggucuuugauuuuugguaucuguggggauccuggaaguaaacccuuguagccacugagggacagcuguauacgcagugcucucagaacugugucuagcauacaguaggugauuaaacaugugaauccuaagucaguuagagagucacucuaggaugaguggugguuggagagaggcugucgaauacuuagugcugugucuagccauggcaauacagccauugccagaggauguccaccacugugagacacugaaauguccucucuguauuuacccaucacaguugcucuacaccuggcugccaaugggaaagcugauucugugaagccugaggugucggacucuggauggaacccguacucucagccacaaugcagugucacuucaguuaggaacauuguggccccggagguuguuuagcccacaaccugacagaaccaucggcugacuucucuucuucuuggccagucuaucagcagaggcaguacucauggcugguccucuguggagggcugcagccuuuauacagagacacagaacaagccuauugguggguuccugugcaggccuguuugggguucaaaucucauuucaccucuucccagaucccauaguccaguggcucuaccaguacuggccucagggccaaccagcuccucuuuccccucaucuguggagccucuuccaagaggugcuaaaggacauaggugucccuucgggucacugcuacaagccuuuuaccgccuucacuuuucagccugugagugcuggauucccacgguugccugcuggggcuguggugggaaucccugccaucuuccuggguggcccugugaccaacauugaacacucugugaucauacaugggcaaagaguggauuggcaaagcccagcaggcaccaggcugagagaugcccugaccaugucucauaaugcccagaaguuugccuuggccaaggaggugguauaccuggagagugguguggcugcccuacagacccugccagccccagcuugccuagcaggaacaugggcaauaagugugggugccaagcaugcccuggggcucuacggaggccccaugagcuugcgaacugccuuuaacuugguggcaauagugguaggcuauguagccuauaccuuuuccaaagacucucucacucuugcccuggaaggcuggcuggaccgccgcacggccucucugucugcagccuauguccaggguggaguggaauucuaugagaagauucugucaggaaacuuagcccuacgcagucuuuugggcagacaaggagaaaagcuguauacaccaaguggaaacauuguccccagacacugguuucgcaucaaccauuugcccuacaccacccgccgggacucucuacaacagauguggagggcaacagucagcccaggccgcuucugagaauccaggcaacagggcaguccuggcuugcauaggcacugccucgugaugaacuugagaugaaucucuuagugugguugcacccacagcccagggucagaagagugaccgucuuuggaguuaaacaauucaacucuguccucgccaugaauagacucuggcugagcgugagucccuauaugaaucuugagucuuguuuaccucaacuaugaaguggggaggacugauuguaggguuguaugagauugugagccugagggccugguagaacgcagcauaaauaaacagggcuuucuucccuaguggucucugaauuccaguggacuguggaagucaaaccaugagucaccaccagacauguuucugauauauccacccuuucuuucuugcaguggagaacugcccuaaucuaccagauagcauauagcuaauuuaucccuugccuugauccuuggacaagagacccuagcaggacaaggugaggagacuugugaucacagagcuagaccuaacuuggccauucacaucaucuucuccuuggaaauucucucuucccugggcagucuugaaggauaccagccuggguccaguguaacucagaggaaaggccacacaccauaggaaggguacucugguggcugugguaggcugaagaauggcagggugggauaaccaguggcuucuacucagacuuuguaugugguuuagaguugagugcacugccagccacggguccuuuccccuggucauggcaggcugagcucuugaggacaagggacucuagagcagaauacaauaugggacugauacguggaugguguucuagcuuucucuucuguagaugugauaaaaaaauacucugaccagaagcaacucuaguaggagagguuuacacuucuagaucauauccuccaauccaucuuggagggaagucagaacaggaacucaagucagcccuggugucagggacgaugaaagaaugcugccuucugguaacucuuaacucccagucucugcucagcuagcuuuuuauacaacccaauacuaccugccuauggaugcuacuauccauccauuaauagugaagauaaucccccacagacacacagagaccagucuucaguugaggcuuucccuucucaggacuguaggcuuugucaaguugacaaaucuaaccaggacagauggauaaaguaguuacuagauggauggcucuccauccaggcugacaacacucuacaucccucagucacugcuguugcuguaugcugcuagcuaagggccaaaaguccacaucaacacccacauggaaaaguauggacaccguggcuccaucuucuuggcccuuaacacucuaacacuacacuaucuacucuuaaucuugcgaggaaccaagaugguggcagcaggccccucaauuuauuugcucaagugcuaggguuuaaauauggaagcuguguccccauuguggcaguguugaaaguagggaagccuuugagagguggggcccagugggaggugaugaggcccuuugggguaucaucuucaggaaggauuuguguuggccuugcacagugagcucuggcaggcacaaguaacuaaagcuuugguuuacuuuaguuuuugagaugaggucucccuguguugcccuugccagcucagccuucugaguagcuguugcugcagaugaaccaccauaccaagcacaguuguuagaauaagagcaagaccagugcagaguccacacugugguauacaucuggaauugcagcauuuugggcaggaggauuauuaguuugaggccagccuaugcuacacagugaaacccugucuuagaauaauaaacaugccauggugccucacacaugugaaccccaacacuugguagguugaagugguuagagguuaacauggguuacguaguggugaauucuaggcaagacugaccuaggccaaaacccuauccaaagagcaaguccuucccccauggcuucccgauauuguacccucuuccaugacaccuucuucaaggugucaccagagaugagcaugaagaagaaggugauauuuuccugaaccuccagaauuaugagcuaaauaaaccucuuaaaaaaaaaaaaaag

SEQ ID NO: 336 - RNA, 7822 nt, Mus musculus
uucugauuggcugcugccgcucgcccgagcucaguuggaacgccgggguugugcuuuuaaaggcgcuagcuggugcgcucugugacuugauugcugcugcuucugagcuugcucccgcgcuuucggcauccguaucaccucaccaguaugucucagguacugcgugugccccgccgggcugcgaagaugcuguggguuuggggacagccgggucuauuuccucagauaucccgcagcucuucugggauccgagcccagcucauagccuggggagcggaacuuuuucccuugcagauauguaaaacugccacccacgccggaacugccagagaguugccggugggcugaacuccugggugaagcaggaacaggguccucgaaagaaagauggggcguaagagggaaggaaggacagggaagauugaaucccacacugggaagaaccgaauggaauagaggggcacucauacaggcccuggcugaagagccuggaggucggggaagguauuuagucuugugccuggccugccccuguacagaagagaugugaguaggugaggugguccagaagccuuuuccuucccuccaguggagaccacuaccgaggacugagcccuguagggcgaucucugacuccucccacuugccucucccuaaucugggcacugggacagaggucaacgcugaacuccaggccccuguaggaagggaccagcuggcuccagacacuggauuccaccgcauuccucuccugaacucugaucgacuguuuugaucacaccacguuuccccuuacugcccagucaaucuccgcugaucauaggucgggcuuuacuggaaccccagcaauuguuggaucugggccagugguggcccaggcaguuaguugggcaagaaaauuuucaagggcgugcacuuccacugugagccaaaacuauucccagcacuugacacagugcuguaacugcuugaguggacaggugggccuuagggaauccuggcaagaagagggaauaugggaggcaucccugggccucucccacucaggcaaccuacaucucguuccucucccucucccucacucuuaggcugaauuugacaaagccgcugaggaggugaagcgccucaagacucagccaacugaugaagagaugcuguucaucuacagucacuucaaacaagcuacugugggcgauguaaauacagguaugcccagcuucucaucagagcgggccaaguuggcucggcagcccgggagucugagaacuucgccuuccgacugccagaggcaggcugugaugacagaacauugguauggagaccuuaagcugagagauugucaccugcaaagaccaucucccuaaacucuuagugacucugggagcagagucaguguggguuuacaaggacuuuacugauuaucucagcaucuacucugaaggcagcaaaggcuccagccuuguugcucagcagucgcuuucucgagccucccguuuccaucagaugaacagggucauggagugcuuggccucuuucccaagccgaauagaugagcagauacaucauaucugguacccuggggcaaggcagaagugcugcuggcccaagucugcccuauccaggugacuuuucucccuauccaaaaaucuugggcagauuuuucuuuuuugccaaguauuguagguugaugggccagccugucucugccucuccagcacuguuauaagcacaggcugcugcguggccuuauauuuguuucccucccacauggguuccgggagucaaacucacacccucguacuuuacuggcuggccugucucuccagccccuugguauagcuuuugaaacuaugcuguggguuaccuuagucuaugauacugucuuuucugugccuugagcaguggcuauagccugagauagcaacacaguguguuccagcaaggacucaugacagcauagaagaaaauguaugccucagucacccaccaagcauggccuccaauuccacuggagcuggaguggcuagccaagcaggucagagauuugagggcuuauaaacauccaggaaggagaagccagugggaagggaacagagagcuguggaugcuuucugcuagauaguauuuucccagagccuggccucuagccacgcuauugguacuugcuggaauauaagcaucaguagacuagcuuggaauccacccuugccuggucagggaaccggcuuguuuguuuguuuguuuuuugcuguacugguucaauacaacaaagacuagccacaagugguuauauggguuuuagcugaaaacagcuaaaccuaaguaaugccaaaaggccagucuguagcuaugcaagcuguguuucaagggcucaguggccacagggggcaagcggcuucugaauuagacguugcagggaucaccgaaauggcuagcagguucucgcugccaugccugacuaucuaaaggagccacuuggugaaaggagagaauugacucccaaaaguuguccacuggcuuccacaccugcacaguggugugcacacuuggcguguuggcaaguauacgcuuccaucuaaggagaacuuccucugaggcagggagucuuccucugaggcucugaggguuccuuugcagucacagucuuccagugagguuccuggaacuuauuuuucucagacucagugccccaagcugcacacucugcaguuucugcuccuagcaaugaaauugucccccaaggaaggauggugaaaggccuuuccaaaagcaggugcucuggaagcagcgugguccucagacaaaaccuccagauacaacaagaaggaguccagcgauguguggaaauagggccagauuauaaagacaaguacaggcaaggacggcagagccccacccccacccccacccccucagauaauagcaauguagcucgaagggaaaccagcaagcugaaagggggauggggagagacccuaaaagcucucuuuagauuuguuguuguuuuaauuucauguucauguuuuaauuucaauugguguauugccugcaugucuaucuguuugagaguuaucagauccccuggaacuggaguuacaauugagagcuaccaugugggugcuggaaauugaaccuaggccgucuggaagagcauccagugcucuuacgugcugagccgccucuccggccuuauuuuauuuuauuuuauuauuuuauuuuuucagaauguuuggauucugaaccacacgaauggguguuuguuuauuuaucuugguuaaaguagaaguuugguuugguuuugaggauuuuuagucuuugcacucccccacccccuauuuuguuuaagacagagucuuauguagccgaggcuggcccagauucacuauauagccaaaaauaacauugaauuucugauccuccugcuuccaccuuccagauauuaauucccaugcccaguuuaucuggugcuggugcuaggacccaggguugggagcaugauaggcaagcgcucugccaacucagccacauucccagcccuuguauuacuuaauauuuuucuaauuuugaaacagaaucucacuaagccacucguucuggcuuuaagcucucuguaaggcaaaaccuugaacuuuccuuccucccggccccacagccccuggcaucaugggugugugaacacuaugccugccuauuuuucuuuuauuguauuauauuugauuuuuugagauaaauccucauguagccugggcuggccucaagcaacacuguguagccaugaugaccuugaauuccugauccuccugccucuacuuccugaagugcugggaugauaggccugugaugccaugcccuguugauacaugcugaagcucaccagggcccuggacaugcgagggaggcuucugccgacucagccucauccccagcuccaaggaagaauggguuuuuuguuucuuaaaguaaaacacuggguuuuaaaccuuuaacuuuacaguucauaaaaaccuaagggcauauauuuuuuuauccugucuucucucaauuuuaaauuuggguugcuauaaacccgucuggguuucuuacaauagaacccacugugugagacacuaggaguucuuaaaaaccguaauaaaaaugccggguugucgcucuucacaauugauggcuucugacugggggccacuggaaguuugaccaugcuccagggaguauccgggcaacgcaaauuggacuugauuggauuuuuuuggguuuuuuuuuuuuuuuuuggagggguuggauuuuuuuguuugggggggguuugagggaggguuggggggagcuggaaggacugggaaguguaguugggguucaugauaauaaucaauaaaaauaauguuauaaaaacugucuugacaccaagagguggcggcauacuccuuuaaaaucccagcacucaagaggcagagcugggauggagcucugugaguccaaggccaaucugaucuuuggagugaguuccaggacagccuaggcuacgcagagaaacccugucuugaaaaaaacagaaaaacaacagcaguagcaaauucuuggcuuuccugggaagaguugaaaguccuccauuagaacuuguagcaaaccuaacagugucugcuuuucccucgcugcagaucggccggggcucuuggaccucaagggcaaagccaagugggacucguggaacaagcugaaagguaacacacauucugaucaacucccuccccugugaggcugggcacugcaggcucccuuccagagcggggagagcaaaggucaggaggcacaucuuggaagccagcccagcucgccacccucacauggagaaaacuaggucauagccuuucuuuucccuccaaauguuacugauaacuuuucuaagagcucucugucacugggcauaggaguugucuggagggaaagcgccugcggaugaggccgcugagaaacagacuggggagugauaccgucgccauggacuuuggauguguccagaguuaggagaguucuguccacaccuuucucuccccaacaaggccaggcagugaccccuuagccgaguggccuuccccaguucccuuucagccagaagggcacaugaaaaggggggaugagguaaugcaggccagugaauggaacuauuauuugcaaaagcacaaucauccaagaaguguccaggauccacuaaaucacguguucccauggcugcaagccccgaaagcuggcaccaaagccguuggcagcuuucguacgcuugcuagccaguugcugaauaagcccucuguccucucacaagggaggaaggcgugaacucaggaagggccgcagcacacuaaaaugcucugcuagggggccaggcaagucuggcugcuccuuuuccacaccauucucaggcccccgggcauguagagcuucacaauaagcucucucagucccugaggacuucuuguuucccuaggggacgcuaggaaccaaguaugucccucgggguguauucauggucccugugcugugacaaggagacaaagauuugcuucauuccucuccaaaaaccagcuacuuucugcucaguccucagcucuucucgcagcuucucgcuguggggaagagggcggcuggcuuagcuugcucacagccaguaguacagcugugggagguaaaaaguccaaagcaaauaguccauaggcuaaaggcaaacaugagauucuuagcaccaagaagaucagugcagggacacuuuccugcuuguccacaaggcuggggccccacgcugucugcuguccuacuuucaugggugacgcaucaugcaggugcuuagugcaugguaaagcacccccuggagggcccugaguccaguccucaagccaucucugagauguaaaagggcugugcuagauauguaagaaacgaucuccaaagauuuaacugggaucucagcagaugcauccaaccuguagcccaacacacguacaauuuuagacgguuaguucaugauuaucaugggagacaacagacagacauauuccugcagugucaaaagcuuagauaucugagauugcucagucagcaaggugccugucauguaagcacaaggacccgaguucagauccccagugccuguguaaaaagccaggcaccguagcaggcaccaguaaccuagaaggggcagagacaagcagauugauccucugagcucacuggccaauccaugagcuccagguucagugagaaaucuugucucauaaaauaaaguagagggucuggugagaugacucaguggguaaaggggcuugccaccaagccaaacaacuuaaguuggaucccagaacccacauggggaucaguucccacaaguuuccuuucugaugucuacccaugcuauaguaugucuaugcccccuuccuccugucuuaguuacuguucuauugcugugaagagacaucaugaccaaggcaacucugcuugcucacaguuuuagaggguaguccaugauuaucauggcagaaagcagacagacaugaugguaaagcaguaggcugagaccuuuauauccugguccacuggcagcagagacugacccugacaucagcuuuucaaaccuuaaaccccacccccaguggcacgccuucuccucugguaaggccacaccuccugauccuucucaaacaguuccacuaacugagaaccaagcauuuaaaccauucucauucagaucgccacuaccaccaccccuugcaaaauacauacauaauuuuuuaaauagguaguguggggcuggagagauggguaauggauuaggguuacuuauagugcuuacagaggauuuagauuugauucuuaggacuuauuaaguggcucacaacugccugugacuccaguuguuuuugguuuuguuuguuuuuuuugguuuuuuguuuuguuuuguuuuguucuuuuguuuuuucgagacaggguuucucuguguaacccuggcuguccuggaacucacucuguagaccaggcuggccucgaacucagaaaucugccugccucuaccucccaagugcugggauuaaaggcaugcaccauuacugcccgguguaacucccaguucuaagagaucugacacccucaucacacucccacagguaccugcauaccuuugguacauauguauacuaaucgucuuaggguucuguugccauuuagagauaccauaaccaaggcaacucuuauaaagagaacauuuaauugggacaggcuuacaguuucagagauuuaguccauuaucaucauggcaggcagcauggcagcuugugcucaguaguacaggaaaugaggguuuuccaucuugauccacagacagcaggaggagacugacauguaacucugaccccuacauuucacauacgugcacauuugcuggcaaacacagagacacacauauugcauccacugugaaguaugcacacacaaguuuuuuaaaaagcaaaggcuggucacccuggccagcaccuugccuuucuagcauacagccucccugauguguauuccuuccaauuccuuccagggacuuccaaggaaagugccaugaagaccuauguggaaaagguagacgagcuaaagaagaaauacggaauauaaaucaccagauuugguggccagccacacgugugaccugugaggacauaaugccuugguuuuuucuaauguagaugauauggcugugauacauuagggccagcguuaaccucugcuccuccucccucuguaguuuuuaccuacaaucaauuaaaaguacauuuguuacucugugccuggguua

SEQ ID NO: 337 - RNA, 2655 nt, Mus musculus
ggaagcaggaagcagaaaacacucuccauucauccucauacagcuugccuacugccaaguagacagucaauaaacaaggaaauaauuaguugcacggcucauuaggaagggacuuauuccaagaacaacaaaaaucaagugggaaggggaaugaaggcucagagcaggggauuacuuuccauccagguggcugugauaggaauggaggcugugagcaacugccaggggggaaggaacauucuaagacaaugcagucccuggugcaacagcccauguggcaggacauaccugaaacacacguggcauggaaaggcaggucaguagucagcccaagagugaauguguauuauuuaauaucauuucuggccauuguaaaaaaauguucugauuaaagcaacucaaggaagaaaggauuuauuuagcuuacacccccagaugauauagucugucucuguaggaaagucaaggcaguaugggcuagucauacccacaggaguagagagcagugggugaaugugugccugcuacugccuggcucacucucucuguuccauccagcccaugaaauccugccugcaugcuuucaggcccuucccacucagaaaacccagcacaggccagccuaaucuagauaauuccucaaugaggcuccccuuccaggagauucuagaugguaucaagaaaacaaguaaaagcagccaucacagcaggaagugggaucagagacuggauagcaaagagggcuuaaacagggaaaggggcaugauuuuacugaggcugacacagggcugcccuaaccacuguacuggggcaagaugucagagggcuuaggcuauacugcugugauccaugaagggaaugaugauaccuugugccaagggugggcagagggugaugaaggcaguguugaaacuucagaaguggauggaggugaagcaugugggaugugccucaugaaagacuccaggacugugguccacagagcccaagcaaaggaguugcuugugacugacaugggagacugcaaacacggcggacuuggaaggaagaugggguuauucauucgcugaccugugaccagacgacgccugugggcacugagaguucucaagcagugugucaggauugcagauugaggggaauaagcauuaacucaguccuacaccuuacagccccaggaguccuauauaucagcuaugggaucaaauaucacacaccccagcgacuacucuggagcagaaugugggcuuucaagaauauguaguaggccagcugaccuaguuuggagagugguuggugguuggaggaggugauaauccaauguugguaugaaagaggagcaaugguuaacuauguggaaaguuuggugugggcacaguguccuaguaagaggaaacuugucaagguccuguagucagaggaagugugaggguccagggcauuugagaaagaguggaacauacgaugucugggaggguaggaaagaaagagcauggugagagaagagacuggacaguacagggacaggcagaccaggcuggacagucaugucaacuuggucauguaaauuuuucucuucucauuugacagauguggaagcugucccugguaguggagcaagguguccaagccacccagcuagcaggcaguagaacucauaccugccuuguccugagaggucuuccuguuggaagcauugucaaggcucaucaagugcacugaaacugagggaaggucugucaggcugggaacccaggacacagucaaggauguaagcugggacucugaggucugucuccgaguucugugugucuugcagcaaccacauuccuguuucucccaugugcuauucugcuggacauuuuucucuuugauuugauggcuauacaauuaaucucaucugacaggugaggaggggucuccccuaccaugguccccaagcuuccuggagaguaaauauugauuuugggaacugggguggagggcagauucacuugugaaucgauucugagucaaaccacaucuugaguggcauccugcgaugaaggaugguaccuuguccuuuuggcuggcacacugaauaugagaggaggugggggcucuccacagaccaccagaaaaaaguuaggagcuccacacagcauccuugaugaacgaaugcugggccuacccuggaaugagguugucugaugaagggacuguuggcagacccuucugaguaacaggcacaggguuuggcucugugaggacugucugagaggcuucagucagcugagcccugugcccugcacuggagcacaagucgucuuauacacccagucugcuuaggaaagaagcuaugugucuccaguagucacguggguccaagcugccuguuuucuguucuggaggccagucuucagcuucccuggaaagacuaggguguccuuaccuggauggcuuguuucaguaguaccaucacuaaauggcucucaaggagacuugcaugucccaggaauggaggacaaagagacaagagcccaaacacaccuuagggugaaaugaagucucacugcuauagcaacuucaaacugcagcucagaccuaaagcugagaugccuggcuuauugaacagaugcugagccauuccacugauaaaaagcucaaguauaucua

SEQ ID NO: 338 - RNA, 697 nt, Mus musculus
uaaaaggcuuuuugcgaggguuggggaugugacucaguugccuaacaugcacuaagccccacagauccuuagcaccacagaagucagacauggugacauauggcucugauuguagcacucagguggaagaggaucagaaguucacgguugucuucaacaaugucucaguguugaggcuaguaugggcuacaugagacugccucaaauaaaauucaacaaaaauuccuuuuugaauuugggaugucucuucgcuguuccuccagcucccagagcuccucagcuuuauccaucugguguuuccauuucaaugaucaguuuuaauuuccagggucugucuguuucucucucucucucucucucucucucucucucucucucucucucucucucucucucucucucaagagguucuagcaauguaauuccacaacguacuguagaacaggcugguuucaaaacuuacagagaucuaccugccucugccugcuaagucuggggauugagugugugccacccaacaagaauccuuuuauuuuuuaaauuuuauuuaacuauucauugauucuuucugaauuuuacaucauguaccucaaucccacucaucuccccaucccuucacauucacccucuguccuugccuccccaaaucuacuugaguaauuuuuuaguccuguugagagaccuuuuaauucuagga

SEQ ID NO: 339 - RNA, 1573 nt, Mus musculus
aaugaaugcacugcaguuggaggaagcagaguucggcuuucacuugguaauucagcuuauacuugguaacgugcuuuucugagggaagucagggcagaaaccacagaggaacauagcuuacugguuccucuuuggcuuauguucagcuagcuuuauauacagaccagagacacuggccuagggauggugcuacccauaguuggccaggcccucccaggucaauagccucaggccaaucugagacaauucucuaucugaagcuuccccuuuccaggugacucuauguaagugucaaguuggacaauaaaaacuaacaagaggagcuggcaaggaagaggguugggagagacaacacacagaaaguuccaggugaaauaggcacagcugcuagaggaugcuaauugcuuagagguacuguuccuaucuucuguagcagggaggcuauaaugugauucucaugagguacagacaacccuagagcagauucagcucauuucccuauuacauagacgaaagaacagaaucagcuuccccaauucccucgaaguucuuccaccaaugaggccaacccuucagaguggcuaauacaggcagcuggcuucauuugcuugggucccgggcccugggcuacuaugaaagguugacuucagaggcccagcugccuguauuaguuagggcuuucuagaguaacaacacuuacagaauaaaucucucucucucucucucucucuuuauauguguguauauauauauacacacacauauauguguguguguguguguguauguauguauguuuauguaaaggggauuagaauaaacugcaggcuaugguccagcuaaaccaacaauggcugacuaugaauggaaaguucaagaauccaguaguuguucagcccaugaggcucuauguuucaucugaucuuuaguauauauaauggagucccacagagguagguucuaaugccagugaaggaauuaaugcuagugagagcaagcaggcaagggaacaaaaagcagggggaggggaagagaucuuuuuucuuacaugucaacucuagaaggugaggcccaaauuaaugauggguuuuuccaucucaaaagaucuggauagggcuuauuuccccaccucaaagaucuagauuagaagugggucuucccaccucaagugauuuaucucucaagugugccccggucagauguggucaaauuaacauuuaagaauacucaccacagcgcugagccagcuuccagauauggcacgugaucuccuacagcuugucacccuuugagcagcgugccuucccaaacuauuucagcaaaggcaucuccaacgugcugcgcugcacuggagagagcacccugcgcuuggcaccgccguuuguaguguucuaccugaucuacauauggggcaacccggaguuugagcaguccaaaaggaagaauccagccauguacgauaaugacaaguagacggccugcaccugggugacaguccccugccucuguaagacccuucucugggagaggaauccacacuguagucuugaagacaauaaacuacuuauagacc

SEQ ID NO: 340 - RNA, 14157 nt, Mus musculus
auuaaaacagugauaaaauuuguuuuauggaaguauuuaaaaauaaaauauuaucaucauaguaaagacaaaaagauccuaaaggugauaaaguuccuuuuuaaaggguacuggggaggggggaagcugggcaaagucaguccaggcugaaggcagauugccucagugugagaacugccugcggucugcuggcuucuuacugauguguuuaaagaucuuggacuucuccacuuucuuuguuuucugguagccgaauccgccaccaccgccucucuucuuaagcuugccaucauggcugcucacaucuacagguaaguguuaaggaggccaagcaacagagagcaccagcugugcaggagaaggcccaacccgcccagcacugccccucugccacacuccccuugaccaagggagacguggggccugaagcugugcaacgaaccugcgcgagacuaggagagacaauaggcuuguacgccaaaaugaacaccaaugucagcugugguggcuucaaucagcacacuauaaucaugacagaguacaacaaacacgcaucacugcgcaugccuuuuucaggucugcugagaccagagucagagaggcucgugagcuaggcagugauucuuucucauacaacccaacucucacuacagcagacugccacgagcucucgggugaagcucaucuaucugauccugcaacccccucaggaguuacuaauauggucgacacucaagcacauccgagcauacaucugugcaccacacggcaauggaagcaacuagaaggucccuuugucccuccccuagaccaaggcucagguuaaguuucuguggccagccuugccauuucuguguagguaaccugguggcacacggggcuagaacuccgagagcucugaccucucuucagcuacuucccaccucucugcgccucuacccugaagacacaacuaccugcuuuucauuaacagucauauuuuucucucuaauauucuucuguauguauguauguggccacgugugccacagcacacacuggaggucagagggcaacuguuggagauguuugguucucuccuuccacccugagucccagaggucaaacuugggugccaggcuugcugggcaaacacuuuugcccacugggcuacccugccaaccagccuuaguucuacacagacuuaaguccugagcugccuucuugugguaauucccaccccagugacaagucccauguucuaugcuacugcaggucgacacacaauggccagggggaacaccagagccuguggcuggcagcugagguacacuccaacuuacugcagagccccagcagcucugcuaagccccucaauuguagcacaacgucacaaaggauacucagaucaacaaaaggagggaccuuaaaaccaaaagacagagcaaccugaggcagauuuaaguuguucacguugaagaucugcuugagagagugagagucauaugcucuuauguaggauuuguaugcuuccugggcagacuuguggagaaaguaguucuuuucgaucaguuuuuccagcugaaauaggaagaaaaaagcagacgucaacuauuagaacaguuauccaaaaagcgccugucccagcacacuugauucagcguuggccuguccuugccucuggcagcacaggugccagacugagguuccagcaggcccaccugagagcaggacccagguaggaaggauccuggaggaccucagaguccaagccagcaucauccacaaacgggagugagcugggagugacugcaaaacuccacaaaguaguacuggggcaggugaucucuuccccagaaagauaaacagaaagcguaccugagacuggauaucagaaacuuuagaccaggagaagucaaacugauucaauggaaccuagagaaaaaacaauuagguauuaguaagaggggcauucaggauuagauguaugaagacuauagugucccaucagcagcgacaucaagggacagugcugguucugagaacagaaaugccugggcuguggaacccccaggacagggacagcgauuugcugcuuacuaccucccgucaucagagcaguccaucuccacggaguucauauggguccagcgugaaagucgaggugaggaacugagcagaggcaggcagcugcuccagcuccccugacccugacauuuagggugauaaaugauuaccuauguuuuuccuauuuucuagcagggcuggccuugaaccugcuguaauccuccugccucugcuuuuuuuuuuuuuuuuuugguuuuuucaagacaggguuucucuguauagcccuggcuguagaccaggcugccuuuuaacucagaaauccaccugccucugccuccuacgugcugggauuaaaggcaugcgccaccacugcccaaccugccucugcuucuugauugcugggguuauaaguauguacuuccaugccugggaugaccaccucuuccccuauaccaggagagaggucucaauaccacuguuuucugugcuaaugacaccgaguccaugccaagaugacgccagcucugcuaauaauuuaccaaauauugccuuuacacagcugggaaaacagauagaaccuguguuugugcuacagacuggggaagagaagagguguacuaggacuggcugcugcccugcccuaggaagucauguguggcagcccacggaacagacagggaagugaugcaggaccugucagggugcauuugcugggagcacaacuuccugaacaauauucuguggagauccagggcaagggcagcgaggcaaaaugugcaggggccucagggcaacuucaggaaucugugucauacuguaggaaggaggaaauccaugugacaagacugugccaagacggugucauggugucagugucauggacaagcaggccggucauguaccuaccaggccuggcaacaaggaggccaaaugcagccuguaugcauccuuuccuggcaagauggaauuagggcaaagccaggcagguuggggauuagcuggagaccagaaaauauacaaaccacuuucuuaaacaaaaagaccgagaaggcagaggcaguggccguggccagcccugaagggagcggcaggaggcugaggccgaagcagagcuucauagggagacuugagaugggaaagcccuagcugcaaagggaccaggaugugcuggaaagagucaggagagggaggaggaggccagcacagggagagcacagaucugcugcucgucuaugacagagagagaucgggaagaugcugcacagcaggcugcagggugccagccggggagcagggaaccagaaaggagaaccuccaacaguugcuguggaaacgcagcugggacaaagccaugggccugcuccuucuguccaugcugccagguagaaacacauucuauucccucacccagugaccuagcacuguuugacaccauucaaccccgacucugacaucuacagagaugguagaauuaguaucaacaaauuuccucccaacuuaagauuuuccaaacaagggccuuuaccuuggacuguuucaaguaacgaaggaaacccaacucuucagggcgcaggaugagcagggcgugcccucuuccauucaggccccuggcuguucuaccaacacgaugaauguauuccuguggcgaggcaagaaagucuggcuuaaguuaugaaguauucuugagucugccacuagcacucugacugugucccuuaauggaaggaagcaggcuggcacaccuacacuacaugguguaccaaucacaggguagagccaacuuuacugucacauccucuacacucugggccagccagcacucucuuuguggauaccaccccuuuuuggggccagccaccaaagcaagaggagcuucaccuaucagccauagcaacacuguaggaaaagcccauaagccagucacaucaacaaugaccuauuaaaauggcuauuauaguucuccuucaaagcaauuuucuaaggaaauuaauuuaaaugcuagccaauacuuuauuauagcucauuguuuauuggaagugcuuguguguguggaagccggguggaggccaagugacugccucugcgguccuccgccuugcuuguccaggcaggcucucacugaaccuggagcuugcuguuucaguucgauggccccacaagcccucagagucugucuguccccauucuccucccuccccugcuacugcugggguuacagaagcaccgugcaugccugggcuuuacaugguuagucauccuacugcagacucuacagacuuccuuccacaauguuacuuccuccagacaccagcuggaccuaucagucuaaggaccuagcauucuuaaagucacauuugccacucaaaccacuucacaccccuuugagucccacaggucucugacacucaacaccaguaauacccuacagcugacagaguggcuguucuguacaggugagccucacagaugugaaagaauaugcuucuuugggcaagugcacuccucagaucuacuccgaagacaccaguuaccuuggggucaucgggagggucguacugaacaauccaguccacuucggggauguccagcccucuggcugccacaucaguacacagcaguauuccugaauccgcguugcagaacuggaaaaacgugguuguucgcuuauuuugcuuuugcuuucccuagauucaaaaucaacaagagcacaaaaaucauucaaguuguaugugagaguugaauguacaaauaaccaauuguggagcugcuaccacacuuuggagcauccucacuccagccuaggcccuaucuccccaacuggaccaaagcguuuugagaaggagggugucuucuauuagccugcacuuaccuguguuauaacacuacugugugaaguacucugcccacacugaccccacugcccucuccuggccccucccacuccugcgcauucccuccaugucccucuuccuuucaugucuuugugugauucaagaagugaacaaaaccaggagugaaggggacugcaggcacauccaguggcuauaccacugaggaaacaucuaacaaccauuagccuccuacagauccucagggaggggcugagccuugagagacccucccaccaucuaaucuucaaguaaucucugguaucuucagauccauguagccccacucaucaucugggagagggaccacucagaucuguguucagagggaguaaucccuccaaucccaaaugcacaggcucuccccaguucuuaacaagcucccugccaccacuuacauggauggccaagacgggaaggucaauguaguucaacagcucauagugguauuucacagacauacaagaugaaaagaagaccaucacuuucuucuuccgguucuucuuaaggaaugugaaaagcagaaggaaccucuucucagagggacaaacaacauagcccugaaauggugugaguaaacagguuacucauaaaagaaugugaccgaacacagcaauauccugcaaggucuuucugccauguuuaaggacuauaccaacucaacaauuccaauuauauagaaccguuuacucauuggaagaauuugccuuggagcuagaaagacagcucagcucagccaaguaaagggcugaggacagguacccaugggaaugcuggguaaguguggcagccagcauuguaaucccaaugcccagcaaaugggaucaguggggcaaacuggcuagcuagauuagcugagucuacaagcacugguucaaaugagauucuucucaauauucaaacggugagccauuaggaagucaucugacauuacacacacacacacacacacacacacacacacacacacacacacacacaguuucucaagcuuaaacuuguuuucaugaacucagaucuggcaucucuuuucugacuuucacagcaauguacuuacaagcuaguuuccucuaccacccaacuucccuggcaccccauggcaacuauuaaaaaaaaguucuagcuguauuaaaauuaguagugacugaugcuuccaauaacagaauagaaguuggcugggucauucagaguucauaguauuuuauacaaaagagucacuacucaagucugcuacucugacuccgcccaucacucacugugcucuguggaucauucugaagaagcgcaaggagacaccauguacaauccuucggggcuucacuuacuuacuuuuaaauauguacuaagcuagucauaaacaguaccugcucaaggccauccacuguggcaaccucuuugucgucaucaacacccacguacaaaggcuccuuuuucagagaaauucuugccaagucuucaacuuuucgaguuuguguggcagaaaagagcaugguuugccuacgggcuaaaaagacacaaagguugccaaccuaccaaagaaucccauaacugcuucacaauuacacuuuaggaagagaguccuggaagaggggauaugcuguugguauacauacccugagauacauacaccaagaguaagguuauaaugugaauuucaggucuauagacaugauagcuuaggugaaacggacaaaauuuaagcacauuaaacccgagugaugggaguuauggcuucuccaggcaccagcaaugccuccuucaaacuauucaaaagaaaaggagcuauauaacccuacaacuuguagucaauguucacggggaaauuuuagcagucucaugccgcaaacaauacacacacaccugucaacagcuggcugaacaaacaaacagcgcaggugacgugccaucacuuuguuugcgguccacaagaguaucagagauuagauauuuaaaggcaauagguauacuuauuuuuaaauaaguguuugugugucuguacacuaaguaagcugccucagggggccagagggguagauuccccuaggguuaagaguuacauacaggugauggaugaccgugugguguggggugaugggaaccaaaccugggucucugcaaaagcaguauguguucuuaguugcugggccaucucucugggcccuaguuuauuuuuugaggccgagucucagcagcucuggggucaaggucucagggaugcccuugacucuugcuuccacacuugcuuuucuucaugucaaucauuucagcacaacacugcacuaagcacagggucauggccagacuacugacccugcauuuaaauuuuaguuuaugagcuaugguaaugugcuguaugaagccagcagaaaagaacuacuucugaagucaacaggcccacauuccucauguggccauaguaaaauucugguauuaagauacuauuuuuccuacaagaucaccaaccacggaccucuaacuacccugugagccccaugcagaugccgucuacuuaccuggcaaaaguuuaauaauuugcuuuaauucuucuucaaacccaacauccaagauacggucagccucaucaauaaccagacacugcagguucuuguacauaaacccuggcguguucugcaugugguccaggagccggccgggcguggccacgaugauguugaucccauugaggagcuucugcacuucagcagaccuguugcugccgcccaugaucagcccauacgugugaacguggugcgucaucagcuccuugagaacaccaaaggucugcauggccaguucucugguaggagagagaaucaggacuccuguuccuaaaaggcaaggggacagagggcugucuccacaaguccugaagagaugagacacaaaucccagugacauaacagcagagagacagggccuuaccauuccugggcaugaacuucaacuugacaaugagcucgaucacagggaugaggaaagcgaggguuuugccacugccgguuuucgcagccgccagaaggucccuuaguauugcagaagacaggauauucauuugacucacgcagauguguacuuagcccacacuaugcgcucugggcaugcucuagacacuaagugagaacacaggugccuagcuccuagcucacaaagacggauacaccaguaaauaacgcaagucuucaguauagccaaacaggaauccauacagagaacaaaaucagaggaacacauauuacaacugcacaguccucagggcagacagggaugucccuguaucagugucagccauaccugccuuccagaaguggccugauacuuuuaugcuggaucuccgucaugcgcuugaagcccauuucuucuauggccuucaggguguucucauugacgagauuagacaaggaagcaaaugaaguguccucaaaagcaccuagcaggagauuguucacuaucagcaagcucuguggucacauggcugccugaaucuaccugcuccuuacaagagcucuguggucacauggcugccugaauccacccaacuccuuacaagagcucuguggucauauugcugcuugaaucuacccacuccuuacaagagcaucuuacggugagagacacuaaugcccaaucacugcuaagauaaugaugagaaaaacccacagaauaagaaaugucuuacagcauaaaaauguguaaacacuggggcuggagagauggccuagagauuaagagcacuugcugcuguugcaggggaccugggcaccauuccaagcaccugcauggcagcucguagccauccacaauccuaguuccaggaguaaaaugacuacuaaucuccaugggcacuaggcaugcguggugcacacccauacacaauggcaaagugccacacacauaagcuuggcaguaaugauggcccugacuugugaccgauguugugggaaaacauguuuccaguguggcaaggauaaacuacuagauacauaaugcuuuuauaaaucaggcuuucuuagaugauuuucccccaucagaguccaaauaagagcucugacuuuuuuuuuuuuuuuuuuuuuaaagauuuuccuuuuagccacaugucuguuugggagcagacauguguacaugaaugcugaccuccguagacgcccuggagcuagaacuaccugugcacaggcuguugugagacacuauuguggguacugucucugauuccuugcuuuucgcugcugagcaccucuccagccccagagagcauguuuaggacaggguacugugaaggcuaaucauaccaugaaccccaauacuguacugcuuacuggacaaaccuguucuaguugugguguggcucagccuuaacaccuuuagucccucuggcuguaauagacaggcccuuaguucacaccuuuaaucccaaacaaugacgauaaagucaguuuguacaaauaguacccaugucaaauuagagaaagauuugacagaauaauauauccccaguucucacaaaagcagaaauuuaagcaacuuaagagaaauacuggggggaagagaggacagaguuuuacuaggacguaauagagacagguuguagaaagaaaacaagcuagacacagaugaagauagaaugaaccagagaaugagcuagaagauuagaacauaugaggccaagcagaacaauucagucagaagcugaaagaagccaguuugaaucagucgacauggaaaggaacagcuaaaucaaccauccagccagaguucagaaagaccuagaauaaaggugagcuuauucagcuauacgucuaagauacugaaaacauucuaggccuagauaagcuuccaggacuuggcccagguuagcagacagaagcaguaagccucggagacaacaguuaccgcaggggaguaagcugcuuuuacagaagguaguaugcguucagggcacucuugacuucuaucuugaacgucagcaaacuuauugggauacagccccacugucaaaaaggaacaucuaaauuggcacugggcuggagaauucuuuuuguguguguguguguguggggggguggggggauuaaauucaggaccuuguguaugcuggucaagugguuauccuauguaacucaagaugauguguggcaccuccacacuacagaugucaggacuacccagucaggcuuggaauguacaaccucuggugcuaacguggacauuucugagaaaagcuuguugcuugacuugggaugccaaacuguccuggcuaagaaucacuucuguaacuucugcauuuucucuguagacugcacucaguacaguaccaagugacuuagcgaucucauuuacacauuaaaauacuggcgucagaccucagcaggaagcaagcaagcaaaaucucccaagaacagaucaaacaacuccuacuacuaauucuggguagagcaacagauuccagccuaaauucuuaaaucccagaagcugugagaauaugaagcacuuuaaauauuaggaacauagagaaagggaaaaaagcgggugggugggguauggcgaguggagggggagggguuuggagaaaagugccuagguaccacaaaacagaagauaaaggaaaacugcacaaagauauaaaacucacugguggcugguaauuaaaggucacaacaggaccuuuagucaugcagagaaauggugacauuucuaagacaagacaccuggaaaagucccuggccaucaccugucaguccuaggggcaggcugggcaccucgcugucaucugccuuuuucacaucaucuucugguuccucacaagccucagcacuuucuucaguuuucgcuuuuuuuguaucuugguuuaaaaaacaaacaaacaaaaaccguuuuauacuuaaccaaugggaaaagaagaucuguaauguaaagaaauacauuuuucaaagcuuaacauuauuugauacuuguuacaaacuuuuuuucagggagaggcuuguuuaauauuuaaacuuuggggguauaaaugauuugcaaauaaaacaguguuuuaaaguuucuuaaaacauuacaguauuccagauuagaaaaggaucaccccugugaugggcgugguggggcacgccuuuaaucccagcacucgggaggcagaggcagguggacuucugaguucgaggccagccuggucuacagaaugaguuccaggacagccagggcuacacagagaaacccugucucgaaaaacaaacaaacaaucaaaaaaacccaaaaaacaaaaaaggaucaccccacccccacaacaacaauuaucuguguagcccuuccugacuguccuggagcucaacuuacuagacuggccuugaacgaagauuugccugccccugucuccugggugcugggauugacagcguacacuaacaccgccugccucuaaagaaggguauuugaaaucccacuaagcaguaucagggcagcaauugugaguuucacacuucaggaggaaagaggcacauguucgacuaaggcacacagugcccuguacuaucugcucacuugaaaaaucaaugucuuauuuauucacaacuuuccuacaaguuaucuuacagacucugcaaguaaguacuuauggggaagagggcuuacaaaaauauaugggcaaaagacaaguaaaucaagagaucaaagaaugauuaaugugaaguaccuucacacagaaaagccugggagauacuucccaucaccaucaucccaucaccaucauagauccauguuguguucgaaaucacggaaauauacaaacccaaaagacuaugugaugauagauccaguuuauuuacaaagcccaaugaacugcucccuaaaacccauaguggaguauuauaaaucuaaagaaauucuuaucaaauuugaacuuuucccaagggcagcuaacuuaaaacacauacaaaucuagggaaaaccuaaaacccacuucccuugucuaccaauaaaaggugucuuuuagcucccaggguagacucaugguggugagcauaggggaugcuucacacauacaacaauagagaaaagugaccaagagcugaaaagcuaucugaaugaccaauauuaaaacaaaacaaaacaccaaaaaccuaccaggcccggcaucauuugccauuuuccucuuuuucuucuuuuucuuuuuuacuucugaaucaggaggugguguuggugcugcuucuccguuggcuaaaguugugaguuucuggggugacuuuuuaacuuugccauuuuccaaggucuccucaggcaugccuccacuuugugcuucugcugaguccacaggcacagaacguuucagggccuuuuucacuuuuccaccuuuuccuguuucuuuaggcacaucuccauuuugagguugggacaggcuugugucugauguuucuguuuaaaaacagaacuuacacugugacaagagaaagcuuacuuauaaacacugaccuucacaggagaaauuauggguuuucuggaaccccaaucauuuaguuuuucuuguauguucacuguuaaaaccaaauauugguacucuauuauagaaaaggcacauuuucuuuauggaaaaaaaaaaugucaguaaaggaaaguuguuuuaacuucaaaagacccuaucuguuuacggcuauauagaaauuugugacagaaaaaugucagcaagaucacauaauuaaaucaaaugauuaguaaacagcaaugaggagaaauauauauuuuaacauuaagcauuuggccugcugguguuggcacacaccuuuaguccuaguacaugaaaggcagaagcugguggaucucuaugaguuugaggccagccugguauacagagcuaguacuggaacagccacggccaagugucugauaaauauaacugaaugauauuuacuucgcauucccacaauuauuacuuauauaauuucacuucauucaaacccaacuuuccuagacuuuggugaacugaaaauucaguaaacgaaaaccacucauuaaaacccuauuaaagccccaaacuauccucacaaguuuuccauuuucauacaaagagaaugaaggcaacaccaucuuuaauuuacaucauuacccacaccaagaaguagcuacuaaguagcauuaauuauucuacagguacuaagugaaggaacaucaauacuuuugccuaaaauccaccauccccucugggaugucuuucaaauacuaucuguugaaaauugcgugggucuagacaauuauucagcgauccucaacauacugaucucucgaccccccaacccccacuacaguugucucauaccagauauuuacauuacgauucauaauagcaaaauuacagccaugaaguagcaacgagguuauuuuauggugugugugugucaacacaauaugaggaacuguauuaaagggguacagcauuacaaaggcuaagaaccccuacagguagguaaccuaaacaagcuacagaaacugcaacaagaaagugacauguguaaauuuuucauuuaagcccuugugccaaaaccaagacguuaaggaauucacuaaguugugcgcgacaaaaaacacugggaggguucugccuaacauaugaagaggaucgcugcaggaaugaaaagaacggguuugggggagagagcuguaucacugggaaagcuccgaggaaaacaauucguaaguuugggcaggggaugagaucgagcaauuaagugaaagucgggaaccguaauggauacaaaguucuacguggggacuaaagaugcugaugggggggucuaggguaaucugcagguuuucuugccaauagaaaguuggggaagaaaguccgaggccucccgcuuucacccugagucgagaaagccacgccggcaaagggcagaaccaaugaaggguccacgggggcugggacccaggcggccugcucgugccgcgcauccccggcucccgccggaagcugcccagcgcaccgccgaguuccuggguuccccacgucguucgccagugcgggguucagcacagcucaccuugcagcuucagguuucgcugccgcagcuuggcauuccgcuucucgaucuuccugcgcaggaguuucaucuguaacugcgacaucuugccaggccgcccagccgucugcaccgagacagaugcacgugcgcaauugcaagucggaaguguaccgcuggagccugcggacccgcggggcggaaaugcuucgggcggaaac

SEQ ID NO: 341 - RNA, 14157 nt, Mus musculus
guuuccgcccgaagcauuuccgccccgcggguccgcaggcuccagcgguacacuuccgacuugcaauugcgcacgugcaucugucucggugcagacggcugggcggccuggcaagaugucgcaguuacagaugaaacuccugcgcaggaagaucgagaagcggaaugccaagcugcggcagcgaaaccugaagcugcaaggugagcugugcugaaccccgcacuggcgaacgacguggggaacccaggaacucggcggugcgcugggcagcuuccggcgggagccggggaugcgcggcacgagcaggccgccugggucccagcccccguggacccuucauugguucugcccuuugccggcguggcuuucucgacucagggugaaagcgggaggccucggacuuucuuccccaacuuucuauuggcaagaaaaccugcagauuacccuagacccccccaucagcaucuuuaguccccacguagaacuuuguauccauuacgguucccgacuuucacuuaauugcucgaucucauccccugcccaaacuuacgaauuguuuuccucggagcuuucccagugauacagcucucucccccaaacccguucuuuucauuccugcagcgauccucuucauauguuaggcagaacccucccaguguuuuuugucgcgcacaacuuagugaauuccuuaacgucuugguuuuggcacaagggcuuaaaugaaaaauuuacacaugucacuuucuuguugcaguuucuguagcuuguuuagguuaccuaccuguagggguucuuagccuuuguaaugcuguaccccuuuaauacaguuccucauauuguguugacacacacacaccauaaaauaaccucguugcuacuucauggcuguaauuuugcuauuaugaaucguaauguaaauaucugguaugagacaacuguaguggggguuggggggucgagagaucaguauguugaggaucgcugaauaauugucuagacccacgcaauuuucaacagauaguauuugaaagacaucccagaggggaugguggauuuuaggcaaaaguauugauguuccuucacuuaguaccuguagaauaauuaaugcuacuuaguagcuacuucuugguguggguaaugauguaaauuaaagaugguguugccuucauucucuuuguaugaaaauggaaaacuugugaggauaguuuggggcuuuaauaggguuuuaaugagugguuuucguuuacugaauuuucaguucaccaaagucuaggaaaguuggguuugaaugaagugaaauuauauaaguaauaauugugggaaugcgaaguaaauaucauucaguuauauuuaucagacacuuggccguggcuguuccaguacuagcucuguauaccaggcuggccucaaacucauagagauccaccagcuucugccuuucauguacuaggacuaaaggugugugccaacaccagcaggccaaaugcuuaauguuaaaauauauauuucuccucauugcuguuuacuaaucauuugauuuaauuaugugaucuugcugacauuuuucugucacaaauuucuauauagccguaaacagauagggucuuuugaaguuaaaacaacuuuccuuuacugacauuuuuuuuuuccauaaagaaaaugugccuuuucuauaauagaguaccaauauuugguuuuaacagugaacauacaagaaaaacuaaaugauugggguuccagaaaacccauaauuucuccugugaaggucaguguuuauaaguaagcuuucucuugucacaguguaaguucuguuuuuaaacagaaacaucagacacaagccugucccaaccucaaaauggagaugugccuaaagaaacaggaaaagguggaaaagugaaaaaggcccugaaacguucugugccuguggacucagcagaagcacaaaguggaggcaugccugaggagaccuuggaaaauggcaaaguuaaaaagucaccccagaaacucacaacuuuagccaacggagaagcagcaccaacaccaccuccugauucagaaguaaaaaagaaaaagaagaaaaagaggaaaauggcaaaugaugccgggccugguagguuuuugguguuuuguuuuguuuuaauauuggucauucagauagcuuuucagcucuuggucacuuuucucuauuguuguaugugugaagcauccccuaugcucaccaccaugagucuacccugggagcuaaaagacaccuuuuauugguagacaagggaaguggguuuuagguuuucccuagauuuguauguguuuuaaguuagcugcccuugggaaaaguucaaauuugauaagaauuucuuuagauuuauaauacuccacuauggguuuuagggagcaguucauugggcuuuguaaauaaacuggaucuaucaucacauagucuuuuggguuuguauauuuccgugauuucgaacacaacauggaucuaugauggugaugggaugauggugaugggaaguaucucccaggcuuuucugugugaagguacuucacauuaaucauucuuugaucucuugauuuacuugucuuuugcccauauauuuuuguaagcccucuuccccauaaguacuuacuugcagagucuguaagauaacuuguaggaaaguugugaauaaauaagacauugauuuuucaagugagcagauaguacagggcacugugugccuuagucgaacaugugccucuuuccuccugaagugugaaacucacaauugcugcccugauacugcuuagugggauuucaaauacccuucuuuagaggcaggcgguguuaguguacgcugucaaucccagcacccaggagacaggggcaggcaaaucuucguucaaggccagucuaguaaguugagcuccaggacagucaggaagggcuacacagauaauuguuguuguggggguggggugauccuuuuuuguuuuuuggguuuuuuugauuguuuguuuguuuuucgagacaggguuucucuguguagcccuggcuguccuggaacucauucuguagaccaggcuggccucgaacucagaaguccaccugccucugccucccgagugcugggauuaaaggcgugccccaccacgcccaucacaggggugauccuuuucuaaucuggaauacuguaauguuuuaagaaacuuuaaaacacuguuuuauuugcaaaucauuuauacccccaaaguuuaaauauuaaacaagccucucccugaaaaaaaguuuguaacaaguaucaaauaauguuaagcuuugaaaaauguauuucuuuacauuacagaucuucuuuucccauugguuaaguauaaaacgguuuuuguuuguuuguuuuuuaaaccaagauacaaaaaaagcgaaaacugaagaaagugcugaggcuugugaggaaccagaagaugaugugaaaaaggcagaugacagcgaggugcccagccugccccuaggacugacaggugauggccagggacuuuuccaggugucuugucuuagaaaugucaccauuucucugcaugacuaaagguccuguugugaccuuuaauuaccagccaccagugaguuuuauaucuuugugcaguuuuccuuuaucuucuguuuugugguaccuaggcacuuuucuccaaaccccucccccuccacucgccauaccccacccacccgcuuuuuucccuuucucuauguuccuaauauuuaaagugcuucauauucucacagcuucugggauuuaagaauuuaggcuggaaucuguugcucuacccagaauuaguaguaggaguuguuugaucuguucuugggagauuuugcuugcuugcuuccugcugaggucugacgccaguauuuuaauguguaaaugagaucgcuaagucacuugguacuguacugagugcagucuacagagaaaaugcagaaguuacagaagugauucuuagccaggacaguuuggcaucccaagucaagcaacaagcuuuucucagaaauguccacguuagcaccagagguuguacauuccaagccugacuggguaguccugacaucuguaguguggaggugccacacaucaucuugaguuacauaggauaaccacuugaccagcauacacaagguccugaauuuaauccccccacccccccacacacacacacacacaaaaagaauucuccagcccagugccaauuuagauguuccuuuuugacaguggggcuguaucccaauaaguuugcugacguucaagauagaagucaagagugcccugaacgcauacuaccuucuguaaaagcagcuuacuccccugcgguaacuguugucuccgaggcuuacugcuucugucugcuaaccugggccaaguccuggaagcuuaucuaggccuagaauguuuucaguaucuuagacguauagcugaauaagcucaccuuuauucuaggucuuucugaacucuggcuggaugguugauuuagcuguuccuuuccaugucgacugauucaaacuggcuucuuucagcuucugacugaauuguucugcuuggccucauauguucuaaucuucuagcucauucucugguucauucuaucuucaucugugucuagcuuguuuucuuucuacaaccugucucuauuacguccuaguaaaacucuguccucucuuccccccaguauuucucuuaaguugcuuaaauuucugcuuuugugagaacuggggauauauuauucugucaaaucuuucucuaauuugacauggguacuauuuguacaaacugacuuuaucgucauuguuugggauuaaaggugugaacuaagggccugucuauuacagccagagggacuaaagguguuaaggcugagccacaccacaacuagaacagguuuguccaguaagcaguacaguauugggguucaugguaugauuagccuucacaguacccuguccuaaacaugcucucuggggcuggagaggugcucagcagcgaaaagcaaggaaucagagacaguacccacaauagugucucacaacagccugugcacagguaguucuagcuccagggcgucuacggaggucagcauucauguacacaugucugcucccaaacagacauguggcuaaaaggaaaaucuuuaaaaaaaaaaaaaaaaaaaaagucagagcucuuauuuggacucugaugggggaaaaucaucuaagaaagccugauuuauaaaagcauuauguaucuaguaguuuauccuugccacacuggaaacauguuuucccacaacaucggucacaagucagggccaucauuacugccaagcuuauguguguggcacuuugccauuguguaugggugugcaccacgcaugccuagugcccauggagauuaguagucauuuuacuccuggaacuaggauuguggauggcuacgagcugccaugcaggugcuuggaauggugcccagguccccugcaacagcagcaagugcucuuaaucucuaggccaucucuccagccccaguguuuacacauuuuuaugcuguaagacauuucuuauucuguggguuuuucucaucauuaucuuagcagugauugggcauuagugucucucaccguaagaugcucuuguaaggaguggguagauucaagcagcaauaugaccacagagcucuuguaaggaguuggguggauucaggcagccaugugaccacagagcucuuguaaggagcagguagauucaggcagccaugugaccacagagcuugcugauagugaacaaucuccugcuaggugcuuuugaggacacuucauuugcuuccuugucuaaucucgucaaugagaacacccugaaggccauagaagaaaugggcuucaagcgcaugacggagauccagcauaaaaguaucaggccacuucuggaaggcagguauggcugacacugauacagggacaucccugucugcccugaggacugugcaguuguaauauguguuccucugauuuuguucucuguauggauuccuguuuggcuauacugaagacuugcguuauuuacugguguauccgucuuugugagcuaggagcuaggcaccuguguucucacuuagugucuagagcaugcccagagcgcauagugugggcuaaguacacaucugcgugagucaaaugaauauccugucuucugcaauacuaagggaccuucuggcggcugcgaaaaccggcaguggcaaaacccucgcuuuccucaucccugugaucgagcucauugucaaguugaaguucaugcccaggaaugguaaggcccugucucucugcuguuaugucacugggauuugugucucaucucuucaggacuuguggagacagcccucuguccccuugccuuuuaggaacaggaguccugauucucucuccuaccagagaacuggccaugcagaccuuugguguucucaaggagcugaugacgcaccacguucacacguaugggcugaucaugggcggcagcaacaggucugcugaagugcagaagcuccucaaugggaucaacaucaucguggccacgcccggccggcuccuggaccacaugcagaacacgccaggguuuauguacaagaaccugcagugucugguuauugaugaggcugaccguaucuuggauguuggguuugaagaagaauuaaagcaaauuauuaaacuuuugccagguaaguagacggcaucugcauggggcucacaggguaguuagagguccgugguuggugaucuuguaggaaaaauaguaucuuaauaccagaauuuuacuauggccacaugaggaaugugggccuguugacuucagaaguaguucuuuucugcuggcuucauacagcacauuaccauagcucauaaacuaaaauuuaaaugcagggucaguagucuggccaugacccugugcuuagugcaguguugugcugaaaugauugacaugaagaaaagcaaguguggaagcaagagucaagggcaucccugagaccuugaccccagagcugcugagacucggccucaaaaaauaaacuagggcccagagagauggcccagcaacuaagaacacauacugcuuuugcagagacccagguuugguucccaucaccccacaccacacggucauccaucaccuguauguaacucuuaacccuaggggaaucuaccccucuggcccccugaggcagcuuacuuaguguacagacacacaaacacuuauuuaaaaauaaguauaccuauugccuuuaaauaucuaaucucugauacucuuguggaccgcaaacaaagugauggcacgucaccugcgcuguuuguuuguucagccagcuguugacagguguguguguauuguuugcggcaugagacugcuaaaauuuccccgugaacauugacuacaaguuguaggguuauauagcuccuuuucuuuugaauaguuugaaggaggcauugcuggugccuggagaagccauaacucccaucacucggguuuaaugugcuuaaauuuuguccguuucaccuaagcuaucaugucuauagaccugaaauucacauuauaaccuuacucuugguguauguaucucaggguauguauaccaacagcauauccccucuuccaggacucucuuccuaaaguguaauugugaagcaguuaugggauucuuugguagguuggcaaccuuugugucuuuuuagcccguaggcaaaccaugcucuuuucugccacacaaacucgaaaaguugaagacuuggcaagaauuucucugaaaaaggagccuuuguacguggguguugaugacgacaaagagguugccacaguggauggccuugagcagguacuguuuaugacuagcuuaguacauauuuaaaaguaaguaagugaagccccgaaggauuguacauggugucuccuugcgcuucuucagaaugauccacagagcacagugagugaugggcggagucagaguagcagacuugaguagugacucuuuuguauaaaauacuaugaacucugaaugacccagccaacuucuauucuguuauuggaagcaucagucacuacuaauuuuaauacagcuagaacuuuuuuuuaauaguugccauggggugccagggaaguugggugguagaggaaacuagcuuguaaguacauugcugugaaagucagaaaagagaugccagaucugaguucaugaaaacaaguuuaagcuugagaaacuguguguguguguguguguguguguguguguguguguguguguguguguaaugucagaugacuuccuaauggcucaccguuugaauauugagaagaaucucauuugaaccagugcuuguagacucagcuaaucuagcuagccaguuugccccacugaucccauuugcugggcauugggauuacaaugcuggcugccacacuuacccagcauucccauggguaccuguccucagcccuuuacuuggcugagcugagcugucuuucuagcuccaaggcaaauucuuccaaugaguaaacgguucuauauaauuggaauuguugaguugguauaguccuuaaacauggcagaaagaccuugcaggauauugcuguguucggucacauucuuuuaugaguaaccuguuuacucacaccauuucagggcuauguuguuugucccucugagaagagguuccuucugcuuuucacauuccuuaagaagaaccggaagaagaaagugauggucuucuuuucaucuuguaugucugugaaauaccacuaugagcuguugaacuacauugaccuucccgucuuggccauccauguaagugguggcagggagcuuguuaagaacuggggagagccugugcauuugggauuggagggauuacucccucugaacacagaucugaguggucccucucccagaugaugaguggggcuacauggaucugaagauaccagagauuacuugaagauuagauggugggagggucucucaaggcucagccccucccugaggaucuguaggaggcuaaugguuguuagauguuuccucagugguauagccacuggaugugccugcaguccccuucacuccugguuuuguucacuucuugaaucacacaaagacaugaaaggaagagggacauggagggaaugcgcaggagugggaggggccaggagagggcaguggggucagugugggcagaguacuucacacaguaguguuauaacacagguaagugcaggcuaauagaagacacccuccuucucaaaacgcuuugguccaguuggggagauagggccuaggcuggagugaggaugcuccaaagugugguagcagcuccacaauugguuauuuguacauucaacucucacauacaacuugaaugauuuuugugcucuuguugauuuugaaucuagggaaagcaaaagcaaaauaagcgaacaaccacguuuuuccaguucugcaacgcggauucaggaauacugcuguguacugauguggcagccagagggcuggacauccccgaaguggacuggauuguucaguacgacccucccgaugaccccaagguaacuggugucuucggaguagaucugaggagugcacuugcccaaagaagcauauucuuucacaucugugaggcucaccuguacagaacagccacucugucagcuguaggguauuacugguguugagugucagagaccugugggacucaaaggggugugaagugguuugaguggcaaaugugacuuuaagaaugcuagguccuuagacugauagguccagcuggugucuggaggaaguaacauuguggaaggaagucuguagagucugcaguaggaugacuaaccauguaaagcccaggcaugcacggugcuucuguaaccccagcaguagcaggggagggaggagaauggggacagacagacucugagggcuuguggggccaucgaacugaaacagcaagcuccagguucagugagagccugccuggacaagcaaggcggaggaccgcagaggcagucacuuggccuccacccggcuuccacacacacaagcacuuccaauaaacaaugagcuauaauaaaguauuggcuagcauuuaaauuaauuuccuuagaaaauugcuuugaaggagaacuauaauagccauuuuaauaggucauuguugaugugacuggcuuaugggcuuuuccuacaguguugcuauggcugauaggugaagcuccucuugcuuugguggcuggccccaaaaaggggugguauccacaaagagagugcuggcuggcccagaguguagaggaugugacaguaaaguuggcucuacccugugauugguacaccauguaguguaggugugccagccugcuuccuuccauuaagggacacagucagagugcuaguggcagacucaagaauacuucauaacuuaagccagacuuucuugccucgccacaggaauacauucaucguguugguagaacagccaggggccugaauggaagagggcacgcccugcucauccugcgcccugaagaguuggguuuccuucguuacuugaaacaguccaagguaaaggcccuuguuuggaaaaucuuaaguugggaggaaauuuguugauacuaauucuaccaucucuguagaugucagagucgggguugaauggugucaaacagugcuaggucacugggugagggaauagaauguguuucuaccuggcagcauggacagaaggagcaggcccauggcuuugucccagcugcguuuccacagcaacuguuggagguucuccuuucugguucccugcuccccggcuggcacccugcagccugcugugcagcaucuucccgaucucucucugucauagacgagcagcagaucugugcucucccugugcuggccuccuccucccucuccugacucuuuccagcacauccuggucccuuugcagcuagggcuuucccaucucaagucucccuaugaagcucugcuucggccucagccuccugccgcucccuucagggcuggccacggccacugccucugccuucucggucuuuuuguuuaagaaagugguuuguauauuuucuggucuccagcuaauccccaaccugccuggcuuugcccuaauuccaucuugccaggaaaggaugcauacaggcugcauuuggccuccuuguugccaggccugguagguacaugaccggccugcuuguccaugacacugacaccaugacaccgucuuggcacagucuugucacauggauuuccuccuuccuacaguaugacacagauuccugaaguugcccugaggccccugcacauuuugccucgcugcccuugcccuggaucuccacagaauauuguucaggaaguugugcucccagcaaaugcacccugacagguccugcaucacuucccugucuguuccgugggcugccacacaugacuuccuagggcagggcagcagccaguccuaguacaccucuucucuuccccagucuguagcacaaacacagguucuaucuguuuucccagcuguguaaaggcaauauuugguaaauuauuagcagagcuggcgucaucuuggcauggacucggugucauuagcacagaaaacagugguauugagaccucucuccugguauaggggaagagguggucaucccaggcauggaaguacauacuuauaaccccagcaaucaagaagcagaggcagguugggcagugguggcgcaugccuuuaaucccagcacguaggaggcagaggcagguggauuucugaguuaaaaggcagccuggucuacagccagggcuauacagagaaacccugucuugaaaaaaccaaaaaaaaaaaaaaaaaagcagaggcaggaggauuacagcagguucaaggccagcccugcuagaaaauaggaaaaacauagguaaucauuuaucacccuaaaugucagggucaggggagcuggagcagcugccugccucugcucaguuccucaccucgacuuucacgcuggacccauaugaacuccguggagauggacugcucugaugacgggagguaguaagcagcaaaucgcugucccuguccuggggguuccacagcccaggcauuucuguucucagaaccagcacugucccuugaugucgcugcugaugggacacuauagucuucauacaucuaauccugaaugccccucuuacuaauaccuaauuguuuuuucucuagguuccauugaaucaguuugacuucuccuggucuaaaguuucugauauccagucucagguacgcuuucuguuuaucuuucuggggaagagaucaccugccccaguacuacuuuguggaguuuugcagucacucccagcucacucccguuuguggaugaugcuggcuuggacucugagguccuccaggauccuuccuaccuggguccugcucucaggugggccugcuggaaccucagucuggcaccugugcugccagaggcaaggacaggccaacgcugaaucaagugugcugggacaggcgcuuuuuggauaacuguucuaauaguugacgucugcuuuuuucuuccuauuucagcuggaaaaacugaucgaaaagaacuacuuucuccacaagucugcccaggaagcauacaaauccuacauaagagcauaugacucucacucucucaagcagaucuucaacgugaacaacuuaaaucugccucagguugcucugucuuuugguuuuaaggucccuccuuuuguugaucugaguauccuuugugacguugugcuacaauugaggggcuuagcagagcugcuggggcucugcaguaaguuggaguguaccucagcugccagccacaggcucugguguucccccuggccauugugugucgaccugcaguagcauagaacaugggacuugucacuggggugggaauuaccacaagaaggcagcucaggacuuaagucuguguagaacuaaggcugguuggcaggguagcccagugggcaaaaguguuugcccagcaagccuggcacccaaguuugaccucugggacucaggguggaaggagagaaccaaacaucuccaacaguugcccucugaccuccagugugugcuguggcacacguggccacauacauacauacagaagaauauuagagagaaaaauaugacuguuaaugaaaagcagguaguugugucuucaggguagaggcgcagagaggugggaaguagcugaagagaggucagagcucucggaguucuagccccgugugccaccagguuaccuacacagaaauggcaaggcuggccacagaaacuuaaccugagccuuggucuaggggagggacaaagggaccuucuaguugcuuccauugccguguggugcacagauguaugcucggaugugcuugagugucgaccauauuaguaacuccugaggggguugcaggaucagauagaugagcuucacccgagagcucguggcagucugcuguagugagaguuggguuguaugagaaagaaucacugccuagcucacgagccucucugacucuggucucagcagaccugaaaaaggcaugcgcagugaugcguguuuguuguacucugucaugauuauagugugcugauugaagccaccacagcugacauugguguucauuuuggcguacaagccuauugucucuccuagucucgcgcagguucguugcacagcuucaggccccacgucucccuuggucaaggggaguguggcagaggggcagugcugggcggguugggccuucuccugcacagcuggugcucucuguugcuuggccuccuuaacacuuaccuguagaugugagcagccaugauggcaagcuuaagaagagaggcggugguggcggauucggcuaccagaaaacaaagaaaguggagaaguccaagaucuuuaaacacaucaguaagaagccagcagaccgcaggcaguucucacacugaggcaaucugccuucagccuggacugacuuugcccagcuuccccccuccccaguacccuuuaaaaaggaacuuuaucaccuuuaggaucuuuuugucuuuacuaugaugauaauauuuuauuuuuaaauacuuccauaaaacaaauuuuaucacuguuuuaau

SEQ ID NO: 342 - RNA, 751 nt, Mus musculus
uauauccccaguccuuuuauucaacuuaacaaacauuuacugaagucuguucugggagacucauuggguuacaaaagcaugguuuacaagaccccacucauugucucagaagggaaagcugugucuagaguugucagggucaaagcuuaggacaugccgccggaacaaaagagguugagcaaucuugccuuaagugaucaauugaaaagauaauaguaaaaagcagagaaaggaaguugauucccugaagaaaggaacaaagagggccaguagccccuaaccugaccccaguccauccucaggggucugacuugagauucaaauuugaauagaaggcgagaaguguagaagcuaagcagagcuuuuugagacuugagaugcaaucccuccacacagcuucaacccaucacuguccggguuccucucuccugcaaggugaucugacaaguugacaggacugugugaagucuucucucaugagacaagcucccuucuggcugacaccaacuuuggccuuuccuucucucagcaggagauuccgggguaaauucaaacuucuugggauccaucauuucagaaggucugauagccaaagggaggggcacaagagccucuucagaauaucuccacuccuaccaguguaguuaaaaagcaaaguuuugucccaacggauaucaaucugaugucugcagaagacuagaggcaauagaaagauggcaauccuucugugagugaggcagagugaaagaug

SEQ ID NO: 343 - RNA, 42837 nt, Mus musculus
ggaaggguaauucaauuuuaauuuauugucaucacuuuuucuucaugauccagauauuugaaaaugcaaagaaaaccaacuuuucaugauaugucagggacuggcacuaaaaaaaauucagacugcaaaugaguuauacaaaugaaauaucaaauggagauccaguuaucaaaaugaaagcacucaacauauuaaaaguucacaauuauuuguacagagcacauaaaaaagucagcuugcuauccaaccgcugugcuuuuaaagagcuacugcagaaucugaagaaaauagacguauuaguuaacuuauaaagagaucaaagagccugaaacaaguaguaaaaagaaauuuuuugccuuuauuagaauggcauuaggccuuaaauaugccaauuuugguaaucacauuauuguuuuaauaagaaacgacucuacagaauugcaauacugguccaacagucuuguccuucuuuuaaagcaagaaacagaauguaaguaaccagaaagcagggcaggcaucggcuaacccaggagacuagcuucuuagauccaagcauuugcagagagaaccguugggcuggggagggguggagcagcucgagauaacuggaacccagagugugcgccaagucccaugaggcugcuuguugaacucaucuuuuccuuggucacauuguuucccuccaauacuacaguuuuucuuugacuuuuuuuccucaaaguauaaaaaaguaugaaauauaaacaagcucaggcacuacccacucagcagugcccaaucaggcauuacagagcucucuacacacccacugagcccagcacacuggguaagucaauaauauacaaaauaucagggcaaagaaagaacuaaaacccauuucuuuuuugauacacauaagauucaaauauucaaccuaaaggaaaacaaucgucuuagcucucuucuacaucugcauguugacacacucauuaaauauuccuguaugaucauguuugguuaaaaaccucagaaccauccauucagacaaaaacaggucaucagaaagauuaucucauuuccaucucccuaacccaaucaacaagaagucaacuuuaggacaugacuccaaacacuggauugugacgacaaaugcuagguccaauuucuucauaauccuuuuugguguggcauacuugguagaacucaggcuggaagaaaaaaaaaaaacagaacaaugcauuugagaggucaaauucuccuauuuuccaacagucuauaaaagaaauacuuuuaaacucguguuaaauaaacaauauuuaucagucgauucauggcuuuuggacaaagcucagaacucuaaaaaccaagauuaaaaucuaggauagacaaaucugccggaacuccagggccauuaauucacaacccaccguucacucgacaccugucucugcgggguucugacauguagucuguucugcugggcuuuuccacuugggaaaucuagauuuaaauugggacaggaaucugaaggacaagagccuacacuaucagcaugccugugcccucccuuuucaccuggugcaugacugcauucuaaagggcaaaucacacacgcacccaacaaugcagcccaacugcagaggacuaaauuaagagagaaaccaaucuuugcuuguuuuaaaugguuuauauccaacgcugcaaaucuaguaacuuacauaaaagauucuguaucuuaauagcccaugcccuaauacaacugcagaaauauuuacuauacuaauuauauuagaacauguucuaagggagcauguuuuguucuggaaagaggauucuggaauaauucucuuuauucuguuucaaacauugcaaugaaaccuaacguuuucuuuaauauuuuuagauauuuaaacagaaauaccaauaaccuucuggugaauacuguuucuacacauuuaaaagaauuuucccuauaauaaauguuaaaauaaaguauaauaagcucacucugaaguauauaauaucuaguaaggacaagguaaaaagaacaacaauaaagugaaaugacuuccaaauauaaauacuauguguguuauacacacacacacacacacacaacugacacacacaauuuuuacuuucuuauuuuuauaaaauauaaaaguuuacagauaaauuuacgaaccguggaagccagcauugacccuccaaaccagacugcauaccgcugcauaugguguguaauaacuuguacaucaauaggcuugggcuaaaaaguaacaaaguaacaguaaauucaaauaccaauuucucaaucaauuaaguuuaaaugcgcauacacaaaaauaauaauuauaaaguccaagggacagaacucaggaccugagauuaucuagagugggugugauggaacagcagaugaagaugaccacacuugucaguacacacagcauagcaccaguauuugcccuaccacaccggaguugagaggcuccaaauacaaugaugcguguuuaaagaaacugaaaugcuauuaccuugcuuugaucuuacaacuugcauacauguaucaaauuaucacacuguacuccauaaaucauguauaauuaaauacuaaacauauaaaucaaauacauauaaggagacaugcauggggcaaaaccagggcagacagaaacuaacucuauuuuuggcaacuacuucagccacaaacaggaacaaguuaacuguacuuuuggcaacuaccucagccacaacuauuucaggaaaacaagaaugaauguuaaaacugcugguugaaaagucucaugaagcacagaacagcuauauggccugacagccuccucuuaaguuucuacacaugggaaugcaaagguaacaggcuauacacagaagaaaacuggcaggaagccucuaccaagcaguuaaagucaaugcauucucugacaaaacgcaguaaaacugacaugaaaacgcuucugugaugugacugucaaagcacaaacuacacccacccagaaggaacaccaaacagacccauaccaagacaaaguucagaaaauacacagccugaacucuucaaauauguccaggcuaggaaacagugagcaaagugaagcuuccuagagcuccuuaacuggagaauaggccagcaagauggcucaguguuaaaaggcauuuguuaucaaucugaguuugcccacaggacccacccacaugguaaaaggaucaaaccaacucauucaaguuauccuuugaucucaacaugugugaaugcaagcacacaggugcaugcguguacacacacaccaccccaaauuauggaaggaaggaagggaggaagggagggagggagggagggagggagggagggagggagggagggagggagggaggaagggaggaaggaagagagggagggagggagggagggagggagggagggagggaggaagagagagagggagggaggggggagggggagggagagggagagagggagagagagagaggagagagagagagagagagagagaaagaggaauguauguuccuugacuaaauaauauaacauuguuuuuguuuucuucuguuuuuaauuuuauucuguuuuccuuuggcuugacagaucauucuuaaaucaacuggugaaauaugucuuaggucaacagccauaccuuguguuuauaaucaauguaugaauuccccuaagucagaauuuaaacuuuuaugugugugucaugguaugcuugaggaggacagaggauaacacugagaguugcuucuuuccuuucaccuuucuauggauucuagggaucaaacucaggucaggucacuggguguguacaacaagcaucucaccaggcccugcuacacagauuuaaaacuauaucugugaaacacaagucagccuuucacacaguggaguuaugugagugucagaagaauugguugguugaggaggaaagcaaacauaaaaaccuuuuuugcacaagcagucugccugagcugugacauuuugucauuucucaacagagcucaaaccagagcaaaguaccaagcaacaaacugcacccaugauucuagggauaguggcuaccuuccagcaggacgccuggcaugauugucuuaaugcuccuaagugagagcuggcaaacauuccuguccagaaugcaguaacaagggggucuuccacauucucugucaaugguugagaaaaccaaccuucaaucuaccaccacucagcuccucgcuuaacuucagccuggcaucuacaguucucuucaaaucucuuugcaaacgacguccaaagucccugaacaugguugaaccaccagagaggacaauguucuguggugguagaaaacaaaaacaaaaaaaaccaaaaauuaugaucuuuauuuuaaaagagaagcaaucuagagacaaauauacaagaauucaauugugucuuuucuaagacacaauucucuaauauucaacaaugaacaagaauaaaggcuuuaaaauaugcuauuaaauauuaugaaaagaaaacuuaaaacuccaguuuuugcuguaaacacuaaccuuguagagaggacgccggacaucaauggggcaauucugaaugacuucaucuacaacuucugagauagguuguguaaaaucuggauuagcaaacugaaaauuaaguauauuuuauacaugaguguauagaauuguuauguuaacauuguguuaguguaauguucaaguuaauaacaauccagcucaggagugaaaggaccauggugaccaacauacuacagcuacugaggauagaagucaggcaagauucaauuaacaagccaugccuguacuaugagacaguagauauacaauaggaacuucuguacacagcuaagagaauacccgaagaggaaaacaaucuggcaacagcugucaaagauccaaggagccacacaccauuggcucuucuucaaacauucccaaagggaacucugaucuauauacuuuauguaaaacuucaccacagugaaaaggugcuagagaaauggcucaacaauguaaaacauuuguuguucuugcagagggaccugggucuguuuccaaaacauacacgcuggcucccuccuuuaauuccaguucuaggggauccaaugcccucuuuugaccucuacaagcaauaggcacauauguaguacacagacauacaugcuuacaaaacacacacauaaaauaaaaucuauaaaaaggugaaaauaaccaccaaugguccaccaguaaguaagauguuguacaccuagucauuagauucugcaucugcaaacugacuugcuacccucauaugaacagguuacacucauuuccacauacacagggcagcagcacuuucaauccaagugcguacuuguacguuccugguugacgcugaacagcgugguacaguuuaggguuaguauuccccugcuaugauccugaugugaccccgaugauuagaccccauccacagcacaugcugacguguagaccugugucuaggaagaagucuggggugugucuuaccaacaaagugcgcguuacgcagcaucuuuaagacauagauagcagaauggaugucaacaauuauuucaaacagaugaacacacagaccagagguaugcagauaggauggagaaaacuugacaagggacagaaaacuaucuuuuucuuuccuuaggagcaauaguucaguaugcaguacuuuauaauauucucaaggacuuuaucaacagaugaagacaaagagucagugauguauuuaguauuauucaucauagccaaaauaaagcccucucuaucuaauaugugaugcucaaaagcaaaccaacaugccacauguuuguagaccgcuacauguaaaguagaucccaacucugcauuauaaggaaauagaaaacagagcucagcuuggcuagcucuagacgagucauuuaaagacaagcucauaugcagucagaggcaggcugacuguaaaagaaaccaaaacagaacuugagacuacuguccaagauggcauuugugacuacauacaaucuuuguuggcuuuagacugcaaacagugaagagcccuuaguucucaaagcacugugguaauaauaagcccaugguaauacuuuaacuucagaaccuggcacugguuuuauuuuguuuguuuaacaaacacuuaauuuccccaaaucuagaaaguaacaauuugacagaaaaaucuuuuuuauuacacugauuucuacaaaacccuuccacuguuaagcauaacuaguaaagucucuucauugcccuuugucaucacuaauauuuaccuaaaacagccacagccacacacacacgcacacacacacacacacacacacacacacacacuucuccuaugauauauuguuaaccuuucccauaaucuugcucaucuuaucugcuauacugugaacagaaggcgagagagcagggcuggcugugcacaucacagcugugucugcauccuuugcacugcacuccaucuccucaugucugauuuuuacugacccacaauuuuucuaagaagcuuaggcugacccagaauuuucgguaauccuccuaccuuaaccuacugaguguugggauuacagguguggacacaacuuccaguuuuuagucuuuaaccaggaaugcacaaaaguaaaacuuuacaaaacucucuauguuccuauacucuguauccaccauggaaauucugauacagaaagaaaugaaguuuaacuugggccuaucuguuggaauauagggccuauccacuacaaugcagaaucucccaaaugaaaaucagaaugguggcaagugguuaaaggugugugcuacccuugcagaggaccugaguucaguucccagccccuaugugggggaagcucacaauugccuuuaaguagcuccaggaagauugacccucuagaagauccaauucuggccuuggcagguaccugcauucaaguguacccacauacacccauaaauauaaauauaaauuuaaaaauuuuaaauauuuagagcuagagagauagcucagcaguuaagaguacuggcuguucuuccagggggaaccccaggacccacaagugugacagcucacaaccaucuaugacuccaggucuggaugaucaaugaaugcccucuucuguuuuccaugggcacaaagcagggcaauggugcauagauguacaugcagacaaaacauccacauacauaaauaauaaucuaauuaaggaaaaagaaggucagguuaauauaaacggguuaaagaaaaauuaaaauuuccucaaaaauuuaauaaacucaacagugguucccccaaacuaauucuuggcccuuccuuccuucagcuuccuuuuaaguauuagucuaacuguucccuggucaggucucagccgcacaagcuguugagaauguucuaagaggcuauuaaaggaggauuauucagguagacugaacauaucaaauaaauacaauaccccaugucugugucauaguuagaaauauauucauaaauuuaaaguauaaaauggcuuuaauuuuuuuuuguuuguuuuuuguuuuuuguuuuccagacaggguuucccuguguaguccuggcuguguccuggaacucacucuguagaccaggcuggccuugaacucagaaauccgccugccucugccuccugagugcugggauuaaaggcgugugccaccaugcccggcuaaauuuuucuuuaaaaaaaaaauuuaaaguuccaaauacacuccuucuaaaaucuuucuaauaucuguggugaacuuagcuauucaaaaaaaaauuuuuuuuucaacaggaugucugcaucacaguccauccucaaggcucagggagcuaugggaauaauaggaggcugaaagaauaggagccagaggugcugacuccaaggaagcagugucuuccagacaugauaggaaugaugcacacacaaaaccuagagagugugcagcacacacaagauguucacaagcucaaaccagacaaacugcagcacugagaggggcacacaaauucccaccccuugugagaaacucugcaguaacugauaucuacuaggaaaaucagcgagguuccuggguauagggcaagguccaugcccaggaagccaacacaaaacugagugauuuagacuucauauauuauugacuacuuugccuuacuggucuucguuuuuauugagaaagagaaaagaaacacagacagagacagagagacagagcuucaccaugaaguugagcugguacaaagcugaggaaaggagcugggaaguuaggggaggggaaagaauuaugaucaaaauauauuguaaaaacaucccuaauaaaaaccaaaagucaaucuucucaucuuccauauauuuuaucaucaguauucaaaucuuagauagguuaaauauucuaucauucaucuaguccaaauuagaaaaaugaaugaauacuucaauuaacagggaaacuagaacacagaggaaucuuaaauauucacuugggaaguagcacacuuucuauaaaacacacacacacaagcaaguucuauucugggaaacuacagugaacuaacuaaauacacucaucuaauuuucucucaccaaauuaaaaccauugguaaagagaguuuuuaauugaaaaaaagucuaaaacagacaaugcaaagguacagcuguugagaaugugccgacccuuacacuucagucaccagugacgucaaacaagaaugacguuguucuauaauggaccuuucgcucaaagaacuaacuacaucuggaggcuuagaaauugaggcaggggagacaaaggcauacagucccauagucagccccaauucucuguaggagcccaucaaauguucucuccucaagacuuguauuuaauguauucuuaagaagacuauucuuccgaaaacagcuuucugagcuauuuuuauccucucuaaaaguaaucaaaguacacagagggugucagaaguccccuaaaugaacugucacagaguagguaaguagcucaagcagacagaagcacugacugacuuuaacucacaugcuaaagaacuguguguucaaagggaacacacagggacaagagcagaagagaagaggcaguuaucuuccauagcucaaagucaauucaaaaaugccuacaacucggugugugucugugggagggcacaggggguggggcaauggaucaaaaauguaaaucucuacaacuccagcucugcuguuugguuugguuugguggagccuaagauggccucaaacucuagauccugugccuuagcuuccagagugacaagguuaccuacagagcugcagcaccacgagcagcugaguccaaguuuccagagacucaucugcucugcucucuaguuauucugacugccacccuacauuucccuugacaaaaucuaaguuacucaagguacagauucuucauauccuuaucccucucacagcuaaguauuuacuaaaucauaaagcccucauuuuguuucuccuuucuccaugacugacauuuauucaccugaaaaucuacaacaaacucaucugcuuccaacccaauucaaaucauuguucugauacaaaaccaccuuuauguguguguguguguaucuccuacacaucuccauguuauauuuccacacacuaugaauucucaaacauguaagauaguuacccagccaacuguugggcugacuucauguuaaucccucugagaaguuuccugguucuuucgagcagaccugugcuauuucuacaaacucaacagcuauguccaucuguuaaagcaacuacucucauuuaacuacuuuucuuauucucuaaccucaaaagaauacgauuaaauagucuuucagcuuucaauagucaacacuuaaucugagaccaugaaagucacagccaguacuguguuuuaaaaaaaaaaaaaagcaauuaucgaaaauaacaguucuugaugcugaauaagcacagcaggcacugaauaccaaaauucuaguaaaguuaaauucuuaauaucaaguuaccugaagaauuuauuauuaaagauuaccaagagcaucuauuuuauuauuuuauggaagacuuuguguucauuagauuccacacaguccuuuugcaguaggggcagggaaucuuucccagggauuaagcuguuacaaacaugaacggcuaccuucugccuugcucuucuaccuucuaccuuagcucuccccagcacauaaagauuaaagaggcaggguauguacagauaagaaggcuuuaacaggagacucuucucagguggggguggggggaguaggcagggguuggguguaggguagaaaucauucacuauggugcuuuccgacacuaaaaguuucugagaaugauucucucucaauuucuucugacuuucugcugcauauuucaaagugaucuguuuaaaacaaagcaaaacaaaacaaaacacaccaacuaccaagcauuaccucuggauggaaaaagaucucgggucccaggaaucgcucauagccaacaucaauagaaaacucuuucuuugagauggcguugacuccgguguacuguuugauccacuuugacccaucggugucauacuuguuaaacucuuuuacuaaaucugggcagacauaacuguagcguuccugaaaaccaaauaaauaaaaguuuuuuuuuucucuuguuuuaggucaaguuauaguauaucagucaaacaaucaaaugaaaaagauauaauuaaguaauuuugagaggugaacuuuuaauacuagaauaucauauugugugguacaaaugaaugguucauccauacauaauuucuuaccccaucuaucaacacaacuaaaaucugaaagacuaaacuugguccuaacaauuuuaauguuacuuuauaaaaucaugcacaaaagauuucaacaucuacuaucucaguaacaaaauagaauguucuauaauggacaaaaaccaaaaagcacaaauagaaaaagaauaccuauaccaacacaaauuaacacagauccuuuaugccuauuuagaauaaaacuaauucugaucaagguaaugaguaaagaagaaauacagaaauguaagcaacucugcucuugccugaaagacugaauuaacauccaugauuaccugacuguaucccacugcuucuaucuaucccuccaucaauuguugagaaauaugcacaauauccuguaauucugaauaccaaggacauuuuucaagcagcgacaauuauuaucacagauaacaacaacaacaacaaaauacacaaagcugucaugauguggcauugugggguuucacaccuuuaaucuagcgcacuggggaggcagagggaggaggaucuucuguaagugggaggccagccagcacuauauagugagacccuguuucaaucccccugcaaaagggaagacuuguaugaaaaaaagaacaaucucauuaucuuacauacugucuuaguuagggcuuuacugcugugaacagacaccaugaccaaggaaaucuuauaaggacaacauuuuauuggggcuggcuuacagguucagagguucaguccauuauuaucaaagcaggagcauggcaggauccaggcaggcauggugcaggaggaguugagaguucuacaucuucaucugaaggcugcuagcagaagacugucuuacaggcagcuagggcgagggucuuaaagcccacaguaacagugacucacuuacuccaacaaggccacaccuucuaauagugccacugccugggccaagcauauacaacccaucacacacaucuaucuccaaaucuuggagauggaaauuuuauuagagaaguuuuuuucaaagaccuucagcaugagcagucuuccuuggaauaaaucuaaauucucaguauccuuuugcuugcuugcuugcuuuguuuuaaugucauagauuugccaaagaaauuaaaaaauaauaguguugauuaaauuuuuaugcauuuaguaguauggagggauuuuguuguuguuuuuaugagauccaggaucucucuauagcauugcuaaccuagaucuugauauguaaaguaagcuguccucaaauuuagagcucugccugucucuguuccuaagugcuaggauuaaaggugugagccuggcuucguauguuuaguuuuuagguuaucaacuugacauaaaguucagaaaccauuuaguagucucuuuacuauacaggaaguagucaagacaucuucauggcuaagcuugaaagaacaaagacaucuccacaaaggucguacaacgagaugcaaauaaaugagacuuauuuuugcaaaggcagauuuacauauucaaagcaugagaaauacagaaaauuuucagcuuuguugauaaacaacaaauuccaaaagcuauacaaaaagaauaaggaaauaguuuuucugcauguaugacacaaaugauauaagaaagagcauacauugucaaaaccuaaucaaauaccucacauacccaucaguuuuugucaugcuccacaucacugauuaauguccuguaucuauacugcagagcucaacaagccaauuacaccaaaacaauuuuaguaacaaaaaacuauuaggauuaaaauaaagaucucagaguaaacugagauguaauaauuucuggguaaaaucaaucuuuacuuuuaauaaaaggaguaaucacaaaaguguauguuuaaacacucuuaugcuagcccucucaaguugagagaauugauagaauaugcaaagggcaggugaucaucaaccauuucucacaaccauagauuugugagaaaucuauagaaaacaacuuagagggauugcuuugacgagagcauguuagguaaggugcaguucugccaucccaguuaagcagugacucgucuccagcugacccagucaguguguguagcuuaccuucacugcuuucgcaguuuccaaggacugcucaggagggauuccuacuucucggucucgcagcaguugcugaauaaaauauguuauaucucuuccugcgauuggaauguguuuaauacagcugccgauaacauauccuucagccuacauacaaggagaaaaaagugucaaauuuacuuuaguguucccaagagaguaagcugcuuaguggggaaagugcuugcuccagguccugaaaacuagaguuuaaucccuauaaacuacauaaaggugcagggagaaauccaaucccacucacaugcccaggcagcacgaguaguaucaccucauuucuguauaauaauuuuuaaaaauuguauuucuaaaaauagauuagaaaaauuaagauccauuucuuagccaguugugacaagauaccuaaagucccagcaucuacaaggcuguggcaggauucaaggugucuucaucuacuauugccuccagacagugccucugacugaaccagaaacuugcuguuuuuagcugggccacuggguccuugaaacuacaccaugucucuguuucccacuacugugauuagguauguacaacuaugaccugcuuuucauguagguacuugagaucugaacacaggucuucauagagaagagaacaaacucucucacccaccaagucuuuaucagcccacaaaaauuauuuuagauaccacaaaggggaaaaaaagagcuaucaaguaaauuauacaagcuauuaaaugcuagguacauccuaauaugauauuaaaagacaccuaaaggcuaaacaaaaggggauauauccacacaguaaacugagacuuggcaauauaaagaagcauauguacuauaacauggacaauuucaaaaacauaagugaacacaacacagccugucauaaagaccagaguauauaauuccucuucuaugaaguuacuggacaagcaaacuauucacacagaaagccuguggcugacagauauuauguacaccauauuuggaagcugucauuugcuacuugagcucacuaagaacuuuuccucuugugugcccuucuuuuccuccuacaugacccaugaugccaggugagauugucaccacagauuauucugccccuuuccuagggcuuuaagugaaaucaaaucuggggcugaucaugccuuauguacugugugagguccacaacacucuuuucagcucugugaccuuuaccggucacaaacauagcuaugauuugggggaauaguaugguaaggaguuggcauuggccuccuuuuagcacuguugaugcucuuaagaucuucgagauccucaugcagucagugauggugguagcccaggaagagcuuccagucuuguaaagguccaucuuuccuaccauuugccucuggguauacuauuucacauccucuuuagcaauuuucuguacuuaccacaggaaugacaugagugacuccgucuccacugucuauuacuguacccgucagcguccgcucuccuacuugucuugagguccaggaugcagcuaaggcaagaacagccuaaaagguuaagacagacaaaaaauaaccuguuaaagaguuacuaggggugaaagucuacagaaguaagcuguaaugagacuacauacugucuacaguucaugggccucuuacugcaucaggauacuuagaaaguucagaguuuaaaaggaacgcucucuuccuagagccacaagcaagagugacacaaacauguauguaacaugcacagcacgaccuugcccaagcuuaaauaucagacuaccacaaacuaccaguauauccugucaucaccaugagcuagcaagcacuacucuuaaaaacucagaacucagaaguuccuaagugcaagcugcaguauacaaguaccuuaacugaaaaggccauacacacuuccagacaccaugaguuaacuagaaaaccaguagcacacaauaccacuuuccuaccaagaaucucaugauggcugauacaaaacaacucuucccaggguggggaaggggauggggguaacuuuuguaaacugaguaucaguuuuuuaaaaaagguaauuucuuaaaaucaaaauauaugaguaguuacuaaaaacagaugauaaaacuaacuuugccugcuuacaauguaacaaaaaaaggaaccaagagguauuuagucuacuacccuccuuuaaaaacaaaauaaaaaagcccaaaaaccaaaaaaccucccaacaaucauguggcuucagacuccugagauugcagccauggcucaucacccaacaacaacaacaaaaucauuucaauaauacaaugacugcuuaccagcacacaauauuuuuaaagguuuaacaaugaagaguuucacauaauauuaaaagaacccaaacuagaauauguauauauuaauauaccaaccagauuacagaaaucuuacugacuuuugcacaccaaagaaagaaacaaauacuaaaugagugacgaguagcaccgagaagucaggcaagcacagcccuaccgugucuaaauugucaccucaggaaagcaugguaugauucaaauuaugcuaaagcuuucuaggaaaagagauaugcaugguuuaggagaaaauuaagccuggauaaaauguaaaaggcaagcuuaaauaagcauaagccacuuaccugcacagcaauguacaagccuggaacauugaaggauucaaacauuauuucagcaguauauucccuguuuucuggaguauucaguggagguucagucuauugaauugaaugguauuuuaaauagacaguaucagaucacuuuaaacuuuauaggcaauuucuaaaggggaacuaauuuauaaaauaauuugaaaggcacuaaauuuauagguaaaaagacacaaagacuacaggaagaccauagagaguaaaacagaccuacacauauacaaaaauaacauauucucagugucuguguguuccuuccgcuuuugcucuuguuguuccccguuuguuuugcccaugccggcugguuuauguuuuuagaugcuuguuuguuauucuaaugagauagaaacgaaaggguauggauucgggggaaaguuagaaagaucuucgaggaacugggggaaaggaacuauaaucagaacacauuuauuauaauuuuuaguauaauugaaaauuuuauuuucaauuaaaaaacugaauuguucaauaucauuacaagucaccaccaggaaaacgcaaacuaagaccaaaucaacaaucauaaugacuaaaauuaaaagagauuaacaggcuaaaaugcaggagcaauucgauuacaauguuggaugaagagucacccuaggccagaguucuauaccaguuaagugucugcccugcagcagagcaaauccacaaaagagaugagauuaaaugucuauaaggacaagaauguucaaagagccagacugucauacauaacugcaugauguaaauuuuacuauagcacaucuuauacgaauucaucaguguaaaaaccaacuacaggcaagauuaaucucacuuguaaaauaaaauuaaaauagaaugauucacugguuaccucuagggaauaaggagcauaaauuaacuagaaaagguauugauaauguguuauuuacacaacuacagcuguuaaaacuaaagguggaccaaucaccuaauucugaaaaacuacuuuacagaaacacauuuauacuuacugacuacauuaaguauggucuauggcuauuuccacucuacaguagagcuggauagcuguaacaaaaccugcuacgcucucauuugguuucuuuaguauccauccgucugucugucugccuaccuagguagcuaucuaaacuaucuaucacaucuaucuaccuaccuaccuaccuacuacauaccuaccacuaucuggcccuuuuucuuuugccacaccuggucaaaaucuauagaaugauuuagcuuugugauuuuuuuuauaguaaacuuuauaugaaaaagaauauaaguggaugcucacagucugcuauuagauggaucacagagcccccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacagggguagccagggccaaaaagugggaguggguagguaggggaguggggggacuuuugggauagcauuggaaauguaaaugaggaaaauaccuaauuuaaaaaaaaggaaaaaaaaaagauugucauuuaguagacaaucuugcugaccccuuuggcaugcuaaauaaagcccaacaagaggacauguugaauugaaaaaaaaaaaaaaugaaaaagaauauaaacaaauaaugaacuguuugaugauggacauacuaaauguuuaagcaugaauugauucucaucuguauauuguucauuuugaugugauucaaaaacaaaacagauuaacagauggauaaaccaauacaugucaaaacaauuaugcuaaauguaauuauacugaaauguuaauuauugcacuuagguuguaggcauauaggugucuacaguuauguucuuuucacuacaaauaaaguccagcuacaaauaguauucacaaagcaccacaaugaaacacuaaacacuagauuagcaaaacucauacucaaauaaaaaaaaaaagacauaaaauaugacagucauuuuauguugugagaugauaaaaggggaaaaaaaggcaauguucacuuauucuacuaggaaguuagaagucccuaucaaaucguuuaaaaaccaaguaagagaagcugcuucccagagaugcucuaucucacuaggcacaggcucagaagcaauagagccaaacaacuguggagguuagccucagaaacugagcugaaagcaaacuuucuucccucccaugauuuugucagugacggaauaaacaaguauuuucgggugauagcguaaugauuacauauuaaccaccaaaagcauuuacaagauuacacuuuagugcuuggccacauuguuacucuaccugcagccagucgguuuuaagaaugaccuaguuuuauguaacaaagucuuucagacaagacaacuuaaaugauuaaguaugcuugcuaauuacaccagaaacauuaaaauguuccuuaaaaauuuuccuaguaggcuaggcaucaaggcacaggccugauaacccagcauuugggaagguaagagagaaugauacugaguuuaaagccauccugagcuuauauaucccauguagaaaaagggggagucuccaauaaaucagaauguguacuuaccaaaagaaaguaaugaucuucagguucugcccuuaaauauuuaaaaaucacuugcuccauaaaccuuuccauuaagucccagucuucaacuauaccauggcgaauuggccacuauuaaaauaaaauucagaaauuaagucuuauuaauguuaaaaauuugaagcagagacuauuagcucauuaguagauacuagaaaaagauguauuucuuuauaacacaaggucauccugaggcuauacaugcuuaaguagaaauguacauacuuagagaaaugaaauuauuuuuacaauauauauccaggugguugaaacguaagaugaauguugucaaaaauguuaaacuuuauccuaauuuucuuaaucuuuaauuauuagcuuguuaacugguaucuguuguauaucuaacauaguacacacuugguaucugauaugguaacacacacuuacuguguuggcuacuaaggagguugaaacacgaggacugcucacaacuuugagaguacucugggcaacagugaaaugucaccucaaaauaauaauagugcaaaucaguaaauaaaaacauuguuaaauauauaauauuuaauacuagaauaauaauuaaggauuuaggauuuacuuuagaaagcuaaauagguuuguguugaaucaaggaauucuagguuauuagucaauccacaaguacaucugugaggcuuagaauucauaaggauacacaggauacacaccacaccaugugcuagccuagccuacaucugguuuucaacaucagagugugcuacacuacuucaugacacuguuucuuugaaaaauuggguugccagcuguugcuauauaaaaaccaaauacugcacacauacucccaaauccaggaagggagggagggagggagggagggagggagggagggagggagggagagaaagaaaaggaaauagcaaucucuaguucaauccacuguuaacagcuauaucaggccaagcauaccaaugggaacuguuaaccaugagggaaaaguaauuuccuucaaauuaaguugccuuuuuauguggcuacuauggugcuugaaccuugcuagcuaucuacuuaauaaacaacugccacauacacucuuuuucaaaaucuaggugucacuguaaauguuacugacauuuuauaaaaggcaccaagaaagcucccuauucucugugacagauuaccuuucacacauucaacaccuaagcagcaaugaagggauaacuuagccacaguguuguccugagcacccuuggcugcaauacuucagaaggcaugugugaugguuucaauagguguggccuuguuggaggaugugcguuacagagugacacauguugaagagcuuugagggcuccuagugcucaagcuccacacaguuuggaaucagugcugccuccuagcuaccuauggaacagucuccuccugguucccuucagaucaagauguagaacucuuggcuccuccaguaccaugucuaccugcacgaugccaugcuucccacaaugaugauaauggacugaaccucugaaacuguacaccaguuaaauguuugucuuuuuaagaguugcuuuggucauggagucucuuuauagcaauagaaacccaaccuaagacagcauguuauuguguuuugcaaaagaacuucaccuugucuaauccaucuacacuaaccacucugcuccugugacacuccauaguguugauucuucugaccacaccaaucucagcguucacuaggcacccuucccuugagcagcagguaaugucuaauaucuuuuacagauaaaggaaacucaagagaggaauugaaucuacuucaccaaaucuguaaacuucuacuauaauguuaguaauauucccuguauuuauguauacgugguugucucucuguguguuauguacaugugaaugcaggagccugagaguucagaaauaaagugucuuaucccccagggcuggauugccagacaguuaugagcagaaggcccuaugaaagaacugugagcauucauagccaugggcccauuucucuagcucccaccucauccaaucugucaucuagaauacacuccuccagcuuucuccaagacgguguuauguaccccuuucaguuuucuaagcagaauuaagcaguaaaugucucuuccaucuucugccucuuauccuuucaucucucccucccuaagucaagauauaguaucccauuuguuacucuuucuugaucuaccauucacaaagcuacauucauccagcuccacccgacuucuaaaacagugccucagcagacaucuuauaggauguuccaugcagagcaccucuguuccucuccacucaagccuaauuagugcgccucccaggcuucucuccugcuguagacuccccuaggugacaacauucacugcccaaaguaacugaucccuuccuuaucucuuccuuauccaucuuguuucugaacuccaaagccugcacacugacugucuggcaacaggugagcugccucauagguacuucaaauauacuauguauucucaaaaaaauaaacguuagcauacuucugauguagauuuuuacauuucuaugccaacaauaaaaaauaagcaagaaauaguggaucauggcaaauguacacuaaaaaugcaaucaaaagaugagaauacaggaaauuuaauagacagcugauuuuucccucuaaguaaauaaccaagaaauaaggacaaaauacauacacaaaaagaaggaaguauagggcagaagacucaugagacuuaacuacaaaauccaguggaaaguucuuauuuuaaccaugacccaaacauuuaccaauuagaaauuacucagagaaauguauuaaacucuaacuaaaaccaugaguugcuguuaacaggcaaguacuuuuaaaugacuagaaaauaauuggggaaugaaauaacaaaguaagguuaguuacaagauuguaauugccaaagcugagugacagggaaguguggggucaauauauuuuucuucuauuuuuauugauuuacuuuacuguuguuuugagacaaagucucacuaugcagcucugacuggccugguaacugcuauacacaauuagaauggccucaaaccuucaaagauccuaccucugccucugccucugccucugccucucugccucucugccucugccucucugccucucugcuucuccugcuucuccugccucugccucucugccucugccucucugcgccucugccucucugccucucucucugccucucugccucuccucugccucucugccucucucucugccucugcgccucugccucugccucuggcucccaagggcugggauuaaaggugugcaccacaaacagccuuuuacuuuuagcuuugaauuuuucuguaacauuuuaauguacacaugugaaugaacacacacacauaccccuuuaaacucuuuaucccuacuagcauuuaccuuaguccagcaguucucagccugugaauuaugaacccuugggggguugauuaucagcuauccugcauaucagguauguacauuauaauucauaacuguagcaacaaaauauaugguugggaaucaucacaacaugaggaacuacuauauuaaagggucuuagcauuaagguugaaaacuucugccuuggcccaagucacaaacaucccuugccauacaucauuacuucagaaauacacaugccucccucaaauaauuacacuucacuauuugaguacuacaacaauuucuuuauagccauccucuaaacaaggucuacacuaacccugaaguacuaauagcuccauugcauccacaaauaacuaaauuacagaaagauaagccauagaauaauaccacaaagcuaaaaagaagcacagccaaaauucaaauccaaacagaacuuaggaacacaguugaucaaguauauccaugaauguuaccuguggguggaacuggcucucaugaagccccuggauuucaggcacauaagcuaugcugcucccugucuuccuaauaagcccucuuuuguacuagcuucugccuaauggcugucuguacaucuugccuaacuccagacucagcucaagaauuuaucccucaaggacugcuaaauccccaacuagacuaacaacuucugugguucaugccuacaacgcccuauccugcuuuccuuuccuuuuacucgcuucauaauaucccugggagagaaguuguuucuugcuacuuucuuuucagcacaaagcaaaaaacuguaacgauuuauuuuuacauaugguaggguaguuauucauuuaaaauuacaaagagagaaaagcacgcaggaggaaaugaaugcuuggaaguguuuaccuuccaagaaggcuguagaaguggcugugaacaaagacacaggaagaccuguguuacaagauucgcucuuaccugguacaaucagccacauaaacucuccaagcugcauaaugaagacuacuugcuuugcuguguaaguucuaugucaaucaagagacagaaaaggcagggaaggaaagaggaagaacaagauucccucauggcuuagaagaaaugaguaucugauccaagaaggaaaucucucuagauguaguaaugcggagacgaaagaacacucauucccuaccaagggcccugagaggcuagggcacagaaaaguaaauccacccacuucacuguguuaaagcuaaagggaaaggagacauuuuuacaguuaggaagaugagagcagagcgagauaugguuuuaaacuggcuuuaagcaccuuuaauccuagcacucaaaaaggcagaagcaggcaaaucuaugaacucaagagcagccuggucuacacagccaguuccaggugaguuccugucucgaaaauuuuaaaccagaaaacucaaugugagaaagcaacaagcccacgacagagugaaaccggccaccggcugauuggagcccucuuagaaacauaccuuuguugcauaugugggcuuuucuauugcuucaucaccaaugaagaagucuaggucauccacgccuuucaucacccuccucugggcuuggucacccacuuuugcagacucuuuaauggcaauaccuuugaaguaaaguaauuagacaucuuaaaaauuuuaucucuucaaaugaaacaacuuuuaacuugccuucuucaauuguaaaauguuacuaaaaacaacaaauaagcaugauccagaauacuuaaaacucucaacuaaugaacaaaagccauagacaaaaugccuucuagacacccauaccucagcuucaucucagggaucaggccucaaguaucaaccccccaaauguauuacuaugggauuauuucagcuccauuuccaacaacuauuaaauuuugauuccaauuauguggcugcauguguguuacuaggguuuuacacauaucagguauauacuuccaccaagcuaucuaccuagccuuuuuaaauuuuuuacuuuugagacacaacucacuaaguuauccagccagucuuaaacuuggaaccugccucccuuaacuucccaaguaauaagaauugcaguccuuugcuaccaacccuuagcuuagcucugaauccuguacugccagaaagauggcugaguggguaaaaguacuuguucuacaagucucaugaccuaaguucgauccccagaacccacaugauggaaggagagaauugacuuguaagaaagucauucugaccucuacauguauguuaugacaacuaugcaaccauacucaauauacguacaauaaguucaaaauaaaauuguaaucuuauaaagucaauauaaagcuuaauggauaagcaagaaauuaaagguaaauaacacuaaccaauaaaaggagaaaaaucuacaaaagaacuuuuaaaaacaagcuuucuuuacaucucuauuuauucuuauccaauggggaucuacuaaauuuuaaucuuaaauacaaaaaguaaucccuuuaacuaauuucagaauucugugucuauucccagaggugaaaucuacugguguacuuuuuggagcuggagcuggcuuagugauuaagagagcauacaguucacccagagaacccacauuuaguucucagcacacggauuaauucacaacuacuauaacuccagcucuuggggauuggauacucuccugugucucauauacacauaugguacccauauacacacacggcagauagauagccucauacacacgugacuaaaaguaaaacacuguuuuaaaaaaaccugcuauguaaucuaauuagguuuuaauuuugugaauucaaguuaagcaucuucacuuguuauaauuaugcaaacagccuuaagaugauggaaaucaaaaauacaaaaauaacgcugaggauaauauacaccuuuacuaauaaaaauaccuguaacaaucuaaaucuacuaaaacuguuacaacuagcagaauguuaacagaagcagaauagaacaaaaguucccaaagacaauguuaaacauagcaugcuuauaggauaucagcaaacagugaggcugcugagucaaggaccacugcuccucacugagaaauauuggcguuugcaucagaugucuacaggauaggucuugcaaacaguaaugguauccuccagccaaaggacggucacuuuagcugagcuacuuaauagccaguuacagauacacaaagguagcagcaauauccucaaagcagaaacuauuuaauuaucaauucacuacuggguuugguuuuguuuuguuuuccuuaaagagauacuuagcagauuugguaaagaccuaaaauaaauaguuaaaagaguuggaaauaagguuccaucuacaggcaauccuguuucuaaaugccugauucugacauaauagcaugcuugaugacuuguuuuacuuugauaaugaaaugaggaaaaccuuuaaaucagcucauccauggggaaaaagaaauacuuacaugaugggaugauaaacuguggcucuguauuuccagcauauccuaguuuuguauaucuguaaaauaaaaauuucauaaaauuucacuaaucucaauauguauucugcaauuuuguuaaaaagugagaguuuguuguauauacauauucagaaguuuaguucacucagcaucucugccuugaaaacuaucuaaaucacuugcuaggcaaugguggugugcaucuuuaaugccagcacucaagaggcagaggccggcagaucucugugaguuugaggccagccugacuacagagcgaguugaaggaaggugagagcuguaacacugagaaacuaucaaaaucacauauaucuacaguucuguuucuuucugcuguauuuguggaccaaaucauggggcuuugcacaagcuaggcaagugcucuauuacuaagcuacaaacucaaaugcccacaacuuaaaaaaaaaaaaguauauuauguauguaugaaugcauguauauaugcacagacgugcaccauaaugcagguauggaagucgggggauaacuuucaagaguugggugucuuguccaucaugaaggucccaaagacuaaauguagaucacgaugcuugacagcaggagccuuuacucacacacucugccuuuguaaguuuacucauuuacuguguguacacaagccacugcaugaauguggaggucagagaauaaccuucagagauaaguucucucucuuucaccaaauggauucagcgauagaagucuacaggcaaucagguuuggcagcaaacaucugcacucacugagcuaucccauuaaccacuaccacuuccaucaacuaauaauacaggacuauuacuacaugugugaagcaacaugcaagaaaaccuucucuauaaauuuguuuguaaugguaagagacuggaaauguccaaagggaaauuagcaaacuacacucaguuuacacugugacuaguaugccccuuuuacauacugauuggaacacuuucagauauacuggaguagcugaacaaagcaaguguauagaacaacaagcaaagugugcuauaccuacauaaaagugaaauaaacacaagggagaagaauaagaacauaugaaauacauuugauaaccuggacacaaauuauuucuaaaauguacgacauaggaauuuugguugcaucuaugggagcaaagcaaguaagacacaaaagugaaaugauuuuuuuaauuauaugucauuucacaucacuugaguguuauacuauuaaagugacuuuuuaauguuuugauucaguauauucauuauuaaaaaugaaaacuacaaaauucuaaugauuagaaaucacaauggaguguugacaacaugcuaagagcuauuauaagauagcugugcacacuguuagcuacaaguaagcuugagagagccagucacaaccguuuguauuauuccauaugcaaacuuacuaaauagaagcagguaauuugcugugacaucacuaaacucuaauaauagcugcagaaaacuuuucaagcaugaaaaaaaaaagcauuucuuuugggauagucagucccaaaacuaaguuuaaaaaacugaguaugccaaauacacucaaccaauagauauuaggagaaacacagacuguccaaaauaugauuuugcuuugucaccuaaaccuuuaaauauuucccacugccuaugccuuuuuuuuuuuuuuaaaaagcaaaacucucaaacaauacuguuccuuuaacaggaugccuaagaaacccucucagugcucugauaguguuagccucuggaaccacagaccugcugacagcugcugaagagcugggcucaucucgugccacuagccucuauuaucccuacucugaccacaugugaugacugcccucagcccucaacacaaccgcuacucaucuugcaaaauucagguuauguaucaacugccucuggcucaaacuuucacaacuucuccagacaaccaacugccucuauauuuuuaauaauuucugacuguaaaaaaguuaacugggcucucauaagggauaaaucaaauagcaugguaaaguauuuauuuaccacaguaucugacauaguacacacaaguagcuaugcuaauucuacauuccacacauucucuucauccugucuacuccuuacaauaucuuaaaucacauacaugccuuaaguuuuaaauguauacaauuaugacaaacuuaccauuuuauaagccuauugagacucuuauauugcaguuuauauuugauacccuuuuacaacaaaguaguauuuuauucuuccaauccaaaauguauuacuaaagucaaaucucuauguguguaugcaucgugggugggggagccugggguacaacagaacucccaaauagcuggaagugaacauuucugaacuguccacaggucugcagacaguaaucagaagugcucacauacauaaaaaccaccacaaauugauggacaugguccucccauggggaucccaucagaaauaaaauuacaacauuagccgggcaugguggcucaugccuuuaaucccagcacucgggaggcagaggcaggcagauuucugaguucgaggccagccuggucuacaaagugaguuccaggacagccagagcuauacagagaaacccugucucaaaaaaaaaaacaaacaacaacaaaaaaaaagauuacaacauuaaauuugaacauuacauugagaguccagguuauuaguaagcugucuaugcaaugguucucaaccuuccuaauguugugauccuuugauacaguuucucauguugggcugaccccaaccauaaaauuauuguugcugauauucauaaauguaauuuugcuacuguuaugaaucguaacgaauaucugucguguaggauaucugaucugcgauccugugagggucagcaccacagguugaggagcacugcacuaaagaaguggaccaaugguauacuucuccucugcuggggaaauggaauggaguacaucauaugacacggaggacuugucuaauacaagauaaccucaaacuguaugagcccaaaacccucaaacagauguccugcuuucaagucugggauuccuacaaggcagaugagaauaaucucuacaaaucgcugccuaacccaaaaucuuaaaaugauaaucuacugccuacaagauaagaauaugaauuuccuucaauuucucuaagauuacucaauuguaagaguuaauaaaguccccaccaaauuaaaacaaaaaagagggggcugaagagaugagucaacaguuaagagcacagguuguucuuccagugaccuggguuugcuucucagcaccuauagagcaacuuacaagcaucccuaacucuuauaccagaugauccaacucucuuugggccuuggagggcaccaggcucacaugugguguauagacauacacacagacaaaaugcccauaacacacuaaauaaauaaauaaauaaauaaauaaauauuuugaaaacuggauuggauccgcucacuccuugagcugagcagaguauauaaccagcuguacauucgguccuguguaaauuccucauaugaaagacaaucccaaagcugugagccuucagagaaagacugacuacuagccuugcuucuaugaaauaaagaauauucuuguaucuuauaacaaggaagaaucacgagaaacaugaaaauuccaagaacauguuaaaacugguuagguuuaaauaaaaaaaaaaaaaaaaaaaaaagaaaaguauccuacauauaaaaaagaccacugaagaaacaaacagcacagugaccgugauaaagaaucaggaaaucugaaugcauucugcaagcagggagucagaaaaagagaaagacuagagcccaguuagccacguuuuagcauguucacuagguaauacaaucaccagucaguugggggcauuuuccucacucugggcucacuagcaauuuuacuuaauauaguaguuugugccuuuuugauuucaaaagcaucucauaacaaauaacauacuugaaaauaccagugcuggguggugguggcgcaugccuuuaaucccagcacucgggaggcagaggcagguggguuucugaguucgaggccagccuggucuacaaagugaguuccaggacagccagagcuauacagagaaacccugucucgaaaaacaaaacaaaauaaaaaaacaaaacagaaaauaccaauagauuauaaacgugaaaccaccuaaaggaauauggaucauacuuuaaaauggaauggauuaaaaugagcugugauaaaagccaaagaacaaucaauauauuaauauucugaacacagcagaugauucagaaagggcagagcauuaagugguggugguaugggccugugaccccagcuccacuugucuccagauaaacuugugaaggcugagaaugagccucagugguaguagauuuauacauaugaaccagaccuugggguucaauccccaguauuacagagggaguuaggaagagagacuaggaugacacuaguuuucuuucagcauuucccagacugcacaacacaacaaacacaaggucauagcaccuuagaauggaauguauucauucaccccacugcaucugugaaacccauuuucuaaaauuucuuagcagcugaaagccuaugaaaaaccugcuucuauccuuacauagcaugguauauuguauacaauuuuacaauccagcuggaagucaaagaugucuacagauuaaucccaguacaaccuccuguuaaauaaaaagcucaguuuccacuguuuucucuuuauucuauaaccaaacucaaaaaguagaguccacaauuaagaacuuuagaguaagaaugccauagcuaauuuacaggagagcuugaagcaaauauuagcuggaaaaacaaaucacugcuuagcaagcuuucuacucuacaacuccaagcuuuuucucucuaccugcaaguaaaugaucaagcuuacacaaaaagccugguagaauacugagagaaaaucugaacccucagucaacagagacaccacuauucuaguuccuucaaguucaauucuuggaaucugggaggaacuuaggaucaaaaggacacaggagagacacgaacaauggcccacuccagaagcuuaguauggggagguuggagcagaagguucuugaauuugaggccaaguugaugaucagaacuagucucaggcuaaccuauauuacccuagcaaggacaaccaccaaaugaaugaaugaauggauggauggauggauggaaggaaggaaggaaggaaggaaggaaggaaggaaggaaggagaugcuucuaccauuugaaguuuagauccugauccuauacacaucaauaaugauagacuguaagaucacagaaauagacuucuaaucuuuuuauguaaguucacaaggcucucauaaaauuguaaguaacaauagacagcacuucacuuuccaaggaucagugaauuucccuccccaaaugacuugucuuccguacaccuccuuacaugcuguuaagaccuaggcguuaauauuuuacccacaugccucuauccauuccuggaauaaucucuuccaaaauucccaauccauaaggcaauacuuguccaacauuacagaucacggcaguaaauacuuccccccaugaaagccaaucacaaaaggcuacaaauuuacauuuccaaugcuauaccaaaagucccccauagccacccacccccacuccccuacccacccacuccccuuuuuuggcccuggcguuccccuguacuggggcauauaaagcuugcguguccaaugggccucucuuuccagugauggccgccuaggccaucuuuugauacauaugcagcuagagucaaauuuuaugcuucuauuuuuugugaaaucccaaaaguugauaaaaggacagaaagugaaucagaaagaauaugccaaguauugaggccagaaggaaugacuugcuagugagcccugagugaggaaaaugcucccaacugaugauuguaauaccuagugaacaugcuaaaaacuacucaaauguaagccuuuacacaucacagcuaacaggucugaucucugaucucauugccuagguauaugaagcagugccugccauacagcaugcacuguaucuuuucucgcauuuccuuagcuuuucugcuguagugggugcuuuaauuuuuuuccuuccaaaaucuaauuuccaaucccaacugacaggaaccacuugugagaauuacgucuugguaggagguaaaacuucagucuuguaugagaggaagagacacuaacucaucacacaucagggacaaacucuccaauacaugcucuaacuccagcuagugugaucagaacuuagaauccugaguguagcaagggcucagcuuagggcucaugcuguucugcagcacaucucugucuggacucucuuuuguuccugcacucaguuccuggacucuuuucuuuuuacagucuuggaguaauuuuguuauguauccaaagugucuacagcaaaacuaagguauguuucuuuugauucuucuuagucuuccuaacaauuuuaaauuuuaucucccccuuugaaaagcucaaucuuuuuuuuuguuuuacaaauggcuuuugcuauugcaaaggaaccugacacaaagugagcagggucauucacacauacugacaaggacagucacaggauaaaagaauucagcuuuaaaagacaauuuucuaaaaucuauacagcagauuagauugccuuuuuuuuguuguuuguuuguuuguuaguuuguuuuuguuuuuugagauagguuuucucuguguggcccuggcuguccuggaacucauucuguagaccaggcuggccuaagguauucuagagacaauaaaaguuucagucauuacuaauuauuugcuguuucauuucaacuacacaaucauuauuucagagccacagaacaaggccucagagucuaguuaacuuuucuuuacccaaagaagugcauuuuccuaaauucaaugauuuaucuuacuagauuuuguaugguggcugacaauaaaggaccgauaggaccucaggugucccaagcuagccuuaaacucacugugcagccaaggaugaccuuguacuccuaacccuucugcauucccacagugcuggggcuauaaguguacuccaccucacacucaguuccuuuucaaugcacaguagauacuuucaaacucaaacugcaaaaauagagucccuuuccuuuugacauuuaacuaauaaaaauuauuucccuaacugaccuaucuaaaauuaaucugcaacugucaacauguucacuagacacaguauuuauucucagaauacugaagugaaccauacacaauuccucauuuaaucugcaguguaauuggucacuauaaccuuucuacacauugcauguuuauacguguaggcauaacgguauuguguacuguguaaagauuauacuugcauuauucuguccccaugucuuguugcaaucaggacauggcauugcaaugcuuauucuaagcagcugcuauuuugaaguuugaauaaacauugcuucccacuuauucucugacuugucaauaaaagcugaucagccaauggcugggcagaagagagacuagggcuggacuucucugccagccaggagaagacagacaaggggaggaugagagagaggauucaccaagaggaaggggucuggagagacaucguggggaaaaaagaccugaacaccugaagcccagagagccagaccaauacuaaaaugcaaguaucuuggggauuuuggcugggagguagccagauuaguuuagaggauuagauuauuaacugcccaguuaugccaguugccauaaagcuugauuaaauaaaucuuauagucucagucucauucauuugaguuagccagaaaaaucaucaacaucaaaaugcuuuuacaauacuaaauuuaguaguucuacagauaauuauuuuuuaaaggauggaugcuuuaagaauaauucucuuuaaaacuguauuaaagauuuaaccacuuacuaaauacaguauauuccugaacaauuucuggaaggacuguaccuuggagcucaaacucuagaucagugauucucaacauaugggucaugacuccuuuggaggccaaagggcccuuucacaggggucacauaucagcagcuaucuugcauaucagauauuuacaauucauaacaguaguaaaauuacacaguuaugaaguagcagcgauguaauuuuauggucaggucaccaccacaaaaagggaacuguauuaaagagaggcagccguuaggaaagcugagaaccacugcucuagaucuacucaauaccucagaauccuuacuuuuaaaauacaaauacacaaaauguaucuauuucuguaaggaauagcuaucucaaaaacaaacuuacaaaggagcuuaaaauggcugauuuccacaaaccacucaacuucugugguuacuugaaugaaggagaaaggugcuaacaggagauguggucuuguuggaggagugucacugggggcaguucuaagguuucaccacacccacucagagguaaugccugcuugcccucccccacuacagucuccagugcagugcucagcucuaugauuaauucuaugugaauaauuagguacuucacuuaaaucuuuuaaaagaaaaauucauuacaauuugucuuaggguuucuauuccugcaccaaacaucaugaccauguagcaaguuggggagaaaggguuuauucagcuuacacuuccaacuuccacauugcuguucaucaccaaaggaagucaggacaguaacucacacaaggcagaacuuggaagcaggagcugaucaggaaccauggagggugcugcuuacugggugcugcuuacugggugcugcuuacuggcuugcuuccccuggcuugcucagccugcuuucuuauagaacccaggaccaccagcccuggggacagcaccauccacaacuggcuaaggcccuccccucuugaucacuaauugagaaaaugccuuacagcuggaucucauggaggcauuuccucaagggaggcuccuuucucugugauaacuccagcuugugucaaguugacacacaaaaccauccaguacacaguuucacuuaauuuaugaaaguaauacaaaguaaauaaauucuuuaaaaaauugcuuacgagacacguuauauuuacuuaaaauaauuucuaaacuuuaaacaaccaaguauuuguucucugguuugguuuagauuaauacuaaaaacauaguuuacauuuucacaguuuaaaaauuaagccuaaauguaaggucuuuguaucccaaauuccucgucuuaaaaacccuuuguucauaguuaacacugggacaaugcauaguguuguaguuucuuaagagguggaaacaaaaauauauuaucuuuuaaaaagaaagcaaaaggauuuaggaagaaaaugaaggaauguucugaaccagcacaucucuguauguucagguaccuggguaaaagaagacacaguacacaaacucauugccacuccuuuacugguuucaaggaacugguaugaaaaagcuaauaagacaauaauaaagaaaauaagacaauggaucgagacugauuugggagaaaaacucuaaaacaacaacaacaacaaaucauuaaaauuucacaaaaugccucuugagaacaaaagaaugucaucugucuuuuuugcuccagugauuauuauaaaauggguuuuuuuuaguuugugugugugugugugugugugugugugugugugugugugugccuuaggauguaaaggcccacauagguacacaacaaccaaauacaaaguauuuguaaucaucacuuuuuuucuaaagaaccaaauuuauaacaguaacaucaccuaucuuacacugccuaacucaugaauauuuaaagaccuggugagugagagugcauuuuguaguguuguuagcauuuaacuguuuguucuugcuucuuuaugcauguggcuauauagacagguagugucauuaaaacccuaacaaguuccaauagaauuacacacacuguaagcuuucauuaacuagaggaauucuguugcagaaaauguuacuggaagcuacauuuuagccauuccacacuucugccuccaggcuaacauuuucaccauugccacugguuggggagugggauuuggcccaacuguaaagauauuccccuccucuuacaacacaggacuaaauagaaugaugacucacaagccacgugcuggcucccucacucccaccaugacauuccagaagcuauuucacacuguguauauaagaagcacugaugauacucaaucucucuauucuuuucuucuucaauucucauuucauuagcuuccgucuacaaacugcuaccauaacuucucaaugucucucugacuuagggaagugcauauuucuuauuccgcaaggagauguccagcuacagauagcauuacaaauacaacuauuccauuuuacugggguuuuuuuguuguuguggguuuuuuuucaacauuuauuuauuuggugugcaccaucagguuagguuagguacaagugcuucaccuacagaaccaucucucuguuuccaaauguaaagagucuuaaaauuaauuccuaggcaaaagagauuguccacuaguagaggcucuugcugccaagccaaggcaucuguauuuuuuuccuaggguccacaugguagaaggaaaaaacccaauucuucaaaguuguccucugauguuuacacaccuccgcacuucacaagcccccccccccaaaaaaacaaguuuuguuaaaaacaaaacaaacaaaagccuaacuccuauauuguccuaaucacucaaggucacgaucuugaaauccucauucuucuaucuacaacccuaaucccaaacccuagcaguacauccuuccauccucuuaaaaaagcaaaaaccaccgacugcgcccagaacuacagcaggcaaaccaaggucugugugagauaagaaaauaaucacaaaacaugauauucuuuuucuuuaaaaccuuuuaauucaaagagagagugaguguguguguaugagugagugcuaacugaugauuauaacugcaacaaaccaugauaaaaauaaauaagguagcugggcagugguggcgcacgguuuuaaucccagcacuugggaggcagaggcagguggauuucugaguucgaggccagccugaucuacagagugaguuccaggacagccagggcuauacagagaaacccugucucuaaauaaauaaauaagggagagaaacccugucucgaaaaaccaaaaaaaaaaaauugcuaaaucaugugagaaaaauaaggucuccuggacuucaaguguccaaagcacuucuaugucaaagguccuuuuauggcagaacuugaauuaaauucaaaacacuugaccagaguccuuguaagccauacagaaacaacaugcaacugugaaagggaagguacagagaaaagcagcagucuuuuaaacuucuuccuucacuccauuccuaucaccaguagccaacagcaaaauuguacacuacuauauaauacccaccagcaaagcugcuguuaaaauaaauaaauaauuuuuaaaaaucauguaggaaauagggcauauuagcucauauuugcauuccccacucuuaggagacugagaugggaagacuauccugaauuggaccacacauaguaagcuccugacaccuggucucaacaaacaagaacagaaucaucuaugaagcccguuggaacacauagugguagucccaauccuuaagacuccaugcacuguguauagaguagcuacucugaugcaguuuuuaaaaaccauacuuacuaggcguggcagugcaagcccagcacguuaauguuugcucaagagguggagacagaagugcaaggccgcccugggcuacaauggaacucaguaucaaauaaauaaacaaauaaauaaaacaaagaacaaaacuaauuccuauuccuaauuccuguucacauucauucauuguuaaaaucaggagcacauucaauacagaucagaguugcugcuauacaccaaguccuguuccucuacccuuccuagaugcaguccuacuacauuccacucaguaaaugaucuuauuauuauucagaauuuggauucccuaauucccuauaaaguaaaauucuuuagcaaccaaaauuuugcugaaauauaaaaucugguacucaguagauacuggauaaauguuaguucacaguguacaauauaaacucacauuuuguuaucaaacagcccaaaacucauaaaggaggccagcagccacucuucccaccaacacuaugcacaaacacacuuuuccuuccuuucuuuuguaaaauacucuccugugcagcuaagcagcuccuuaaaaagaaagcucaaaucugacagucauuacaucuugcuugacuuccugaccacaagcacugcaaaccuggaaaccagcuacuacuaucugaaaagcacccauuuaacauuugauuaacugccaguaucagcugguuguggcggcucacaacaguaaacccagcacucaagaaaccgagggaggagaaucacugugccgucaagggcagccugaguugcguggugauuuccacuacucaucacgacaaugagcauccgccaagcagaguuguguggacagagggguauacugugggacacuagagcuuuuacuacaagacgcuuucuaggcuuugucuuauuguguuuguuugugggauuuuuuuguuuuguuuuugagggaaggcuacaaggguggagggcagauacaaggggaccugagaugagugaaacugggaaacaugauaugaaacucacacccuuaaauuuuuuaaaauuagaauuaaaauucaugaaggcagaagguauuagacauuuuuauuauaauuccaagaguggcuggccuacugggaaguaugaaguaaaccucgaccauccucaaguaacuagcgaaucaauuaaucccucuccaacccaaacuacugaaaucaucaaaaacuucagugguugguccucugggcuccacguuacugcacccaggcaagugguuuaaccuggaacuuaaguuucuuaucuacauaaugcaaacaacccugaacaaggugaagggaaggccaggagcugaagcacagcacuugccacaaguguugcacauggcucucacgaaaugguauuuccugaaaaaccugagucucucucucuuuuuuucaggaacaaggaaauagucuaaaaauuaagaucuuuaggaaaagaaaaucucaagaaagacaaaaaauuuucacuaguuaacugaaucaaauucauaaggcuaggauuauuuuugcaauauuacuguaaucaagaauuaaguuggauuaauuuuacuaacagaugauguaugcaguucuaugaaagggaacucucaaggaaccccacaggccuaaauucagaacuuaguccaagcaccuacuccaccaccuacuaacuaaaaaaaaagcugucacaaguuaaauaagauagaacaaguuaaaauccuggccaucagguucaccaguagccagacuuuucccucugaucuugaaaauaaaaauccuaaacuguguuuaacaauaaaccuuaaaggucacuagacacaaugcaucccaaagucaguacgaguacuucaacuugaagcuggcgagcaggaaagacacuagcaggagagucugaagaaccugacuucuccauagcagcagucugugauccaaacacacacaaguuaccaauaacaagaaccuuaaugaauuuuuguuauccagauaguaugaauguuccugccuuuuagauguuauaacacauuaugaagagaauccaagcaacaaaguugaacuucacaggcaggccuucauucacccauggcuucccacuacgcucaaacucauccugucuuuaacuucuaggacccggccacaggguagauuauaaagcucaacuuucaucaaagccaacaaaaguauuugugcuuuacaguuggaagaugcuuaaaaaaaauagaucugagaaauucuguaauuuauuuaacuauauccaagacuuguaaaauaagacuauauauuaaccuguuauuuaaucacuggaaauaagccaccaaagcaguuucugagugaaaaccagaauucauaaagagagaaaagaaaacuccauacugcauuguugcagaaacgaaggagacaggcagaaggaaacucccuucggauaacucuauuuacagaagcauuacauccuuuuaaagcuuuaaaacuugcuuuucucauggcugcuccucagccgguuggacuggggucugaagcagagccuugugcaugcugaugaggcaccuuccccucagcuacauucccaagccuacauuuuguuuugaagcaaacagcucucugagcaggaauuuuauucuacaauacagaccaaaaaguauguugaccugauacagauaugaaguguuccuuucuuaauucauuagguauuugaaaaaacuucaugaugugaaccuaggucaugaugaugaauuuaugcucuaaguuucuuaauuuaaaguucuggaauuaaaccucauguguccuaacauuuccaguuuguaagaucaccaucaaguuuaacacacuaccccuuuuugcaauucuuuaaugaguugggaugggcaaccuguaaauguucacuuacucuagaagcguaauuguaguaagaccuaagaguaagugcaauggugcuggggcgggggagggggccacaaacuaaagggacaccuuuugcguuugggaaacaaguuauuucagauguaaaacucccugccagucauucuuguacaugcuauuuaucuugggcacugagagaagacuuuccuaacaaagcucaaguaugacuuucuaaguuguuaucuugaauagccaaacaaacauggggguaaacacacacacgcgcgcgcgcgcuucagaagcaaaauaaagaaaaauugggaaauccagacugugagcaaagguaaaaauacugaacagagaaugugacuuuaaucauuuucauccauauauaaauaaaugacuguccagcuaagcucuccuuguaaggugagaucaauauaguaauguaaugauuuaguaauugagauaugacacagaaauagccuagguauaaguuguaccacuuuuccuggccacuccaaauguguucuuaauucaagguugcccuuuaagaaaaaaggucacuuagggacaauuaaguucaaguaccaaauacuauucauucaaaaauaaccaaaacugcauuccaaaagaggaaaauagauacauaaaaagaauaaaaagacaaauccuacuuaagcagccauggcauuauuuauaaggugaucagugacuaugugguucuacugacagugauuucuaaagcaugaaaguacaacauagcacuaucugucacuucaauacaauacacuugaaaaguccuauucacucuggcuaauucuaauuuuuaaaauggcucuaacauccaacaacugaucaauuaaacuacaaaaggauaaacuuaaacacauacacagaaacacuucagggaggugacacuggauuaaaagaaaaccuaacuuuaauaaaaugucaacuaagaaaauacauagaaauuccaagacuagacuaguguuuuccaagaaaaaaaaaguuuucuguuguuuccagcugccugacaaaauuacaaauaaaggcagaagaguuuuaacuaguguggagggaaagaaaaggcaucgcuuaaauaacugugguagggagaauaagaggaaaaagguuggcaacuauccucaaaaccacugauguauuugggggauucgagaucagacaggccucuuccuccaccaaggauuucaacguagaacauaaaaaaauguacagucuucucucuaggucacuacccagagcaaguuguaacucuugacaagguucauuaauacaaaaccacuacuuuaaagucauuuuagucaaccacacuacuaucagaaacaauuacuuuaaaucaaacacauuccuuuauacccccuuucaguuuucaagacacagucacaaaacgaacgugaacaaacguuuagguuccagggugcgucccuucucuccccucugucucccuccguggacacacaagaacauuuuuuuuucuaguucagacauauugauaccuaccacucauaauguacucuuuaugcaaccugcuuaauuuugaaaguucuaauaagacgugguaacguucgagacgaaaaacuaccuuauaaggcuauaaaagacggaaagcaggaagcggcuuugacaaaacuaaggaaguugcagcgcgcuugcucaccaagggacuuuuuugaggcaagagcuauaacccccgugagauccuccucgcuggaacugacuugguucaauggguagugggagauggcuacgaaugggugugggcggaaaccaggcggcgcguggguccgcugcaaaagccccccaugcuagcuucccauuuucacagccugguucgucgcucuccccacccacacgcccuaagagaucgagaguugucaccgcgaucuugcaaaaucugcaaggagcgcuucucucucucucucucucucucucucucucucucucucucucucucucucucucucucucucuuuuccuugcuccuaggucuggagguccucggugggugcccugcuucacaggcagcaaaggggagagaagggaaaggacagccaggugggccagacggccuccucggaaaggaagggccuggaaaagaucucugucccgggaggcucccggcaccaccccucgccagucuggccggcuccccccauucaucucccuccuccgcccguccccggccucagucucccccaccccgaagacccgccguaccccgugccacaguccaccacacaggccggcagccgucccgccaucuuccuccucgcccgccgcugccguccguuccgugcugcugagaggccggggagcuagagaugggagcuggcugaccaugcaccggcccgggccgcccucggucgggagggagggaggaagggagggagcugugggaagcccgagcaggagcgagugagcagucggcuaguacuuccgcaagcccagcaggcuggccggccggcaggcuggcuguccccgcccuacccugccgcggccuccuccucuaccccuccgcucuccgcccuccuccuccuccuccucgcucccgcccccacccuacaacuucuucccccucgcacugccuuuccgcggggagccaagauggccgccgcugccgacgccccggccaggccaggccccaggccgcgaucgcucccacuuccgguuccg

SEQ ID NO: 344 - RNA, 1031 nt, Mus musculus
cacaggcgaaccggccgccuaacggauuggggacccgauugauugcauuuacauccgagcucuagagagucuagauuuuaucaauagguugguaucagucucuaaauuucaucugaguacucuaacaugccaauuccuucauuuaaaggaauccacccuguuuucuuuugagaguaaccgguuuccuuucuugguuuccgcucugccagggaacauagaagucaggauaugauuuaaaugucucugugggguuccagagaugagaagggagucacauuuuguugggaucagaucugagugaucucggcuccaguucggucuuccguuguguuuuuuuuaaacaauaauuucaacuguaaacugaaagcaucgaacuaggucauuucaacacuccuuuuuuuuuuuuccuaugaagaaaaugaaauuuucaacagccccuucuuuucuuuaaagaaaauuaaacgccauguucacugggcuuaagacacacacacacacacacacacacacacacacagagagagagagagagagagagagagagagagagagagagagagaguuuuuaccacugauccugacgcuguucuugguacaaaugcuucacauguacagagcccuccguccucucgcauccuggauuguggggguuguuuuuuguuuuguuuuuguuuuccuuuuucuuuuuucuuuuuuguuccagaugauuccauuggcugcccucucaacgguagucaaagaaucaccccaagaacaaaaauauccaggccuugagcacuguggaggucgaugucacaggcugcaacagaguuggcugaaacguuaacgcaguggcuuuuagacuucaucccccuccuaauauucugcuuuuuugaaaauuauauuuucuuuuucacuguggucuuggggacaggagcagaagagcuagcaccggcuuuagcacagagcugcguccccaccucuaaucuguuuguuugugcauuuauuuguuugguauuuuaacaagcauuuuccuuugcugugugauucaa

SEQ ID NO: 345 - RNA, 75106 nt, Mus musculus
cgacagccuucgcgcggggccugacgcuccgcuccgcaagauggcggcggacagugaggugaguucugcgcccugggugccucugucacagaguucugccgccgacgucaguggcccgcagcuuacugucugugcucuucucuguccccgcagcccgaguccgaaguguuugagaucacagacuucaccacagccucggagugggagaggugaguaguguguuugguccugucuggccccgggcggcaucacacaggugacgcugguucggagggagacgcccacgcuucgucucuucuuccgcgccacggcaacuuuggcuuuuuccgcaucaaucauacagacaggucagaccaaccuucagacuccgccuuuaaaacaaguuguguugacuuccagaucacuucccuggcacagaaaaccauuuccgaggucguccccgggucuuaugcuuucaugucaauuugccucaguugucaucaaagccgucagcuaagcagcugcuguguuuucuuccuguguuuauuggaagagacuuuuagcguaccgaugacuguucaucugucauccucuuaccaucguuauccugucuucgagaaauuaaaaaauuaaaauucuacuauuucauacuuauaaauaguauguuuacauacgucuuuggaauguuuugauucacagcguuacauuuuaaacuugguccugugcccagacuucccgagcuugucaaauucagaugaacaacugcauuaaggcgaacauguuuuaucaccugagugaguugaaaacuaaguuuguuggcuugauagcuagcuauugagguuauuguugcagugcuuguaggcuuuacaaauguguggcucucauaucaguugguggcauaggaagauauaaaagaucuuugaaauaguaguuugacuuguguucccauccccacacuucaucgagucaguaagacuuaacacacuagcaagacuuuaugaggaaguacugugugcccugaacuauccuaagaucagggaaaucuauauaccuuuuaaaaacuccaacaaauaguuaaaauguaagccaguugguacuaacuacaaagaacuaguuaaguagggaaaacguggacuacaaaauuguuggagacauuuuuguagggaaaagauaggaaaugccugcuuugaaauuggggagggaaauggaagcugggugacguggcaccuguguauaauagugacuacuggcaaggcugaggcggaucacuugagcuaaggaauuaagaccagccugagcaaucuaagagguacugccuuaagaaaggaaagggaaaaugguucaggguuugguuaaacaugagaagggacugacauuucgagacaaguaagugaggaauuaucacugggaaauaaauaaaaaugauacagugagaucaguuuccaaagccaaggcagaggcgucgagaguuggugcacuugacuaaaaacucuccaacuugacugugcaucagaaccugcuggucucgguucucaguguuucccauuagguuuuagguccaauccccaaauuugcuuuucuaacauggucccagguaauacagaugccagcaggucagaagaccauauuuagaaagcacugcugcuuaaaguggcaagagcuuuugauccuauggugcaaggauuguuugguuuaaguuguuacauugugguaaaaugaaguaagcaguuuacauugauucauaaaguggaacuguaauuaguuggauagagugaacuagauuuagguagaugagcuuaauguaagucugaggggaaaggcucaauuaugaaacuucagguucaugccuaaacgaaaagauauguaucaagagugcucuuuugggcacauugacuguaaaguugauauuuugaagguaguuagaaaaugauggucuuggagggugagugguaagaagacauuaaugauuaguguuuagaauggaaaaauggccauuuucccugguuaaauaguuuaaaauuuccugaggggugcuggggcgaugcuuagcgguuaagaguucuguacauucuuccagaagacccagauucaauucucagcacccacauggcagcucacaacugucuaaaacuccaguucuagguuauuuaacacccucauauagacauacaugcaagagaaacaccagugcacauuaaauaaaucaauagauaaauaaacccuuucccgggcuggugagauggcucagcggguaagagcacccaacugcucuucugaagguccugaguucaagucccagcaaccacaugguggcucacaaccauccguaaugagaucugacucccucuucuggugugucugaagacagcugcaguguacuuacauauaauaaauaaauaaaucuuaaaaaaauaaaaauaagcccuuucccugcugugggcucagguacauuuaagauuuggcuucauccauaauucacugccauggcugaggaagcauugaugcuaaaaguguaguggaugccagcacugcuucacaagagaugccgaagacuaccuuaggccaugauggccuaacauauggcauacacuaagcugccaaagccuuagcaagcaccaagcacaccguugugugcuuauauccaauugugauaagccuauguaugucagguuggugaaggaagguacuuugugcuggcaucaaauuaaccugauuaagguugaugacaauaacuaggaauggguaggccugucuagaauucucaucauaaagugauggguuucaucagaguaucaaaugcaagaaauaaaugcgaauuuaaaguuucuuaagccuuauuuuuuuuauuauuuggaugaaaaguucuucucagaauugaaugacaauagggacauuaaugauccuaggcaugguugagaaggugguuuauuguaaauaugagggagcaagcagggagugucaacuggaagaggucagacuaaacugggccagcagacugaacuggccaugagagguaggaacagagggaaagagcagagagagcacauagccagaugacugggcuguguaggaaaaggaggcuaggggaauggacgcaaaguucagaguggggcuggagaggguuaggguaguggguagggaaugccagccaggaugguucuauaacugguacuugugguagagacugagggaaucuugagguuagcagagacuuugauauguuaauagacacuaccagcacagguuaauggaagagcaauauguuccuguugccagagauaaggagaacauaagcaauauguuccuuguagcaaguaggaacaauuuuaagucccucgaaaauguuggcuuuugucuaaaugucagacuggcaaaaggacuuucuugaaaccuaacaaguauguuauguaccauacagauaauuuauugagacuacuaaguagagacuuaauuuugaaugagcauguguaagacacaguguaaaacauuagggauuuaguagcuaguaaaaacagaugaggcuuaguaugcucauugaccuguguucaaucccuaguccuauaggaaaaaggaaaaauaaggcagacucucucucucucuugcucucucucucugauuuuuuuuuuuuuuugaggcagaguuucucuguguagcccuggcuguccuguaaaucaggcugagcucaaacucagcuccaccugccucugccuucugugagugcugggauuaaagguauguaccacuacacauauacccuccccauccccuagcuaaggguccugcucuuauugaaaguauagucuagcagaagaaauagacaugagucagauaauguaacuagucuguaauuacaaguugacaugaaagcuacaaaggugaaauggaaagaacccuguuuuuccaaaagcauguacaaaagaacugaguauaguaagugacucagcagcuaagcuauggagaacuguuaaagaaaaaguuacuacacuuuucuagccaaaucucaauauuuguaucauauaauugucuccuagccagugcuaaaauucauaaguauuuuaaaauguuucuuuggggcuggagagauggcucaguuuguaagaacacuggcugcuuucccagagguccugaguucaauuccuagcacccacauaguguucacaaccaucuguaacaggaucugauaccuucuucuaucaugcagguauacagucuaauagagcacuaacauacaaacauaaguaaauguuuuuguuuuuuacucugaaaauuauuuuuaagauuauuuuuauuauagcaauaauaccuuguuaaaaauuacauuuaaaccuucuacaaagauagcuauuaaauuuugacauauuuucuuuuaauuguguguguguaacuuuuuuuagaucaaacuauaucaaugcuuguuucugcagcuuucuuuuuucacuuaacacacggaacuuuuucuuauuuccucaacuguucuucagaaccauuuucaguggguauacauuggacggucuacugaauggacauuuuaaggaguuaaugagaagguucaguuaaauuauaagcugauuuauuauuugaugucauuacuguuuuaaaagaaaugcauaacucauaaugccaaugaagaaaaaaaucugaugccuuugauuacaaguugauuuuaguuacucuagaagcacuuucuagauguuuuaguuacucuagaagcacuuucuagauguuuuagguagcaauugcagcugcuagauuggaucacauuuuucuaauauaagcagauugacaguuuucauuugcugauguucagcaaguugcuagucaaguuuuaaagauucuuuuuaucuguguaaagugcuuuugcuugaaugccugugugcaucacaugcgucucauaccaucaggccagaaggcacuggaucucuagaacuagaguuacaguuggguaugagccacucugcuggugcugggcagggaaagugaucaguuguauaacuauccuuaauuaggauuaaguuaaucucucaguuuuugcuucucuucuaaauuuauucuaucauauuaaaggaggaauuguucuuaguuuauguuuuguagaaagagugcuuuuauuggguggauagauuuaaaugaaucaaaauuuaagaauucuugaacuagacaacauuguuucuacuuuuauucuauaucccuaaguuaggcucacauauuaaacuucuugagcauuuucuaauugaaacguuaggguguaaggaaaugucuuuuaaagaaauugaauaguacuaggaaaaauguuugguuauauauuuagaaaguuuucccuccuucuuagguuuauuuccaaaguugaagaagucuugaaugacuggaaacugauuggacccucucugggaaagccacuggaaaaggucagaucuguucacuuguaucucuagauugcuauuuacuuugaaaucuuuguuuuuaugccccuugcuacaaauaaugcauuugcauuaaaauguugaaauuuuaaguuguauaaagucuuaugaacaucaaauagcaucuggaagaacuuggguuugaauuuguagcaaaugauauauguaagauauuugcaaaacuuauuuauugauugauuuggauuuugagacagguucccacuguguagcuuuggcuguccuauagaucacuguggugacuaggcuguccuugaacucacagauauccaucuguuuucuaccuccccagugcugggauuaaaggcaugcuucaccaggacuugcugugaaacuuuuuuaaauuauaaaguuguauauaugacaacuuucuuuauaugauuucaucaauuucuucagaguuuacuuuucucaaaaucuaaguuuuccucuagccaggaaaacuuaauuuuuuaauugcacagaaagaaauuggacuuaccaauaguucauuuaguaaggaaacuucuuggucuaauaacuuauuauguaaugucagcuacaguuacuuuacuaaguuuguauugauaaugugcuaauaaacuacacuuuagacauuuccuaaagagaauacuuugagacuauacuucucaguuuacugaagggcuauacuuugaucugaagcuuauguagauaugguuaguuaauuaaaaaguacacacacacacacacacacacacacacacuuguagguauucauugguucucuccuuccaugacucuuucuggggagucaaaguaggucaccagucagugguaucaguugauaccaggcuggcuuugaacuuacagagauccaccugccucugucuccuaagugcuuggauuuaaggcaugcaucacuaccaccaccuguuauuagacgcguucucacgaccggccaggaaagacgcaacaaaccagaaucuucugcggcaaagcuuuauugcuuacaucuucaggagccagagugcaagaagcaagagagagagaaaacgaaaccccgucccuauuaaggagaauuuuccuucgccuaggacgugucacucccugacuggcugcagcccaucggccgaguugacgucacggggaaggcagagcacauggagugaagaaccacccucggcacaugcgcagauuauuuguuuaccacuuagaacacagcugucagcgccaucuuguaacggcgaaugugggcgcggcucccaacaucucccccuauccuuuuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccgugcaacucucucgggcugcugaaacacacucacucuaucccgugcaaugagacuagccucgugggauauaagagcugaguggccagcgaccuauugccuaagcauagauaaccauauaucagggggagcuccauguucuaguccugcaagcgccugggcaauaaccaccuugucucuccuaguuuaggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagggacagguccaagcgcguggaguugaccugaagucucaauucccgaaggaucuguucaaauucagccauccaauucuguaacauauacugaaaaagacuuuuugacaaauuagcugcccuaguaaauuuaacauacugaauggaaauaacacacaauuccggaaacuuuuguucacaucccagcugaguuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucagucgucuggaccuguccagacagagccaaggcugucugaaucaaggccaaacccaguucccaguuagugguaaaaaagcaggagaauacuugagcauuauacaucaccgucauugggaguggaaaugucgacauuaucccccaacgcugcucucuuuuuauuauugacgcccuggacaucaccaagacgagggacauuaguauucccuuggucagucuggauuuuucgggugagucuuucugguaaccaaaauggguugucuucauucugugggaaaacacagauagcuccccuggaucuuaucaaaauaggauccgggccauaccauuuauuaucaaggacauuuuuccauuuaaccaucucauugggccuaucuggcucugaacaaugacguucagccgcaguauggccaugaacaucaauauuuaaaaaauugaguguaaagagugccauagacaccgacacucuuggugcucgggguacagucuccucaaaaguuccccucuucuguuuuauaagauaggcuuugagggugcgaugcgcacgcucaacaauacccuguccuugaggguuguauggaaguccagucagguggguuacguccaucugacggcagaacuguuggaauuuuugagacguauaagcugguccauuaucagucuuaaggagucuggguuucccccaagcacuccaugccucaagacaauguugaaucacaugugaggcuuuuucuccgguuaacggagaggcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuuuuugcagccucuaccggggaugauagggcagcagccaccacuuuaguggccuuaucugccaaaucauuucccagagccauggggccagguaggccugaaugggcucuaacaugaguaauauaaacaggaaaucuucuagauaacaaaacuaauuguaucugcugaaaaauauuggcaacucuacuggaaggcuuaaucacuccagccacuucuaaaagauuuacugcauuaaccacauaacaggaaucugacacaauauuaagggguucuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggaugcuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuagaccuuuaagggcaagcugugcaauugcaucaggauaccaaucuauuauuuuagcuggggauacguuuggauggauccacaacaauggcccauucugccacaaaacugcaguuggcaauugugcugucuuaaagacacacaaacugaaagguugcgaauccucaauacguuguaauugugcauucuguaaggccuuuuccacuuuuuguaaggccugguuagcagcuagaguaagaguccuaggggaggagauaugaggaucuccuucuaaaauacuaaacaaaggccuuaacucagcggaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaaaaggauaugccuuuuguagcaugguaaggucuuuauggcacaggaggaugucauccauguaaaggagcaaaauuaaagaggggaauuguucccucacuggcaaaagagcuucuugcacauaaaguugacacauaguaggacuauuggacauucccugugguaagaccuuccauugauaccucuuaucagguuccaugugauuaauagaggggaugguaaaggcaaaucugggccuaucucuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuccaaggugagguagaggguucaauauggccuaauuuuaauuguuccucuaccaguugaaucacagcuucuaguuuuucagaggauaggugccauugaggaacccacacuggguccccuguuuuccaugguaugggucgugcugccccaauggccgcuaaggaaaacccagacccugucugucuugguuuccauuaggugagaugggcucuauccuucccuguucuugauguccuaacccuuuuccuucuuuauaacccaucuuugccaugauauuuuuugcuuuagcugaauacccuccugauggggcguuuucauuggacaaaauaaggcccaaaugcugcauaauaucccuuccccagagguuaaccgggagugggagcacauaagguaugaauuucccuugcuguccuucagaggauucccacgucaaggcaauggagcuuauagugggacaugauugauauccuaggcccuguaaugaaugagaugacucuguggugggccaugcuuugggccaccaauguguagagauuauacuuuuaucugcuccgguaucaaggaugccuucaaacucuuuuccauuaaucuuaaggcggagcuuaggucuaucauuuaaagauacaaccaaauaggcagaaucauuuccugaggagcccauuuucuuuaucucagguccugcagauuucucccugguauuaucagggaggagcagcagcugagcuauccuaucuccuuuacuaauagaaaaaacgccuuuagggcuugagcacaggaccuguauuucaggggaauguugacaauccauaacuccaggguggacuacuaagcccugcaaggugagugaaccccggccgagaauaaggcccaugguucccgggggcaaggaugguauaggcuccacuggcaccggcugaauacucauuugaggcauuaauaggaagucggaggcggcacgcagguccacccuugugggucuuccugggucgccucucugacugcuuccuggguccugacaaaccgguucccauaucuuugagggcccugggaccgagggcccgaugacccguuuuuuggcacaucaguugauugacuaucaggugggggaaggacucugcccuuuauaucccucacagagcgacacuggucagcucuaugauaacccuugccacacuuagagcaaagagugagagucccucccuguuuaucuggagcucugcaaucuuucuuaaaaugcccaggcuuuccgcaguuaaaacauguccucugauuauuucugcccauggagcgguucugagauugaaggauggcggccgcuaagccugcauuggugagaggucccccaagcucucgacagacccugagccagucuuguaagccuuuguucuuucuuggggcuauggccgcucggcacuccuuuguggcuugcucauagauuagcuguucuaucagaggcgcagcuugcucugacucuccaaaaauacgcucugcugccucugucauucuggccacaaaaucugagaaggauuccugaggucccuggauuaucuuuguuaacugaccagugguuucaccugcucgagagagcgccuuccaggcccuaauagccguggaagaaaucugggcauaagcuccccaaugguaguuugucugaucagcagaauaagcucccugacccguuaacaagucaaaaguccaaucucucugcucuggagucaaagcagcugcguuugcucgggccugcgcuugugcaguuucaugccaaagagcucuccauuccauauauuugcccauacuagggagagcggcuuuuacaaccguuugccagucagcaggaguuagugccaugccggcgagccugucuaacugcaccaagguaaaauuagcauugguuccguauuuacggaccgacucggcaauuucuuuaauuuguaaguauucuaccggagcguggacacgcccacccucggcuccuucaaagaccggaaaugccuguuguauuuuccuuuguuccucucugggaaugaaugagucugcgcacugccucucugcgcacugccucucugcgcaucucucugcgcauugcugacgcacuacgcagggcggggacuccgcauagggcggaccuugaagccgacugcccugaggccaaucagcaaacuggccuucgccagccgcuuuuggcuuccuuaacugauuagcuagcacuuuaccuggcugguacccuuuuuucucauaaugagcugcuucuuccucccagucuguuucuucagaggagaauucuucaucugcuucagagcuacuaagagcuggcuccccgagcccauccagcgaugagcacaggcuccuuuuccuagagaccuccgcuaauugaucuuucuucuuuucccuuuuuccucuuuuucuucuaaucucucuccagguauuccuaccuaaccuuaacuuuuccucggguucaagacccuuggaaaggccuguauacuuauuuuguguaccauauuuccucuuuguuccuacucucucuccccgcuuuacuucugauagcuuguccugaauuucaucuagaauccgcccugccuuaaccacuugauaacaugugaaaaggaacaaaagggcuucuaacacuagaaaaaauccaaggccaaacauuuuccacuuuacuucugauagacugucuugaauuuccuuagaaaguucaagaucagacuuaccucguaaagcuguacucacugguacucucguuccccagcugaaaaguucugaauucauacaguugaauccuucuuaacagucugcuuuacgggaaccuuuauuaccgcgacccgcaguucugguucuggaaugagggaucuuccuugcgccagucccgaguuuuuuuuuuucgucccggaauucggcaccaauuguuauuagacgcguucucacgaccggccaggaaagacgcaacaaaccagaaucuucugcggcaaagcuuuauugcuuacaucuucaggagccagagugcaagaagcaagagagagagaaaacgaaaccccgucccuauuaaggagaauuuuccuucgccuaggacgugucacucccugacuggcugcagcccaucggccgaguugacgucacggggaaggcagagcacauggagugaagaaccacccucggcacaugcgcagauuauuuguuuaccacuuagaacacagcugucagcgccaucuuguaacggcgaaugugggcgcggcucccaacaaccaccuggcuccuaaauucuuuuaaaguaaaauugaucauuguuuuuauuauuauacugaaaagaccuuucaaucucaguauuugcuaagagguuucagcuucauggaagugauaacagaauuuagauaguaagaucuuuuucccauuaugaguacuauauauaggaauugcaguauuuaaagauauguugaaacauacagaauaaguugguguccuauauuaaaauauuuucauuuaaacuuuugaauaaagaaaaaaaaugugaaguucucaaacccagauauuucuguugcacuugaaacaccuauauagcaacguguauauggauuccaacaagauggauugaaggcacaaugugcuggcuguaucugaaagcccaaaacugcaguuuuaaauacaagagcuaucccagguucuucugagaucugauguuacacucuugaauccuuuguuuuauaucuguuacuaaguacuuggugugaguuagaugguagugguagaguaaugaacuaaguaagauucaugcugccaucaagguugaggugacagagaaguaaugaggaaaagagguuaagauacuagauuaggauuuaaguggggauacaguugaugcuuccuuuuaaguuaaauuauggaaucagugauuucuuagaguauaaccagauccuaggaccaaaaagucaagaaucacugggccagacaaaaagauaugaauuugcaaaucuuaucagauagauuucaugucagaggugaaccccucuucaguuugugguuacauuuaacugcucuacagaccuuuaagauguccuuugcaggacugcagagaugguuuagucagugguuaaguucaggacagccaggacuauacagagaaacccugucucaaaaaaccaaaaaaaaaaaaagaacacucgggcgugguagcccacgucuuuaaucccagcacucgggaggcagaggcagguggauuucugaguuugaggccagccuggucuacagagugaguuccaggacaaccagggcuauacagagaaacccugucucgaaaaacaaaaacaaaaaacaaacaaacaaaaaacccaaaaccaaaaacaaaaccaaccccugcuuuuccagagggccugagucugguuccuagcacccacauugagcagcucauaaccaucuguaacuucagcuccagggaauccagcauuccccaccuuucuacuuguccucugugggcaacacacacagagaaacacagugaaguauaacaacuucuccggcuagauuuguuuuauccgagggaggguuuuugugacugagcuacuugaccauuguagagcugggaaauuacuuaagaggggcugucaguuaugagcauauauugugguaccauacgcuauuauugggacuaugccuguugacuuaaucccuaaauaaacuucagugaugagguuguaucuacucaaugaguguggaaugaggucuggaguucauggaguaauuugcuccauuauuuugccagcaguugaugaacguaggguuaaagcuaggucucaccuuucaaaugcauauuguacuugguggcuugugcuaugaugaaauuuaaguaaauguaguauuacuuagaagaauuaaaguagauuuguaagggaacuuuuugaauuguaguguuuugggcuuugugugacagaugaaccuauaaucuuacuugaaguuaagugacaauuaagggaaaugaccuuugaaauucuuuuaacuuuggaauuuuagauucuguguagcuaguaaaaguuacaagugcuguuucugaaauguuaaauuuagacaugucaugauguuguaauagaccgacugucaccccucugaaagagucacaaaggaagaaucacuaacguuagaauauuaauagaggacuaaugauuccugcagugcugaugugagcuuggagguuucaugcucagaagauuggaaggauauugaccuccauucuuagaaguucaggcagcagaggccuaacaguuacagaaguggaugcucacagccauccuguggagaauggaggagcuagagaaagaacccaaggagcugaagggguuugcagccccauaggaggaacaacaauaccaguacccccagaacucccagggacuaaacuacuaaccacauagagguacucagugcuccagccacauauguagcagaggauggccuugugggacaucagugagaggagaggccuuuggucuuaugaaggcucuaugccucaguguaggggaaugccaaggcuaggaagcgggagugaguggguuagugagcagggggauggaggaucggauaguggggguuugagaggggaaaagggauaaaauuagaaauguaaauaaagaaaaugucuaauaaaaauaauaaaaaaagaacuucagacagcaaauguaaaaugaauuuagcuguaguuuuucucuagcuuucccauaaguuaauuuggaacagauacaaacuaaauaguugggguuccuuuauuugcaucauucacucaaacauagggugcuuuaugaaucauugcaguaguggaauagaggguuuuuuuuuaacuuuuaaguuuuuaagagauuagauaagauucaaacacugaaaauucaaugucucuaaaauuuagugaaaaaagcuaagcugcucacacaacuuuuuagggaaaugggaccauuuaaaauaagaucuuuuuuugcugggcagugguggcgcacaccuuuaaucccagcacuggggaggcagaggcaggcggauuuuugaguuugaggucagcuuggucuacagagugaguuccaggacagccagggcuacacagagaaacccugccuugaaaaaacaaacaaacaaaaaaagaucuuauuuuguuuuuuucauuuucauuuuuugucuaaugagucaccauaguguugugucuuuggguaucacauaggaaaauaauugguauuuuauuauguuuccuacuuucaaaugugaagguuggaggagauuuuuguuuuauuugauagugguucaccuucuuacuuuuguuguguaaauggcaagaaagcucuuuuuaguuaacagugauaccugugggcuguagagucauacugcuuauguuagaguucuggucuuguugcuccucugugugugacacugcgcuuucagucagcauuagcuguucuuacugccacucuauuagauacguucagaagcuagagaaugacaaugaguaagagggacauagaguauaagcauguaggacaacuuuaugcgauuuuggugaugggaacgauucacuuuuccuuggaguacuggcuguuaaacaccuaauaccuaaguggggcuguuaugaguccauggcugaaaagcucaaguuuguuuaggguaaaugagaggucucuggacauuuuuagagguuucucaguauuauguauuuuuaaacuagaugagugauaaguaaauuuuucagcaugaaaguuguaaagucgucaauauaaaucuugaaacuuaaucuugucugagacauguugauaacuauagaaccauacaaauauuuuuuucauuuuuugaaauuuuaaucacaacauuucuccccuuuucuuccuccaaaccuuuccauauaacugcccuucuugaauucauggucugucugucugucugucugucucucugucucugucucucuuucucucuuuuaaaggaauggaucugauuuuuuuuuuaagauuuauuuauuugguuauuuuauaugagucacuguagcuggcuucagacacaccagaagagggcaucggaucccauuacagaugguugugagucaccaugugguugcugggaauugaacucaggaucucuggaagagcagucagugcucuuaaccacugagccaucucuccagcccuauggucucuuuuuuucccauugauuuuacaugcauauauuuauuuuuauguuuauguuuauauauacacauauauguauauauagauauacauacacacguauauauauauauauauacauacacacauauacauauauaugcaugcaugucuguauacauauacacauauuuguacacacauguauguuuauaauauagaauauauauuacauacauauauacauacuuauuucuacauauaacguguuauagugcuaccuguaugcauguuuucagggcugacugauugccaccgaacaaccaguuuguguguucuucucugggaaaggccaucucuuccacuuccugcuuuccucaggugccuauaguucuuuguguaggauugaagccuuggcuucuuuacuuuguccaguuuggcauguugauuggagucauccuguucaguuuacuuugggcaguuaugcuggugagaguuuugggguguagcuucuaauauuauuaggaaacacaaucuuaaagcaaacuccguauccucuggcucuuuacaaucuuccuuccuucucuucugcagucuuccugaaucauaggaguuacaggaguguuuuguagauguagcccauugggacugggcuccacaacuuugcguuuugacuggcuguggguuugguuuuuuuuauaauguucuccaucauuguaaagagauguuuccuugaugaggggugaagacuacacuuaacuaugaguauaaagacaaauguuuauagauuguuguuaggaauuaugcugguuuaguaaauuaguggcuauagguucuccuccaguaccaugacuucacuaacacugaauacuuagcuacauuucaguaccagucauaguuucccucuugucgauggggucuuaagucuauuagagagcaguuauuaccaccaagauaugugugcuacuacugcaccuguacuuagagugcuauguuggucauuguucugguccacaggaaucguggcuggguaggacuguugcuauccucccaucuucggaagcuuguaugacaccuuggaccaugaaagcugguacucagggaggggccauucagaucauuugcagcucaagggaaugggguaucugcagaaauaggaauucaccuucucccucuggaggguaaccaagggcaacagcaguaggcucuaugucuuggaagucucuuggauagcccugccaacagcucaaaagagggcuucacaagucuggugguauugggguuuuuguuagguguucuuuggcuauuggagggaacaucaucagcccacgugagaaagauucauugaaaguauauguuugucuauacauuucuauuguauuacguaauauauacauuauaugguauaaaauuauauuaaggccgggcgugguggugcaugccuuuaaucccagcacucgggagguagaggcaggcagauuucugaguucgaggccagccaggucuacagagugaguuccaggacagccagggcuacacagagaaaccaaaacaaaacaaacaaaaauuauauuaaauguauguuuuaaaaguauauuguauauuauaaauuauauuacagauguguguguguacaguuuauaguauguuuauggucaguuaagauaucuuuauuguuauuuuccucaccuccccacuucuuuauuugccuccuucccccuucccuaggugcucccuuguacccauuaccugauuagaccauuuguauuccacauagcucuuuaucuuucuuuugaaagaucauucuuaauuguuaagaaauaucuuagccuaaacuauuuauucacuuauuuuagacaauauuuaauguaaugaaauuacucuacaaguuauuaaaagcaacauaugucuuauauuuuaaacuucauaaacaugcaauuuauauguggguuugauuauagaaaugaauauucucuaaauaaggaaaaguugauguacagcuuuuauugaaugauaacuuacguuuuccuucuugauauagaucacauuuuguaauaauaaaugcaacagaagaauuuuuuguaaaaauaauuuaaaaucauaauuacuucguggagauuuuggcaauuucauuuuuauuguuauguuuuauuuuuguuuugugauuugagaugucugacucuguaguucaggcuauuuuagagcuauauauccuaggcuagucuugaacauguuguaacuuuuguuauuguuguuuguuauuuuuuuuggucuggcagcagaagaugugacuuuuuaaaaaaaugauugcuuuauguaugugugagugccugcauguauguaugugcaccguguacaugccuugggccuuguggcccaaugagguuguguccucugaaacugaaguuagagacaguuuugugagucacuauuauaggugcugggaauugaacacaggcuuugugccagggcagcaagucuucuuaccagcugagccaucucuggcugugauguacaagaugugaaccaguaacacauucauugccugguauauucucaguaaauugucuucccaguguaaacagguuauauuuagucaacucauuuuuuuaaacaaacaugggacuuacuguuuacuuaugauuucaaacauggcauaaaauuauuuggaagucaggauuuuuguaagucacuugauauuuaauacucugggauuuuuuuuuuaaaaaccacauuuacuuauuugucuguguuuauguguguguguuugugugugugugcacagacacgcaugcgugcauguauacaugcugauguguguggagguuagaggacaacuuggaggagucaguucccucuuucuaugugguuuccaggagucaaacuuaggucuucaggcaucuugcugacuccaaauagccacugugauaagucauuuauucuccugaaauuauuuuuuugccuuuaucauguagaggauaacugucgaaugcagugcuaugauuaauguuagaaaagagacaaaaaucauugcauaguaaacacuaugaugacuguugaguaagcuggcuguuguuucuuucucuuguuaaaugcaggguauauuuacuucuggcacaugggaagagcgaucagaugaaauuuccuuugcugacuucagguuuucagucacacaucacuaucuuguacaagagucuccugauaaagaaagaaaggaugaagaauuggaggguaugggguuuuuguuuuuguuuugugguuuguuuuuuuuuuggagggggaucauauuuguacaaucuuuaaagagucuaauuuuuaguuauuaguuuaguucucauaacucaauaauacccauaggaagcauuuuuuuuuguaaccacauuugaaauagcuuaugugcuaguacugcaucugaagaagaggagaagccacagugacgagcacuuuagacuugauugaaccagcagauauugacugaguggcucauuuggugauuggugguaggucauguagucuacucugagaugcccuauguguaacagugagcaggggguuucagccgcuagucaaacaguagucauuaguccuccuguugucuuaggggauucaucccaggaugccugagaucauacauaguaccaaacugacuauauaguauauucuauaaauacacaaaucucugagaaagcauaauuuauaaauuaucacuauaagagauugccaacacuaauucacaaaauagaacaguuaaagugaucuacuaugaaugaaaguuaauaaaaaauaagcuguuuuugaaaauuuccauuaaauaucauuggaccauauuugguaagaaacuccagaaagcaaagccauagauaagguggaggaacuguacccaucauaaucuuucuaaaaauaaguagauacaauauauuccauucuuuuggccaaagcaggcuaucauuuauaagcaugggccuaaagugcuuuuccuagguagggaugaugcgguaccuuuucuguuauauauguucuuacagacaaaacugcaugacuucugcauuuagaaugagaaaggagagcgagaacagugaccaaauaaacauauauauguaagauaauuauguaggaacacagaacuaacagaagugaguauauuuuuugaaagaaagaacaggcaggaaauguuugcauuucgugggaugauaaucaaggauauuagaguccauauuauacuaauaaaugaaggaaacgucaaaguaaacaguuuguugauuuauauuagaguuaggcugcuagagcugagaauguuucagauccguguaagagaagaugaagacagugaagacacuguuguuuguacagguuguacuguauaguuuccuuucuacuugguuaugaucaacauuguaacuaaugaaguuagaggaaaaauuuuaguuagcucagagauacacauuuaaagcuauauuaccaacaguugaaagaucaagagcugacuuucauuguuuuggaguucuguauuauuuuugguuaaucaggguuuaaaaauauugaugcuuuuccauuuauuuuaaaauauuaguaaaauauauaauaaaauugcuaagaaaugauaacaaggauauauuuuauaaagcaaauauuuuuauguuuuaaauuuguuauauauuuaucgaugcauacaaugauaauuugugucaguuccugauuauggaucaggauguaagggcuaaacauacauggguuagaaaugagaaauugaguggagaaagguuuucuaaaauuuuaaaaauaucuagggaaauggaaaaagcuaguuauaggaggugacaaggaauauuugucaggauucuaaacugacaauugcuaaucugcagucuaguaagacaugcuuuccucaaggcauguauaaaaucauuuaaaaauuuaaaguuuaaauggacauguuuucuacucuuaaauguuucuguagacgcuauuccacagucaaugcaagauuugcuauguaugaauaacgacuuuccuccaagagcacauugccugguaagaugguacguauccuuuuuauucagaucuuguguuugugugugugugugugugugugugugugugugugugugugugugugagagagagagagagagagagagagagagagagaauguauuuuguuguugcuuguuuguuuugagacaggaauucucugcauagcucugauuguccgugaacucuguauagaccauccugaccucaacucaaacucacagaucugccugccucugcccuucugguggugggauuaaaggugugugugcuuuaagugagcccaagacuaacucuagguucagugauugacuaggggacugacaggaccagcgacugccugcuacuaaagcuguuuauuauagcagcaggcauaaagcacagucagcagaagacaggaauuaaaaaccugcuggcaucgcuuggaagaaguuuuucuaauaagaucuuacagguuauacucaguucccucuccaauaaauuaugacaacauaugaaacaucaucuaucuggaaggcuuuucagaggcucacuccucaaagcuuuaaaggacuuggucuguagggauacuuugucuggauaguguauaccaaaauucagacuccccgaaggaaaacagguguaaacuuauaaccauaugauuugcacaggcauuuuaaauacaccgauuaaguuuuuauaaaccugagaaugacgagaaucuucucagggcgagauuuccagaugcuaaccaagagccaguuugauaggcaucuccuagggcuacugucuugggcuugcucugaacucuuuugcacacugcacaucauaacccagagugauaccuacuugugguucugaugaacaguagagaacacuuaaauaucauaaauuuagugcauauuauuauaaauauauguuauucgacgcguucucacgaccggccaggaagaacaccacagaccagaaucuucugcggcaaagcuuuauucuuacaucuucaggaaaagagagcaagaagcaagagagagaagcaagagagagagagaagcaagagagagagagaagcaagagagagcgaagcaagagagagagaaaacgaaaaccccgucccucuuaaggagcauucuccuucgccucggacgugucacuccuugauuggcugcagcccaucggccgaguugacgucacggggaaggcagagcacaaguagucauaagauacccuuggcacaugcgcagauaauuuguuuaccacuuagaacacaggaugucagcgccaucuuguaacggcgaaugugggggcggcucccaacaucucccccuuuuucuuuuaauaagagcaaauaggccacccauauuaaugagaguggagauagaggucaaauccccaguguguagguaaaggagccauguacaggauuagcucuuaggcuuacaggcuuuuacccagagcaacccugaccugcucccgugucguuuugccugggggaagggaacuaggacacugaaccuucaugaaagaugacaugucucccuagaauaggcucauaugugccgcagagcccuucuacugcagugcuuagccuugcaacucucucgggcugcugaagcacacucacucuaucucgugcaaugagacuagccucgugagauauaagagcugaguggccagcgaccuauugccuaagcauagauauaucaggggaagcuccauguucuaguccugcaagcgccugggcaauaaccaccuugucucuccuaguuuaggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagggacagguccaagcgcguggaguugaccugaaugauggcaagccucgaagggucuguucaaauucagccauccaauucuguaacauauacugaaaaagacuuuuugacaaauuagcugcccuaguaaauuuaacauacugaauggaaauaacacacaaucccggaaacuuuuguucacaucccugcugaguuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucagucaucuggaccuguccagacagagccaaggcugucugaauuaaggccaaacccaguuccuaguuagugguaaaaaagcaggagaauacuugagcauuauacaucaccgucauugggaguggaaaugucgacauuaucccccaacgcugcucucucuuuauuauugacgcccuggacaucaccaagacgagggacauuaguauucccuuggucagucuggauuuuucgggugagucuuucugguacccaaaauggguugucuucauucugugggaaaacacagauagcuccccuggaucuuaucaagauaggauccgggccauaccauuuauuaucaaggacauuuuuccauuuaaccaucucauugggccuaucuggcucugaacaaugacguucagccgcaguauggccaugagcaucaauauuuaaaaaauuaaguguaaagagugccaaagacaccgacacucuuggugcucgggguacagucuccucaaaaguuccccucuucuguuuuauaagauaggcuuugagggugcgaugcgcacgcucaacaauacccuguccuugaggguuguauggaaguccagucaggugggucacguccaucugacggcagaacuguuggaauuuuugagacguauaagcugguccauuaucagucuuaaggagucuggguuucccccaagcacuccaugccucaagacaauguugaaucacaugugaggcuuuuucuccgguuaacggagaggcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggagaucuucuagauaacaaaacuaauuguaucugcugaaaaauauuggcaacucuacuggaaggcuuaaucacuccagccacuucuaaaagauuuacugcauuuaccacauaacaggaaucugacacaauauuaagggguuuuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggauguuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacguuuggauggauccacaacaauggcccauucugccacaaaacugcaguuggcaauugugcugucuuaaagacacacaaacugaaaggcugcgaauccucaauacguuguaauugugcauucuguaaggccuuuuccacuuuuuguaaggccugguuagcagcuagaguaagaguccuaggggaggagauaugaggaucuccuucuaaaauacuaaacaaaggccuuaauucagcagaaggaaucuuuaaaaagggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaaaaggauaugccuuuuguagcaugguaaggucuucauccauguaaaggagcaaaauuaaagaggggaauuguucccucauuggcaaaagagcuuuuugcacauaaagcuggcacauuguaggacuauuggacauccccugugguaagaccuuccauugauaccucuuaucagguuuagcagaauaagcucucugacccguuaacaaaucaaaaguccaaucucucugcucuggaguuaaagcagcagcguuugcucgguccugcgccugugcagccucucgccacagagaucuccauuucacauauuugcccauacuagggagagcggcuuuugcaaucauuugccagucggcaggaguuagugccaugccggcaagccugucuaacugcaccaagguaaaauuagcauuaauuccauauuuaaucugcacauauucuaccggagcguggacacgcccacccucggcuccuucaaagacuggaaaugccuguucuauuuuccuuuguuccucucggggaaugaaugagucugcgcacugccucucugcgcacugccucucugcgcauugcugacgcacuacgggcugacgcacuacgcagggcggggacuccgcauagggcgggagugcaccugguagccgauugcccugaggccaauuagcaaacuggccuucgccagccgcuuuuggcuuuuuucuugaccaauuagcuggcugguaaugggcugcuucuuccucccagucuguuuccucagaggaggauucuucacuugcuucagaguuacuaagagcuggcuuccugagcucaucuagugacgaguaucuccuagagaccuccgcuaaucgaucuuuuuucuucucccuuuuuccucuuuuucuucuaaucucucuccagguauuccuaccuaaccuuaacuuuuccucggguucaagacccuuggaaaggccuguauacuuauuuugugaaccauauuuucucuuuguuccuacucuuucuucccgcuuuacuucugauagcuuguccugaauuuccucuagaauuuucagcccuaucuuaaucacuugauagcaugugaaaaagaacaaaagggcuccuaacaccagaaaaaauucaaggccaaacauacucacugguacucucguuccccagcugaaaaguucugaauucauacaguugaauccuucuuaacagucugcuuuacgggaaccuuuaucaccgucguuccccagcugaugaguucugaauucggcaguugaauccuucucaacagucuguguuacgggaaccuuauaaccuugauucgcaguucugguucuggaaugaaguaucccuccugcgccaguccggaguuuuuucucgucccggauuuucucgucccggaauucggcaccaauuguuauucgacgcguucucacgaccggccaggaagaacaccacagaccagaaucuucugcggcaaagcuuuauucuuacaucuucagaaaaagagagcaagaagcaagagagagaagcaagagagagagagaagcaagagagagagagaagcaagagagagcgaagcaagagagagagaaaacgaaaaccccgucccucuuaaggagcauucuccuucgccucggacgugucacuccuugauuggcugcagcccaucggccgaguugacgucacggggaaggcagagcacaaguagucauaagauacccuuggcacaugcgcagauaauuuguuuaccacuuagaacacaggaugucagcgccaucuuguaacggcgaaugugggggcggcucccaacaaauauauagugcauauuauuauuauaauuauuauaaauguaaguaaaauguugacuucaaacaguuaugauaaaaucaaaaucuacaugucuaaguaacuauaaaugugauaacauuaaugcaaggggcaccucaaauuugauauauuuuuuaaaucauucucaguuauucagagucucugaacauuauuuuggagggguacauuuagucuagggacuauaacucagugggaggagugcuuagcaugcacgagacucucaguuugauccauaggaccucauaaaccagauguggugauacaugcugguaaucacaguauuugagggguggaaacaggagagaccuuguuaaaauguuugcuuuauugcugauaguuacuaggagauuuccucuuucaucuuuccuaaaaauuagaaaaaaacagcagacaacuguuugaagaugaaacauauuaaaugugccuguauguucuuucauuuaaaaagcaauauuucaaaacacuuaaagugagccagacacagacauaccaaaauauguuccuuaugacaguaagcuauggcuuuggugaggaaguagacaguggccacacugugugauaaguguucaugcauuauagauuugaugggaggucuaucccacuaauacacguagauaaagagagaaaaauguuucuuagaagagcugauaaaguacccuaauccucaaggacacauaagaguaagccuagcuguuuugguuugaagaggagaugcccaccauagccaacugguaguccuuuuauaagcuuugguaaaucagcguuuaucuuccacuuguaugaauuugaauccuucaguacuucauaaaaguggaaucuuuauccuuuugugacuuacuggcuuaugcuuucaagguucauuuaugugcauuuauucuguuuuaaggguaaccauuccuuguaugauuuuguguguuggcucaagguguuuaugggaauuuggguuguuucuuuuuuuggaugcuaugaacaggagugccuguuuuuguucuuuuuggucuagacccagaagugggauuguaaggaugagugguaggucauuuuuaauuuaaaaaguuuguuguugggcuggugagauggcucaguggguaagagcacccgacugcucuuccgaaggucaggaguucaaaucccagcaaccacaugguggcucacaaccauccauaacgagaucugacucccucuucuggagugucugaggacagcuacaguguacuuacauauaauaaauaaauaaaucuuuaaaaaaaaaaaguuuguuguuguuauuauugagauggaguuucacuguguagucuuggcuggccuggaacuugcugugcagaccugacuggacaugaacucagaaguccucuugucucugagugaguguagcaccacaccugaguguuggugauauuuuagagacuuguguucuguuucucgcagcagcuuuccugcauucuggccucaccaguaaagccagaguuccugguuagguucucuuuuccuucuccuuucugauaauaguaacugcgaagugucucaugaugacucugauccgcaugccuucugcugacuacugauguucauugucuuuuuaugggauuuuaaaacaguuguguaaauuugugggagaugauagcugucugccuuuguucauuaaaguaaucuaguugcuuagcuggccagaguggugugugucuuuacuuccagcaguuuggaggcagaggcaguuagaucuuugugaguucuagcagugauaauauauaguaagaccuugucaaaagaagggaaaaaauuggaaaaaucuaguuguuuacuuuucacugaugcuaguuuuuugcacauacuuucuuucucuuuuaauaccuauacuaguguuuguugacuuggugagggaaucguuccaagucucagguagagcuuguaaggaaauguaaaccaaugaauuauuuugacagcuagcagaucauaaugauaggaaaagauguuaaaauucagaacagggugcauguuuaauggaggucauuaguugauauuuaagcuaacuccuuaagaaaagauuuggaucuggagcuauagugauggugugugugugugugugugugugugugugugugugugugugugugguguguauguauauguauguguguguguagcauuucacacagaaaauaaagcauagaggguagaagaucuugcagaaaaauaaaaaaccuuuuacuuaggcaccaacaguuuauuaagucaaaaggguuauuuggcaacagauaucagugucaucaggaaggcauguucuuguuuuucuggaacuuaacuuccaggaauguacuguacagauucguuuguagaauuugcccauuaaguuauuucaacaccagcaaccugugagcagaacuggucaguguagauugguccaugagaguuaggaacagguggaauauuucuggaagaacaucaagaaacuuguuuucuuccaaggaugauuccugcacauccuggguucuuucaguggccugcugcugccuccacagggugacuccugauuucaugugucagagaguggagaugaguugaggagggaaauaaauuucacucaugaaucguuggaggaaacccucauacugugucagaaucaacaguaaacaguaugagcuagacuuuaaggaaaaggguuugguuugguuugguuugguuugguuuuuguuuauuaugagaggauuuaugagaauaggcuuggucugucucaguaguuacagucuagugauccagguaaagggaauuuuuguauacuacauuccaaggaaugucuugagaaaguucauuaacaccaggauuugugacuacacaugcagagacuaacuuaagauaggcaagugauaagaguaaugccauucuuaaguuauuuucuuuauuuaaaaauuauuaauaaaauucacuuaagaguauugagaugaguuguuguugggcagaaagaacaucaaguuggcuguaaauuauuacuguuuucuaaaaguuaggcagcaggggcugcagcagaaguucagcuguuaagggcacugguggcucuucaggaggaccuggguuugauugccaggaccuacagguggugcaucugaaacuccaguuccagggauccaguacccucuucuggccuguguuagcacuaggcauggaugugauacauagacauacaugcaggcaaaucacucacacacaugcugagauacacauauuugugacuuuaaugacuuggcaacuaaaugagaaaauauuguuguagauaccauagcaagaggaagccauauccuaaaauguuauaagcccugacuaauauguguccuugaguaaagaauacaagaaaucuuuuaggauacucucugacuguaucucauuuuuaacaguacauguauaucagggcugguaauuauuucccuggcauucagguagucuagcuuauuuucuacauugcuggacacaguacugcuaguuauuuaaggugagaauucacuuaguucuuucauauuguaaacuggaguuuuguuuguauguauguguaguaaaugcguauguguaucaugugugccaugguguccuuguggaugcuagaggagagcuuuguuaaguuagcuuucuuuuuuguuuuuuuuuuuuauggggguucugaagacuuagguugugaggucugugugacaagagggccuucuuacuagcccuguaagcugauuuuuaagacaaaauuguuauuuagugguuacuauaauuucaacaaaugacuucauuucuaaugaauagaggggaugaaaaagauggaaguacuucuuaaagaaaagucagggccugggguuagcucagugguagagcaauuaccuagcaagcaugagauccugcuuuucacaccuaauccuccagggagaaagaugaaaaagagauugaggcucagcagguaaaaaugcuuagggcauaauccugacaaccuaaacucaaucccuggagcccacucacagagaacugacuucucagaguuauccuuuggccucccauaugcacuguggcacaggcaugaccacacacacacacacacacacacacacacacacacacacacacacacauauacacuggauuugguuuucuuuuuaauaaaguuucaaauguauaugugugcaguugcuaugugggguuggaauagggggaaguaaaaaaucuugauaguacagauuuggcuuagauuuccuguaggaaaaauucucauucuugucaaauaauggcugucuuuccuggggugauucucucuugaagguauggccugcgugaguuuguggugauugcuccugcugcacacagugaugcaguucucagugaauccaaguguaaccuccuccuuaguuccauuucuauugcuuugggaaacacuggcugguagguacacuucacagauguugaaaauauguuaaaauacuacuuguaguaauauaauucaggaagguaauuuuuuuuacuauaaugaagaauuuaguaccgaaccuugcacauuauuauaguagaauuugguauuugagggugaaauuagaacugugcaugguggagcaggucuuuaaucccagcacucaagaggccugggcaagaggaucuuaaguuuaaggucagccuggacugcacagugaaaucuugucucaaaagaaaaauaaacaaagacccccccccccccaaaggaguauaauuaauuaauaaaacccuuugagagguccuuacuaaagaaaaucaaauguucuuuguauauuucaguugagagaugcauuuugcuacaaagucugauuuuaaaauguauauaguauuagacauuauuuugcgauuaaccuuuuuuaaaaauuuuuuaagauuuauuuccuucauguaugugggcauauuguuacugucuucagacagcaucacaugcccauuacagaugguugugagcuacuaugugguugcugggaauugaacucaagaccucuggaagagcagucagugcucuuaaccgcugagccaucucuccagccccgggauuaacuuuucagugaauuguuuuuguguauuuuuguggccccucuucuccucuuuuuuguuuuguuuuguuuugguuuugagacagggucucacucugcaggccuaggugauuuggaacacugaccagucuagauucaaacucauguagaucugccugccuuuucucccuugagugcuuggauuaaaaggcaugugcuaaaaugcucagcaacuuucuguucuuagguguaagcguuuaagagcaugaaguuagcuuuauccguucagcuacuuugaguuguauuuccuuugcauaucagauagaccaggagacucuuacuguaaauuuacuaguggagaaauugaugcacuagaguacccuaaggaauauuuuggacuuuuuaagauuuuguuauguuuugguagcauaagcuuagccuucaaugguggagccaucuuucgagucauuuccuccauaaaaaacuggcaaagcuguauuuacaaaggaguauuguaacuuaggaauguauuuuauagccuguucuuauaauuuacuauauuuguguucuagaaacaccguagcuguuguauuauaucaaucauuguuccuaaggggaaaugcauagguucucaugcguuuuuggucacauucuuaucaacucuauacuuuaugacuuuauuucauguaugucucuguuuaagggugucauuuuaugcuccuguauguuaauauauauugcugauccacugagauugagcucauagccaacucauggaagcuuguaacucauguuugaaugaaucauuuuuuacacauuucuucugucuguaagacauaugacagccuucuggcucuuaggaacacugcuugcuuucagauccaccuagaucaucaaaggacacuuacuuuuuuauagucugagaguugagacaggaaggugaaucauuaccuaauuugaguucaucugaaacauuaacuuagagacucagcaucuuucugcacugcagaucugcacauacucuguacugcuaguguuguuuuggggguuacagaugcaguuuuaauuuacagaaacagaaaccugugaauggugaaaauuaacucuaccuuuaaaugauaaagaaauacuucacagaguugguuuuaaaguuuuuuucuuuugcuaaagugccaauaggcuucaucaguuuguuaggguaaggagaggagaagcuaaguguaucuuuguaaugaaugggaaucuguauucuuccuauagagauugaaaauaucugacauuaaauaaacaggacaguuuugagguuuaggauauuuacuguuuaaugagugagccuaauuucugcuccuuuuuacccauauucuuuagccagguaccacuguuuguccaaauacaucacaaauggcgacgaauguacaugggagaaugucaagguccugguguucguacugacuuugaaaugguucaucuucgaaaagugccaagucaguacacucauuugucaggccugcuggacaucuucaaauccaaaauugugaguugacguugguggugucagucuuauuuggaauaaaauaaaagcaguuugguaauuugaguauauagaaauuuucuaucaucaauuauguaauaaauuguaaucaaacuugauuagcaaacugaaauaaauuauguaaguuaaauuuaugauuuuauauauuaguuaaaaaauuaauugaguuggagagaugacucagcaguucuuccagaggcuuuggcuuccauuccagcacccacaggguggcucucagucuuuuguaaccccaguuccagggacucacuccaguguccucuucugaccucugagggcaccagacacacauguggugcacagguacacaugcagcaacccccccauaaaccuaaaauauaaaaagaaaaggaaaaugaauugaaaagaaaaaaccaacugauauugcauuuuucuuuagugugacccacucaggaggacgcaucugagcaguguuucugucuggauguuuaacauaaauagaaauguguaaaauguguaaaagcaaccgcuuauuuccaaaguugaacuuuuuuaacagaguaauuggucuagacucaugaaauaaacgcugcagcuguuuagauuaaagaaggugaaugagaugacugccgcguacagugaaugguuuuuacucgaucaaggcagagcagacagggaagaccugguuuaggauuguugggauaguuuuaauauguacugaguauuuaaaaauuaguguugauguuagauuucuuguguuaaacauugaagcugcauaggaaaacauccuucuuaaguaguugcugagguacugagaagugaacuaacugccuuggugauuacacauuuuaaaggguucaggaaaaaaauacacguggaggggaggguucugugccacagaacuugguacaagucaugugaguguugauuauauucauuuuccaacuuugcaagguuuuauuauuuuaaaaaggaauuucucuguuuuaaauagguauuguuuguuaggauuagaacuugauuagaaaagcacggaaccagagguuuggcuuaguguaguagaaagccugccuagcaugcaugagagucuuuguucuaucuccagugcuguggugguuugaaugagaauagcccccaugggcucuuguguuuaaaucuugauccccaguuagugcagucugagaagaauuaggagguguccuauuugagaggaaugucacuggagguaggcuuugagguuuuaaaagcccaugccaggccaagugucuuuuuccauucucugccuacugccugcagaucaggauguaaagcucucagccagggagggauagggcuccgcuggccagccuguuugccagcaugcuucccugccaugauguuacagauuaacccucugaaacaguaagcaagccccaguuacuugccucccuuuguaaauugccuuagucauggugucuccacagcaaugaaacaauaacuaagaacauucccaguacuauaaaaaggaagaauugaagcuuggaaggaggcaggcugccuggccagccaaacucaaauccaucugaaauacaggauaggaauuuuaaagucaggucuucuuuuuaucauuuauuuuuucuuaacauaaucuuuugugguugucucaauuaaaaaucagucuuggaaacauuugauguauguaguaacuuuguuacccaagucuucugggcucugaaaucugaacuaucuaauucuguauauaauauggugggaauuuuuuuuuuuuuuugaaaagcccaacuuuguguugauuucucuucauuuccuuuuuuuuuuucuuuuuaaacaucagaaguauuuaauuagcauuuugugaaauuucuggucugaugccaauauuuauaaucuuaucccuucuuuuuuugguuuuuccaagacagaauuucucuguguagcccuggcuguccuggacuugcuuuguauaccugacuggcuuugaacucacagagaucugccugucucugccucccaagugcugggauuaaaggcauaccucaccauaccuggcuucuuguuucuuuuuuaauggucagaaguaauuucucuuuucuuuuuguaacuaaaacuuuauuguaaaaaagccuucaaaaaucuuauuccuuuuaagaaauaguaaugaacauuuucagauauuuuuguauuacuucuguguagcucaacauuucucuuuggaaacuucuauuuuaaagagacugucuugaugugugaagccuaacuuagauuuuggcugucaauagcugagguuuuaaaugaaaagcauuguuaguuuaccaugucaccucucagccuuucacaguuuuaaagaacucuugaugguuggcuucucucaaaauugaucugagaaaauugaaguuaagguaguugagcacuguaacguuuucuucauaguuaaagcuguccacaucuuuauaaaauuacccuuuaacugucaccugagauagaguagcugauuucauuucauagagcacuaacuuuuaggaaagaguuccuguugaugggcccaguuuugccauuugcugucacauaaaguacagcuuuaaaucucuuccaccauacuacuaaauauuugaaccuucucagugcuuuuccuuuucaacuuuaauauguuuaguuauuucauguuccuuauaaaucaugguuuuauaauuuaauagcuaauuuguauauuuguuuuagaacuauacuuuuugccuauucuuuuuaauaaaaguuuuauuugggcccagagagguggcuccaugguuaagagcauugacugcucucagaggaccuggguuccauucccagcaccuacauuguggcucacaucuaccuguuacaccaguuccaggggaucugauaccuucuuucuggccuucacaggcaccaggcacucaagugucauguaaacauucauucaugcaggaaagcacucaaacacagaaaauaaagcaaaaaaaaauuuuuuaaagauuuauuuauuuauuuauuuauuuauuauauguaaguacacuguagcugucuucagacacuccagaagagggcgucagaucucguuacggaugguugugagccaccaugugguugcugggauuugaacuucggaccuucggaagagcagucgggugcucuuacccacugagccaucucaccagcaacaaaauuuuugaaauuaguuuuacuuugaaauuuuaacuuuucuagccguuguguguguuaguuuuauaaacucacgguugcugucuauagagcauuguagaaccaggucuuaaaguagcaguuggagcuucuugaccugcucauauuggaaguguugucuaugugaucuuggaauuugaguuucucugcucaggcugugagggggaguuauuuuucaggcauauggcuacauucuuuggaaaagugugacgcacccuuguugugcucaagacuuugguaccuuacauuuacuuuauuuaaacauuuauuuuuuauugcauuuauuuuguaugugugcaugcaaaugcacacacauucacauacauauuauggugcauguguggaucucagagggacaacuugagggaguuggaucucuucucuaugugggacccaaggauuggggucagaucaucaggauugguggcaagugccuuuaaccacugagccaucauguuaguggccuugguccuucauuuaaugucaucuguaaucccccaauaugucuucauucacacugucagauuguaacagucaugugcucugagccccguguagccccucaagucuucucagaaugccuuuccuaggaccuacaaacgugucugugccauguuugauccuuacucuuuucagauaucucagucuacaucuauccgaacugccaggacuagggcagaaugacugaauacuaggccuuaaaaaacaaagaacaaaaaaacaacccaaccagaaucauacuuuuucuaggguacaauaggcuaagguuuggauuuguuucuuaucauacccaccuuguacuuagucucugaaaugaguuuuuguuuauccuaaauuaccagugauauguguaggggcugcuucugagcuauaagauucuauaguuuuguuucucaggggauaguauucaagggaacaaaaucaaaccugugcuuaagauguucccaugggacuccugaaucuguuucaaucuuguuuugcuuagugggcaagaagucagggucguagaauuuuuauuauuguuagugaacuuauggauaauucuaagucuauuguuaacgauuuaucuaauauaaucuauuuuguaugagugauuaugguuaaauauuaaaccuaauuuugauuucaauuuuucuugaagauaccauuucccgaaauguaucgauaaacuuuaaaaaguauacaacucucugugacauucagugacugaaauggauaguaaaguauaggugcuggagagaugguucagcaguuaaggucacugccuuguaaaggacccagauuugauucccagcacacacacgugugugugugugugugugugugugacagaagcuuaaaaccaccuguaacuguaguuccagacaaacugagcccucuuuugaucuccuuaaguacuacaugcacguggcucagacaggcaugcaggcaacacacacacacacacacacacacacacacacacacacacacacacauauaaauauacaacuaugcuuuauaacaaaguugaagaucacuuugcuuaaugggauauauauuuucuuuucugguaagaguuuaagcucagccgggcaugguggcgcaggccuuugaucccagcacuugggaggcagaggcagguggauuucugaguucgaggccagccuggucuacaaagugaguuccaggacagccagccagagcuauacagagaaacccugucucgaaaaaccaaaaaaaaaaaaaaaaaaaaaaaaaaaaaagaguuuaagcucuuuauuuuaaaguaauuuguucccuggccuuguuuuuagaccuuuaugcuuauuucuuuggauuuugacauucagucucacuguauuacccaggcuggccuggaauggccugggacugugagaacacagcagcagcuucuuuuuuuuuuuuuaacguacauaacuuuuccauuagaugaaaauauuuguggaaaaaauacgcagagguuaaagagaucucuugcucuacaaagacccaaucaaauaauaguggcauuuccuggaguuugcuuuuccaguuuuuaaguucuguagucucuuccuccuuaguuuucuuuccauacagaguuuauuagcuuaaaaccguugcacuucauugugaugcuuuugucucugugacacuucuccccugaccuuuccccuuccuugugcucuccucucccccaccucccugcagugaccccuguuccacuugaaugucaugugacgugucgcccacucccuuucucagucccucuugauccccacucaggguucccuauccaguuucauaggcuguaccuauuccuacaaccacuuacuuacaugcacacagacauuaaaaguuaagaucuggcucuuaaaaucuuuccauccccccuuggugaucgccgagccuuacuuuguagagguuacauuauagaugugucaguugggauugcaguuuuuuuuccuuuccaaaauuuuauuuauuuuaaggcauguaucacuauguagccuuggcuggcuuggaaguugcuguguagacaauucagaucucaaacucacaaagcucugucugccucugucucucgagugcuaggaugaacggccugcaccaugcucagcuaguaucuuccgucuugguuauuuaagcuauacacaacugggucagucuuauuuuuuuuuucauguuugacucuauacacuaguguuugaaacuguaaacuuaaaauucuaguuucucagcuuugaaauguuguugcugaaguuuuuaaacacaggcuaaaacauuuacaugguauugucuuugcauguguuucuagggcuguccuuuaacuccauugccuccaguuagcauugcgauucggcucacauacgugcuucaggauuggcagcaauacuuuuggccucagcagccuccaggugagaacauuuggaacuguguuuaaccuauuaaaauagauugaaaagaaaauauauuaagaaauuaagauuaucuaaugguguuucauacuaggaauuccuguauucuuuuaaauguaauugcugauuuuguuaucuguauaauuuuauuuuccugaagaaagcucucacaucuuuuugagacagugcuauuucauauuugacagucugugaaagcugacaugauuuauaaagcaaccccugugauagaacauugugugcauuaccauacagugaaugauaaaaauacccauguuuagaaugucacagaagccauccucauaagcugaaaacaguaaugucgaaaccuuaagagcagcaguuuugaaccuguggguuguacccccuuugagagaugaacaggccuuucacaggguucaccuaugacgauccuaaaacacagauauuuauauuaugauucauaucaguagcaaaauuaguuaugaauuuagcaaugaaaauaaucucaugguugggguucacuauaacaagagggacuguauggucguagcauuaggaaggcuuagaguauggggaaaagaagaaauaaauuuguauauuguuuuauggaagaagauuguagaauaucuaauauuaauuauuaucccaggcuaugccaaggacucagauaugaacaaugcgucaccuaaguucuagacaaacucagcuuggggacauagaaccuaauugagguuuucguugguuuuuuuucuuccugcuugcuuuguuggauauaguuguuuauagugcuucuuuuaauaccauuuauuuaauguaugugccauggugugugacaucaaaggaagucacaggacagcuugugagaguuaguucuuuucuaucaugugggucuggggauggaacuuggguugucaagcuugguggcagacaccuuuacuugcuaaauucucuugccagccucacaguacucuacuuuuaacccuuuuuguuucugaaauaaugucuguacuuccuuuaaaauauuuuuguuuugguuugguuuuguaguccugguuguccuggagcucauuauauauaccagacuggccuugaacucagagauucuccugucuuugccuccagaguggugugaugaaaggaaugugccaccauacuugaccaaaauguuuuuaaaaauucuuauuaucauauaugcauuguacaaagugauguuucauaaagaaauguucauuuaagucaucaaauauaugcauauauauguugcauaugagagaaaacaauauuggacucauuucuccauuacugucucauuugcucucucucuuuagacuuuucauuccugcaaauauacauacauucugcauauauacauacuaugcacuuguguguacgcgcgcgcgcgcacacacacacacacacacacauauaagcauacacacauaggcguguacacccuuuaaauauagagaaaacauacaauauauguuuuuccaggucagucugauuuuguuuaacaugaugacccacuuuccugggaaugacauaauuuuuuuuuaugacacaaacuucacuguguauauaugaaucauauuuucuuuaccuauucaucuguuaguggauaucaaggaugguuccauaucugagcuguugugaaugucgcaaguauuuuugugguaugcugacuuagauucuuaguauaguuggauaagauaauuuaucuugaauuuuauuuauuuauauuuaucuguguguguuugugugugugugcgugcgcgcacaugcaugcgugugcaugugcgccuaccauaugaacaguguguauagagguucagaugucuuccuuuaucauucccacuucauucauucauucauucauucauucaugggggggagguacauuuuacuaauuucuuaguaacaaauaccaaaaugggaaagaauaaaugggggugcugauaauuaauucccucugugggaaggcucaaacgccccaggauccguuuuccugucaacuuuggguacuugcugugggcccugugugcugaggcagagcauauuugguaaagucgauaagaagacagaaggcauugauggcuuuuauauuacuugggguguuggggguugucuggccgccuggccuggccugcccucaucccuuuucuuucauuuguuggcuuuggucuuguaggugcagggcuuguucauucauacacauggucugcuaguacugugcccucuucgggguaccuuuuggucuugguaccucugcuucuuucacauggcccacagcucucaaauuugggucugcagucagcuucaaauuccuucuuccaguuguggugucccugcauggguguccuaggccugggcucugcagucacccucuuggagaccacucugcaguccuuacuguagacaccaugcacucaguccccagccagcccuuguucauuugucuucuuugugagacagggucucucauggaaccuggaacuuaggauuucgacuagacugucuggacagcaagcccucaggauuugcccgucuucacccucuuguugggcuuacagguguuugucauugugcccagcuuuuauguuuguauuggggaauccaaacuaauguccuuaugugggcacaguaagcacacugcuuacugagcuaucuaucaucucaucucuacuccaucuuaaaagacagccuucuaugggccagauuuauaaguguguuuauauuucaaauauacuuaauaagaaaugaaauauaaacuuguaaauaacuaaaagacccccucccccucucucugaagcgagaucuucuugugacuuucuggcuggcuagguacugauuuuguagcccacgcuggcauugaacuuaugucaguuuugccucagccucccaaaugcuaagguuuagcuaaaaacuaccacacccauguaucaauaaacagcuagcuuagaacauuuuuuaguguacugcuuccaaagaaaaccaaaauaauauuuuucaugcuuuauuuuguuccagcucuuuggcuauaagauugagaauaauugcugggguagagauaauacuggaauuacuauuguacauagucagcuuuugguaguuauguguaccacuacugguuuuuauacuguugaacaacuuagaacuccaaugugcaguaaacgagcuacaucuaaacaacagcaaaggggagguaagagaaaacuuugguuucuagacagcaguaccacugcaugcuuuuuaauuuguuaugacaaguuuccauugugcuccuuuucccaaggcuacucuauuaguuucaaaccuuugccaagaaccuuggaguguaucccagugacggaguauauacuuagcaugugugaggccuuggauuuaauccuaguugcucaguuccaaggugucgaggucaccaaugaucuuaagaaguucaagggccagacacuuacauuguaauucugauugcuaauaagguguuugaugauguuuucuguucccagauuuuaaaaaaaaaugguggauaaaaauaauaacauuccuuagucagcuggcgucuauauaaacucagaauuuucucuuauaagagggaaagaccagcaggaauuacaagccagacacuacacuuugcauuuuauaucuucuguuuaauuuaaaaaaaaaagauuuauguauuauuauacauaaguacacuguagcugucuucagacucacuagaagaggccaucagauuucauuaugggugguugcugggauuugaacugaggaccuuugggagagcagucagugcuccuacccgcugagccaucuugucagccccuacuuaauuuuuuuuaaaaaaagauauuuuuauuuauguauuucauguguauggauaauucauaucugcauaccagaagauggaaucagccaauugugagcugucacgugggugcugggaugaacuugggacuuucagaagaucagugagugcuauuaaccacugagccaucucuccagccccacuuaauucucuuuaauuuuugugauacaugaauguuguugcauuucucagaaaauguaaaccuuagaaaggcugaugguacaugguuacccaguugaucaaguuugccuucauguauuagucaaucuccaguuuccugggucuccucacaguuuuuuuuuuuuuuuuuuucguuuuguguuuuguguuuuguuuuuuguuuuucgagacagggguucucuguauagcccugacuguccuggaacucacucuguagaccaggcuggccucgaacucagaaauccgccugccucugccucccaagugcgccaccacggccuggcuccucacagcuuuuaauuaaaacuuguguacuggggcuggagagauggcucagcagguaagagcucugacugcucuuucagagguccugaguucaauucccagccaccacaugguggcucacaaccaucugugaugggaucugaugcccucuucuggugugucagugacaguguauucauaaauaaauaaauuaauuuaaaaaacccuuuuuuacuauccuuuugcuaauuauuuuuaauguaucaguuuaugagaaugcauguaaaguuugaagcucuuaaagguaauuuguaguguaaaacuaaucauaugaucuuuauuuuuguaagcauucuuuaaguuguaaaauggaaugaauugauugaagaauuauugaguaauuuagucauauuuaaugacuguuuuuaguaucuuagggcauaaguugucaaguguugauuuaaacaagucagggugauguuugugauucaacaauagacuuuaaauuuaugaauuucuaguauaauauuaacaauuaaauaccuccaaauauauuacuucagagagagaaauccuuuuaauguccuagaaguguuaguuucucaagaaggauggaguuaaggguucagugacuuuuuuuuuguuuucuucccauggagagaccauucauuuuggaaaagagguucuuuccugaauuucaauauugcaucuaugguccacagagaauuuuacuaauaauggcaaauuugguaauuuguuaaccagaaauuuuugacaacaaaacugaugaguggggcuggagagauagcucagugguuaagagcauugacugcucuucagaggucaugaguucaauucccagcaaccacauggugguucacagccaucuguaaugggaucugaugcccuuuucuggugugucugaagacagcuacaguguacuuauauaaauguaauaaaucuuaaaaaaaaccugaugaguguaaguuggugaauaaaugucuuaguacuuggauaaucgucccuuuuggauucuuugaaaaaggagaaaaguacaagccuauuucucucuugaguaguaguugagaacuauuucccacgaguaaaauuuauacuggauggcuugacuugaaacaguggcuaagcagaaguguggcucuguacuugaacgcucucguucucagaagccuuaccucgcaugugcuaguucaugcuuagcuugcugucugcacugucacaggcaccucagagcuauccucuucugaaagguuucauagaacuaggcaagaucucacugugcgguuccagcuagcuuagaauucacuguagugcuuuaugugccuuuugccaaauaaagaauacauuuuucccuuauuuagauauagaugcccuugugggaggagaaguugggggccuggaguucggcaaguugccauuuggugccugugaagauccuaucaggugagaguuucagccugucacuuagauuauaggguuauuuugcuuuuaaaguuuauauugaaauuuguuuuaugacacuguaugcuguugaaguaauguuggaaauaacuauacuugcucucuuuaguuuauaacaucacaugagaacuucccaaauuaauacucuucuuaagguuuugcaggcuguggggcugggcuauagauuagugguggaguggcugcauaguaugcaaagcaugcauagccccggguucagugccaacacaaagaguuuggcagucuguggcuugugggccagaucuggccagucucuguuucuauguggcucauaauaguuuauguauuuuaaaaguauguauaaacacagacacacacauaagaaaguaacagauuguauauggcucccaaagccaaaauauuugcucuuuggcuuuuguuugacaaguuuuccagcuuaccacuauaacaggauuuuguuucaaaguugagaaaauccaucuacuaugaaguucagcacuucaaagugaaaaguuuggugguuuuuauuauagguuuaugcagacauuaucacuguauaaaccugaaacauuuuaaauaccucggagagaaucuguuccuuuaaaauuuauauuauuugugugugauuguaaaugucuuugaaacugcuugaauucugugauaaauuucaugaucauucuuuuaaguuauguccuggggucuauguagguaauucucauuaggaaacauuucuguuggacuaggguuucaugggaaacauccugucuuggccauucauuuuguuuuuauuuugugauguuaccugggcauguagauuucuuucuucgguuguguaucuggugugaggaucuggccugcuuuagacugggccagggccugagcugugugacuggaguuaggugguagagcuggugcauacgcuguuugauuggaccaggcaaagauggcugcugaacugugauucuggggcuuggccuguguauaugaagggaaggcuggagugggagagugaaggagcagcucagcaggccagaguggcucacacaccaagcaggcucuagggccuuggguuuguagcuuggucuguggguauugagauggcagcagguagagggaagaauaggaaaggaacaaagccuugcaaccugccauggcuccuagugagcaagcugcucugagccaggguggagggaggccuggggguggcgaugggggagggguaacugaaacucaucuguguuacagcagaagcaguugguuuaaaaaaaaaugcuuucuaguaugccauuauguggauaagcuuuaugcuuaugguguaucacauuguguuuauccauucaguuaauggauauuuuacuuauauuuuuuguuuauuauauaauguaacauuuaauaucuacaagacaauuucauauggcuacacuuuccuuucuuaucuacuugcuuuuaguuuauuauauacagcccuacuuuucauaaugaguuuuauagauuuaugugugaugaucuccuuuuuuccuaguuaguaacuuagaguuuuauugcugugaagagaaacuacaaccauggcaaaucuuuuuuuucuuuagauuuauuuaguuaguuaguugaacuaauuuuuuaaaauuauauucaacacaauauguauuuuuauaccaaucauaaaaugauggacauguuauuaaaugaacauaaauagauaaagucucguuuguuuguuuuguuuuguuuuuaguagaguuuuaaaaucuuggcucuuacuauggugcaaacccaaaaaucagaacaauuuuuagacauuggaguucauuguguuaaggcuguacuucagugucccucaaaucaccgaaggcuuuuaccuccauaguaguuaagcuaagaguugacaguucugcugcggaccauggcaacucuuauaaagaaaaacauuuauuuggagcugacuuauaguuuagagguuuaacuauuauugucagggugggaaacauagcagcaugcaggccgacaugaugcuggagagauaucugagaguucuacaucuggaucagcaggaagagagagugacacugggccuggcuugaguaucugaaucucaaagcccaccaaacacuucuuccaacaaggacacaguuacucccagcaaggccauaguaaugccauucccuauggccaaggggggccauuuucauucaaaccaccacagcacccccuucauuacuuuuuucuugucuuuccuuuuggugacucugaguugcuuacaggaacauagguguggauauaggugaaggauuauuuacaagagugugaacuacucaccaggggcucugccagugaagaaagcgucucccuccccuagcagccauuacacacaacacuucacaugcauugcuuucuuaggauacauuucuagaaaucgaauuauugggucagaggacauacauacacauuuuacagguuuaauuuuuuuguuuuuuaauuuuagugaacuccauuuagcaacaacguggccucauuugacagaagggaucauuguagauaaugauguuuauucguaaguauguuaagaacuucauuccaauauauuaaccaccaagugcuuaguacaaaguuuuauuuuuugaaaaaaaauuuuagacuugucuguguguguuugugaugaguuuuuacaaugccacuuugggaaggugauccuuaauucagggcaguaaacuauuuaaaucuuaugauugcagcauagugaucucucucucuacccuuuagugugcaauccucuccaacucuucuuagcuucuaagaaucauuguaggacugggaauauagcucacugguagaguacuugcccaguguagacccuaagcuugacacccuacaccccucccaaaauuauuuuuucauguaaugcuuauaagaaguagugagggggcuggagccauggcucagugguuaagagcauuagcugcucuuccagaggaccuguguucaauucucaguaccuaaauggcagcgcccaacugucuguaagcuuggaguguagugaaagaaaaaagcauuacauucuucuucuggcuguggaauagacacuuugacuuuucacaguuaacagaaacucagugcauuuguugaugguaaaaguaacagcauacauguccucacuuaggguauguacgugcaaagaaggaaauacagacauaguuuaaagggccuguuaagccuuaguguagauguuuuuaaaguuuaugugucaguuugcuuuauucuuuuaguaacuuaugcuuuugugguguuugcuugucauggugcaagugugagaaucagagaauaacugggcugacuccuccuaccacauggccuuccuggagauugacauuagaggaucagguuugcuggcaaguaccuuuaccugccaucuugcuggucaugaauuuaaaaaauaauuacacauaauaaauaccucauugaauagauccucuauaguauucuuuaggaagcagaaugcuuuugguuuuguccaagguuuggagucccuguuuucauuaauaguaauauuaaauuaaaaacagguuguuuaaggugauuauauaggggcuggaaaaaaauaaacuaucuaaaaaagauaauugugcauacuuguuucuuaauuuucauuguauucuuuaaaaauauauuugucccauuugguuuuuagugcacauuucaugauuuuauaauucuagacuuuguuuugaucuugguaguucauugauuacagaugugccacuggaccuagcuuucauuccauugcauuauagauauuuuuauuagucauaauuauugccuuacucuauucuagugauuuggauccuguucaagcuccccauuggucgguuagaguucggaaagcugauaauccccagugcuuacuagguagguacacucuguuccuuuucuggaaauuuccaaauugcaaugcugaauacaugucaccuauucaaaguauuguuuuacauuuucauagcauucucaguguguagaaaaagaauuuaccaaguaagugaaucuuuuauuaacagcaauagcagcauuucuucccuuuaaugaaucuauacuccagcauucucugugauauucucucagaucuuguuuugcucuucccauuguuacuguguccccuucucccagcguagucugcaucuucaguugagcccuuaaucaggguuucuguugcugcaacaaagcaccauaaccaagaagcaaguugaggaggaaaggacuuauucaucuuacacuuccacaucacuguucaucaccaaaggaagucggaacagaaacucaagcagggcaggauccuagaggcaggagcugaugcagaggccauggcagggagcugcuuauuggcuugcuucccauggcuugcucagccugcuuucucagagaacucuggagcagcagcccagggauggcacccccaacccccaccaugugcugggccuuccccuagugaucacuaguugagaaaaugccuuauagucugaccucauggaggcauuuccucagcugaggcucuucccuucuggcaauuguagcuugucuuuugagaucccucaugaccugugaugcgaugguacaagagcauugacuuagugugcacuagagcaggacugcuuaaacuuuuuccacuuaugauccuuuuuaacugagacaucuuugcaugacaugagguauauauuaaauagguaugcagaucaaacauguacugagaaauuuuuuucuaggaugguucuuugguguguguguaugcauguuuuuauuauagcugagacgaauuuguauacuaaugagauagauaugcuuaaucuuauauuaaaaauaaaucuuaccauuuucaacauuuuccagaguugaugucuuaguucuguaauugucauuucugaauaugcugcuuugcacaaauacacuauaucaaauggcaggauauauguagggucaucucagaaauuguuggaaguucaguucuaauaggauacucaaguuauuaacucaaguuauuaacucagcaguuuuuaaaaguaaacauucuaaggauacacuuauuuuauccucacaugcuaaggaagaauaauaagaaaauguugucuuuuuuucuguaaugauaucauucuguuuauacaaaggcagaaauuuuuauaaaaauccugucaugugcaucaugcauuaguuggugguauguggagucccagcaucugcagugcggagugcauccugggaguucagaagcagggcuguaguggaguuccaugcagcacaugucagcacugccagaaacaucuuggauuuaucacauguuugauuuugaguuaauuuuuggucauuccacauucagaagccuuuuacuauuugcguauuuguagugucagaaaucauucuuaaccggaguuuaaagggcagggcaucggaggcuggagggauggcgcagcggguaagagcaccgacugcucuucccgagguccugaguucaaaucccagcaaccacauggugacucacaaccaucugaaaugggaucugacgcccucuucuggugugucugaagacagcaacaguguacucacauacauuaaauaaauaaaucuuuuuaaaaagcugggcauuacaccucuucugccaaguuguaucacaucugcaaaccuauuuuauggagagagggauauguaaauauacuuuuguucaccuagcagguguuuugaagauuaagugaaauacaauagaacuuuaaaguaacuugaaaaguaguaauugccauucagaaucuauaucuggaauuguuaacuccuuuuuaucuuuuucuucuccuccacaaccuccaacuccacuuuaagauaaggucucccuguguagcccuggcuagccuggaauucauuuuguagaccaggcucagucuggcuuucuugaacucacagagaucuauaugccccugccuuuugguugcugagauuaaagauguauacuucuuuuuccuuucuuuaagcuuaucucuccagaucuuccaaaacccauagcuuuuccuuauuucccuucuuacauuuaguacucauggagauauucucgccauauuuucuauauagguaugccuaccuuuacucuguaucaccugacauuaaauucaacugauauuaaaauaguacuuacuaaugacaaugcuguuucuucaaagcauuuuuuaguucuguuucuaaauauuuauuuauauuauauauaugaguacacugcuguagcugucuucagacacaccagaaaagggcaucagaucucauuacagaugguugugagccaccauguggccgcgaaaccucugggagagcuguuaguguucuuagcugcugagccauucuuaggcucuaguucuguuuuuuguuuuuguuuuuguuuuuguuuuuuuugcauggauagauggauggauggggcagagccccccaaaccacccuccaacaacuuuauuucuuuucucuggccuuuuuauacccuauuagacaaaaagaucuuuagaaaauuaucucagagauaaaauguuacauagaaugggaguuacagaaggguguugauauuaaguucaaaguaguauuuuauucuauauggccuugccauaucauagugcacaucuguggcuuagaucuaaauguuuuuccuugaauaauacaaauuugucccaaaucuaccucucuuuuuuguguaauuaugcaaagcuaauuguauuuuuuuaaaagauuuauuguuauauguaaguacacuguagcugucugaagauagcuacaguguacuuucuaguucuguuuuuaaauauaauauauuuuuuaauucuuucagaguuucauauuuuuuugcuuagcucuuaaucauucguuuugugcuguucgucaaaugucagauagcacuuggcccauaugguaccugauaauggagaaaguguucugccuuuggugagcuugccuggggccuuagagagacagcauugucgguguugaacaaacccauacccuaggcucuugaagcagcagccucgucagugaaacagaugaguugguacacaccucacaggauguuaggcugaugaagcacaguuaccgucuguaugcacgucacacguaaccaguguccugugcauagacagugcagugucugugcugaacaacgcuugauguguuacacuggcaaauuugccuacuugauggccuucuaaaaccuauuugccuucauuugaucugauggcuuugguaaggacuugagaagcacucuuauuuuaaguuacuauuucaugaucucacuccacuucuuuguuuaggguuuuuuuuuuuuuuuuuuuuuuuuugucuuuuuuuuguuuguuuguuuguuuugagacaggguuucucuguguagcccuggcuguccuaggacucacucuguagagcaggcuggccucgaacucagaaauucacuugccucugccucccgagugcugggauuaaaggugugcgccaccacgccuggccuuuguauaguuuuuaaugacaaaauuacuaggauuuucuacauuucuggaaaagaaaccaagaaauguugguaaauucuaaaacuuuauaauuuuuauuguauuuugguacugacaauucuuguuaaauuuauuggugcaaacauacccucccucccaccccccaagcuaguggagucacuaucuuaucuaauccaggcuggccuuccacucacuguguaaguugaggaugaccuugaaugccccaucuuuccuccucuagcucccaagugccaauauuacaaggguacacugccauacacgauuguaggugaaagaaguugaccaaggggagacaacagaccucccccaaccucccagugaaaaguguuguggaagagacagccaugcuuccaugcauagcuucuuggaaucucaguauuugggagacuaagacagggagauugcaaggucauggccagccugcuauagauaauuuuuuauuaaaagugauuuuauuauacuuauuuauuugggggagcuauggcauucacauacauagcuuguauggagauagaggguaaguugagggaauugcuuccuucuaccauggggcugagagaccaaccccacugagccauccugucaacaccaagcaucucugcaucucuugaaaacauaggaacuaauuuucaucuuuauaucacuaauaugcaaccaaagauguaauagcuuccuauuacaugauuucuuuauccucuaggaacaucuuuacaucuuaauuuuaauauguguuuuuaauuguuucagaauuauuauaggauaacaggaaagaaaaugauguauaauaauaauguuacuuuuaugauuuaaugauaauggauauugguaacagugaagccuguggaaagcuuaauauuaggaaauguguuuuguuuucauucauucuagaaggauuuuuuucuuuuuagaaauaggaauaaaggcaucuuacugagagagaacgcauucuugagacugggaauagacuagugagcucaugggaaagcacgcaucccaaacaggaggaacacagggaguacacaggagaagacucuucucuauccucagauggaauaaaaagaacaagaucacuucuaaaguagggucaguuuuuauuuuccucagagaaaaacuaaguagaacaggcuguccucgaacuccgauugccuuugccucugccucucugucucugccucgauuaaaagaaccacugccuggcuucccaacuauaucuuuuaaguguuuuuauuuuuauauuuuuuuggagacagaguuucucuguauagcccaggcuauccugaaacuaacuugguagaucaggcuggccucgaacucccaagcccgcgccccaccacugcugcguucucaacuguaucuuacuuuauagcuuugguucauagauguggaccucuguuggacugauuucuuagacuucagugucaaaaauuaauaacuuuuuuugguaggugauuuuguuacugaauuuuuaaaaauuugccgucgaaaggaaucaacggaugaaauucuuggacgauccacauuugaagaagagggaagagguaaccuacuuuuccuaguuuacauuuucuccaaaacguugccuuuauucuuuggcauauauccuagcaacuuuuuaaucacuuugaauugaguuggagaagggaguauagauggcacuugcuggccuuucucuuuaggcugcacccaaagcuuaaucagcaaauauguuuaaucacuucuucccaacaacaacaacaaauaguaauaagguauguggaaaaagcauaguuuuagauauucauauuugaggucuccagaagaaaaauaacuuugugauuucucggcauccauguuucauguaaagcugagcaugugagaacuugauaauuuuauaauucugagaguauuuaauacguguguaagggagaacccaaacaugugaaugucaucagcuuauugacacuuucccugccacuuuuggugauagaauuugcauucauuucuacuuuauagaaguugcugauauaacucaugcuuugucaaagcugacugagccagcgccaguuccaauucauaaauuaucaguuucaaauaugguacacacugcaaagaagaagauacggaagcacagaggggaagagucgccgcugaacagugauguucucaauacuauucucuugguaaguagccgccucacuucuguguguaucugcauaagcauaugauuauauauuccauuccuucuuuauggcagcacuggauuaggagcauaaaguauaaucagagauccacauucagagacugguuauugggaagaagaggcauagcguuacaguccuggguggugugugugugugugugugugugugugugugugugugcgugcgugugcgcgcgcgcgcaugugcuaacaugcacaguggaagucaggaugcuuucuaaagaggaugccaccuacugagugagguuuugcuauguggugcuagggaucaaaccuagggccuucuccaugccugagugcauguuaaacaguggugucugaggagugcuucccugagagugaucaggguaaggaugggcagguagcuggaaaccugcaugaucuagcaccgcacuuuugucuuaacaccacuugaaacagauucguuugugaugggaauugaacuuuuaaaauggucuuaugacaauagccuacaaaaaucuguacaguaagaaccagagaggacaaagaagaggguuaaggugggucccagguauaguguaauuggaguggguguagccugagagccacauggcagggugaauacugacuuccuccaugauguugaacaagucacugcagguuuuucaucucacaaacggagcugguacuccugugauacauuccuuuaaucccagcacuuggaagguagaagcaggcagaucucugugaguucuggucuacaucgagaguucuagggcagcuagaaaugcauaauaaagagcccuucucucaaaaagaacaggaaaaaaaaaggaagcugauaacaccuggugagauuguuacaaaauuaaagggccauuacuaccuggcauauaauaggucuuuauuaaaugauuguaauugcaguuauaauaaagucuucaaggaaacccuucaaaaauaguguaauaaaggaagguaaugcuggguuuggaccugaugcuggccagugucuugccaguuuucugaucaagacuuuuagaucuuuagcugguacauuauaaauacgggaaagaugagaacugaaugguguuuguaaauauauaacugcuacuguaacuuuguaccucuuagcuacgucgguuuuuauaagucuguuaaauauugguuaaaauacuagaaagucugaacauguucuguaauacguuccaauggaagcuagagagauugguuaguaacaucagaaaaucgucucaauacuaauaaaaggaaauaagucucuguagagaagacuccuuaaauccuaaggaccugguaaggugguguaagccuagcacuuggaaggcuaguauagaaagcucaugaguuuaaaucuagccugggcuuuacagugaaaccuuaucuacacaaugcagguuuaagcuccucauuucuaggggauauuuuccaccaugccuucaguauuucauacauggaaaccuguggaugaucuuagcacagauucucagaaacacagaggugguuuuagaucauuuguuaaaguuuugacucuaaagggauucacacuuuuuaaaauacaggauuuacuaacauugaugaguauugaaucggugugaugagauuuuugcuucuguguuuuaccucacagaaucaagugcuuauuugaaugaaaaauuucugaacugcugaaaauauuuuccuuuuuaugacaauauagaaucagcuggauaucacaguaagaauauucucauaauuuuaacagcaaaucuacuggaaagucaaucaguaucuucuauggguuauaaacaccaacagaauaguuagauguaguagcuuauauuuuuaaucccaucccaguaccuguggagcagguggaucucugagugcuuugccauccuggucuacauauugaguucuaaguuagcuagagcuuuauagugagaacugacuuucacgagaaaaagaacguuaaaaucaucaaagaagguaaguauaaugugauuaucccuccccuaguucuuguucccagaugcugucucugagaagccguuagauggaacuacuucaauagacaauagcauuccugcaccagaggcuggagacuauguaaguuggaauucagcauuaaaauauuguaaaugcacuuuaugucuagggauuugcucaaugucuagagauaccuaaguaucucuucauuuaaaaaucuaucugggaaaacugagugguguucacagccacucagaugaugaccggcuuagaacaucuguguagauauagcuguuuuguagagcaaagcagcuucuugggaaauagaaacgaauagcauaagaaucguauacauagcuguuggauccucguaguuuagaguucuugucaaauucuuaaguuugucuugcagcagauucugauggguuuauuuugauggaagauucuucuuauguacucuuuaaguaugcaaauuugcuguuaacagguuuugcuuuguuuuucuuuuguaaaauuuagacucucuacaaucaguucaagucugcgccuuccgacagucuaacauacaaacuggccuugugucuuuguaugaucaacuucuaccauggagggcugaagggaguggcacaucucuggcaggaauuuguucuugaaaugcguuucagaugggaaaacaacuuucugauuccaggguaauaauuuuaauuuccaguuguuuagcuaggauuuuuuuuuuaucaccaaauaucugacuucuuucaggaauucuuuguaagaaauauguauccaucuuuacucagguguucagugcaguacauuucuaauggaagaaaaggccagacaaccuaaaugucaacauugugcugcaugacuguaaagcuuucuucuagagucgcuuauugcuuuguuugaggugggguauugagacaugaacccagggccucauguauuccaggcaagugcucugccacugagcuacaggugcauaccucaagaaccuuaauguagaaacugugcguguugggcaugguggcagauguuuuuauucccaucacucaggagucaagaggcagaggcagaggcacagagaggcgcagagaggcagaggcgcagagaggcagagagagagagaggcagagagagagagagagaggcagaggcagaggcacagagaggcagagagagagaggcagagagagagaggcagagagagagaggcagaggcagaggcgcagagaggcagagagagaggcagagaggcagagagagagaggcagagagagaggcagagagagagaggcagaggcacagagaggcagaggcagaggcaagaggcagaggcagaggcaagaggcagaggcaagagucagaggcagaggcagaggcaagaggcagaggcaagaggcagaggcaagaggcagaggcagaggcagagacaagaggcagaggcaagaggcagaggcagaggcucagagaggcagaggcgcagagaggcagaggcggacgcagagaggcagaggcagaggcagaggcaggcagaucucuugugcauugagcucugcauaggaagcuccaggccagccagaacuacauaguuaaacccugucucagcaaacaaacaagauuaagucauagaaacuguauuaguaacuagguguuguaauacagcacagaaugcuuucaauuaugcugauauguagguauagaaaaaagauuggagagaaauacagucaagugguaauaguuuucccagguaugaaaguacauuuuuguuuguuuauuuguuucaucuuuguauuucuuaaauuaucuaugcauauacuucuauuugaagaaaaauaccuuuaaaguacucuauaauuucaggcauuaaauauaaucuagaaucucuuuuuuaaaaaagauuuauuuauuucauuuuaugugaauacacugucuucagacacaccagaagagggcaucagaucccaauacagaugauuguaaguuaccguauaguugcuggaaauugaacucaggaccucuggaagaucagucagugcucuuaaccgcugagccaucucuccagccccaaucuagaaccuuuuuauauugacauuuuacugauugcauaaacucuuaacuaugcauacaugccaauuacugcuaguaggcuagugguugucuacccauucuaaggagaggaugauaugacuaguuuaauggccacugaccugaaaguguuuuguguuaggauguuuugccagucucuguuuaucuggauucucucuuggcuguuacuguuuugcucuggaacuuauuggcauacagaagcacacugaguggaggaauuuagugauuuagaaccaaagggaguccaggaucucacuggcaaaggcgauguagagacagaccuugguuuguuuaaugagaaucuaccuauguacauaugaguuuuguuugugugauaugcaaagugcuguacacuaguuacuuccuguggugaguuuagacucagguuucuaacuagcuuggaagcuguuaugaguuugcccuuauauaucacaugguuuuuauauuugaugacgauugugagauaggauaaaauaauuuugaacuuuuaaucauaaucuggaaccuggcuuucuuaaguauggaaaucuaguuuugguuucuuaacaauauaguuuaaaaaauugacaauggggcuggagagauggcucaguggguaagagcacccgacugcucuucugaagguccagaguucaaaucccagcaaccacaugguggcucacaaccauccguaacgagaucugacucccucuucuggagugucugaggacagcuacaguguacuuacauauaauaaauaaauaaaucaguucccugucuuaaaaaaaaaaaaaaaaauugacaauguguaaguaggcuuacgugauauaauuuuacuaaaacuuaagcuuucuuuuccuauuugguagacuagcaaguggaucaccagaucuaagaugcugcuuacugcaucagaaacuacagguaacgguuuuccauagcaugagugcacacacauuuacaucauuuacauauauauauauauauauauauauaugcaaaaccugacgcuuaaucuaacacuuaaguguaggaaugacuuauauaggcuacuuucuuugggcugcuuauggguugcuuauaaucccuguaaucugucuugguaaaguagaaagaaauacugaagcaauugauacauauugcuguacucuaguucaaccauaaaugcuauuucuguuuucuucagauguuaaauuguuguauugaaaggaagaaagcacgugaugaagggaaaaagacgagccucucggauaguacgacuagugcauauccaggggaugcugggaaaacuggaggccagcugggccuggaccaucucagagauacagagaaggaaaagggagaaguagggaaguccugggauuccuggagugauagugaagaagaguuuuuugaaugccucagugauacggaagaccuuaaaggaaacggacaggagagugguaagaaaggcggucccaaggagauggcaaacuuaaagccagaaggccgccugcaccagcacgggaaacuuacccugcugcauaauggagagccucucuacauuccagugacccagguaggugcaccaaggcuugcaaacucagcugccuuuuguuguugauuagguccuuccuagaggagaugauugcuuuugguaggagagauuauuuaaagucuuugauuagguuuggaacuuucaguucugccagucugaaauugcauaaucguuugaagccuuaguagaugguauugaccuuauauaaggugauuaauucuuugagaauucuaugcaauguguuuugaucauacuuagccucaccuucuccccgugacuucucuuaaagucuauaccucuccuaccuuccccaacccugugcucuccuuucuuauuuucuuuuuuuuucuuuuuuuugguuuuucgagacaggguuuccucuguguagcccuggcuguccuggaacucacucuguagaccaggcuggccucaaacucagaaauccaccugccucugccucccaagugcugggauuaaaggugugcgccaccacugcucggcuuggcucuuuucuuuuuaaauagcccaucaauuccuuuuuuuuuuuuuuuuccccauaugcuccuugauauggggcccuccccagcaacaugguggaccuaccaggacccacacccuuaaaggaaacugagucucuccucccuggaaaccaucaucuguccauggcuccucagccacacaucagggcucaugaaccccuuccauuccguguuagaauggggacuagcuugauccucugugaaucugagugcaguggccaugucauguccacaagaugcuauguacccuccuccacaguggacccugaacuuguggaauuauugguucuuaaacuguauuuccauagguagagaugaagugcuuggaguacuccaaguacagaauggggagaacaaaaacgaucguccuucaguuaggacuguuuuuauuucuucaaacauguuuuaaagccauuuuauaccauuagaacagcaacucagucuagggaagaacaauucauuuuuggugguugguuuugccuaagugauaugugaauacuuauguuuaaaaaaaaaaaaaagcagcccggcgucguggcgcgugccuuuaaucccagcacucggaagauagaggcagguggauuucggaguuugaggacagccuggucuacagagugaguuccaggacagccagggcuacacagagaaacccugucucgaaaaaccagaaaaaaaaaaaaagcaggcuucuugcucacugguucagaccuucucaaaaguaacuguuguuacuaguuugaguuauguuucuuacacuucuuccuuuccacugaugugugcauauggauaugauuugguuucauuucugaaugugcacugauacgcagcuuguuuauccuaucaauagggucaccccaugccauuaaauguacaucugugucauuuauaauuguugcauauuauucuaacauguggaaguccuacagcuuauuuaauuauucaugucaaucacugugugucauuuucaaggauuugcucuuuuaaacagucuguaucaugagucccugccaucauuuacauaagaaagaugguucacuaggugaagggaccaaugcuaucaaguuucccuuuaaacagguugcaccuguuuuacauucucaucagugguaaauuaaaggguaaagacauaguaauucucacacucuuuccccuuuucauagguauagauggaaugcuuaguaugugcugacacacuguagccauggcaguuuagcaagaaauuacaguaagguucuagcacugaaauuacuugcauuuuaugucgauuucauaaacuaugguuucaguccauaucauugucagcagugcaggauuaucuaucuaucaucuaucuaucuaucuaucaucuaucuaucuaucuaucuaucuaucuauuuuaagaaagugcuuccuauguagccuugucuggucugaaagucacuuaacucacuuuguagauaagguugucccaaacuauuagagaucuguuugcucuuguuucccaagugcugggauuaaagguaugcacuaccaugccuggcuauuuccucgacuuuugaugaaccuaagcauuugucaauguaauugacugguuuuauaucuugaaauguuuuaguagcuauuauuaaacuaaggguuaagucucuaaguguauaaguauauaaguauaaacuaaguguacaagcauaagcuaaguauauaaguguagaaguauguaaguauaaaguguauaagcauaaaguaaguauguagugaucgauaggauggauguguauccucaccagcauugcaugugauuauuuuauguaauucccuucacuugauguaucauggguucacauacaauaauuaaauuaauaaauggaaccauuuguauuauauguucauagaauaaucaauauuguccugauuaauguuugucaaugugagacaaacgagacaccugggaagaggaaaucucacuggaggaauugccuccaucagacuagccuguagacaaguccauaggacauuuucuuaguuaaugauugaugucaggaaacccauuggaugacacuaucucuagcagguuguauaaagaagcaggcugagcaaggcauggagagcaagcagcaaagaaccucccuccauagccuaaguguuagcuucaguuccugccucuaaguucuccugaguaucuguucugacuucccucagcgauggucuugacuugaaaguuauaagauaaacccuuuccuuuaguugguuuugguuagcauugccauggcaacagaaacccaacuagaacagaaauguuguugucuuuugauauugaguagaaaggagaaaguugaauuaggucucauguaggcagaguugguacugaauucacugugaaggugaggaugaucuugaagccucaguccuuuagccuucaccuuucaagugcuaggauuacaggcaucacacccagcuaucuauaguaugugcucauacggguaauuccuuucagcauaguuguauuuuugauucauguuauuuugguucacucauguuuauucuuuagugauuuuccuauuccuucccuuccauccugugacuucauagcuauagggccauaaaaaguagcuucuuauuauggggaguuaguuaguuagggccucugcucugaagucggugcuccaggagaaacucauggaauuuguugguuaaauucugcauuucuuuacauucuuccaaauguguauuuuguggcugcauaagcagaaaugucuaugguccuauguuuauccuauguuuaugguccugcuguguuucugaagagcuacuuuuguccuuuuguccuuuugugcauugucacaggaaccagcacccaugacagaagaucugcuggaagagcagucugaggucuuagcaaaauuagggacaucugcugagggggcgcaccuccgcgcacgcaugcagagugccugucuccucuccgauauggagucuuuuaagguaggucacacuuccagagcucucugagucugucuucagcuauucugggaugaaacugugaacaacacuauaaagugacaugaagguugugucuuuuuuaaguguuuggauuuauuacuuguuacaaaaugcuucuuccagccuggaaaggacaugucagacucacuucuuagguuuguaaaagaaagucaaccugcuuuccaaaguugagaauugaauauucuguguguuauagaugguuuuuccuuuguguguccuuagccaauuuaaggcuuugggaacuguagggauuucuauguggauuauuuuaugcaacaaacauaugugugccacacacuaugaguaggugggggagauacaguauuuauuuagucgauugagcuugugagagauuucuagucuucaaaggaugcaaggucagagggaaguggcuaagcagguaugggaacuuucucagaaaagucaguauuuuggaaaaguagguauuugcugccuggaggaguuauugugggcuuggauaaaggcuuggguguacagcucugcacauuuaggggacagugguauuugaguguccuuaacccuaagauacuguaugaaccaguaucugaaacuuuaaaauuuuauguguguggguauuuuaccugcaugaauaucugugcaccauguggguacugggaauugaaccuguguccucuggaagagcaaguggugcucuuaacuccugagcaaacucuuuggcccccaauaucugacacuuuaaagucauaaccuaacacuaugaguagaaaauuccacacuauaagaguguuucauaugcaaaauuauuuaagucauuguauaaacucaccuucacaguauauaaguguaguaugcaugaaaaguaauugaauuuuagguuuagacucgagucaaagcuuaguuugugcauuugaaaauucagaaaucuaaaaaaauucaaagcccuccuacacccauguauuuuggaaaguauacucaacccgagugacaaacaacucgggguggggggggggggccuucgcugucugcacacggaugucugaaacuucuuccaggccugagcaugcaugcauguuuguuuguauguauguauuuaaugugaguacaucccugucuccagacacaccaaaagaggauccuauuacaaaugguugugagccacugugagguugcugggaauugaacucaggaccuguggagaaaaccaaaaagaagggggucagcagguguggacaacuuccacuacaguucuccugccaucagcugccuuccuagucagggugugcuccacagcaggcucugcagacgugcacacaagagacugcaaacggugcuugcagucuuuuaacauugugcacuaccaaaacugcugcucauuaaauucuuuuggacugagcugggcacuuacaaauuuauaauaacuuuuuaaaccagaaaauagagguacauguauaagguggcucuuaggaauacaacuaugaaagauagauacuuuuaaaaguaaguaguuauucuaaacauaugaguugccuuucccuuucuguaggaacaauuuacuauuagaacugcuuagagaucccagaguugggcauggauguaugccugagacacccauacaucauaggggcuuauucugggccauccguuauaauaaauccuuuaacaguaaaaagaggacaagucauggcugaggugucuguccugccugguauguuacuaagaacuuagggcaggggagggcucuaguacaaaauacucacuagucuguaacauaggagcugaauauugaaaacugucaagcuuacugccuuuacagaugagcuggugugcugccuggguaggauccagaccuuugcucauaaauccuaggcacugucacaaaccauggcacagccuuacaagaauggauccuauggggcuggagagauggcuuagcaguuaagagcacuggcuguucuucuagaggacccagguucaauucucagcacucaggaaaaacaaaaugaaacaacaacaaacggguucuacaguuagugaagaacuuccucugguucguuagggucucucuggguuaagaauggugacccuaagccccaugaguuuagccaucacauuugaaacagacuauucucaccaacagugcuacaugcccauccuuauguacucugcuaauaauagcucuccacaagcagugugaggcggcuuuaucgucuagguuugaaaguagaauuguuggaacguuuuuggcauaugucauuauucuagguaguugugcuauaacuggagcaugaaugcuugcuuuuagccaccugaacaauaauagugggauuucagcuccuuaauagcauagacguaguuuagauggagguguuuugugugaagccuuagaguuugguugcugacuagaacaugagugagggaggcuagcugauauuuauaccagugcugcuauugccuaaccaccaaguauagagucucggucauguguuacucuggcugugcugugcauuauuuaacucucuacacuucauuuauucacuacuuuguucaguacugaguaauuaauacuacaguuuguacaaagucaucacauaaaaauggugcuuuuuugguuuuugguuuuucuguaaaauugaggaacauuuuuggugcuuuaacaccuccuauuuuaaaugugacuuucaaacuuuaagugugaauauaacuuugcacuaggcuugucugaaaaugcuggguuuuguuuuguuguuuuuuuuguguguuaggcagcuaauccaggcugcuuucuggaagauuucgugaggugguacucaccaagggacuacauugaggaggaggugacugacgagaagggcaaugugguccugaagggggagcugagugcccguaugaagauccccagcaacauguggguagaagccugggagacugcuaagccugugccagcacgacgucagaggagacuguuugaugacacccgagaggcugaaaagguacgaggaagugaccaguaaaucuacuguguaaugacaaagaaauuacagauuguagaagaucgcuaacaaucuuuagaaguacugagaaaaucaaguaacaaaauaacacuuacacauuuauuauuaguggcucuaucuaaugcccuaaaaaagaaauccuagauugacaacacgcugcuguuaacugccauguugguguuguggcucacagaucauccucguucucugcaugcuccuccuuuguacguguaacauaaagacuuggaaagcuugagaaaguaguucuuacaguuccuacaugcuugccucugccauagcugcugcuuagcugggaaagaggcaagagugagcugaggucaggccucugugccccaggaaggccgcccugcaguauuucuggguccccugugucucccucagguccugcacuaccuggccaugcagaagccugcagaccuagccaggcaccuccugccuugugugauucaugcagcuguucucaagguaaaggaagaagguaaaugucucaguugucagucccuacgcccauugccaaagaaggguuuuugguuucauuuuuaacuauggcuuugaauuucuuucuuucuuuuuuuuuuuaauauaaauagaaagucuggaaaacauuccuucuguuaagaagauuauaaagcagaucauagcccauuccagcaaaguucugcauuuccccaauccugaggacaagaaacuggaaguaaguguauguuuugucacggucuugccaagaguuuuccccaccuggcaguaauuacuugaauuuuuuuuuuuuuuauguuuuacauuuucuuuuuacacucauuuauuggauagugauguugguaugcaugcaugucaugggauauuuagaggucagaggacagacucaggauguaagacuuggugacaaggaccugucccugcugagccaucucauuggcuucuaaaaaggcuaaaaggcuccucaucucugucucccuuucugcuccaggaaaucauccuucagauuacuacuguggaagcuauaauagcccgagcccggucccugaaggccaaauuuggaacugagaagugugagcacgaggaggaaaaggaaggucuggaaagguacuguugcuugugcccugcuguguccacaggagggccugcugcagacagaggguggcaugguggcuuuaaucccaguacuugcagggcuaaaacaagagguaacuuugaauagcccagaauacauaguagcuguucagguuagccaaggcaaacccagcaacaaaagaacaaaaugaaauauucugcccuguaaugauagacagcgaaguccugaguucuaggaucagagcugugccaaguucuuuccaggcaauucugucacucucacuuguccaugggugggcuuaggaggaguugccaaugaggcucccugaagaacaagcagcuugacccuuccugcuuccuccucuagguuugucagcugccugcuggagcagccugagguaucagucacuggggcaggaagaggacaugcuggccgcaucauccacaagcuguuugugaaugcucagcggguaugugcgaguccuccguggcugcucuuggcccaggaugguguucugagucccacaccggggugacagcacagaaaggaacaggcuccagggcuccugagacuuugagaugcccuggguuaagcaaagugaugaaagaguauuucagaccuaaacuguggaaauuagaaggcucacacacccauuguucuagaagcugguagggacuuuuagcaauggccagagcuaugguauggaaaagcgugcuuauagccucaguuucugacuagucuguaauagagauugucucaaaaggaaaaggacuucaggcugugaaaacuguguaaacgagccucagcacaggaggagauccacuuuggaaaauuaucuucauuauucuuuccauucaugaaaguaggaaguuaaguuauauugauuaagggguauugguuacauauguguauauauauauauauauauauauauauauaugcacacagacacacagacacguacacacacacucaagaaggcgcugguauuggggcacauuaauauuggcaauucaggugaaaguauuaugaugugcacuaaauacaguuuucacugaccuggaacaagaugacacuggaaacaagaacaccagcucagccuugagauagucauucucuaccaaguaagaguuuucuuggugcacaccuggcuuccuuaggguuacuacugcuguaauaaaacagcacaaccaaaagcaauuuggggaggaaaucucugaagcaagucagagcaagaacucaaacugggcaagagcugaugcagaggccauggaagggugcugcuuacuggcuugcucagcaacccccucaccccaucccaucaaucaguaaauaagaaaaugcccugugggcuggaucuuuuguaagcauuuucucaguugagacucccuccucucagaugacuauaacuugugucagguugacauacaacuaaccagaacauagacuaacaguugcaucgucccuagagagaaacucaaaauugcagucacacacagugacugaaugcuaaaagcuaaacacagaauuaccuuauuggcuuauacgcuaaugacggguaggaggcagcacuguucuccuuugucguccucugaucuguucucacaagcucuaccucuccgccaucuaacccagaggcugaccagcaguguccuugucacuccugcugcugcgucuccucaguagggaagacucaacucuuuacuaacuuuugagaaaaucaugaauuaaguuuuaaaaucagaagugucuaggucuuuaguguuaaggguguugcuuguuuggggugaucagaauuacuccccuaaacuggaacaguccccucgguccuucccugacuacaaagcugcuagaaaaacaaagauuagucauaguuucuucaaucuugagcacuuaagucuuacacaccaacggauguuucaucacucgggcugcugugauccucaugguuucuacuuccgguguuuaucauaucuaagaggcggacgcugccucucagggguccuccucaagacccucagguugugaguguaucucacacagcacagcuucucagucuaccucaguagucagcgcuuucagaacccaugugaugaccagcacaugguuguguuguguuuuaacucagcucucacuaucuggcucagugaacuguugacuuuauguaacuuuucauggugagcagguacucugugccaguuuuacuaacaaaggaagauuuaauuauauuuaaggcguagcugaauuuuuauagcacacauuagcuucauauuagaacuuuucuucaaaauuauaaacuguaggcccagugacacggcacagggguaaacccuugcugccaagucuuuugucaguuuauucuccagaagcuacauaccaaauggugagaacccacuccugaaagcuguccucugaccuccaugugugugcuguggcauaugcacacaugagugccccacucccacaagcccaaaguguaaaauauuagaauucugaacuguaauaaaguugacugagaccauauagguuuggguauguacuuauuuaaauagaauucagcaaaaauaacugcuuuguuccggucuuacuaaguugaauuauuucuacacaucuguccuuaaauuuaugguuugucaagcaucuuuugaaacagcaucuuguuugaaagagugaggguuuucugucauuuccucauuaaaugacccugcacuucaccuguugagccgucagaugcaugagccugagccucugcuggccauguguggucugugaugugguucugugcaccuucagugcccuuggauggagucaugcccacacagugcgugccauuccugaugugcccccgagucugccccggcccuuagcucccucggucccuuucaucacuguuucuuuucucaccuuucucaagcugacugaaucuucugaugagguaacaacauggccuuaugucccucauaguucuuuguccuuccccaucccucuaacuucauaaggucaucuuaacuaaccaucucuaaccggcuggauguggcauccccucuggcuguacagcuuaacuugacuucauguuuccauugcccaaagaauuuucccaagcaguggaaucaugaaagaaggacaguauugcguucugaaggcucccauuggcugcacuggugcaguuugaauguacaagcaaugccuucagcuuugagcacuuuuccucuguggcuauggccaugggcaucuguuagcuugcugucacauuagaugcccaguagucaaagccaguguuccugguucuaauuuggcaagagaaucuaaaaaagaacuagcugagagagcagagauaaaauugccuuucucgacuugaaaguaagucuguccuguuaacgucuaacucagaugugagucacugccugcagaaaugcaggcaccagugcagcucugccacugcugaggagccccaaugcccuugcuuuucagagcagagugcuggucacccaccucugccugccucacuagugcccaagcucuuuccagcuuucugcuuuucuguuuuuguucuuuugagcaaucauaacacacaguggauauaaugcauuuccaagugacacaggucauuguguguuucuuguguuuauccaucugcccuuggguaauguagcuuucgacuggcucuugaauuugguguucuguucuguucaaggcugcggcaguggcucugccagaggaggagcuuaagaaaucaggcugcccagaggagagaagacagaccuuggugucagacuucccaccaccugcaggccgggagcugauccugagggccacugugccgcggccugcucccuacuccaaggcccugccacagcguauguacagcguacucaccaaggaggacuucagacucgcgggugccuuuuccucagacaccuccuuuuucuagggggaggaggaggagcggcagcuccugccgugggcaccugagacgcccuuguggaaccagcagcaggagucacaccagcauccagaagcauguccaguaccaagcuugagccagauggauagauuugaggugucagagacuuccaccuggggggagguggccuguguuaggggaaccucacaucagcaggccucuuaccuugggggacagaguuuguucauucuccugugacagucaucuguguagacacuuaguagcuauccuuacuaguauuccauaugcaagguagaguauccguuaacucacauucuggacacuugcugguagagccuuuagucccaggaucuguguuuuuaaacugccacguagcauucuguuuauucagucaccagauggauggucagcuuuauuaugcuguuucaugagcauuugaauauucuaggagaaagacuagaauuucaauuuuuuccaugccacuaaccaaaugcauuucuucugauaaaucuguacaugaaauguagcugcagauuagagcucucucugugugucugucugugugucugucugucugguaggaucucucgguccucuugguugcaccccugcuuugcacuuuacuucucugcguugcugguuagggaugguauuuaaugacaucauacgagcacauguugaacacacauccugggaacauagaucaccaugcaguuagugagcuguggugugugugccgaggcugugagugggcugaagcacccggugcaggggugauggcucuguccucugcagcucagaaugcaucaguacgcugcugcgggaccucuccuuggugauuguaaauuauuuugggaccuaaaauucccacuugaauccaaaguaaaaaaugguuauggugaaguguaaauuccgccugugugauuuuuaaaaauuaauagaccuacacaagcccuguguuauuuuuguaaaagaaaaaaaagaguauauauauauauauuuaucuguauggugugcacagacacgugucuguuuggguauaugagggccaggggccaaccccuagacuucccagcgagcacucuuuccucugaaaugcuggacuuugcuucuuagaaacccauagauacgggcugaggcaugaggggccagaacaaauacaagacaggacaguguuugcuuuccuggguauugaugacagaacucuacagugugggguuggucuaaaauggcauuguuuaucuaauaaaacggacugcuguuuaugugugga

SEQ ID NO: 346 - RNA, 506 nt, Mus musculus
uauguuuuacauuuucuuuuuacacucauuuauuggauagugauguugguaugcaugcaugucaugggauauuuagaggucagaggacagacucaggauguaagacuuggugacaaggaccugucccugcugagccaucucauuggcuucuaaaaaggcuaaaaggcuccucaucucugucucccuuucugcuccaggaaaucauccuucagauuacuacuguggaagcuauaauagcccgagcccggucccugaaggccaaauuuggaacugagaagugugagcacgaggaggaaaaggaaggucuggaaagguacuguugcuugugcccugcuguguccacaggagggccugcugcagacagaggguggcaugguggcuuuaaucccaguacuugcagggcuaaaacaagagguaacuuugaauagcccagaauacauaguagcuguucagguuagccaaggcaaacccagcaacaaaagaacaaaaugaaauauucugcccug

SEQ ID NO: 347 - RNA, 540 nt, Mus musculus
ugacaugggcuguuuuuuuuuuuuuuuuuuuuuuuuuggaagucaguggacucuuuauugcuucgggcguguggggcucaggagcucuugguggggcggguccguuuccucuucaccaccacaggcuucuggcuucgaaggauggcacuggcccugcggauggccgccauacgcagaucagggcgguacuuguucuuucggaucaugugucugaugcugcugaggguagcccgagcauucuuguugauggugguccucacauaagaaguggcagguuuucgcugaccggaucugcguuucauaacuaccacgaccccuuugccaucggcggccggcuccacuccgacggucuugcggugaauuagcccguuguagcggaaggaguuucgggcuuucagauuauuuggcuccgugcuguacgucugcuuauuccucuugaucaagaaacuggagcaguuccggacgaccauccacugcagaugcgcggacauggcggcggcuccucucccuauggcggccggagacggaaagagagaccaa
